United States Patent 8,781,750 (CELL-TYPE-SPECIFIC PATTERNS OF GENE EXPRESSION) - sequence listing, part 20

SEQ ID NO: 36572 - DNA, 369364 bp, Homo sapiens
tccttttattgtggatgaacaccacgtacatgccgtaaatgctccctaggctggctgcggctacaaggcagacccgggagctgagaatagaggaatacctgcccaagcaactcattctgcacagcagccgacaagacagcgattttcctgtgctggaatgtgcccatccaaaggtatcacttccttttcattgagtttctatatttcttaagaattacggaaagcagagatgctgatcctggaggaagatccctgctttctagtaatgctttgttcctgttctcaggctgagtgccagctttaaaatggttaacctctgggggagaagctactaagcagaataaaggaacactttacgttgcttaagctgactgtgcacagagcttttattaggatggattctttgttactcttgctattgttgcgaaggtaagctggttacaaatgcagctttcaaccatcacattctgctacctttataactaaggagacctgggggaagacctggggtgggggtggagggtctagtatctcaaaggttgctgcaatttatcagcctcagagagaaaaaaggccaaattgctgatcaaaggtagagaaagagcatttggttggtatgaggattcttctaccttaggacacaagttttataaaaaatgaacactgcatattttcactgtgcttaataattaagatgccttaattatcatttataactgacagctggtgtgctcgtccgaaagtcatcagcgtgttaggcgctcttgtttcagttgccaaggtaattggaaggataatttaatatgttagagtaacaaaagacccatgagaaacatattgcattaggtgaggcatgagattgctttgtggagcgtttatttctgagagtgagttccttcttttgtctcttggccccatcaattatctgttagaaggaatagctataacagggactttcatcatgtaccatgcagttgaactaacacagttgtttcttctatacagtaggcaagattcagtttctgtctaagacattaaattgttagtcatatggaaatatttcccgggaagttgttcattatcctctgtgggacaagtgacatcacacatcactgggttatgaatggtggcttgagtgaaggagagaaagtgttttctcggggagcagaaatgaatgcaaagagtgctctgcttcatttcctagtgatctctaagaaacatggcccattgaaatgttaaatgtcacagcaaattatcagggctaacattttatggtatatttgtggaagctcttataagtcatgcagatgctttgtgtagttatttttctaaaagaagggacatattaaggcattgattatagtttctaaattgctagcccggtggtactgtttttttgtttctttgtttgtttttgagatggagttttactcatgttggccaggctggaatgcaatggcaaggtctctgctcactgccacttatctggttcaagcaattctcctgcctcagcctcctgagtagctgggattacaggcacctgcctccacatcctgctaatttttgtacttttagtagagttggggttttgccatgttgaccagtcttgtctcgaactcctgacctcgtgatccgcctgcctcagcctcccaaagtgctgggattacaggtgtgagccactgcacccagcctagcattatctatctttaatagccaacatttgaaaataatgagtgccaaacaataagagacgcttcgtttattcattcagtattcatttatttactaattatggtctggtgagtgaaaatacacttcgcctctgtgacaacatcaattatgctagcttgatacactttgtgattttgtttctcaaaatatttacaatgtacataattttatttataaaatataagcaagtaaaatggaaatgtacatctaatatttaaaaagcatttatgtgtaatataattcactatcaaaataatacaaaattaaaattcaaagttttaagatttaaaaatcaactgtaagataaaaataagattttttaaatgtatgtgagattattgtcttacttatttctatgtttaaaaggcattgcttttgagaaggtgtattagcccattaatcagatggtcacagggagtccattagcaaccttgatgaatggcaacgggactatagagggggtattattttgcagaagagaatacagaaggagggtatcttggatgataagaagtgtccttatacctgagatatataaaatctatttctagtaaagaaagaataaaaagaacaggcagattataatctttaaaaataaagttagcatcaataaaacattcaggacagcaagagatgagttaacttaaggaatggattaaagcaaaagaaaggacgtctccctccgggatgtcctccaggcatgagataatggaccaaggttggccttggacacacacaggtgtgatggaaagcccagctctgcgcctactccctgcccacaccggggagattggccctacttgggcagcttatgagagttgcaagaaatccacataattataagcagttcatgtaaatataagaagggtgtaattataaaggtgtgataaaatcgattcccacctcactggggatgatggagttgacatgattactcctgagaagaggggcctggctacggagccagcaacagaaaggcccttattagcgtcttcatctctgtcctcaccctcgccagtctctttcatctttcagctgacatctagacttctaccttttgagagtattgccttggatttaatgctctgaagcctatgcaaatgcaaatagccttgggaagtacactttaacacagggtcccaccttggtgtcctggtgggactgagcacggaggctgttggggaatgctgagtagaagagagatttttccaaaggaagggtggaaataccagaccaaaatgatgccagtgagagaggaagggctgactggagagcatggagtctgggaaacatattattatgattattattgtttgtgttttttgagacagagtctcattctgtcacccaggctggagtgcggtggcgcaatctcggctcactgcaaactccacctcccgggttcaagcaattctcctgcatcagcctccctagtagctgggattcaggcgtgcgcccctgcacctggctgatttttgtatttttagtagagacggggtttcactatgttggccaggctggtcttgaactcctgacctcaggtgatccacccgcctcagcctcctgcagtgctgggattacaggcgtgagccaccgcgcccggcctgggaaacatttgaagagaccaacataacttaataaatgcccacagagagacctacaagtgggctgtgggccaaaatgaagttcgaagctcaggctgtaaccttaatgggaatgtgacacacacacattttctttttctcggccacctgtgaggatgtttgctacgagtggtgactcatgctgtttgtaggaagaatttgtttattggtttgaaggggaataaactagaggaaaaataaatcaaatctaagggacagaacaacattttttattttttgccaggaagaggcaaaatgtgaggagataatgtgaggaatggctttcttcaaaattaacgctgtcggcatacatgatggactttgatctcaacaaagaacgatacagcctctgagcaggaataattttcagatttgtgcaaccctccagactctccctattcaagggaactgcactgcatgccttgattttctcaaagacgaaatgaatcccatatactcccacctttagggcttagtagtgattaaatctagagaggattccatgctactcaaggaccaaatactcagggtattgcccaggcatgggcaatgggagggcccggtgttctcaggtgacctctacctactggcccaggcctcagtaccacctttaatcccactgaaatgcaaacacctggaggtgaagggccactataaaaagctattttgccaggcttggtggctcacacctgtaatcctagcactttgggaggccgaggctggtggatttcttgaggtcaggagttcgagaccagcctggccaacatggtgaaaccctgtctctactaaaaatacaacaaaaattagccagaagtggtggcacacgcctgtgatcccagctacttgggaggctgaggcaggaggatggcttcaacctgggaggtgaaggttgcagtgagccgagatcttgccactgcactccagcctggcgacagagtgagactctatcaaaaaaaaaaaaaagaagctattttaactttcttctaccacttttgatattctgccatctttttacaattttggggttgtttgtttcctttaccagattggaattcttccaaaaaaagaatagagttgggcttctaatttatgattgcctggctagcaaaatgcctgtcacatagaaaatattgcataagtatttgttcaactcactaacccgatttatttcccaagaagctcactgatgcatgcacactgagctaccaagctgcctaagttacccgatgggaaaggtggccaaattaatagtctcaatttgacttcacaatacaatctgcaaattaggaaaatttacctttgttcagcatctctcagcaaacttaggtcagtggatcctggcaccttatggtactgctgataccagggaactgtgtttatgcccaagcaagtctgacagatccacactgagaaaataacaggttactgtcatctattagtgcaggagcctaatcctgaatgtgcaatgtcagggagggctgttgagaaaggtacaaaggacaccagaagtatctgccacctactgggaagtggggattggcttctaagagggatgaagggcagagatgacagggcagcagtacccgggcagtgagctgggctggaggaaggccctggattaggaggcagggtgatggatcccacgctagtcatcagagaacacagccatttgtcagacatgggaggcatggtcctgtgtcgccctccacaatttcttaaactcttctcatgtctgttcaaaatgcttgtatggactgagaaaggaagccaagtgtatgttttccctgatgtgcctgaagtggtagcgtgatggtacatacctgttaacagctgggaccgtgtgattctaaatcctgttaaggcaggcaatgaaaaacaatgaagcgctggaagggtaccaagaacatttgtcttgttttgttgagtatgatgtcattgagggatcacttgcagtagcatctggtttctgacctgtgaatcaatccatcttacattccatccatccttccttgctttaaactctatcggtatttttcctaccagcagcacaggggaaatacttataggggttcattcagtgaacgttcagcatcctctggaaccatctgggaaccctattcccttcctattctgctcttagagacattcaagctccttccctcaaccccaaaagagcagatatccgccgtgcaggccatagtgcgatttccaaagtgtctctctaaggaatattcagcctgttcttagaggaaaaaagggcaacattattaaaacagagactctcaacaagtccaaatgtgtattaaaaattaaaatattgttcacagcctggtcttgtgttaaggctccaaatatgcattttaaaaaatcattgctgaagtcctggaaggggcattcatcactcctgagccacaccgtcaggcacacctgaattctagggaaatatttgaataaagaatctctatgaggtaacttctggaaattgcctccaaaccctcaacctgcacagaatatagaggttctctaacccactctggtctctttttccattaactgtggccaaaccatgatcttctccctagactacagcctctctgagattttatacttcatctgcctctaattccattatgttcttcaggtctgggattacttcctaattcactatcaaaaattgattcagtgttgagctgtagcccaatgttactttacaaattcattctcaaagtattctttttttttttttgagacagtcttgctcgttgcccagggtggagtgcaatggcacaatctcggctcgctgcaacctccgcctcctgggttcaaacgattctcctgcctcagcctttctagtaactgggattacaggtgcctgtcaccatgcccagctaatttttgtatttttagtagagatggggtttcaccatggtggccaggctggtttcgaactcctgacctcatgatccgcccgccttggcctcccaaagtgctgggattatggccgtgagccactgtgtctggcctcaaaatattcttgataggatcagttaccagttgtagcaaaaactctttgttcttctcttcccctcttcttggcatccagttattatggtgagctgctggacccttgattacttgagtttcgcatgatgaaaagtcagtgagcattgtgaggatgctattgttgtcagttatagttcccaaataggtctcagattcagcattttctttgaatttcacactgtgtttgtttagactcctgcatctctcaccagacaactgctttacgttttaatgggcttttctgcttgtaagactcttccttctttcatctattatccacactgctgcacagttatgattgttaaaattcaattttttaacattattccttcccttaaaacatgtcagagggccactcctcactctgccccccgcccccttagtctaatctcttccaaagtgtggttgcaatcacgtggactttagttaaaaccccgactgcaccattttggtagttgatgacttgatttttatgtgaatgaagtgggatgatatctatctatgttgcattttacttgaggtttaaataggataatgaatgtcaggtatctaagatgccatctgtttcggagtagacactgacaaagttggaaacaattatttctgctcgggtccagtccagattcaatactgggtgtaccaccaaagagactttcattctctgacacctgcctaccatagcagcctcctgctcctcccagcccactgcttcctcctgcaattttattctctagccgtacttggagttctcaaacatcacatgtggtttagtctgcattcctcaatgtttgccattatatgtgctgtttcctcagtatggaatacagcatctctccccaacccccctcctgtttcctggaaatttcttgtgcatcattgaacacatagataaagagcacctgtttcttctcggtgataattctttataccttttaataactcttcaaacatttgataatcctttctatgtgccaggagctcttttaggtgttttaaacattttatctaatttaatattgatcacctttcaccttacgagaaaaagaaatgtaatgtttttaattaaaatgaagtacaaaagaaaaaaataacaatttaatattttgaaattcatagcctggcgtggtggctcacacttgtaatcccagcactttgggaggccgaggcgggtggatcacctgagttcaggagttcaagaccagtctggccaacatgatgaaaccctgtctctactaaaaatacaaaaattagccaggagtggtggcggacacctgtaatcccagctacttgggaggctgaggcaggagaattgcttgaacccaggaggcagaggttgcagtaagccaagactgtgccactgcactccagcctgggcaatggagcaagactctatctcaaaaaaaaaaaaaaaaaaaaaaaaattgaaattcattactctcctaatcacaatgtactgtcttccccattacatttatgaactactggagtgtggaaaccagtgattatcatagcttgaatggatgaatgaacagaaagatagatggatagaagaaaattgggagggctaatgtatattaggggaggtgaaactgtttcctgagatggccaatattttaggaagggaattataacaaagcccagaaatgcctgaaaagatgctatgtaaacaaataaataaaaacaaggtaaaccaagcttaaaccaggatggtctgctgcagattggagagattcaggtaagctagatggcctgataggaaactaagaacagagagaagctgcatcagaggattcctgaaggaagagtctaggatgcactaagaatgggcttcacttcctacagaaacgagccagagtagcctagatggaaaacaacaacaacaacaaaaatacattaaaaaaagaaccggcctctttaagaattcataatatatttgattagcacttccttagtgccgggttccatgctaagcacattacatgaattgactcatttgaacttcctttaaaaaatctcaagagggcggggcgtagtggctcacgcctgtaatcccagcactttgagaggctgaggcaggcagatcacctgaggtcaggagttcgagaccagcctggccaacctggtgaaacctcgtctctgctaaaaatacaaaaattacctgggtgtggtgacatgcacctgtaattccagctacttggaaggctgagacaggagaatcacttgagcccaggaggcggaggttgcagtaagctagaccacaccattgcactccagcctgggcaacaagagcgaaactccatctcaaaaagaaaaaaaaaacccaagaaaaaagagattttgtaatccctattgtgtaggtgagatgaccgaactgtagccagactagtgtaagaccacagagctggcaattggaaggttgggttggaacccaggtttgcctcacttttgccctttaagactctgcagttctgtccctctaaagatactgtaggagatggtttgggctagaaaaaaaagtgaattaacctaggaagaaaagacctcacatcacctccaaagtttgaaactagaggaaaatcaagaaatgcaaagcccaggaaattaaaatatgagaagaaacaggcttccgttccctgctaaactcattgaggattgtgagatttccctgactatagtacagatcccataagagtgccattactgtggcagcgagattgctgtggacactgaagaccaaccacatgcacaggttgcacttttcctggataaggggtagggagaggatggagaaggaattcaagaaaactgaaagggggaaagctataaatgccagggccatgaactgcggagacacaaatcctcctttttccttgatccgattttaccctggatatgtaattgttggggaatggagtagaaattgatgggaggaggtgagaacactaagtcatgggccaggtacccatctgttggggtacaccccagggagaggtttggttgtatgaccctggcacacatagtcagggatgaaagatgatttctggagtcagggagcaatctgacaggtcatcattttgcattttatttaattaagtatttttatctgttcaatgaaataaaaagccaaccgaaggttttattgtcttatttggcactttaattgaaagatatgtgctgtaaaatatgtcttatttacaaaattaggttcagatgtacattaagtgttgaatttattccattaatatattttgaaaagaatgagttcatcatttagaggagaagcagggtggatgaggagatggaaggatgtttgtttgtttactttgctttgtatttcctttgctgatgttttgattagaacactacaaagaaaagatatttggagatgtaaatgggcaagaaatgtcatatattgatttttctggaattcatatctatgtctaactctcatctcaagttttaagcttcatccattttcaggttcttacagatgctaaacttacaaaacatatttgtaggcttgttgctctttccaacccatccctgtttcttctattctcaccattgccttcgctcacactcacatttttttgttccaattatggcaataaccttgtgataggtttctaggcctgcctcctccaacttctacatacttgccagagttgactttcgaaaacacacatctactcatgttctctttttccttttcttcttgtttttccttccccacccacccccccaacatcctatgggtgctgtacggatgtggtaacaagctttgagggagacacatgtcacacacatgcatagaaacccaatcatcacacctatcaaccccaaaaggatcacttcctcatgttagtaactttcttaaactttttaaagatagccctttattctcagaagaaggtccagctttgctcatggattacaaagtcttgaccatctgtcaacatgcgagctcccaacagcctctgccccattgccatgaagctgccaaacacatggttcttttccaccacccttgcctttctgactgctgctgcttcttcctggaacatcattccctacccctccatcccatcagtcacttcttactccggcccgaagccctccatttccgggcacatggcacatctcacagcaagcccctgctcacacacttagccagcatggatcagatatctgtcctctctgctcattcagcacctgtttgtgtttctaacatgtcaaccatttttaatttatgtttgcctgattctcgagaaatgtttgttgagtgaataatgacaaaaacaagaatttctaaaatgaaaagggcaaagaacatatatttcctatagtaatataatcagtggaacactagaagaggatctgtagatgaaatcaaattttcttcctaaaggtttaccaaaattgtgcaatgatcgggaaataacttgggatttgaatcatcatcatttttcattcttgttatgaaatgttgcctattaaatgtgcctacccttgacctaacctcagtcaaaaatttaaagacatagctaaaaaatttgctaagtcatatgttataccttttatttgttgataatgctgtccaaatatttggtttggtttcttcatttattcaacattattctctcaggagagagctgatggggttcataaacttctcaaaatggtcaacttgtcattgcaatggttactgtatcaacaagttgacagaatcaaataggtggactaaacttccaagctatcacaatgcatttagcttagtaactgctgatggtctatattctacttaatgttcagggcccatctccaaatcaacaccaacttgagtaaaacgtggcgggcattggcatatatgagcacgttgcatagtgtgattcataagctccaaaagttcctagagcactcatgattttatgtttggagcaccctttaaaggcttgatattagtgttctttttcctataaattgttggctgctgcattggagaaattcagtgacagagtggttttgtaacagggtttgaccccaaatatttcggctgttggtagcgatgctaatcttgcacttacctgtgccatgggattgcagagaaaagctcattgttttatgattgtgggacacaccgtaatatggagtgtcctacaaatgactttcacagaatcatatttctttatacttgtcttcattttccaggatgtaaagtcacttgaggcgcttgtctcatgagtatctgcaatgaagcttcatggatatatgtatgttcctgaactcttttagttatgccagcattttcctgttaaatatttataatgacttagtgccacatttcagcttctctgtagtttgaaaagtgtcaatgcatcaaaagggctgtgtgatttctgcactatgcatttcagatccaaattttagatgtgttgtgtctttatagtctctagattgactatattgtgtaaattcatatctggtctcatttgttagaactgacatgttacacagttctgatctctggaaatgaactgacattgagactcaatctatgtaagtatttaagtgatgtggctgacatcacattgatgtcaatgaaagtgtcaatttggaaactaggcccaggctagtggccacacagtggctttaagtgggtgcttctcatctctatttggggccccgaaagcatttcttgccagtcacttacttagaatttgcagaagatttaagaaaaagtagttggctatataagcgtttggctttccgtatgagggctttcctgtgtgaagcatatatgatcagttatattacaggagatttaataaaatagtttcctaataaggagtgcagaatgacaaatgtaagtaggacatagctttgctaagtaactttctgaagcactaccattagcttcgtttcaacatttttaccttcaacatttaaacaaacagaatgattgaaagaatagtacatcaaatacccactagctggatttaattattaacatgttgctgtactgctaggtcctcacgggcatgtgttttgaagaagcatttgaaaataaattgtaggcatcatgacgtacttcactcctagaaacaggagaccccaagagtaagggcattgtattacatggcctcaattttataatacaactaagaaaattaatagttttctaatataacctaacgtccatttcacttttagtctttttcaattgttctttttaaattattttattcttttgttcttcaaccaggttatactggaggctcaggaatttcatctctattaatctaatatattccccctgctatttttccctgtgacattgactttgtgaagagaacaggccaattgtcttgtaaaacgtcccacagtgaggatttgtgtgattgctttattgtaatgatgttccctttggttcctattaactagaaattacttcttacagcttgagtaggtaccatttgtatgtttttggcaagaatatgtcgtagatgatgtttctatgccatcacatctggaggcacacaatttcatgacatcagaattcagtgatgctgcagttgattttttggttaaggtggtgactgccagatctttccaaaaagaaaagttttcccttttacaatcattaggtaatctgaggggtggtaatttgttactatgtggaatatcctatttgtccataactactaggttcgtaggttgaaatggccttaagccacccaagggatctttcctgaatatctcttttctgaatgtgtttgaacgtgatctatgaggaaattatttctcctagaagcaccattaatccaaatctgtttcatcaggaaaaatgtcataagccttctaaaaattattgttgcattaaaccaccttcattaaagaaaatatagatgatatcaaacagattatctgtggaatttattttctcatatcctaattattaaatatacaactgtcagttcatcatctgggtgtaaaccacatttttttcagtcacactctcagaaacaagtagaacaagttggagagaaagctgtcacttgtttttccagtaattctatcagattatgaaccagtctgcaaagtaatggaagatctaatataagacatacatgatctctttccctatctacattgtaaactccttaaaggcaagaaccatagttctgattttggggtggagataaaataaggggcaaaggtggaaattgttctaataagagcatggagacacattgtactgaggggcaagagtaaagaaaatatggggccatgcgcggtggctcatgcctataatcccagcactttgggaggccgaggcgggtggatcacgaggtcaggagttcaagaccagcctgaccaacatggtgaaaccccagctctactaaaaatacaaaagtcagctgggcatggtggtgggcacctgtaatcccagctactcaggaggctgaggcaggagaatcactcgaacccgggaggcagaggttgcagtgagccaagatcacaccactgcactccagactgagtgacaaagtgaggttccaactcaaaaaaaaaaagaaaatataaacctagggaaatgtagtcatctaaatgaaggtcctgttcgatttgaggactgcaaaaagtgctttcctaagtgggctatggggggcctgttgccctaagagcttctacaaattctttcttcccagaagcatttcagagttacatgaaaattccaaacagaaggaagaaaaactggaattttcatcagtatcttgcttagtttctccaagtcttagttttttgttttttgttttaaatggaatctggctctgtcaccccagctggagtgcagtggcatgatcttggctcactgcaacctctgcctcctgggttcaagtgattctcctgcctcagactcccgagtagctggaattacaggcgtgcacaaccacacctggcaaatttttgtatttttagtagagatggggtttcaccacattggccaggctggtctcgatctcctcacctcagacaaactgcccaccttggcctcccaaagtactgagattacaggtgtgagccaccgtgcccagccatccaagtcttacttttcttacatgtaaaataaataatttgaaagctgtaatctctaacgttctttccaccaaaatgactctgtggatctatgggtctgaaatgtgttatgcaagattggaggcggggctggagaaatgggtgcaatcatactcgtgttgagtacaggagtgaggaggaaaaactggacctgagagagtgtgggctgaatcagagggaaagcaagaaactggaatgtctccaggatagaaagcaggtcatttcccgggaagtcagctttgtgtgagattataagaagcaatgctggaaaggtatgcagaactcttcattcgttcaagatttttgagggcctcctatatgtctagacagagaggatccagagataaacaagtatattatttccatgttctcatggagatagtatattagtgggaaaagacagataatataggaaaaaaatgtaacctcatggccctctaatgcaatggttaaaggtaaaggctttagagccagaccatctacattcaaattctagctctccaacttgatctggagcaagacagttaaccttttcctgccttaatgtcccatctgtgtaataataggacccattttatatggttggaacatgaggattaaagaggaaataaatgtaaaaactttagaatggtgtccggcacgtggtaagtctgaaatacatgttaattattattatgatgatgcagataagtgctgtgataataacgaagtagacgaatggcatggtttttcaaccttaatcctactgacatttgtgggaccctgataattcttttatgtgggcagctgtccagtgcattgtagcatccctagcctctactcactagatgccagtagcaactcccagtaacgaccaccaaaaatgtctctatccattgctaaatgcccctagggaggcaaaagtctctcctgactgaaaaccactgggttagagaataaagggtgcaatatttttagatagggcaatataggactcctcaaagaaaaacaggaacagactcctgaatgatgttttgcacacattttgcagcgatgagaaaacctgggggagactgctctgtagaggcaacagcaaagataaaagtacctaggctggaacaagttggtgtagccagcttgggtggagaagagtaagattatgtcaaagaagtaggtggggtcagagtctgaagggcagtgaagaccctggcaatcagtttggattttattctttatatgctgagaagctattagaggatattaagccagagaatgacaaagcaggaaagctggtgtggagcggaatgcaagtccagtgagagatgaggggggcttggacaggagcagtcagaggtcatggctggggaggtggtgagctgcaacaggattgcaatgtatgatggttgaagaatatgtagaatggttcttcatgtatggggaataagggtaaaaagggaaaagcacatttatgaggaaggagtttaataaatcagtaattctgtctaggccgtgtgccatttgggatcctgcaagtggtaactgggctgttgaccatactagtttggagatcaagtgaaagattggtcctggagatatatgtttgggagctatcagtgtttagacagtacttaagccatggaaccttctgagatcaccaaaggagagaggagggtgaggtgggaaggccatggaccagttctgaagcatgcctacattctctgaagagacagagaaaacagaaatggccactgatgtaggaggtcagcccagaggctgtgtggcgtcttagaagaaaagcaaagaaacgcttcaagagggtgcggctcatctgggtcaaatgctaccaagaggtcaagtaagaagagaactctggacagacatctggatttgacaaggtggagagtgttggtgactatgatgagaatggtttcactgggggcatggggatgaagggctttctggagttgattctggagacagtggatgggcgttaagaaagttgagacaggccaggcgtggtagctcatgcctgtaatcccagcactttgggaggccgaggcgggcagatcacgtgaggttgggagttcgagaccagcctgaccaactttaggagaaaccctgtctactaaaaatacaaaattagccaggcgtggtggcacgtgcctgtaatcccagctactagggaggctgaggcaggagaatcgcttgaacctgggaggcagaggttgcggtgagccgaggtcgcgccatcgcactccagcctgggcaacaagagtgcaactccatctcaaaaaaaaaagaaagttgagacaggaagtgcagatacctctttggagaactgttcctgggaaggagaagggagaaatagagcagcagtcagagagggacgtgggccaaagaacacactgttttttggttaaggtggaagtattacagcatatttgaatgctgatggaactattccagtgaagagaaggaaactgatgatccagtgggatattaggaacaattgcacggaagaatttgttgaggaatggaagaggtaaaatacactgttgacaatgggtcagtttgtctgatgagagaaggatggacagttcaataaaatgagagaggagagaaatttaggtaaaatggtgcattcagggtgaaaaataaagtaatttttgtcagaatacttctattttcttaaagtatatagcaagaccatcaacatatggccagggcgcagaggttaaagggctgaacaaaagataaaaaggcactgagtattcctttaggagagagaacaggagtatttatcgggaaatctgttagaatcaccaggcagttttaaatactgattgagccgcgtagtgatgtctttaaaagtgagacccatcagcacatttgcatcctttttctttgttgctttcgtgctttgaagcggacataatgtagttagagggttgaatgtaaacagactggtgtattgccaggcatgtgtacagggggagaatagaggagcaggggatgaaggcagaatatgaagggacatttgcactggtgggttctggcctccaggctgctgggggggaaagcagttgtggggagtggtgctgacaggcgggaaactcatagggttggtgcactggggttctcggggaggtggaacgtaaccagagtgtagatactaggataagttgcctggaatgatcagagataattatcagagtggatgctttccactgggatctcagaaatggtcaagtcttgggtgatgaatggtgagattacagagagctttgacacgcaggataagaagtttgagttctgatcttcctgagcaagttgttcagtctggagtttgtggacaagttttagagcatggaactagaataaaagggtgtgtgtgtgtgtgtgtgtgtgtgtgtgtgtgtgtgtgtgtatgtgtctacatttttctgggtgagaggatcctaggttcccctagattatcaaaagaatatctgaactacaaaatgttaagaataatttcttggtcaggcgtggtggctcacgcctgtaatctcagcactttgggaggccgaggcgggtggatgacctgaggtccgaagttcgagactagcctggccaacctggtgaagcctcatcgctacaaaaaatacaaaaattagctggacatggtggcaggtgcctgtaatcccagctactcacaggagaatcacttgaaccgggaggtgggggttgcagtgggccgagatcatgccactgcactccagcctgggtgacagagcaagaccccatctcaaaaaaaaaaaaaaaaaaagaatgatttctctaaaacctaggaggcaggcagccactgacagtctctgaacagcagtagtggtgtgagctgctatttccaaagatgacactgagtttgaaggggcagagaggagaagatattccaactctgaagagatgtgtaattctccacttacatagcacagaaaggagtagatgctggagccgactccacagcacagcacctgtggggctggatgccggtccctgctgaggcagcatccctcttcacatcattctgtgttcattgcttcctcattcctcatttccccctcccctccacttccagctaaaataaagtggttttaatgaggcatcacttggtgagctttcgaatcaggagcctgtaggaggactgaaccaaggatgtagagccctgctaaatgcatctttcatcactttggggcaggaggacagacctagaggtactttttgacgaaggatttagtgcatttgttcctgggctcaggaaatatggagttctccacttctgaagttaagcactttagtgcccatcaaccttaagattgaggcattatggtgtcaataaagagcaaaaatcttggattcagatacatggctaagcagctacttcatttcaccctaacaatagctctgttaagaaaaattgaacctatctcactgtaagagtaaataaacagaagtttcaagaaattgcctcacccacggtgagactgctagtacaatgcagaacttgatatacttttcaaaaggtcacatgtatttctcaaagcgtaggaaacatgctcctccagttctcgtgaagcactcactcactcactcactcactcactcactggcagaagcacgagatgaatgagttttccttaaaatcgggttcaagcaccaggctgacaggaaaccatgtcataattaaaatcagtcaatgtcattgttgaaatagaatgacttgtcattcaagaagacaattctgagtggaatttcaattacatttggaattaaaataactgtgctatgtaatcttttagaaggtagtcctcttactgtctaagaagctgaatttattttttaaaacattctaattaggcattcttgaggaatttccaccttcagtgaaactgacagcccgtgccatgctgtgccgtgccgtgcatgctgtgctgttggtagtgagagcagaagctgagtgtgggaggtgaaaggagactcttgcatagtcttagaagcagacggaaagggaaatcttctgtaaattgcatttctaatcaacgtgatgaccatgttttctagccctaaaattgggacatgtgacttgacaaagagacagaatactcaaaactgggaatgatcagaaatatgggatttatggttatcacactattatcaatggtggcaagggtcagcttgaagaattcagaattaaaatttagattagatttgaggaaatttactttaaaaattaatttctgaatatgtcacacttatgaacattcaattctctgtcttgaaagcttcccaccacctccttctcctaaatatcctgtttgtgagttcccatacgtactttataactttgtgtaattgatggtttcagtacccattgcctatgtgcaactgcattcagcctttgtagttttggaactgaggatactgcccactctcagttggccatcaataaatatttgttgcagggatggagggtgggtgaaactggagccaaccagagccaggataaaccatgtgccttggtgcttttcttgtgaaggctttatatttacttctcttcgcacaactaaatatgggactaagtttgaatagcacgtgtctcctcattgaaaacttaccgttggccaggtgcaatggctcacgcctgtcatctcagtagtttgggaggccgagtcgggctaatcacttgagctcaggagttcaggaccagcctgtccaacatgcaacatggtgaaacctcatctttacaaaaaacacaaaacttagccaggcatggtggtgcacacctgtaatcccaactactcaggaggctgaggcaggagaatcacttgagcctgggagaaagaggctgcagtgagccgagatcataccaatgcactccagcctgggtgacagtgagaccatgtcacaaagaaaaagaaaacatacctgttcactactctcccacttaattttcaaaggcagcctgtgtctcttttccacattctcccatgatgctctgtgttaccaactacggctctgattgattattggtgtctctgtggagagtaaatcatgttttccacccatatacatatctcaaaaacagcccaccgttctaggttttaactggacagcttcaaattggtgataattagccctatcaataccctagttaaagttggtatgtctaaagaactagttcttgggtactaacaatggctactcatggtaaaatgttggccttttggtggagtttgttctaatgatctaatgtcttaatattgctatagcacttggaatagtgctgggacatagtgagagacatttttgtgtttgccattatcttgctttatatctcaacaagcttatgggggcagagaaaactgatgcaaaagtcaaggagtctcttaaacgtgttatctcccatggcttagttttgagtttcttgttacagataagtgatatttaagcataaaataataaatttaaaatgtggtattgatagctgagactcagcccctttatggtgggacagaagcttgtggaaatagtagatacttgggattgaaccccttgtgccttaaggaccagaaaaacttctcagttattgaatttggatcgggttttactaactgatacattgcctattggtttgtgggtacaaactgtgtttctttggatttttcttaagaactggggaaagagctacattagccttgattgttggctgattttgatatctgtaatgatttgacttggaacagaaaggcagaacatatttcatacatagaaggtactatccaaaacacctaaagtgcaaattatggagaagcgacctgactcagtaacaaactatcccgaagagccatgatcaagcatcttctccttgagcagtctagggatgcacagagggggccacagaacagtgtttagaaagacagaccccgtcttgagtatctgattagagttgaatgtcagcaactgccttgatttctctctcattttttttttttttttgagatggagtctcactgttgcccaggctggagtccagtggtgcaacctcagctcactgcagcctccgcctcccgggttcaagcgattctcttgcctcaacctcccacgtagctggaattacaggggcccgccaccatgtctggctaatttgttgttgttgttgttgttgttttttgtatttttagtagagctggggtttcctcatgttggccaggctggtgtcgaactcctgacctcaggtgatccacctgtctcggcctcccaaagtgctgggattacaggtgtgagccaccgtgattgaccaaaatttttttgttctttaatatgtaaaatctcatattgctttgtggaagggtgagagttttctaaacaaaagcaaattggatgcctttattctagaagggtgtcttcattctgtttcactggtgagtgcaagcctttgcgtggcagggacagtgccttattcatgttttatcctgaagggcttacagaggtcacgccatgaagagcggttctgaaaatcatctgtggaatgaataaatgaatgaaagcaggaaaggctcttgtcctctagattgttattcaaacagtgttcgaattgctatattatccaacaatggcatgcgggaaaagacatgagggttaaaagagaaatcagtcagcaaaagtgccaaccagagagggactttaaatgaaacctactgggaaaagttgacggatgtgtcttccctaaagattttattttttcctatggggaaaaatgctttgaaggaaagacttttgattgagaacaaaaccacagtctctggaaagtgtgcagcttagcaggccatctatagagagactttaaagccagttggaggtcaacttatgttcctaagctctgtaatcttttcaagaagggtcttcatatcaggtggcctactttcactgaaatgccactgatattggctaaattctgtttcctttccaattcatattctgaagtcttaacctccagtacctacgtatgtgactttttttgggaaatgagtggctggtaaattaacagattaggtaagattaggtcattttggagtggggtgggcatttgatccaatataagtggtgtccttgtttataaaaaggggaagtttggacatggacacacgcgcaaggggaataccgtgcaaagatgaaggcagagatccaggtgatgcgtctacaagccaaggaagccaaagacggccagcaaggggaaaggcaagcaacagactctcccgcacagcctcagaaggaaccagtctgctataaccttgatctcaggcttccagccttcagaactgtgagataatgcatttctcacaggatgcatttctcacaggatgtttaagccatcctgtctgtggtactttgttatcacagcccaagcagacgaatagacccacagatgattcaaacactgttgtactttaatggttactgcaaaataccacagttcacgatgattctacagcgatactctagaactgctgtaacgttcgagtagacatgagatcactgggtggattgtgtttttaccaacatatgaaactgtaattatccatgagcaccgtactgcctttggagacactgctgggactgtgactcagacctcccttgagacaactggtcattaggagtcacagtgatgtggaatcaactttgtctttctgaaaagctggagatattcatcatagcctggactgcctgggatctacatgttttctccgtgttgtaatgatgtgaaacactttattagcagaggaagacatttttaggagaagcattttgaatcagaaggcttaagaagaattctgcttttctcgtgagtatcaagtagttgattattgagaactgaaaacattgtagaaggataatttacaaaatgacccttaaacatctgcatttatcatggaagataaaagtctagagaaactgttttttagctgctaggaaaagctgtgttttcttcagagggtaagtcatagagaaggatcatggtgtggccagggcaaccgagccccaggggggctcatccgctttaggccaggccctgcctacagcagtttgcagaggctggtctcagatgcttgccaacaaatacagccctgcaatgcagtgacattgcattccggcaactctctgttctcttcatattttctcataaaatcttggctctggctaaagagaaaatgccgtgcggtaggcttagctccttaatggtgaggtgttgatttggtataggtctgttttcagccaacccagtacttaatgtgtggggattttgttgttgttaatgataacagtattgtctggccaaaaaatcatccttgccatccagaagtaagactatcatcgaatcacgccacttctgcttgcagacaagcagcagtggacatgtcaaaaccgtgtgtggttattaaaagttgacttaacaccctactctctaccctccactgtcctttgcaagatttcttcagtatatcaggggatccatccttttttccctccactgcccccttcgtagctgcccctctgacaaatgcctcctaatcccgcaagcattgctgttcagctgcttctgagtcagctcatttcctcatgatcttggggccccttcctccaagtggtttaccaaggtgtgtgtttattatgtgtatataataaacacacacatatataaataaatatataataaacacacacactaaatatatatctgtatctatatctatatctatctatatatatatatatagagagagagagagagagagagagacaggttcttcccttaagatgtactctagggcaatctcatataagaattcttttccacacacttttactcactttctcttaactcctgtaaacttagaggctagaccatttacttacatgtccttgttatctttcttctctttctgcatgtgtgcatgtgtgtgtgtctgtctgtctctgcctctcctgtctttttctttctttcttttctttattttttgtattgacagtgactctctccctaacctcactctggtctgtccttggcccatttagtctaatttcagcaagaatcctgctgcgtcagtttaatgaaagtcccctgcacttggggtctgatcccccttggtacctgatcaaatgcctcatcccctagccttggtatcttatcaccctggcctgccttcaacaagattatttttgagtcagcctagtaataacccccggccttgatgttcccacttagtaattttccatctgctcacccgcagcctgcttcttggccatcagtctccgctcgtccttgtagttggagttgagctcagtcactcttcccaactacaaacctccttgtggtgtcccccctcataaaatctgtgtgtccttaacaagtgtcatgaatatttttttctctagcagtaaaagagttattataattagaccataagcttttccaaggtaaaacttttctccttggctcctgaaatcatgagtatatagtagttggtcaataaacatttgctagtagatggattctcctcttccttctcattttcccccataccctccttattgtcttgcttcctttttccttctctgtttagcataaaaatgatgaatcataatgataaattatctaatgtgatcataatgtatgtaattctgtgtagaattgttcatatacttataattataccataaaaagtgaagatatcatcactttaaatatattcatgtgttttcttcatttaatcagcattctctaacttactattaatgaaattatccatttcaatagggtaggtatatcaatgcattgagtttttagaggcacatacatttcacagggacttagtgttttataaaaatatgtagcattgatgcattaattaagggagaagtaaaaatccacagaattcgtatacaagtcattattactttttccatcacagaattctgcttctttttattttataagaagaatatagaaactatgatttttcattgcttggaaacaagtggatagcattggaggaggggacagatcatatttcatgagttacaccttcagaataacataagatagtgataaggagaaatatcttatcaaaacagagagagctgaaaggattcaaaatcccccagtttaaaactctatccagggccgggagcagtggctcacacctgtaatcccagcactttgggaggccgaggcaggcggatcacgaggtcaggagatcgagaccatcctggctaacacggtgaaaccctgtctgtactaaaaaatacaaaaaattagccgggcgtggtggtggcggtcgcctgtagtcccagctactcgggaggctgaggcaggagaatagcgtgaacccgggtggtggagcttgcagtgagccgagatcgcaccactgcactccagcctgggagacagtgagactccatctcaaacaaaacaaaacaaaacaaaacaaaaaaacctctatcctagtgttataatagagatacaagttttattcactaacataaagtaataaaaactgtaattctatggggttttcttgttatgtttgggggatgaggaggtgaccatttaaaatatccctgaaaacaagtgcagaattatcagtttcatatgttgttagcatcctgttctgattcttgtagaaaagtagtgacaaagataacacacatttgttctgccctcgtgtgtgccatgcatggtaagtgctttctgtacattgcctcattgactcctcacaaccacatcgtgcagtcatttcttttcttatctccattttatccatggctgagctgaggcttgagagtgaaataaactgcccaagttcatccccgtcaatagcagaatatgagattcaacccatagtgtcacacacgcccaaaatcaggcttttaaaaatctctttgcggccaggcacagtggctcatgcctgtaatcccagcactttgaggggccaaggcaggtggatcacgaggtcaagagatcgagaccatcctggccaacatggtgaaaccccaactctactaaaaatacaaaaatcagctgggcgtggtggtgcatgcctgtagtcccagctattcgggaggctgaggcaggagaatctcttgaacccgggaggcggaggttccagtgagtcagtgagtcgagattgcaccactgcactccagtctagcaacagagtgagactctgtctcaaaaaaaaaaaaaaaacccaacaaaaaacaacaaataaaacctctttgctatcataatgaaaacaattgacctttgatggatcatacaaatgagatatttgcttgtactctgctttaaactcaattataaaagactttggaaagaagagctatgatgatttacagattgaatctttctacatcatgtgaggttgatttcttgaagtttctcagaactggattgacaccctctgagtgttaactggttggaatgaatccaaattccttcagcgcttgtggaagcctgggtcacctgtctcagagatgtttatcccagacttgcagacccagaaatcttgtgaggtgctgcccaggaacccacagtggtaacaagctcgtcataggattcttgtgtaaactaaagttttaaaaccactgttataagggtgatttctctttctataggtggaaaaagattacatccaaatgtttagtttaaaggaatatcactataattgtgataaaccaggagttgcaaactcgtggcctgaatgacagtagtttttcctttggccagcacagtttgttaccataagagtttggatgtgtttatgtaaggcatacgccctctatttcaacacagtgcccatgacttcctagcatcttagactttgaagatacctgcatgatccctgaagaaagctggaaagaagaaccttcttggccaggcgcggtggctcacgcctggaatcccagcactttaggaggccgaggtgggcggatcacgaggtcaggagatcaagaccatcctggctaacacggtgaaaccccgtctctactaaaaatacaaaataattagccaggcgtggtggcaggcgcctgtagtcccagctactcgggaggatgaggcaggagaatggcatgaacccaggaggcagagcttgcagtgagccaagatcgcgccactgcactccagcctgggcaacagagcaaaactccgtctcaaaaaaaagaagaagaagcttcttatacatgaaatccatgagatactggggccccacgtgcctgactctcccgcagtgctcaagacctgtctataaagtagtttttctctttgttcagggagttagacaaagaagaaatatgttttctttttttctttttgagatggggtcttgctctgccactcaggctggagtgcaacaacagggtcatagctcactgcagcctcagactcctgggctcaagtgatcctcccgcctcagcctcccaatgagctgggaccacaggcacataccaccactcccaaataatttttattttttatagagacaggatctctctatgttgcccaggctggtattgaactccttggctcaaggaatccttccactttggtcccccaaagtgatgaaattacaggtgtgagccactgcccccagccagaaatatttttttttctatgcttcttcttgccctctataagtgacttaaatattctcatgggtcatttgagacctcagtcctttttgataaagcagaagggaaaaaatggacaggaggccttcagtgaaaacaaaccagcaatatgagtatttttcagaaattaagaaaataaaacaatttatgttaaatcaacaaggtgacatatcaaataaaacaaatcagaagtccgtgttggtgatgaaaatgataggacttgtgtatcccttgagtgttcaccatataacaacagtacctataagggctttgaaaagaaaaactgtcaaaattaatcaagattcatttttgggaaaagatgacatatttgacaaattaaaccacttaaggaaagaatagtagaaatgacatataaacttaactttatttcatcaatataggtaattgaagtaattgggcttttattttgtaactaaatatatgtagttttcaaattaagatgtaatggaattttgactaatacttaattaggagcctttggttaagaactgagtgctctctcagcaaactaacacaggaacagaaaaccaaataccacatgtcctcactcataactgggagttgaacaatgagcatacatggacacggggagtggaatatcacacaggggcctgtcagggggtggggggcaaggggagggagagcattaggacaaatacctaatgcatgtggggcttaaaacctaggtgacagattgataggtgcagcaaaccgccatggcatgtgtatacttatgtaccaaacctacatgttctgcacatgtatcccagaacttaaagtaaaataaaaaataaaaaaaaggactgagtgctcaaaatttttttataagttaggaaaaccaaacaaaaattatatatacacatatataatatgtataatattatatataatatgtataccttatgtatgtaaatgtattgttgtatgtaagaatatattttatatacatataatattcacatatatatgacaatgtgtaatatatattatataatatgtggtatcatatttcatatatatcacatataaaattgacttgattttataatagcatggcagttcaataagaaggaggaaagtaaagaaccgtaaaatcctctttgttcaacttttccttggcttgtggcttatatagagctatcctaggtttcttctgctggttaaggattgcttatttgtgattaggattagttgatagaattaatgtcagggtcagcaatggatgagtctgtaaggggagcccgtgtgctctaaagtgatgatgaaagtcactttcttagaaataaagatccttgtgccacatcaaaaagcttttaaatatgtcaattaacctcgcatgtttcctaagtaaacagagatatgggcaaaggtaaatctataaggatgtttatcagaacaatatttaaattatactaatataaaatataaacaaactgtgctccagaagtagtatacttgtgttttaaaaattggcttttataatagaattctacattgccattaaaaaaaaaacaaaaccacaacttgaacatttcaaatcaacacgtccaaaacgaaacgctttccaactagatgtcctcccatcatttatatatgagtgtttccatcacctccgagatgatcatgccagataccaaaaattgtccaattcccctatctccttttttgtctccctaatacagccccatagtctgtaggcgacaaggcaccgcctccaggactcagcctaaactcatccactttcctctacccgtgccgccaccacgctagttcgagagaccatgccttcttgcctggaaactatgctgtagcctcttaccacggccctcttggcattgcagccagggcagtcattttcaaaatgcaaattagaccacgcccactcctgtgcttaaaagccatcaggtcctccatttgtttcacgtgagatcccaagcctggcacatagcgcggttatagcgcagtccttgctctccagctctgtttcagcttactctccacctcgctgtctgcactccaggaagggtagtgtggctcctccgagtctgtgtgtgctgttccctgtgtctggaatccttcgctcccacacagcgctcctcccttccatcaaagaaattgccttcttatctttgacctctcagcttaagtcctgtcttgccagaggagacttctatgctctgtgatatggattgagtccctagttagttctttcttatagcgccctgtcaccctgcacccggactctatattgcatatatgttttgtaattaaaatttcatttgggcctaatacctgcttgacccatgggatcgtaactctgagaggaggtaatcttgtgtgctttcttctccagccacctcccccatgcctaccgatacagtgcagatgctgacagttgtcactcagcgaaatgtgtagagtgagtaaataatgtctgacatttaacagtcatcatcatatatttccaaaatgtatctttttaaatagacatgaacaaatatacgcgtctcatacatattttgaatatgcgactatgacactaagaatgcaagcaaaagttataatggttctctctggggggagatgcgttttaaaaatatatttctgtgtttttcagttatccattgagtactttcatccttaaaattagaaaaaaaatgtgctattttgtaaaatgtgtccctttcttgcactaattataattctgaccacccaccacatcctattctgcctctagggctaggactctaagacaatgcgtttatcaattttaaacccagctgtacatgtacatatttaaggaccagtggcattagaggatatattctcaaaaagaagaatgactgttttagggaaaaagtccaaagtggcctcagcaaatcacacagtttatcagaatattaagtaataatataacaatgagaatgtcatagatgcaaacaaaaccattgtcttatatcatggcaagctgtttttgtgtttttggtctcaacattcatataaactcaatcagtggcaactttttggcttgaatatggccattgttttaatgctgcgtgtattcactgaaaagccttgtcagagtgatttttggggtgggaacaagttgatacgactcggatgactggaggaacaccagggttcttggtctcacgccgataggattaatgacacggacacacatggagtggtttcatggagcgaaaagtttaataggcaagaaagaaggaaggaagaagaaaacagctccccagtatagagacggagggagtggggattggaacaaagagaaaactcgctgtgcggcagcaaagtggctgcttatatgaggagtctggaggaggcggtgtctgatttgcatagggcacaggggattggtttgaccaggcatgtcattcacatagcccgtgaaataactggccctcccaccctagtcttttaatatgcaaatgcagggcgccatgatgttctacacacgtggggttatgtggggcagccatgttgccaggcacttgtgggcaccaggaaaagacagcgggtattgccttgtttgggtggacccagtttctaatggcgtacatttgcatatcaaagcttgccggtgggggcttttctgctaggcaagaaatgtttcttgagctactttaaaagaaacaaaaacttggcaaggaccctttttcgtatctgcctaaaataatttcttattaactcctataacgaagtgaggtttctggccccacggtgaacttttgcttccccaaacttctaaggcaggctccctccttgtgctctaatggacaccacccactcactccctggcagtgtggactactcgtcttttcttgtaaattgtgtctcttgaggctgactgcaagctccctgaaggcaggagagcatcttctgtacctctgtatatctatcctcacactcacagaccactcaacctgttcatgtactcatttcactcattcattcatgtcacaaatattgactgtgacctcctgggttcctggctctgctgtaccacctggagataaagagcaaaacagatgagacagatatctgctttcatgctgcttccattctagtggagtaatacacatcgcaaaggaatggtcatttattgattgagcgtcttttaacaattcttgtcttgaaaattaactgattttagtattcaggaaagtatccaaggaaataagagacatatttttcttctttagttcttttaaataaatttcagaatttttttttaaatgtaagaagttaatgttagaaccctgatactgtatctaaggaaggaggtcgtgtagaagtgtttctctccttttgtgtctttttcatttacaaatgtagggggtagagcttacacttccagagtaatcatcacgtgcaaacgaatgctcattgccaatcagattgcaagtggagtttcacaaatttggtatacaaaggtctatagaaaaattggccaggcacggtggttcacaaatcccagagctttgggaggcagaggcaggaagattgcttgaggccaggagctggagaccagcctgggcaacataccaaagtcctgtctctacaaaaaaaaaaaattaaaaaaaagaaacttagccaagcatggtggcatgtctgcagtcccagctgctcaggaggctgaggcaggaggatcacttgagcccaggagcagtgagtaatgatggcaccactgcactccagcctgggtgacaaagcaagaccccatctctaaaataattctttttaagtattatatgactgatcccaaagaataagttactcaggaaaggaggcagggcgtacttttccagcataagcagcatagatccaaggttgaccacaacagagacaaggaagactatagaagaagatgggacaagacactcacctttgtggagtgtctgctcattatctgctggactctgtgtggggctccccccatacagattatcccctttaatgctcttaacctcactgacacttagccagtattcttcccattctacagaggagagaactgaagctcagagagattaaatagctttcccaaaggcctcttagaaagcttcgttcagggtttgtatctaacttgacagtcctaactacttgagttaggagtcaaacgatatgaattttcagtttcagttccctcagtttactagcaaggaaactaaactgggttactatatttcctaggtcttcctctcctcccctagaaatgagaataataatatctgccatatgagcatgtcaatttttaaaggaaaagctaaatgaaaccattctgtaatccataaagcactctgcgaactataacaattgctgaatgttaagaaatacagaaagtctacaaaagattttctaagaaaatggaaaggaaatgataatcgctgtaatttcatgaaggagaaattgggccaatagctgtcattaattacaaatgataaaacaagaaggaaagcagaatgtcatatcactctcaataaaaaacataggttatgcaaacctgatgcgttccagaagaaatgagaaaagttcctgaaataggattcatttctgaggctcaattccatgattcgttcctatgaatgtgagttataagagctggaaggaaccttccatgaaggatcagggatggggagggttcagagacttgctcagtgccaaagccagagccaagacccagggctgctctgcccagtgtgttctcccttagtgcactagaaatcattctgagtgatgcactccaatgaggggctgggacagagagaggaaggggagaggaccactgttatcaacaaccttccagaagttaatcaaatttatgtcctagaattattttttacagtagaagataaccacatagttatgctaaccacgactgttaaagctaaaagaattctcctgaaagccagtgcttcaccatacacagctaccatgtgcctgattagagctgtggcaagtgtaaataaatcaggggctcaccaatgaaaggactatgttgataaccaaatccattcatcagatgaagaatgctttccatgaaatgaacaactcctgttttcccaatgtgagccagtgttttaacaattgtgtggcttacgtgattggcagtgttcctgtaacaggcagctccaatagcagggcagtctgaataaaggaatctctggaggtgaaggtgctgaagagtgttgatactggaaatgttggggaatgcaagactactccttttgaagaagactggaaggatcgctttgaaatcccggaaggcttgcagacatcctgcagaaaagaactggctaaaaatagcaaaccagcgttgtggtcggctgatagggctgtatagtggaaaagtaaatatccattgctttgtgaactgaggatctctataacctgtatcttctcagaaatatactttctacttcgtccttctttgttttttcagagacagggtcttgttgtatcagccaggctagtcttgaactcctgatcaattaaaatactttccatttctttttttttctcttcctctctctccatattttgttgtgtgacatattcctccaggataatagggaaaaatttaataaaatatttttctaacgccaccattgcaaagcatctgggttgttcatcttcacctccataaacaactcattatcgggagatggttaacttgagcaactccgtaacagattcggttttgaagtcacgttataaaaaacagcctacagtgattgtcacgtacttacagatatgcttagctaatccttacggtattgatgttatccccaatttagaaatggctgagtggagagagattaaagctgccaaggaaaagattaaagcgtagctgtctaacgtctacgagaatgggaaccatggaaaattgaaacctacacataatgcaaacgacttaagccatgagctatctgatttgcccctttctgctctttaatcatgaaggggaagccagcctcgtaattgacaaggaaagtatcagcattccccgcccagccctctgcctctcaggtgctgaggggctcccatcgaaggaggaagcctcacaacttcctttcctattcgctactcaaaccctcatgatgggacatcttattgaatggatcactgaaaagcattttgatgacccatctttatgacatcatattctgtgaatttgtacagatgacttttgttaccatttacttatcactgaaagagagaattgtagtattctgtctcactttttctttcacttttcctttgtatcagcaaaattaattttattaaatctcaatatttaatgtattcagtctacgaaaatcctagcttcttgaaggaaactagtgaaaattcgcagatacactattttctggtaaacttttttagagttgccaaatttttttaaaagtaaaaacatgcaagatttaaattacattgagttaggactgttggatggctggaatctctgaggcatacaagctctattctgctccactttttccactttcagtcactgaagcacttttaggaaggatggaatggaggtactttgtatggcgatgcaagatgaagcaggatctgttacaaattccctggctggaaaagtacacttctttcagcactattgtaccttgacggtctccagttacagccagaggagatgtgtaatatatgactggacttgccgcaaatgcaagtacacaaaccttgggacagagacaccttgtgctacggtaaattgatctgctgctggcgtccactgagtcatccggcacacaaaataggagctcacatcagagatggtgggaactggttggagttctgatttttatctggccattcaagatctgtagaaagagtgaattttaaagtcctctcctgatgattatgctacttttatatttaaaaccatttgacatagaatcaaatttgtgtaccactattttgaaactcattttccaatgtttcctcttagaataatttttttgtcaaatgagaataacatatagcttgcatttttcttaaatggaaatattaagattattcatattattgaggaagattaataagaaagatggcatactaacaactaattgttttgtatgatagttcagaacagcggtagattttgcaaagccaatatcttatgtcatctgccatgtattattgagcatcaaatatatgccacttcaggctgggtgtcccagagatgcatggcatgaaaagatgacagcaggacaataagatatgagcgaagtaaaaaggaaagagaagataagagattactgataaacggtgaagcaaaccattgtatcagctatttctggtgatgtcaatttggtgacatatcctggtgaagtgggttaattgcatgtgtgtgtcaagttgcttcttttctgatgcgggtttgacttttctcattttgactgcttttccagaggtgaaattagagtaaagaaagaaagaaagaaaaacctctacagtcaaaaactggtctaggcagtttatatcacctcacttaattattatcaaatgcttgggaagagataatattattctcattacagagatcatgaaactaaggctcagaaaagtcaaggagtttatttataatcacagaactaggaaatggctaagatggagacttgaatctatgttcatcttgatgaggagcctggtttcatcccacagcacagtcgcccacaactgcaaatgtcatgtactttccgcagcgcctcctatgacagcaaaaagagtaagagttttgggatttctaggcagaacacttatgtaatcaagtatcttagagatatttttcaatctccaagcaagctggggattgaactatgtaagtggtaatgaacgaattctttagaagatgggttaactatgctggttcataaaagaggaaacttgactgcactaaagaaattcatgaaaagagttctgattcttcctgagttcccagtgtcccttgttctaagagagctatgcaaatactacactgatgcctggaatcatctataatttaaagagttacaaagcttttcttctgccctatgctttggttttgtgaagatttttgtacatcaaatgctgcatctgtggactcattccagttacatgtatatattatacagatcatttgtgcatccattgtgatgtactgggtgaacatacgtggaaactgtaaatcttcatgaacatctacatcatcattagagaagttctactcattaggctctcagcacagaatagtccaattcaattagaacacttcttcagtgagagtttaataatgagactattttcggtgctgtgaccgtgatataaggcaaatgcaagagctattgtaggggctctgctcccaccctaggctggaagaggtgagtggaaacagagctacgcaaatgtctctctaatatgagccatgggggccaccgtgaggccgtggtgacctcttggggaagggctgggtgaataaagaaccctacttcagttttctctcacccttcattggccaactcaacttgaagccagagggtagatgcatctgttgacaccatctgtaaagatcagtcagttgggcactggcggaaaagatggagagtgacctggagggacaaagagaagccatttagcacatcagtatgagagaaattactcgtaaacaatttaaaccaaagtattttctcatacataacgtttctttctccagctctgtaaccatgaaaacgtacgaacaaaaaaaagttagttgtattatctgctaacagaatcaaatagcatgtcaaatttgggaaattactaatttaatttctgcaaacaacctttataagattttttacattcaaagaaatgttggtgattagtgaatctgtgaaaacatcttaggtattgtctttttttctaacaagtattttgagtttgtttgatgcctagtaaacactggttgagtaaatacccaatgtattgcaaataagctatactgttagaatgtgtctcagctgctttcccggaacatcacatttctcctttatttccgttatgaaactaagaattttattttgtctgccatattcataatacatggaagtcttgacccgttctatcgttgacagtcagggtttctcaatctgagtggaaaaaacacaaactgtttttcctctgctctcacaccacgacaatcaacacagaagacttcagtgaccaaatgtcagggaggttttccccactcatcaagcagcagacaccagtagggtgtcccccagttcagtaccattctgatgctgtctacctgaaaatagtgtcagatcccgcaggttgaaggttcagtcccaagtctgcctctccccaatttttgataccagtcgcaaaccccaggttgaataacctgtgcttctgaccggctggctatagctggggttcccatgtcccccttcttaggtttgattaatttactagagtggctcacatgactcagggaaacatttgctgttttattataaaggatattatgggccagcagtggtggctcatgcctataatcccagcaggttgggaggccgaggcaggtggatccctcgaggacaggagttcaataccagcctggacaacatggcgaaaccttgtctctataaaaaacacaaaagatgagctaggcatggtggcttgcacctatagtcccagctactcaggaggctgaggtgagaggatcccttgagcccgggaggcggaggttacagtgagctgagatcgtgccactgcactccagcctgggcaacagagttagaccctgtttcaaagaaatgaaaaggatacaaaggatacagatgaagagacgcacagggcagggtatgagggaaggggtgcggagcttctgtgccttccctgccacaccgccctccaggaaactccatgtattcagctctccagaagcttcccaaaccctgtcctcagggactttatagagtatttgttagataggcgtgattaattaaaccattggccattggtgatccacttaaccttcagcccctctaccctcccatgaggttggggtggggccaaaagtcccaaccctctaatcctggcttggtctttctggtacccagccccatcctgtagctacctgggagctgccagccatgagtcagctcattagcatacgaaaagacagccctttgcagattctaaggatttgacgagttgtatagtcaacctgtgcactgttactatttggggccacataattctttgttgggggaggtgggggctgcctgtgcactgtagcatgtttaatagcatcgctctcctctacagaccaggtgccagttctcacctccctagttgtgacaatcaaaaatgtctccagacacagaaaatgtcccctgggaagtaaaattgccaccattgagaagcactgttgaaaatgaatgtgctgggagtgtcgtatcttgggcgtcaaattctctattcacaaaccagtcctctttttataccaggccacttcaagaatccagctattgagtcagttggctaatgtgatcgattctgtgataatcattagtaatgaattggctcactatgcttcacaggcaggtgactgggtggtttgcactcaaaagcaactgtgggcgtgacaggcactgagactgacatgtccagaataactctgcaagccatgctcccacctctaacttctggttgctgcctggtgggacagccatatccatacaatagtttttagatgaaaacagaccaaagaacatctgaggcccctggttttcttagtttcaatgattttggatcaaagtccaccatcttctacctggactctgaaattcctcctaattcagtcttcttgcatccattcttgtttccctccggtccatgactcatactgcaccctgagtggccctctaatttcctccagttggaaacccttcagtatcttcctgacccacttgaccctattgtgatctcgcttctccttacttatccacctgccatttccctctctgctttcttcctatacaagttcatacagatcgttgatgaccacgggccctttgcttatgctgcttcttcctccagcctccttatgtctggttaacaccacagtcttcagtttccaggtcaaatattacttcacctacaaaccttcttattgcaagatcccaaatcttcaaaattaccagggttaggtttttttgtgttacttaaccttcttagagagctacgttcctttaatccagagcacttatcttgctttgcaatcatacattcagtagagtgagtattaatatctctccttcattaaacttaatgctgggggtggggggcagaaggacctgttaattttcttcttaccagtacaagtgtagcacatagggaattcccaataaatatttttgggagaaaggaagaaaggacaaaagagaaggaaagagggaaggaaatgagagaaatgtagaaaggaaaagcagaaaaatagatgtcaaacgtctgcagtgtgactgcagcaaaacctgtttgtatgtactctcctggtcctccccaggctaccctcgtagttagctttttcctctagagcacaatgctttttccatgccatcagaatgaccttcagagctgattactatttaggtttctggccaacaggtaaaatgttcccaagaccttcattttaggaaaatgcttttcaaggcattagaggaaacatgtgagtctatggcagtgcccttggagggaggcttctatgagataaaactgaggacagtaaaagttgcttcaaaaacaaatgctccattcagttccattcgggtctctttattaaagtcatcgtccacttcttacacacaaatgctgctgaaagcagtataaaggccgaaaaaagttttaaaataacatgagaaaatgagcagtgagtggtatgagtgaccttggtccacagatcatcctttcagatgaaagccttttgttttccctaaagtccttcacattagtctttagtgtcgtcattcattacacagtctatcttcatttacaatccatttgccacacgtcaccactgaaggagatggaaaaaatccattagacataacccaggctttctcccaccagcagggatcaaacgaccccataaagtcatttcctattaattacaaattgattgtgtataaacatttcagcactatttttcagatgataataaatgagttgtgactggttacagaggttagataaagatgccgagacaggaagagggcaagggccgtgcagggaatgaaaacaaagctgcctgatggtcaggcctcgtggtatttgtaaacgtcaattggtcaggagtgatggatgcatttcagaaacctcaaaacccaaaaaatgcataatgttaacttcatagattctttcaggcctgggttaccacagtatttacaatgaacgtgcgttcacggtaataacataatagtacctttcagccccaaatcccagatatttgcacctttataaactgttaaattctaagccaatggtgaataacattccggtatgtacctatagaacttgttatgaaacatgattgagtagcaactctgtaggctagattataaaagtatatttttatgagggtgaaataatgaaaacagtctgtacataaaaattataccagaatgaggaaatgctactgtaacaaattacttaactgagatttactgaggcaagagtcagtgcaagtatacacgattagtggggtttttgtttcagaacttgaaaggagagaaaatatacttatttctaactttcctagagaaaaaatgaaaaatatagtgttgttttctatttttcagtttttgagtttgtttatagatggttgtggcaacattggcaaagctagagcaagctagttattgtccacagtgaaaataacccaggtatagaatcatggaatttcagactgaagagtgagtactttaaaacatacttgttttggtactcaaaatttcttatttttaagctttgtgtgtcaataactgaacatatttgaaggtttgtgctctgaaacccttcagaaaggtgtatggtcttatgaagcactactggattaaaattcagagtgatctagagctaaccatgtcccacatggggatgttataaagattaaattatgttttctacatcaacattttagatattggatcttcagagctcaaaaacaaatttattttcctgggattacattcagactaaaccattgcaatgaatgagtctttgaagagtcattcatacatcctaaaatccagaataatgagaatctcttctagttttaaaatctcaaagagagacattcctggtgttacaatgtcatttgctctaactcctgtcttgctaacaataaccaactagtcaccatcctcttcagaatctggtttaattaaatccccaagaagaaacgaaatgagaaaatgtttaataggaagtgacttcttcagtcttaccgtttaacacaatcattgcgatcagagaaaacagtcagtttgaactgaattctatttgattgtattggtttagactcgtctcgaaagaatcactcagcgaatcctttggtaaaatcttttttaaaagttcagatgttggtctgtcaggtcaacctaaatcaaggtatggtaacattttttaaaggtttggacagaatgagcctcaatggtaatattttattggatgccatctggtaaaaactggttttatttggttaatgtttatttgttccataaaaagataggctaatcatgactctgttttatataatgcttgtttatgtaacaggacataaccatgcagtgggtcccaggaacattattatatttggttgcttctgttttcccaaatagatgaaagaagcaaaacatccttgtgcatttttaaagttgctggtagcttttgaactgccgttcagatggaatcaatttcagcacagcaagacattttttaatgcaaccctgcagcactttagcaaatgaaaactattttccatgagtcattctttgaattacaaaatgttcatcatccaggagtgtttattgcacccataaaactaatgcagcacaataatgggtgttaatgtcagcagtatccggctgtttattatgtaacattcgaaacgggaaggtgagtgtttaatgctattgtttgttgtctaacagttccaattgttcataccatcaggtgcttagacagcagatcaaatattttgcttgatgttctccagagcaaaaaatgtaagtttacttttctttataattagcatggtgaaatggagggctaacaaagaagctgccaggatctcaaggtaattatgattttttgtttagtgacagcttcttgttttgaataccctttcccttttctcctactatgacaaaatagaaactcttttttttttttttttttttttttttgagatggagtttcgttcttgttgcccaggctgcagtgcagtggcatgatctcggctcactgcaacctccacctcctgggtgcaagcgattctcctgcctcagccacctgagtagctgggattacaggtgcccaccaccacagccagctaatttttgtatttttagtagagacggggtttcaccatgttggccaggctggtctcgaactcctgacctcagatgatccacccgcctcggccttccaaagtgctgcgattacaggcatgagccaccatgcccggcctagcattatctatctttaatagcaaacatttgaaaataatgagtgccaaacaataagagatgcttcaaataaattacctatattttgtcacctgtacgaggctagctacacaccactgagaaaagaaagaagcactgctaattaaaaactacacttactgaaagagttttttagggttatttaaacatgcattttgtgcatacatgaaaatgaaaaataagtgaaataattggttagattattttcaatgtttttctcctacaaagtccagctcttctgagtcacttttcaattgtgaatcatcaaagtccatgtttttccataagtatttctctgtgccatggagagcactagtgatgtggcatttcttatctgtgccctgcagccatctctgggatcttcctgcaagttgctcacaaactgttctgtgaatgttgatgctaattgcttcttgatctaataatgtgtcaataagaggttttcagaacccagccaggtcttctattttttctgcaagagatccttgtcatctgtggacctgacataaatgagttacagttgcccagttgtgccactgaaactataaccatattaagcccctgcaggcagtgaccagtctgtcaccgctgccacctggccaacgtgacagcaaatgtcagttgtccttgatcttgagatacatcccgacttagatgttaaaatgtgtatcttagaaccattaaagtgcggttaagtgtatccaccaagagggaaacttgcgcactcaaggagaaaatcaggctgggcgtggtggctcatgcttataatcccaggactttgagaggctggggtgggaagactgagcccaggagttcaagaccagcctgagcaatatagtgagactccacctatacaaaaaataaaaaaaattagccaggcatggtggtgcacacctgtagctccagctactcaggaggctgaggcaagaagatcacttgaacccaggaggtcaaggctgcagtgagccatgatcatgccactgcactccagcctgggtgacagagcgagactctgtctcgaaaagaaaagaaaatcatcataattttgaagcctcttggacagtttttatcagacatatgagataagtttatgttataagacaataaaggaaatgtagctcagtagaaagggcataaacttgtttgtaaacttggacaagctacttatctaatctctctagagtctttattttataaagggtaaaatggaagttgttaacacctgctttgtgaggttattctgaatattaaatgactcaatgcataatagttttagtattttccaagggaagttttttttttttaaaaaatcaaacaccgcattgtatataagaaacgagtcctactctgaaaccacgcacctgagaaaagtctggaagggaatttggataatgttaaattctgatttactgatgtagagaaattataaatattttatttctcatatataatacagtctgtgatacctgtttatatctgcatctttgtatacccacaggatttaggttatagaataaaagttgcagtcagatgtgctggctcatgcctgccatctcggcgactcaggaggctgaggtgggaggcggttgagctaaggaggctgaggtgggaggaggttgagctaaggaggctgagcctgcagtgagccatgattgagccactgaacgccagcctgggaaagagagtgagacccagactcaaaaaacaaacaaacacataaatgaataataaaagtttcataccagaagccatgatcttcaagctctatctgtgttctgaatatgaggcaagagagaagggaggacaggagaggaatggggagaaagtctccagagttgggagtattgatggaaatggagaggataaaatgaagtcaacttcataaaggggttttgaaggatagcaaggcttctttgttacaaaatcagcatttcttttcagtaagagatagaaacacaggaaacgcattgaaaatggagtagggtgtggccaggcccttctcgtcagtgggaaccatagcattttataaatatatgcatagggcacacattgtactccagtgctattacttgtagtgtcctttattctgcaggacacagggtcatttgtggcaaagagcacagttgcagagccaccttggcctggctggaatttgggctgaatcacatactaggtgtgtcttaacatttcctttcattagatcttgaacagtgtcagacacacagccaggcatgacattgaagggaatatatttcttttctttttttttttttttttttctgagatggagtctagctctgtcacccaagctggagtgcagtggagcgatctcagctcacttcaacctccgcctcccgggttcaagcaattctcctgcctcatcctcctgagtagctgggattacaggcacctgccaccatgcctggcaaattttttctctttgaataatatttctctttgtagaaaaagaaatgcagcagaaaaatcaactgtgtcaaatattgctatgagtgaacatttctttgcatgttttcctagtttagagttcttgaccaaagttttcacaagttatattgagtggcagtgaaacaatgtcttcacagaagccctcataattcttcagaatctttggctacatttatgcgatgataaagcaatgcttgaaagatttttaatgcaatgactttattttttcttttttttacccttttatttatttatcttaatttatataaatttaagaagtacgagtgtaattttgtcatgtggatatattgtgtagcggtgaagtctgggcttttggtagatccatcacccagataatgtacattgtccccattaagtcatctttcatcatccaccccctccccacatacccctagcccttctgagtctccaatgcttgtcattctacgtctatgcttacacattatttagctcccacttacaagtgagaacataaagtatttgacgttttgagttgtttcacttaaggtaatgacctccagttccattcattatgctgcaaaaaacataatttcattttttatggctgaataggattccattgtatatataccacattttctttattcagtcatctgttgatggacacttaggttgattccatatctttgccattgtgagtactgctacagtaaacacatgagtgcagatgtctttttgatataacgacttcttttcctatgggtagaaacccagtggtgggattgttggattcatacaaatataccaaatttattttttcttttcctttgggtagaaacccagtagtgggattgttgaatttatataaatatacaaaatttatttttatatatgtattatataaaaatacatgtatataaagtacatgtataatgcatatattcatatatttttatatgttatgcaagggttatattttagagccttatggtttcatgttttatggctcaacctatctgttttgtgtcttgatagaacagagcctccatcattgtgggtctcctatatcttactctcctgagatgaactcctttgctctaaaagtttttactagtttatagaaatatttacaaaaattcatttggttaaggactcattcatttcagaggtctagaagattgtctcctgaggaaacacagtacagcttcagaatcattactcggcgatccctttgagcgcttctctgagtttactcgacagacagattcattttccaacaaaccctttctaagcgttttgatttagcaatcagaagtcagagggaacgtggcacttttttttttcattgagaataggcctgtttcaattatatttcaaatatttaaatagtttttgtgatgtctttgggtgactttctatacctcgagtggccatttactaacatatatatacatgtatatatatgtgtatatatatatatttgtgtgtatacaaatatatatatatatatatatatatatatatatatatatatatatagcctttgcatgggttcactagtagttcatttcagaccataatttatctatagatgaaataaaaaacaggttttctttttattaagttagatgggagccaggtcaggtaggaagttggttcttgagaatagaatgtgtgtgaagcagctcatcaagaagaagaaagcaaaagcaatatcctgagaatgcgcttgttttgggagaatgtgcatggtagtggtgaggagctcagcatggctctgcccgatgacctctccaggtcggttttccacagttgcctctcaaatgtccttaaatgtttaattacaccttatactaagctatgttgggaacacaattctgggattgtttcaattctcttaaaggcagacaattgtgtatatggttatgtttaccaagacaaagcataggtctaatgaatctttaaaaaccaaaggcacatttgtacaaggagaagattggaaatgacttaaactgaattgtgcaatttaaatacacgcacaggaaggagagagggaaggagggagagagagtgcatgtgcttagctaagagttccgtatctatacctataataacatctatatccttgtattttccactaaagaactgaggtagcttaacttaccaataaaacctcggaaactaaaatcacattatacataaggataatatgtgattttaaagaaaatatccatcatcaagaaacaaaataaaaagaggcaagaagcaaagctctccagaaaaacagctaaacataaacatccaggccacaaaatgtgtttcttcatggccaaagttaaaatggaaacatgacaattatgttataaagacggtaaataacacctcctcaggagaaccgagctttttctacctcatagctctaaaataaatttcttatatggaattttacattaaagtgctctaaacgagtttcttactataaaagctaacattataataccaaaaggtaacccagcgaaaacatttaaggtggacagacagactagcagggtagcaaggaaatttggccgaacatcctctattccatggttcgacttcaaccaacaagacaagtgagcatatgatggaatagatggacaacaaatcttcccaatcattcctcttttttttttttttttgttatgatggagttttgctctgtcacccaggctggagtgcagtggcaccatctcagctcactgcaacctctgcctccaaggttcaagctggtctcctgcctcagcctcctgagtagctgggattacaggctcgcaccaccacaccctgctaatttctttttttaattttatttttagtagacacggggtttcgccatgttggccaagctggtcttgaactcctgacctcaggtgatccgcctgccttggcctcccaaagtgctgggattacaggcgtgaggcactgcgcccggcctcttcccaataattcctccctaaatatcacttctcccaaatggggacttggggtataatgagcaaaagattcatttattagaagaaagatctttgtcttttcgtatagatagaataccatattcacatgtattagagtcatgcatatagtccgagatacgtatggaatcatataaacagtgggcaggtgtcattcatttattcattcacgggcactgcattgtagagtgctgcgttaggtattttcttaagctatgtttatgaatagtaaatttacagatgatttcagtatgtgtttatttcataccaaaagttggtcctgctaaaaatgattttaaatgttttggttttgacccaaatatcttaagtatctctaattaacttcctaatgtctgtagagagggtttatttaaaaaactttgagaaataaataaaattttcccagttttggatagagtggcatattaaatctggagatgcataaagcaaatcattacttataaaaataaacaggccaggcgtggtggctcaggcctataatcccagcactttgggaggatgaggcaggcagatcacctgaggtcaggagtttgagaccagcctgagcaacaaggagaaaccctgtctctactaaaaatacgaaattacccaggcatggtggtgcatgccagtagtcccagctactcaggaggctgaggcaggagaatcacttgaacccaggaggcggaggttgcagtgagctgagattgtgccactgcactccagcctgggccacagagcgagactccgtctcaaaaaaaaaatgggagtggaccacatggtgtgacctgccccagttgagcactgccctaaaatagtttggatggtcacttggtgctcacacagagtatgagaaggaggcagagggtcctctctttgctgggcccagaggagattgtgttgattctcatgacagcagggcacttatttttgtttgaagggccctgactaccttatttgtcttgcagttgttccctttgacttggaaattcatattgggtcactacttagttcataaacacacctacaaaaagacagaagaggccgggcctagtagctcatgtgtgtaatcccagtgctttgggaggctgaggtgggaggattgcttgaggccaagagtacaagaccagcctgggcaacttagtaagaccgcacctgtagaaaaacatattttaaaatgtattaaagagagagaagaaacaatgacaacctaattcaaactcaaatgttaaccattttgataggtgtatcattatgcttcagaaatggaataccgttatgactgttatgtttgttttaggaagggaatactgttttgctctaaattccagcatttgcaagtgagagtcatttttcagagccaaaacattttagtagacctctgtataaaaataatacagcttttagtatctcttgagaagataaaacactaccataaatagtatatttaagtagttttccatacacccttaaatgattgttacatacacaaatctgtacatttacatgtattgtatatgtttatatttgtatagatataaaaatgagctcactttagccattatttgatgaaccctgtgtttccctggggttttttggcccccagcttggggaagcctgctccactggagtaagacagactacttcagatggtctggtaggctggcactgtttctttctttctttctttcttttttttttttgacagagtttcactcttgttgcccaggctggagtgcagtggtgcaatcttggctcactgcaacctctgcctcccaggttcaagcgattgtcctgcctcagcttcccgagtagctgggactataggcatgcgccaccacgcctggctaattttgtatttttagtagagacaaggtttctccatgttggtcaggctggtctcgaacccccgacctcaggtgatccacctgcctcagcctcccaaagtgctgggattacaggcatgagccactgcgcccggcctatttcttttacccttggaggtagttgcacttctcacttggttcagtctcgtttgatgtcctgagctttgccataactccctgggaaactgcttatttttatactttctcttttattttagtctcttgaaatatcaaataccacaataccaaaatcagatgtacggttgcctcacataacccttgatgtttataagttgcttttgtcattgtgcggcatgcactgttatttatctaatcagcatttcagggaaacaccaagtcagaggaactttcttcctgttcctaaccgcctttgagatattacatacaggccaagtaccacaggcagggaggctttttaccgttcttacagagaggcaggtgtctctccacagtccaaagcctgaagaggccactgccacccagtaagatgattcttctgtccagctttcaagtccatccactacccctggagtaaggtgggacacaccttcaatgaacttagatcttcctcccagcctctgtccccatttctaaagtgcacaaatacatagtcccaatcctgtgacgttccttcccgcacacagacgaagatcctgctgctcttatactgtaagggtggtagacattaggcaggtctttttctctcagaaaccatgttcacagttaattaataagattatacatccataagttaaatttagaaaactgaagtcatgataagagaccacagttctcaggtaagtaaaattcctatctcaaagtagttttaaatgaatgtacggtggtttctagattaaaaaataataataattatgcaattgccaagagagtaaatttccagaggaatgggtatttttgctgtataagtattcttggagggcaaataagaccgaatctacaggccactagttttctaagtcaagtatgatcttaacagaatgccacagtaattatcctgtagttctctgcatgctctgttgattttaatacttttgataacttccattcagtagttcccttgaacatgaatcctttacaaccaaagccaggtttgtaagtttcaaggttatcgtgcaatctgaaactcggaaagatcatcacagggtccttacagctacccacataggccattccatcgttatcctggcttaatgaattatcagtccaaatgcaaagacatagcctgaagagaatacatggaactcaattatttcattatttaacgaatgcattccaaaaaaacatatctggcggtggcaggggggagagctagacaagcaggtatcagagggacccctctttttgaggggaaaggaattttgaaggctctgtactgaccagaaacttggccttccccacaatgttgttccagatagtcatgggtgacttcttcctactggcctcatgtatccacatgtcaagccaaagtggagagaaaagaaatgtatgaatcatgatgatattggtaataatagaacctcctacaacttactgagtatctgtcaggcactatgtcacatgctttacatttattatctctaaacctcacactaatcttaaagagcccaagatttttctcaattagccatgaaacattttgactttaaaatctacagatatcaaatcatttcctatggcatgcccccccaaaatcactataaaatataaagctgtgttttaggtcttttagttgtgtttctttcagtgctttagtagaaataatgatggctgatatttgttacatgcatattttgctccgggaaggcaccccctgagaaccttccatggacttaatactcacagcaccccatggaatcagtgcttttagttttctcagttcacagatgaggaacctagacttagttaagtgacttctgtgaaggcatgcctgtggcaaagccaggttccaactcagcgattatgacgtcagaacagagcttttatttactttgccatagaattaacatcacggttgggaatattggatgaatcccagtgcagctaaaccaactgctgtcagcagaggtgaactgaggtaatatacaaaatcgataacacaggaaatgttctagcagctttagcaagatccagaaagcaatcaggactgaacatgcatgttgctcctttctttttcttttttttttttttttaagtaaaaacaccatttttatctctaacctcttcctcacacagaggctatagaattccccatgtaagtttttgccccatcctctctccagaccaattattgaagttagtcttcccaagatgacaactgatcaaaagattcatgtaataaaactctaatttcataataaggatttttcacaatttgaaaatgccctcaccttaagatgttgaggaacttggttcagttacttcacaggccatttactctccaactgcacagctggaattgcttccttttcaatttcagccttctgaaagatggtctttccatattgtccttaataactattttagaccctacagcctctaatattttaattaattcttactcatcctaatatactagaaaatatataaataaaaaatttaaaattgtcattgtgtcttcaagtattaaaagtaggactcagaaactgaactttaaaaaagtaatatttcaaagtgatattttcttcagcagtgatatcacaagaaacatttttaacccagattttgaagaatggatagaagtatactaatatgcttttaaaatactatttcctgctgtaattcacaaagaagagaacaaactaatcaagtaatagttctgatttatcaataatctacttaatagccttttttatagtagatctttcttatgatttctatactttatttttactaaggggctgctatttcatattttataaaacagaagactcaacagaaattaagttaaattaaattaacagaaagcctgctttttaaccacaaaactcaggtttcaaatgatttggttacatgaattttctgaccaacttaactttagctttaatagcttgttagtttcagtacttgtcttcataagacttgtccagtaaattcacatatattttgctctgctaaggagcttgtaattcattgttcgaaaccctgataattatttcaacatttgccttaatgagaataatttagcaaatataaatttatctttgtatgctaatcaaagatattataattcattgtaagaaattccaattgttaaaagctctatagacatgagtatttgggtgattagtataaatatagaataacccccaaacagccccttgatatttttaaaatatttctgccataagtttattttattataaattttcctcttcggccaggcgtggtagctcacacctgtaatctcagcaccttaggaggccgaggcgggcgcatcacctgaggttgggagtttgagattagcctgaccaccatggagaaaccccgtttctactaaaaatacaaaaaattagccgaccgtggtggcacatgcctgtaatcccagccactcatgaggctgaggcaggagatcgcttgaacccaggaggtagaggtttcggtgagccgagattgtgccattgcactccagcctgggcaacaagagtgaaactccatctcaattaaaaaaaaaaaattcttcttcaacattttgggtaaggcaaggagaaaaatcaaatttggaaacatagtctacacagtatatgtattccgaaaagatagatataaattgaattttgtaaatggcatcataatttaaaactgactaacaaaatactggtgctaattctttaggaaaagaaataaatgcaacctagtttatctaccttgtttcatgcaattgagattgcaaatgttagatatgtgcaaaatgaggtcagtctttacacagaaagagatagctgtccataaacaatgttttagacaacttgataattgcactgccttttggactatccttgggctgtagattaaaagcagtctgtagttttagtgactgaatcagattcttggtctgaaatataattctctctgtctctctctctctctgtttccctgtctccctctccctccctctctctctcccactcatacgtacaaatacacaaagtatttcagtaaattgtaggcagtttcttccaactcatctaatcacacattttgcaaatagaaaaatattgggtatgtaattcacatttgtcttggtatcactgcctttgctatattttttgaattttttttctctctctatataacctgttttcatctgttcttggttttgtcctaaattatttcacaattaatgagaaatgggattctatcactttgcaaataaccatctctataacctagtagtcttcattattttatgcatggaatgtttttaggtatgacttacagagctggcttctttgatcttcatataaatccaagttgagttctctttgataagagaactgggacttgtacttgactggagaaagtcccgttgttaacctaaaggctgtgtggttcactgctgggtgtcagtatggaacgggtagctctattatttctcacaagttaggatctagccaatttaatattttactctcaagtatagtaacttatttgtcctatgtacttcactgcctttttacttatgaacgattgtctgcctctaaatttcttttagctatcttctcctttcttccccttcttctttttatttttagagatgggttcttactatattgcctgagctggagtgcagtggctattcacaggtgtgatcatagcacacgacaatctgaaactcctgggctcagagatcttccttcctcagcctccttagtagttgagactacagatgtgtgccaccatgtgcagctgtctcctcctttctagtgccgttgcctctatcttagatcaacccttacctgttttcctccaggctgtggccacagcctaactcattttcatatttccaactttacccccttctaataagtcttccatggcgtccagtatggtaaccatttgctgagtgcttatgactgtaaagaacgtgcgaagcctgaaggtataatactcgttgggctctactgtaacacttggctcccccaaacacaagtctacttattcagatacaatttgttaaggagagctctttatttttccaactctggatatcaagcccttgactcaactagacaatcttggctctgggagtgcctgggcatgttgcgtagttggttgttaggtgggtttaaactcagtgctgagtatgcctgtcagggtcccagcctctggggaggctgaggggggaggatcgcttaaacccaggaggctgcagggatccatgatcacgccaccgcattccaccctgggtgaaagagtgagaccctgtctcttaaaaaaaataaaaataaactcgctacttcacaaaatgaaaaagattttcgagaacgacagaatctacactctaaaataaaaaatatgtccaaatccctgtgcacacttaaacacagagaacgggtcctgatgacagtcaccaattcttcgagaccttaaccatctgactaaggagtagcctctgcctgtcccagcttggattatccgctgtgtgtcccaaatgctgttatctagaccggacctggtgcttcttacctccagccattgcctgtgaatgctgggaggggctgtaccgggcagcaccatctctttctcctgtgagcactctgtcagaggctgccctgattcctgtctcctttgttccagatcaggctgctctgaaaattagtattgcctctgcacactgtgatcatggaagagattttaggttccttgcttgaagtatgagcttaaaaaaaaaaatctctcattgaaccaaagcatgataggttttgtgtagttccattaacatcccctaggcaagagtggatcaggatgttgccattaaacacgtcatccacaatatcgtgtgggttatactagcataatcgccttttagatttatgctctgtgcacctttattaaatctcaccatgccttggcctctacagtgaagctcacggtatccaaataacattctctgctttttctaaagatttgggtattacctcctgctaaactgacgccctctccataccactctgcattttatttctattacttcttcaatttttttcccagaggtaaagacaagcaataaggctgagatgcaaatcaacgtagccgctagttagtttcatttgcgttttggtagtcattattttgttcttattttgccacccgttactgactaaccccaagcaacactgcctccaaaaacacgagcaatgattcttgatgtttttattttcctcacccagtctttcatcgtccagtgaatagagtgtgattgatttaacttctaaatatatgtttgggaaattttccctttcttttcttccttacagacatggtgctagtttgagcctttcttatttttgacatcaactgtcaaactttctttctagtttccctgcttatgtcccctaccgttcatttcccctccacttaattgctagaatgatccatttagaatatgtcttaaaattgtcaatggcttaatatgtgaatgagtttctttggctatcacacaatcttgccctttcagcttgttttgccttcaggcagtaatgggatgtcaatcagaaaacagtcattaaaggcacaagtttatttagacgtcaaaaagtggttggattatagtcactttgcttagatggaatgttagcccctgctgtggagctatccaactcctgagcttttttgtttgtttgagacggggtcttgctctgttgcccaggctagagtgcagtggcatgatcttggctcactgcaacctttgcttcctgggttcaaatgattcttgtgtctcagcctccctagtagctgggattacaggcacctgccaccacatcctgctaaatttttttttttgagtggagacagggtttcaccatgttggccaggctggtcttgaactcctgacctcaggtaatctgcctgcctcggcctcccaaagtgctgggattacaggcgtgagccactgcacccagcctaactccttagctttttgaacgccctctcgtgctggtttgaaccttagccatctgtgttccgtgactttctatacctgttgtaggctgtggagcatacctgtttcagactgcagtagttatggttgtgtcagggcctaggagaaattttcccttcaccctctgaaggttcgctgaaaaatcaactcacaaaaggcagattcatttgagaaaagatgtacaaattttcttaatgtgtacataggagccttcagattgaagacccaaagatacaggggaaactgtccatttttatgcttaggtttaacaaagtatgggcagctgtgtaggcataggattggacgaaagggtgtggtctaatgcgaatagactgagtggggacacccagcaaggcctgtctgtccagattcttgctggcctctctggtcagctttccttccttctggtgtggggtggggccctctctggaatcggatctcatacctacactcaaacaaggtgggtcagagagtgtctttatcgccagttcttacccagaaaggcggagcgaaagttagagtaatacttttaggttttaaggctggctctggggcaaaggggttgtggttactgtgacggtcctggaggaagagggattctggtttctatatctggcctcaggggagaattgggctgaggaaccggaaggcagaagtgagcagagagaagctcttgcttctgaggctgtcatctggggtactgtttcctgagcctccgcaattgctgcagatgctgcagcttttccagtagctcagtaatacaaccaatcactgacgtgctttgtaatacaaccaatcactgacatgtgcttttttttttttttttggccatgtgtaagcagcatttgtaatttagggcaggtatcactggcatcactgggaaacttgagggcaacgcaccacccagtggcttggcttttcccagtggagcctcctccaccaagaactctctgcagaggacatggctctttgttaggggcacacaccaggggccacagagcaccccctgccaatcatcctgttacactacacagtagttctgtgtttagaaaagagcagtgaattgaaataagaagtaaggaatttccatatgtcaaaacccagttactagctgtttgtttatttatttattttgagacagagctttgctcttgtcacccaggttggagtgcagtggcgcgatcttggctcactgcaacctctgcctcccggattcaggggattctcctgcctcagcctcccgtgtagctgggattacaggcgtgcaccaacaaacccagctaatttttgcatttttagtagagacggggtttcaccatgttggtcaggctggtcttgaactcctgatctcaggtgatccacctgcctcggcctcccaaagtgctggcattacaggcgtcagccatctcgcctggccaacatgtctaaatcctttctctgaggatttgtatctaattcagaacccgtcaatgccaaaaattaccccttttctttaagtgcatttctttatgcatgaatccatttcagtctgtctttcctacctatttcccatgacaaattccaaaatgaaattgctgtggaatccactggagtatttgttatatacaagttggttaagtgagattctttggcctaatccggagctttttttggcctatgagcatttgatccttgttcagagctggataattgtggtcaatgggatttctactcaatgagatttcaaactccatcactctcatacactcccttttcctggtccttactgatcattctctctggctaattttaatccaaatgaaattctgtgctgagaatttgggaccaaacttttccgataataatattttcaaaagaaaacaatgaagggattggccagaattatttgaaaattaaattctttcaggaaaactataatttgcccacattttacttctctgaaaaagaaattgttaatgttacagtgtgacaaagtcactgttcttcaagtttcttattgttgaggcaaagttctcagagaagaaccctagtccttcattctcagctgacctgtccgggccaatcagcagaaagtactgtctaggaccacagacactgagacctgactctgagcaagaaggcagccgggcactgggcccggtgcacccgggatcctggcgggggtgatgccactgccatgcagcaccaggtgtcgcccgggcgccatgaccgctgcatctgctgcagcagaacggatgctcacgccgctgccactttcctccactgccctcacctccttggcttattcattcccactggagatctgaacctaagtcgagcttcggttatgaggacaagggaagacttacctggtcttcttggattctgtgttgggatggatcaatagagtagaagtttggatggtagggaattacgcaaacatacagacaaggagttcaggaggtgctgtgacaccaaaacaagtcctctgtaccttggccctgacttagttcactgctgttgcttcagtggcatcagggcttgccctgtcactcataagagaggtaggctgagaatgagaattttggcccccggtgggcctatcgtcctaattcattcttctttcttgtctgtgtcatggattcttagaagcacacaactagtaaatcacatgttttcaagtctaaaattaaagtaagtgtgcaaagccatgtgatcagatgaaggggtcattaaaacactgatgcctggccatacatggcagcatggacatgggcccagccggggtgtcaggaggcatccccggctcagtcactggctccccgtgtgatcatgcccctcctgtctgtgcttcaggaaagtgctaggctccgaggagctggtctccaggcctccttcattctctgagagtctgtgattttcaagtcacagtgatgtttgctgagggagtgggttgcatcatctgggatgatggtgtgttttgttcttttgtggggactgaggtggcagctctctttggcataagctgagctgtgtcagcgcaatggagctgattggctgaacctcaaaagcagaccccagagagatattgattctgacagtgcagcaattacagggaggcactggtgccttgcgaggtaagacatctgggtgcttgtgacacggctggtcaagtcttcagtgtaacatgtgatgtaattggtatggacagaggggctctgggttcagaccattcttaaaaggaactggagattatgtctgtaaaactgaaaacctacacagaaattttcaaatcgatttttatttttgatgattactactaataaaaatgactatctctgtttatttttttttttacttctgaagccaaccaatttgttggaaaatcagtcaaaatctaattttgatgttctgcaagttccctgggggccatgaagcacctggtgagtctcacgcccacttttccccaacacctgccaacattttcttctgtgtttgatccttttgctcttgtctttttcatatttttccttcaatatgttcccataatgtctttgctcttttaaaacatgcatatttctgtggttctattgaaagaaaccggaatattttaccctaaaatatgcttctttggcatatttcgagatcggtattcagaggggctggagaacacaggaatagctctgaaaagctgtcctttgtgaggcagatttgcatctgtagggaaaatctgcattcgggaggtagacagaccatgcagacaggctccgaggcacccttgtcttcctcatccggatctaggaaaggttaactcatgggaaaaaaaggctaaagtctgacgctgctgaaggtctgatagagacttttaccccattcccatctgctcttcctgagggcagctccagggttataggagagttttatccacataacaagacaccgtttgctcaccaggcttacctgccttcactctcccataaccttgttgcctcctcccccggggaacccctagcccctgttccttccatcgcctggaatggaagatagtctaaaaacttcagtcagctgacccttttttgagtctcatgtttgtgggactcccatgtccatgggcatgttaataaattcacatgcccttctggctgttaacctgtctattgtcagtttgttttatggactcaaattatcaaaccttcagaagctggagggaagaaaattcccttcacctctacgctatctattccagatttaacatccatgagtgaggtgctgaagggcccgggtctcccagtatcttggagaataatgaagtttgacaagctccagccctgctagtgggtgggctccagcccaggaagcagctcccagagcctttgctccagcgcggcagtggtgctgtctggtgtattgcagcccatgcatcccgcctaccccaggctcacactcgcagatgttatgatcccatgtcaagccctctcaccacacatcactctggaatacagggcagcagaagacaatccatttcctagtatgataaggcctttctgtctcttctttcttcctcctcattccacagcatagcaaccccagtgccttcccctactctgtgcctgattatctctttcttccttctcctccacagctagcatccttagaaaattcaagaccagtaatttcactagctctcaatagtaatcggagtgttcaaatcacagaagaatatattatgtagttccctattcttgtttttttcaaggctataattttcttgttcacttgctcaaggtttctccccattctcattttctaaataacataaaattgaccattttagccatttttaagtgtacagccataaggccttaagtgtattcacattcttgggctaccgtctctgccatccatctgcaaaattttttcatcttccaaaactaatactgtgtacccattaaacaataactggccacctcaccctagcctctggcaaccaccattctactttctgtctctgcgagtttgacttctccaggtacttcattatgattggaatcatacaggatttttccttctgtgtctggcttacttcaccatgcacactgtccacaaaattcatccatgttgcgacatgtgccaggatttccttccttcttaaggttaaataatattctgcgatatgtatgcaccacgttttgtttacccattcacttgtccatggacccttgagttgtttccaccttttggctattgtgaataaggttgctgtgaacatgggtgcataatcaaagtccttatcagtagaatcgaatctatgggaatgctgacattgctctggggaataattaacatggattaatgtttgcaaaaaggaaatgttgcagagctctctagtggatgttttaaattatgtctctcctttgccccttaaagatacatgatgcaattctagaacattaacaactcccaagttccttcatagctggatattttctttaacctctttattcttctgtacactcaggttagtttcttaaagcaattgaaattcttgagtttactttgatgctcaaagatttctagtataagcaggaggagaagaaattaacttagcacccaatctaacattttatataaaatggaaaaatactttgggagaccgaggcaggcggatcacgaggtcaggagatcgagaccatcctggccaagatggtgaaaccccttctctactaaaatacaaaaaattagctgggtgtggtggtgtgtgcctataacactagctgttcacgaggctgaggcaggggaatcccttgaacccgggaggtggatgttgcagtgagccaagatcgcgccactgcactcccaacctggagacagagcaagactctgtctcaaaaaaacaaaaaagttattgtaaccacctgatgggctcttcttgcccactacacagacaaaaccaattcactgagactatggcattgcaatagtttaattggcacaagactggccacagcacgtaggagatagagttattgctcaaatcaatctctgccaaaatttggagactagggtttttcaaggatagtttgacaggccagggggtctccttgtgagtgaggcctcatagctggttggtgggtccgagtggagccattggtggtcagaagtgcaaaaacctgaaaagacatttcaaaaggccagtcttaggttctagtacacaatagtgttgctatctgcagaaataattgagcacgttgaaatcttgtttcctctaggataatggctgataattgtgtacgtctgttccttaacataattcaggtccctcattctcctaacctgtgttcttgtattagttttgcaaaggccgtgtaggtttgggaaaggctgtcatgcccaggaatgactaaaggcggtttggaggttaaaggcaaagtggggattgtttagatacgttctctttcactgcaataattttctcactgttactatttttgcaaaggtgatttcattatgatggcttcttgggtttaatttcacagatgctaaagtccacttacttttttgtttactgacacaaaataaaaaagtattagaataagcagaattaaaaaacaaagaataagcagaattaaaaaacaaagaataagcagaatctgaaactcataacattttagatctgaaaggaatctcagaggcagtctgtcctgacgcctttattttatagctgaagaaacccacacagcttaagtgattccctttcttttatttcattcattcgttcattcattcattcaatatttactatcagctctgtataatgcaacatgttcaatactataaaacatacaaatgtttcttatagttttgtcctacccttaaaaagcctgttttctagcaaggcagaaaacctaggcattggaattccacacatatggagccactcctacgttcaggcccatgtgctaggatgttgaagaggacaccaagatgaaaggagggtgtccccatgctcctgagtgcatacagctgtgaaggagcaagagaaacacacactgtgctgttagaaggggtctgagcagggcaccagaaagcatctggcctcagcaggcagaggtgagaccactgagtggagcgtgatcacgtcatgaagccgtcagggtgagactgtgggggagtccggaagcgggtgtgagtggaggcggccttaaagattctcttgtgggctctctcattaggctgtagagatagagacacacagttctaatcctggctaaacctctggattctcactgtgacactcaaacagtactgagcctgccacacagtcttcttgtcaggataagaggagataacatctgtaagtgcttcagagtccccagaacataccagaattccatagatgttagccacggtgacttctgtactgtaaagagctttgcaatgacaactgaagtaaattgaatggaatatacttgattcaatagaaaatgggtagccacaaaaggattttatacaaaaaagtgatatattaataaatacacttaaaaattaatctggtccaggtgcggtggctcacacctgtaatcccagaactttgggaggctgaggtgggtggatcacttgaggtcaggagttcaagaccagcctggccaacatggcaaaaccctatctctactaaaaatacaaaaattagctgggcatggtggcacatgcctgtaatcccagctacttgggaggctgaggcaggaaaattgcttgaacttgggaggcagaggttgcagtgagttgagatcgcaccattgcactccagcctgggggacagagtgaaactgtgtctcaaagaaaaaaaagaaaaaaaattattctggcagaattgtgggggagtgagtggaatgaaggaaggcaggaggtggaatgagtgtcaggaggaaactgcaatagctcaggtggcaagtgagtgatgagagcctcattatatccaatggagtaacagtaacaataaattatatagatgttcagggcgtaaaactgtcaggcggaggaggaggacagaagcacagattgggtggaaagaaggggaaaaagcaaagatgaacacttggtacccaagtgagagactgagaggaacatgaaaagataaattggagatcggggaatgataccgattttaaacattttgaatcgaagcagagatatccaatatgcaggccacagcagagttaggtgcaacagcatcatgtcccagaagcagtaactggacttcataactatgaaatcactaatgaatttgaaaaaaaatagcagaggtgaacacggagaccaggttagaaatgatttagaatgcgtgaatggtgaggcatcggaagcagtcttaaaaaaaaaaatgactgtggaaaaaatcaagtagggtgggagagaaagggagcaattgcattttctttctctattttaacattgttgcacctcattctgtttttcagtttagaagaaagtgcaaacagagagggattgattgagatgttttccagaaggagaaaatggctagaggctccagaggaggcgccaatgatgaacattaaaacctagttggaaagtttaaccttggaatggaagaaaaaaccctcttcctctaagataaaagtaaaacagaaaagggatgatagaaagcaaaggtgttaggtgaaaaagagggaagcttaggaagctcactcagccccgatcgcctcacaaggcataatgacagcagtcgcctgctggagtgtgtgctgggaaagagatacagctatgcactggcaatttggaaggcgacaggtgggccgaacacctactctgccctgaatacaatgctaaatattttcagtttatctcatgcagtttgcaaacaatcatgagagggttttcagatgagacaatgaggactccggggctttccctgtgttgagtgttcagaggaggagttgagtgactcccagtcatgcgggttggggtggacacagcaggctgctggggccacaccatgtgaagctaagcctggaagcactggcaggattttagaacctagagatggggaaggaaattcccaaacattgtgtgagcaatttagagttgggagaaggtaggaaaacaaactctagaagaaagaacactatttgtttcatatggttgctgtaacaagttaccatgaactggatgaaaaagtaaaagaaattattctcacacatttctggagtccagaaattcaaaaccaagatggaggtggggttacactccctctggaggccctaggggaaatttaatctttgcttcttccaaattttggtggctaccagcatgccttggcttgtggccccatcactcaagtctctgcctccatctccacattgccttctcctctgtgtgtctctctccaaccccccaccacccctcgtttctagggacacatgtgattgcatttagagcccatccagataatccaggataatcacattctccaaagaccatgttttcaaataaggtaacattcacagattctggggatttgtatatagatgtatctttgggagccattactagcacgagcattttacagagtatgataaatgcaatgaaaactcagaataaataaattgggacaggcaatatattgaatgccagaaagcaaaataataataataataataatatagaatgtcaggtttcatacagtttatgcttccaataattataatgaaaagatatgagttcaatgtacacacacacacacacacacacacacacacacatatatatatactatgtgagaatccatgataatttagtaaaaagtcaaacaaaaaagcaaccttttctatccaacaacaacttaagggggaaagttttgaggaacaaaattacagataataaattggataatttgttattaagaagatcagcaaccccatcttcttaataactctccagaagatatgaaatgattctaataataataattacaaataattgaagaatagtttcctatagtaggagggtgctaccacccctcagcttccaaagtcttgctaggttatagtttgctgcttgaaactattgaataacttgtttaacttaggttacagtagctcattttgctgaaatatcataaatagcatacttcaaatcacttgcaaaaaaatatttttaacataccacaaaatctgcagtctataaatctgcaggctgcatggtatatgcatttccagtgtcaaaccattgaataataaatgccacggtctgcgatgcccgcaagttttgatttttccttttcctgaagccacagcgtggttcttaacgaagcagtagtttttcaacccttcaaacaaccaaatctttataacagtttcggaactgtataaaagagggaagtgtgtttcttcaaacactgtaatttcgcttgctcaaagacttcctccatacacagagcaccttctcttctacccggcccatgtagggttctactaacagaaagaaatgtgatattatttccatcatcaattgaactgtgagcgcctatgtaggtgggtgccagattctcactcaacagccaagtttattatatgggctcgtggaccctcttttacttctacctactaaatgccttttccggcttccccgcagacagctgcccaggctgtttgtgcaactcaagtgtgctgcaaagccagcctcacctctcaaggcagcctattctgtcttcaaactggctggaaggtccttcctctttggccattctatcgctgcccgctggaaggtccttccctttactgagctgaaatctgtttctctgtagtttctgaccatttggtctaagttataccctttggggcaaaccaaacaaatcgcttcaaagcccagcttttcaaatatttgaaaagggtgatattgtcctttcttgcactgagtctgttccaggctaaatgatcagacctcttctgtcatcctttacgtctcccaagtcccggttctctcatggtgctgctattcttttcttggtacagatcttctaatttccttttagcatgtactttcccacacggaatcccatgttccagattgacctgagccgtggatagcagagcagaaccagaccaggccacaggccacgttgttttcttttcttttttttttcttttctttttttttttttttttttgagacagagtcttgctctgttgcccaggctggagtgcagtggtatgatcttggctcactgcaacctccgcctcccaggttcaagcaattttcctgcctcagcctcctgagtaactgggactaaaggcaaccgccaccatgcccggctaattttttgtatttttagtagagatggggtttcactgtgttagccaggctggcctcaatctcctgaccttgtaatctgcccacctcggcctcctgaagtgctgggattacaggcgtgagccaccgcactgggtggattgtatacttttcttattgcagcctagaacaccttagcctttctgccgcccacctcacatttcctttcataagagtttctagcaaggaatttaaacctctctggacagtccgggaacaagtcactatgcctaaatgctttctcagtcagtccatcgttttccccaatcgcccaggggcttgctatgttcacctgtaacacatcgtatttgcttgtgaatacttgtatttaccagcttgtcatgtggtttactaaggggcgcagtaacttacaagagacatgtctaatgctgtggattttctcggaacttttaaatagggtgacaacctgagaaagttgcctgttggcacctacgcatcaaaacagaaagtttaaaaatcatgcattacttactttatggaagcttaaatgaataagaccgaattcgtattttctaaaaagatgtgcccagagtgtcatgggaagtggagtgggcgtgtgtgaagcacgatttggcttcttttcatgctaccttttttctctacagagatgccaaggatattctagaggaatcttaaagagccaagtgttcaggttcatttatgcattgttatatattttattcttgcctaaacactttgaagagtaaaatgagagattataaaaatagctagttcatccttttatcatttgagtttatatgtgtagttagtaggcctaaggagatcatgagaaagaaactgtgaaatgttacgcttttgagctgtcattggcaatgcaggtgacctcaaaaagtgaatggagtctatgtgtatggaagtgatcttggtgacatttggcctctgagctgtagtgggcatccctagacacttctgcactctgagttaagccttcattatgttcttggctttccctaaaatgcttatttattcagcagtgtgagaaaatgaaaagacagcaggtgcccgggggtgctatgtcgtatttcaagggcagaaatgtgaaagcacaagagcgggcttttcctcgcccttgggctctgcagttcacataagaggatttgctaactttcccatccccaacgagccatcagagggctacaaagaccacttacttctagcttacgccttaacagctttgaagaagaggcctgtgagcttatgagtatctgtaacttcagttttgctggattgcaccttctttcccagcaacattaattaaacattttgatttttttttcttcttgttgctctccttctcaagataagtccaggcaggtgtggaggagccgctgcgtacattgagaacagatggtggatttcatgtatcaatttatgccgtgccaccacttcggctgcctgactttctgtagggaaatcagcagtatgactgtaacttgattactaaaatcattgcataaagtatgtagtaaattctcccaagaactgaaagaggagtatgccaatacaatacgagaactatctaaagaaactccctactgtctgagcattccgggaatacaccgactccatataagtctgtgtgttggaaacctcttaggagtcaagaactaaaggcagttgagagatcattgtaggaaagtggtcctttactgaggaaaccatagtctagatgataggtcagtggtcaactgcctgctcagatccagtcctgaaacccagaaaggccaagttgatggaaatcatattctcacctctactcagctctgctgggccctcattgccattccggatttcttttgttcagatcttactaatcctttattttttggagcctttattttgagcccttagcaaaaataaaacttttttattttaaaaaacagcacatgcttattttaaaaatcaagaaatacagaaatgcatgaagaagaattcaaaatgtcactcaaagtcccaatcaccctactataaacatcaggaatgttaactgatacatgttaacatttgtattaacaaagatttaaagattaatatttatgtctataagaatatccagatagaaatgataaatgggaacaattcccatatataggatctataaacatgccaatttaattttatagtcaggtttattgaggtataatttatgtacaataaaattcaaccattttagatatatagctctatgagttttgacaaatacagtcatgtaaacttcaccacaatccagatacagaatattacctccaccccgtgaagttccctttggaaggtaccttgaaccttcttcctcccccacctcctgatgaaaactgatcggacttctgtctctggggttttgctttttccagaaagtcttatggataacatcatacagtatgtggacttacgtgactgatatctttcgcttagcaaaatgcttttgagagtcctccacgatattgtgtgtaatgatcatttgttagttaaaaaaattatttttagatatacggtcttgctctgtcatccaggctggcatacagtggcatgatcatagctcactgcagccttgaacttctgggctcaagtgacctcccacttcagcctgagtagctgggactacaggcacatgccaccacacccggataatttaatttgttaattttttgttgttgttgatgaatactatttcattatacaaatgtaccacattttgtttgtgtattcaccagtcaaaggacatttgagttgtttctagtttcagctattataaataaagctgctttgaacatttgtacacaggactttgtgtggatgtaggttttcatttctcttggataaaaatcgagcagtgggattgtgtttaacaccataaggaactggcaaattgtttcccaaagtggctgcaccattttgcattcccacaagcagtgttatgagaattctagtttcacctcatccccaccggcattgatactgtcaggttttaaaataatgtagtggtacctcattgtggttttaattcatattttcctaatgacttaagcatcttttttctgtgctttgtttgtcaataatatatattcttttgtgaaaaaatctattcaaatctctataccattttaaaaattgaattgagtttttattaatgcatttaaaagttctttttatggtttaaatataagttcttctcctgataagtattttgcaaaaatttttccctgtctgtggcttgcctttctattctcttagcagtatcttccacagtagagaagtttttaattttggaaaagttcagtttatcaatttttttcttttatggattgtgctttagatactgcttctaataaatatttttctaatctaaggtcgtgaaatttttttctgtattttcttctttaagttttatatttttaagatgtacatgtatttctatgatccacttgagttcatttgtgtataagctgagatgtttgtgttttgatttatagataaccacaagctccagaattatgtgttgaaaaaactatcctttcttgtctttgtcaataatcaattggcatagatgtgtgggccttttttggactctctatcctgttcttttggcctgtgttcatatcctttcagctataccacagtattttattatcacagtcctatggtaagtctcaaaattatgtagtgtgggttctccatgttgttagtcttttaagaatttgtttggacaattctagtcttctactttttcatataaattttagaatcaacttgccgatatttacaaaaagaatgctgctggaattttcactggaattacattgagtctacaggtcagtttaggaagaattggcatcttaacaatattgagtcttctgatccatgaacatagtacatctttctactcatacagatcttatttaatttcttttatcagtgttttatagtattctgcataaaaatctttacatattttgttagattttactaagaattttgttttcaatgttgttttacataatactttttcaaataaagttcctattattcattgctggtgtatagaaatacaatggacttttgtatattgaccttgtatattgcaaccttctagacccactcattagttccagtagtttttggtagattctttgagattttctatgcagacaatcatattatctttgaatagaacaccttttccttctttcccaatcaatatgactgttgtttctttttcatcagtttaattttcaaaagataccaaatataattttgcattaatgcaagggaaaagtgctattaaagaaaccaaataaagaaaaacagataaatgttactttatcaaatgaaatattagtgtctaagagatcatattaaaataatgaaacaaagattttgaaaataattaaggaattatactcattaagtttttgtacctctgtttcaaatttagatattattgataaactcaatcatatgaaagataaacaacattaacaattttatacttcttcttttttcttcccctacctcctaatgctttggttacattgttatgtttattttgccaggattataacaccttaaattctgtaacagaaattcccacaataatttagttttagtttcaaattaaagaaagaatcaatcctcacacccattctctcaccactgcttctccattcctggcatttttgcttggatgaataacatatttcaccggatttcatcgtcagaagttgttggcattttttctcaaaaataattcgtgctatagtccctgaattctctagagatttatggttagcctaaatttttcaccacttgtagatgcctttcttttttcttgtctgaatgtctgaaaattctttcttcatgcttgatgtcaagtaattttgaaagaaagtattttggtgtcaattattctgtacccacttttcctggagcactttctgttatttcagagaattatccttggtacaaaattcttataaaaagaaggtttggtgctataatagtttcttctttgagaaatattatttatttggatcattgttgtctagcttccatttctttaatctcctttcccatgctttcactctcatatgttgattgctgtctctaatgtattgttctgtaaagggctattatttaatttctcaatttccttaactctacaatctcccctagttttattatttaaccatgtttgaccttgtttcaatgatattacattactaagtccttgcatgatgctaataaaattttactagtttttaaatccaagcttttgctcagcaacttccttcctcttttcttcctttcccttcctgtatcatccttccttcctttctctttttcttcacttttttctccccatcccctcttctgttcttcatccttctcctccacctcagtgctgtgtctacatagctaccatgccattttcatcctgcttatgcctaccacagacaatacttcccagatctcttagttgctatcacaaatgaggaaaatcactccgaacctgtcagcccttgtctgaccacagtctatttgcttccagcctatgagctgaaattcgagtgttctgttctgtttgcttttccgtactttgaaagcctggcaggagaggaaaggccactggtcctaagcacaatgtttgttgatggaaaggggtgagaaaatatcaaggagaaacttaaaagtatcctagttattgatgaatactatattgctacttttgtagaagattttgtaatagttttcagtgtttaacatttcttgatttaaaaatatgctttcaagacattctttgtctttaggtataactgacacaataacaaaacactgttttttccaagacaccattcattactttatttcttttacattttgataggtcagcttcaacaaggcataatattccttgttttgttttaataagatggcttttttcaaggaatcaatgtagttatgtaacaattcaaaggcatttgctaaccatatcacccctctcatgctccccgactatgcagagtaaaccagaagccagcataacaaaatacacctgcaaccatctagactaacattaaatgggagtgggttgccttgaaaacagtatataaaggccgtctcttcctgtttaagacagacggctctgagagattcagacacaggcggcagtcaggcagggtcgaggcagcctgcacaggggaaagccctgggaggcagaactagacagaaccatctggagtctgcacttggccaaacctcagctacgtaatcatggataattcacatcactcgccaaacctcaactctccaatctataaaatggggaagtgttcactttccttttgttcattctttcgttcttttattttcacaactgccgtgtcccggaaatctgctgtacgtgtcaccgtggctctcgtagaaggtcccagcacggggtcaagcagggcacaaagacacgtggacgccctgccctcaccgtgctgatgctccagtgtgcatgagggtgtttcacctgtgaacagatagaagctcagagagttgtgcatcctcatgagaaaaacaaagccatcagagaaatgcaaatcaaaaccgcaatgagataccatctcacacctgttagaatggcgatcattaaaaagtcaggaaacaacaggtgctggagaggatgtggagaaataggaacacttttacactgttggtgggactgtaaactggttcaaccattgtggaagtcattgtggcgattcctcagggatctagaactagaaataccatttgacccagctatcccattactgggtatatactcaaaggactataaatcatgctgctataaagacacatgcacacgtatgtttattgcagcactattcacaatagcaaagacttggaaccaacccgaatgtccatcaatgatagactggattaagaaaatgtggcacatatacaccatggaatactatgcagccataaaaaatgatgagttcatgtcctttgtagggacatggatgaagctggaaaccatcattctcagcaaactattgcaaggacagaaaaccaaacaccgcatgttctcactcataggtgggaattgaacaatgagaacacatggacacaggaaggggaacatcacacaccggggcctgtcgtggggtgggggggggggagggatagcattaggagatatacctaatgtaaatggcgagttaatgggtgcagcacaccaacatggcacatgtatacatatgtaacaaacctgcacgttgtgcacatgtaccctagaacttaaagtataataattaaaaacaaacaaacaaacaaacaaaaacaaagccgagtaacggatagaaagcgactggagagttggtgctgaactagctgctgcgttgatgggaagctctggcagccacgtgagcttggtctaaccaagggacaggaagatgggcctactgccacacacggaaagtggggagggtggacggggacgctgctgggagggagcagagcccaggtcgtgtaggctgaggcgaggcactggaattgtgctgtaactgcaggcagcagcaatcgggctctccactggggagtgatagaatcagatgtgaggtgtggagttccctgggtgctgggtggaaagcgcaatgcagaagagcaagagtgtcagcgggtcccagtcaggaaggaatcccggggtccaggacagagaccagatccgcttgagtggaggcttggcattggaggtgatgggcgatcgttctattcagcaggtccttagcggcaaagtccacaggacatgctgagggcttggatatggggatggggaaagcgaggcgccaggtacggctcctgggcttctgactcaataaattggtagatggaggtgtcatttaccaagatggggaaataaggcggagggacgaggtgaagtgcggagaggtgggcttgaatcacacacttgctttgcttttaggtctttaaataagattttatagtgatcctcatatatggatattgtacaaaatgtattgcttttcagatcatgttaatgcttactttttcacgtttccactcttacttaattgccaaaatagagaaaacctattcaaaaacacttatctggtatacctgcaaattctttttttaattctctcagtttctctttagctagaatcacttgttttgccaggtacaaaatagtatcacagcaataggagataattggctcttttctttttcaatgcttatgaaattagattttaccttaatcatatgtactaaaatcctcaaggcttttaacagccgtggaacatgtttctgcctagttcctgattttaactggaaatattgtaatgttatgccttttaggatactgtttatttttgtttttttgggtaaagagttgctttatttttctttctttctttcttttctttcttctttctttcttttttttttttgttttttgacagagtctcactctgtcacccaggctggagtgcagtgatgctatctcggctctctgcaatttccacctcctgggttcaagcaattatcctgcctcagccacccaagtagctgggattacagatgtccaccaccacgctggttaattttttgtattttttttagtacagacggggtgtcaccatgttggccaggctggtctcaaactcctgacctcaggtgatctacctgtcttggcctccccaagtgatgggattataggtgtgagccaccatgcctggcctaatttctatttttaatgagcaattatcacagaattctatcttttcagtatatgattatccaacttttttcattttatgatttaaaataaatagctgtattttcaatgattaaatcaaatatatgtgatgctgattgcttgtgtactctgaatagttagagaacattgaagtttggtatagtttgcaaatgcatttgaattgttacataactgcattaatttcttgagaaaagcaaccttattaaacaaatctcttttttttgcttactttggctcttttaaaaaaaacaacctttaatgttttttaagatcagcctttaattttatagctaatatgtttaatagatggtaaattataataataggttttgtctttctggttcttttctggatggttatattaatatacgacattattatggctgctgtttatttgtgcctccagcaagctatttttaaaggaaatgtaattatgtttctatccttcatgatccagaggttattatggataattttattcttttattgaagcagatctctgacttatggcctcatcatccaagagaaactgcatttcaaaatcagaaaaaggcttaagctacaaccatgactaaaagcaattaactaagagaatatcttgttattttaaccttatcaacacattttctgattcttaaagtttggtttgtggggccatgaatagttttatcatatacttcacaatcatgctaatgtatacctctcattccagcatcctacgtggcttagcacttaacctgggatttttattttaactgaattattatgtgcatttaaataagccaatagtagttagatagacctctactttctacttccaagttctgccataatttgaattatggtacataagacacatgggcagaaaaagagggctcattcagacatggaggtaaatccaaaagctcaccagtggtaacttttctcttaaagacacttggcgggcatcttaaaccaatgcttttctttcaagcataggattaaaagtgcttagtgataaaacaaagtgcaccagggacttattcagctagggacagctaattccttccagtcttggtggaagtatacattagtaaatcccattttgggggtgaggcattttatcagtaaagatcaaagttcaaaatatttaaaactaggccaggtatggtggctcacgcctgtaatcccagcactttgggagactgaggcaggtggatcacctaaggtcaggagctcgagatcagcctggccaatatagttaaactccatctctactaaaaatacaaaaattagccaggtgaggtggcacatgcctgtaatcccagctactcaggaggctgaggcaggaaaatcgcttgaacttgggcagtgggggttgcaaagggctgagatcgtgccactgcactccagcctgggtgacagtgggactccatctcaaaaaaaaacaaaaaaatttaaatcctaaagcttgcaattcttctagtattctgcaatagagaagtactttacactcgcgtcaaaagttgtatggagaagggtacaaaacacagagaagagtttgttattgagagaaactgaaaggaatacaatgactatgagtcagggggaaggtgattaattaaaatacaacaattccatattatggtacttttaaaaataataatatttgagtgtaatgagggggaaaaagtcttggaagtcatgttattacctgaaaaaacaccaagtcaaaagacaatacagactctagaacgccttttatgataagccaagcaacactgtatatgtgtgtcatgtgtagttacatatgcacgtaagcatggacctgatcagtcctggaaagacatatgcaaagcactttccagggtttacctctaaagggagcagagggctgcaagccagggccaggagggagactttcatatttattctcttcacatctgcgttgcctgaaactttaacagagaaaatttagtcatagattatgtgcataattttttaaaactaagcactgtaaaatgaaaagtcactctctacaactatatgcttcaacaaacatacttcctatgcagactcactcagttacagagcgatgggaattggccacagggactaaatccctgcctccgggagacgtttttggttttattttttgttgtttttaattaatttttttagttgataaatgaaaaccaaatatatttatggtatactaacatgatgttttgaaatatataaacattgtgggatggccacctcaagctaatgaacatatgtatcacctcatgtgcttatttttttgtggtgagaacacttaaaatgtactctgtttgcaatttgcaaattgttattaactatatttactatgtcatccaatagatatcttgcatttattccttactattttatttatttgttcttgccttatttttaaccaggaaagttttaccctcagatttggatgttctataaaacaagtagttgaggacatacttcctggtattagaacttccagggaatttccaaatgactgcctcacagtttctctgagtcacccctatactttcatgaggaaatctgatcccattcagccagatattccataataaaaataaaaagagtccggatttttaaaatataaatattcacatatgtgaagcattgtgccaaacacaatatactgtagcatgcaaaaaaaaaaaaaatcagggtaaggtaaaaccaataatagtgctttaactttgggataaaataaatggcctcgttcctatgttaggagcaaggtcactcacacaattccagccaaggacaactaatggaaggttagtgtcagcaagtaactgaacacaatgatgaaatacataaagatacagcagagtttatttacagttagcttccttatgaaactatctaaaagtatcagtagagaatggaatgtgtgtgggaaatggcattagaaaacgccttggccctaaagctgcttcttagcttgattaggaccttaaaaatgcattttgtcaattacaacagaaatttggaaatcataagtatgaaaaataagaaaattaagtcattcagcatgcatctttggggcccttatttttgaaccaggcctgttccaggtgctgaacaagactgacccgaactcttaccctcagaaagcttgcattccaatgaacagattctctgtaatttcaccgccttcataaaaccattgggttatatcttttttgatcttttctcctcgagttatgcatgcctgtttttcacagaaatattgggatcacagcgagtattttatacttgaaataaggtagccacattttccatattaataaatatttttcaacagcattatttttggcacaacactatgttccagcgcctcagcaaaccgtagttcaatctcttatttgttcagataattttattttttcattattattaacaacaatatgatggacatccttgtagataaatttgtgcacatgtctaagactacttcagaataaagagtaagtgaaattgcaggataaaagggttacaggatgctcttcagttactgatgaaagttaacatactattttaatattaaaattaatgtttgatataagctagcaaagcaaaaagttagacgtttatattttatttaattaaaataagggggaaatcacattatttagtttatattggcataattatttacaataatataaatgttcatgttatatttttatgtctgcatacaatagtcctctttaatagaatagttaacatattttggcttaaaaagccatttcttacacattattctaggaaatatataatttaaaaattatagttttggacagtatgcagggtaaattatgagcgtagagttgcatcaaaccccagtctttctctaaagtattcattttttatgtagaagcagagattgtaatcgctgttacatgattgatctacccttttgatcagctcttagcagcaaagaaaaatagatatgcatttccctagattttgaattagaatttcaaactgtctttcctggttcatgcttatcaattttcaaagttggaaacacaactaaagctgtcaaaaatataggtagcttgtgctataatattaagacatttcttatcctgctggatttgtattggaatcagtgggaattcaagtagtaaggcaggatctattggcagctagcactcaggggaaggaaaaatagaagcgggcatcattaagaacaggtttctcttgctccatctccgtaagtccacataaggtaaaagacctatatacacttctgagatgcaaacggtgtgtcagaaaagattcaagaacagtttaaaaataaaagtcattgcaacataccagatgaggaattctatatggggaggagtagctgggctgctctgtaagtcttcatctgggtgagttgttggggaaaacacgtttttgtgtaacattcattttatagtggcccttatttatcattttattcttttacccaatatttaataagcatcctctctatgctaggctctctgctaagcacagccctatgctggtgactaaagcagaggtggctgacgtacctgccatggaggtgtcatccagcctatgctaaaaatatcccagcgactcccacctctagtggtcaccaatgaatgtgaaggtgagatcagtcacagcagccgctgtcctcctgaaaataatgggaggtgtagagggttcctcccttcccagcattgcatgggagaaaggcctgaggtacccacctctgtgggacaagatggaagctcaggagaaaggaagaaaagatcctccctccctctttctccctctccccaaccacatttctctttttctcttcctgaaattaatctataaatcattttgattttaggctctggtggcttagaaaaacttagataaaagataagcaatttcttgtggccttttttggtatggagagtctaaataattcaaaacacaatgaaaatattttccttgaaagtgattgttattgataaatatcatcattcttcgttgtcatcatcactggtcatttactgatatttagtgcattccacgcgcacagatgttggcacgtgcatcttgtgaaattcccacagctctgccaaggaggtgttagtatcccccttgtacagatggaggaaaatggaagctaaggctatgcgtgtggtttgcccagggtcacacctctaataagaggaatgacccagattagattagatcctcaaagctataaatcatgcaccagttgcccaaattaactgcattcactgtatgttacacgcctctgataaaagttgcctgtaggaggattcatggaatttctcttctttcccctggatttctccccagatacaaacaaaatcagagtttctattaagggtgccttcagaacatgaaaatgaggctagagcatgatgacaaattgatgtatttttcaaatccattgtattttttaatataacacttttacctcctaaatttacacacgtaaagtttttaaaaagagaaaataaatgtttaaaagtaaatgcatgccaatttcagtgttttccaaagaaagtctgtatggtttgctttgatgagcagtatgacattagagatggatgacagtcctgagagaaggaagtcacatctcatacaaaccaggcactgtcatcagtcacagaaagctgccatttgtcaaggtattctgcacagggaaatgtaaactcagatctagaaagccagcacaataccgaggggctgcacattagggaacaggtgtatttccaagcaagagtgactcagatgaaacgatctccacctttcacaggacctgcaatatgccggtcagctacagaacagcctttgggtggagagagaaagacttgctgtcatagaggacatttcctcattagtgaaggcaaggaaaggaagaactgcaaaacctctttcagcaggaaaccactgcctgcatgtcttgagaattttagcatttccgctcttgtatttttcttgtgagtgtgggttttagcatccactaattacagcatccctgaattttattccttcgctaggcattatatgtaagtaaagggaagctgtgctgggctttctggagggcccaggcattcctcatagcacttgtagttacctaagctctcttagtgtttccatttgtaaaatccatcttttgctgatttgtattttcgctctaaggattctttgtttcatgggcttagtgtttttctgagcttcatgtcctcggtattctcggaaacgtgaatattttgaaatacactgttaagaatgaaaaaggatttcacctggctaactttttgttaaggtacaaaaaaaacaaaattcacttttaaaatatatttgtcaagtgcctgacatgtacactatttaaagacgagacataaacattgttttgattacaggggaatagactctgtgtggttttattgattcaaaggtgcatactaattgctttttgatagttgcattaactttgtatttgggaagttatttcatctgactccctgaaacttgcccgagggtccagtaatcactattgtgcatatggagagaagctaaagagagtgaccaatgccatctaaccctgtctcctcaaatcctcgcacagtgatggaggcatagcaggtgttcagaaagttgaaatgaatgaatgtggcttctttccttaatgttcatggaattatttagaaaaaaaaggaatccttgattgacactgggtctgtaaaagcacagcagtgggctccttcccatcacatcacctcaccaaaggtggattctgaaaactctcccaaggcccagtcccaggattcaccgggcagccctcacgacctgcgcactcactgcagaagctgcctgagagagcaaagccggagccgcatggttccccctgaggaacgagcgcagcatccgtccaacgtgccaacctcagacacgagctgggcagcgttttcagatgctgacagcagttcggtctcattagagacacagatattgtcatcaaagttcaaacaggatcagagacaaacagtttgaaacataacactgaaaacgtggctgtgactgccaattatttcaaataagcctcctttgtctgggtagttgggatgcccgcattgggtcatgaaaagaagagatgcagggctcagagctcacagtcttctgtgcgaccccttgggtcaggctgtgttatgtcagactgcagtgtctcgtctcctgaagatttcacgaattctgcaattcccctacgcagggaacccaacttttcattcatgtttatttgcagtagatctcaatctgtgagctctagataacgacaataacattttcctcacttaaaaggcagataaaagcagaagtttagagcatacaatggcccaataagtttgaaaatgcagtgttaacagtgtaaattactgtagtggttagttgttataattattttatttctaatttacagtacagttggttgaaagtcttactccctcagtaaacaattaagaaagatttttcaactttttatcctctttaaacttatatacataaaagaacggttgcatcttatgggaatattttatttgaagaaaatgttaataaattaactgacacctttaaattattcctcgagaaatccattctcctggaattagaaaaagaattttccttttgcagctggggaatttgctaaatctgcagagtcaaagcagaaatgaggctcagtgattcccaattccatggatttgtctatgagactttgctccctgcctggtgactctggcagacactccacttgcctacccaaactcaaatttcctttcttagtaagagaaccccatttgcatcagaaatgacaacatgcacaagtgacaactacattttccagcatctgtttcagccagcttggtgaatgagtgaggcttcaagaaatgttcgcatctgccttattgctcttgacctgttggctgctgcttcttgctagaatgtgcgtgtgggagctgagggtgcagcagccatctggtaggagccaagtatgagggcatatgcccagggtagcagcataaagacagaaggagactgagacaggggtcatacagtgggcccttcagaaaagtcttgatctgcctatatctactgttttcagtagaaaaaaataaaccttgtatttgtttaacctgcagttattccagttcctcctaccaactgaatacatttcctacctgaaaaagtgtcacaatgcagttctccagtgagtcagaaagattaagaaaaagtgtcacaatgcagttctccagtgagtcagaaagattaagaaaatattttctctcaattatttataagatcgctattcttagagtttgctgtttggaatagaaaaccacctgcccattccagtgcctggtttgttgatgtggtactctcctcttccacactaggcagagttctggtcagttttcacttgctcaccaccaaaggcaagttcttggccaacagtccaagcgttcagaagtttgctgcgattgtgtatttctcatatgctccataaaatcagcattgtttctcctccaggttgaacccctgggattctgtttgtcttcattaccctgtatttaaagtggaatattctgtgctaacttaacgaacatgtgatttatagctgacaaagtgtccaaccactgcctgagacaagggatttttctctactgattcaaaaataatactctttggtagaatattgacacagcatgacttgcccctggtgatggagacagcgtccctgtcactgttttgccgaacacctttagcttttctctattcccctaaacaggctttacagagagggcacaacatgaaaaaaattacaaccggtggtggcacaaaaaacgtggtgcttagccaacactcatgatattaaatagtggtgaggcaatttactaaaatattcatttgtctgtgtcgtcttcgttttttccctccacgcccctcaacctagcactaatccctccttcttgaaattttaggagctggggtgtcttttagaaagtagaagctttcggctgggcacggtggctcatgcctgtaatcccagcactttgggaggccgaggtgggtggatcacgagatcaggagattgagaccatcctggctaacatagtgaaaccctgtctctactgaaaatacaaaaaattagctgggcatggtggcacacgcctgtaatcccagctactcgggaagctgaggcaggagaatcgcttgaacccgggaggcggaagttgcagtgagccaagatcgtgccactgcactccagcctgggtgacagagtgagactctgcctcaaaaaaaaaaaaaaagaaagaaaaaaagaaaagaaaagagaaaggaaagtagaagcttttaatttctatttgttactctacccctctaactaaattcctgttggaagttagaggcacttattgtcttttatggaggctgaaatgaactgagattagggaatgtcccgaaggaagggaagaaaggacttggcctttaaaggcctcaagagggagagattttctaacagatgagatagagctgggacactatttgtgctatgaatagttggtgggacccctgagggttagctgtgtaatgcccctagagacggtgccccctcgaggtgtaggtgccccagcctctctggggactcccagagccaagtatggcaacaagcagtagagtccccagacctgaaggtaatttagagagagtcgataatggactacatctgtcctaatgcctgggacctcccttcaatcctagcctagaccggtgtcaggacctttgcatgacaggaatagagctcaaggaagcaagcaagcagggatgatttgggtttcatttcctgtcagtccaatggttgaactcaaatttgagctgacttaaacaagaaatgtgatcattcctccctctgacttcttggactaagattgtccacctactgtattatagatgaaaatgaaataaaagatatgcaaacatagatcttgcagacatgacaggaagtccgtccaccctggtgcattttctctctactcgtgcctgttttcatatcaggtgaagagggatcatcttgtcataactcaaagcctaaagtagctaaaagttatttagccctttgctaataggaagttctattttcatctttaaaataaaccttctggccaggcgcggtggctcatgcctctaatcccagcactttgggaggctgaggcgggcggatcacgaggccaggagttcgagaccagcctgatcaacatggtgaaaccccatctctactaaaaatacaaaaattagccgagtgtggtggtgcatgcctataatcccagctactcaggaggctgaggcaggagaatcgcttgaacctgggaggcgggggttgcagtgagccaagctggcgccaccacactccagcctgggtgaaagagtgagactccatctcaaaataaataaataaataataaaataaaataaaataaacctttaatattttagtatacattgcgttactcctgaaggagatctctcctcattagagcactgtgttattttctcataactcagagtcctgcctttattcccttgttctgtaatgccaatgcttgggcatagaatgcacactgaaacaagcaatttgtattaagaaatgtacatttattggtgctggcaattcaggatatggtagcaatagtgataaaataaattgcaaggtggcagtaatctacgagttttactgaggtttcaagacaatattcaagataggaaacaagtagcttgtcataaagtataatttgttatgtagattagaactgtcaattttgagatggagaaaaaagagaaatgaggtgaaactgtctctgttttgcctagaaataattctttctaatgatttgaactaaagcaagcgaatccgttattacctccactgtataggatggaacaagaaacaggaggaagaaacatgacgctcttgaatggggctcatgtcccttacaaaattgaatgtgcattaagtgcaatatgcatgtgagtgtatacttgttttccataggagggacagttctatttaagtaaaacccagttccaaggcaaagtgtttaatttaaattcagtcttcttactaacaattagggtaagtgaattaaatgaaattaagtctgatttgggacaggttctccatttcagcttcctggtaaacactgcgcttggtttgtttgctgagaggctgggaacactggcacatttaatctcagcactggtactcagggaacgctagcaaccccggccactccttggtaatcagtatcttacaatgacaactggctggtgacaggaatcttttaaccacagaaaccaatgcaagaattagaaaacagaaaacactcttaaatatggctgcattttttaggctttctaggccttctggaatttcctttggcaatttgtacatatcaaaacctgcatttcctgggcgagagttcacagagacccatggcaaaaagcctagttacatcatgccatttgaaaccagtttgtggacagttggtatttcagagccaaccctgttttatcattaaaagaaaaatctcagcaccttgtgtaagataaattaaaaggcatgtttatcaagaaagagctagaattttcatagtacagtatctgataaaaaattgggagcagactttaaaacccgatggtgccacagcttgactagcgttctctgagaccagaaccagaggtcacattatcgaggactaaagaaaaatataacgtgcttaaagtggaaggaaacgtctaaaagttaggctaagagtgccttgaaaatgtcctgagtggatgaactcattcctttaggaaggatgttcttgaaatggtgttctgtacgtttccgtgttcccattccagaacttaatacccgttaaagcctatagatctcctaagtctttcaggttttgttcttatttttgttgttgttttttaaccagttctcaagggagaccggtaataatacatctgctgattttaggtctgaggtttgcatatgacacttcaaccaggaggatgatttccaatagagttaaattagtgggtgttgatgaggatgggggagtggggcaaggagtggaagccagcaggtagatgcagcagccacagtggagtccctgaaattcccgccccttgttcctgtgcagggggccgcggtgcgctgttgtcaccgcacctcttaacgtttccgtcacttgagttggaggttgataactaaacttatgtgaactattctctttgaataataaagggaactctaaattactccatcttggcagccatatcaaagacaggaaaacgcaacagaaagatgcccatggtaatgtcgaaactgagctttcattttgggagctgggaaggtagcaagaatatggaccaggcggggcaggtaaagattgagcccaaagcatcggctcctcctcttctgctgtccgcccctcccgttcatccttcccccattctcagtacacacaacccaccgtccaggatatgcttttctttttcttttttttttgagacagagtctcactctatcgcccaggctggagtgcagtggcttcgtctcagctcactgcaaattctgcctcctgggttcaagcaattctcttacctcggcctcccaagtagttgttattacgggcacctgacaccatgcccgggtaattttttgtgtttttagtagagacagggtttcaccatgttggccaggctggtctcgaactcctgacctcaagcaatctgactgccttggcctcccaaagtgctgggattataggcgtgagccaccgcacccggccgttcagtgatctatttgctcttaccaaggcgttttctcttagtaaactgttaaataattctttgcctgcctccacttcccaaatctttaaaattaaatttgatgaagcaaatatagtgatagtggtgatgatttcaaatcttcaaatgtaatagtaagtttcagctggatgtttctatcctagttttttgctttatagaaaagtttacaaatcagcatgtaaaagtcttactgtacaagtaataaacggagcatcacaaaaataaacgtggtcctttaattctaagagaccacttcttttcagggcttttaatctctttctttgaatctaatgtttagttgtggggaaaattcaatgtgatattctttgcttcaaaggtattttgttggtggcatgagtgtttttcttgaggtatgtttttgcccttctgttacactccggctttttatagtataatgagaacaatgacctcattctctccagttgatagtaataatggcacactttttataacttgaaaaggcatctgcttattgataagagagttaaaattaactataacacaagagttagccattgcatacttcaccttatcttgcagaccacaataaataggatggaaaacatggaaagcttgtggttaatctttgtaaataataatctgtgttcctgtagagacctttatcttctttttatgctttatttcatagctaaaaaattaaagaaccccatattgttaaatatagccctttctaaattgtacaaacaacactaaaatggggagaaaattaaaggcttataatgaagaggttatatttaattcacaatcatagcatttgatagattaataaaaatgtaaaaatggacaagctgatttttcacactttggaggtgacacacatcttccacctaggtccacactccaattacagtttctgagtatgtctgcttagaaatcataaaaataccattaaaactggaggtttaattctaaacaagaagaaggatgataaatgaatttaaagaccctggcaagataaaaaacttgaaaactgaataatgaaaataatcctatgcaatagcactggtatttctaaactaatctgtgaaataactcaattctaaacaaataagaagacagtatattaaacatgtggtcttttgtttatgaattaaagctgtgagtatattgaattggagatagtgataaattccagaaggaaataagcataggacgttgcacagtactgtaatgatccatccatgtacctgtctccctaactgaattaaaatatccttataggactgcatatcatttttatctctttttcaacctcagtacccgacattgcctggcacacacaggcactcaataaaggtctatattatacacattgttgaaagaaggcagatcccatcattcctattctaggccactgctctttaaaaatgtttaatgccgtgtttcccctaatgtaaaaatgcaaatccaggtggagggacgtgcctttagtctaattagcatggtataccttaacataataatttaaggttcttgagagcttctcaagattccttccgtgtcccacctctccactggcctggcgtgcagtgcattggcacaggcagggatgagggggcatagaggtaggcactagacccgtgagcaggtttgactacaagagtcccaggggctctacaagagaaggcggatgggtactaacaaattgtaccagctgcccaactgtaattatgttcaggcttaaccaccaatccagaggtgtcaggtgtatttgaggagggaagacagccccaccaccaccctcagtggaggggaaacaagagggggacctgaggttgaagggcagaggaagaagaggcaagcttcctcacaccagggcaaaaatgatcatgtaacgtggaacattcatccaggaaatatgtatttcttgcatattgtgtgtgaaatactattaactgtttgaaaaatacatcacaggcagtggctgccttcagtgagctaagagttttgtaaagaagtcaagggcttagttaagtgcaccgcaaggtaagcagtgatctcagccaccagagggatctaagtggaccttgtgtttaggaggagaaattcccttggcagccatgccatcatggcgagcctggactcccatcttgggacccaccagttcacagtccttactgtaaaataaatgcaatttgctcaaagtcaaatatatcctgtcgctctcatgcctctacaacctgtcagtagccattcttcattgcttttcacatcactgaaaccccataccatgtcctacaaggctcaaggccctgcagaatctgcctgtgtgcagtttgaagctgcaaagcctggcaccttcacaccggatctgtagtcacggcccaacacctactgggtccccctgttgctgttgctcttagtaatgcttctctctctcttttgcacttgcaagcacacacacacacacatatacatacactgttttttattcaatttgtatagtgtttctggaaattttcttcctctgcatactctctactccggtagttgctgtggttgtaatgctctcctccctgctcccagcaccttgttcatgccaccgtcatctctcatccggactattgccagccttgcccagcttccagttgccccctagtatcaagtatccacacagcaggcaaagtgttgtctataaaatagaagtcagggctgggcgcagtggctcacgcctgtaatcccagcactttgggagactgaggcaagtggatcatgaggtcaggagttcaaaaccagcctggccaaaaaccccatttctgttaaaactacaaaaattagccaggcacagtggcaggtgcctgtaatcccagctacttgggaggctgaggcaggaggatcgcttgaacctgggtggcagaggttgcagtaagccaagatcgcaccactgcactccagcctggcaacagagtgagattccatctcaaaaaaagaaagaaaaaaaaaaaaatagaagtcagatctttttccacccctttaattaaaatgcatctggaataagatccagattcctctctgggacctctaaagcactctgttagctgcctgccttctttctcctcctccagcctcatcatttgaatccttcctgtcctcccacctacactagcttccttttggtctctcaagcactcaaaacacattctgactgcacagactcacacattccgtatgctcatgtaaaccaaaaataaaattctaagccccccacccgactgatggaccccaccccccattttcagcgaaggacattccaaagaaaccttcaccttcagccaagggcattccaaagaaacctgaaaacattcgttcaggccacagtgggaagtggaagttgaacatccctccttataccctcctacctttggagttcaggcactgaccagcatgaacattaaaacagaaatctgccgacaaaacagactgtttatagcaatgatgccaacaagatagacagcaggccctgaaagaagttgaagtattttaccccaaaatgtatttctttgacatcttttgaaatggcccagcaaagctgtctcatggggaaagtctgcattctacagagaacccctttccctttccatgatccaagagagaataagctaagagtctggcatctttttaagtctgataaggaacatttaccacctactgtctctgaagcttgctactggaggcttcaccttggtttccacgacctcttatcttcacccagaccctcctttctattgagtccaggtgtttagataataacctaactttttcaaccaactgccaatcagaaagtctttgaatccacctggaagcctcccaccttcgagttgtcccacctttccagactgaaccaaagtacaccttatatgtcttgattgatgtcttatgtctccctaaaatgtataaaaccaagctgtagcccagccaccttgggtacatgtcctcaggaccccctgaggctgtgttatggattatggtcctcacatttggctcagaacaagcctctccaaatattttacagagtttgacccttttcaccaacaccaagaacattcttctcgcagatgctcccacaactcttctgttgaatggggcttcagcgtgagtgccagttccatgtgaggccctttctaaccagccaagctaaagccagccctcaggcactgctttgtcacgtgctctctttattgtctgcatggcactcattatcgaaattgtcaactattaatttgtttacttgtttgtttatttaccatcatcctctgctctggaatgcaagcttgttaggaagaaaaaccatatcaaccttattcatccagtagctggtgcagtctttgagacttatagggttcaacagttgcttcccgaataaatgagccagttttctttctcttgctcttctccatctccatttgctcattatattttgtgtgatcctttttcgtatgtagtggaaagttttctggaacctgcacctgcttatacaattacaagtgaccttttatgtatggaccacctttaagcaacctccaatgttaaaaaggaaaaatatgttaataataaattatggaaggatcttgagcatattgttaaaaatttaaatacttagtgtcatgtttacttaccattcatctctctgcatgactcacagtgtttgcttctttacctgttcattgtctctaagcacctgcttttggaactaattgccatcagcaccttagttttttgttgattatgcattccctgtagctccaagtttctattgcctctgccatatgctcccatttattcaccatcttttataggtcacccattgtgccctgggcggtgagaaacaaaggtgacttaaaaatgatccctgacctcaggaggcttacaaactactaaaggagatgggtacataaaccagcaaaaacaatatgtatcatagggtctagaatacacatatttatggggaatcatgggggcccaaacaagagagagtggtcaattttccatgagaatgagggagtcaggaatgctttagggaagagtgatcttgcagaggagaacagacgttcctagcaaggaagcgagactggcaaaggctggagttgtaaaatcgcccagcactttgaggaactgcacagagtgtgggaaacgcagggtgtgagggaagtggattaagagataagagagaggcaggcacagcgtggaggagcagctgggaggataaggtatgctctgctgaaatatttcagttttgtctcatgggaaaaataaccactgaaagtgtttattttctaccctaaggaatcccaagaaagtcacagtccattcacagaatgaattctttgtcttcaagttttccgactgaaataagtcccgttatggccattagtatatgtttttaaagacccagcagaaacctccttacaaacaatagactccttaacctccaacaagccaagtatgttgttgttttcttggcaatttcctgcaacatttttctcatgcttgttttcgactagccttttgggttcaccaaaaccttgtatatactcattatattgtgtaagtggactacaatctcaaaaatgagaaaatttcaaaggttttacaggaactaataaataatcagtaatttcaaggcatcaatagagactgttgcaaatctccagactcctgttgatgttcttagcctgattttgcttttactgcaagaaataaatgaagttgtcacaaggaaagaaaatgaaaagttgtcacattttttccataccttttagattttctcaaattattacaaagataatgttcatgaagccaattaattctttagttaaaacgtgttcagttttatgtttaaaagtagattttgatcttaatcatcatggtaggtgatgtgggtttctttaagccttgtctgtgtctctcccttagtggcccactatgaacttgcttaagagatgtcagtgcttatggcaacctcagctaaaaggcacctggtggaaaggaaatgtggcaaatggcaatctgaaatacccaacatgtgctaagcatcttattttaccatgatttttttctgctgcataagggagaaaggggagaaaaagtgagatttaaaaatacaaaattaagtggttatcttagtttgttttctgttgttctaatagaataccaagacagaatgatttataaagaattgaggtttatttagctcacagttctgggggctgggaagtccaagactggtgagggccttcttctttacatggtgagaaagcaagagctttggagctcaagtctctcttcctcttcctataaagccaactactgggggaaccagcccccaatatttcaacgtaggttcttttctattttccctaagtgtcagccggtctgagaaatagagagaaagagtacaaagagagaaattttacagctgggcctccaggggtgccatcgcatattgataggaccgtgatggagacctcgagctgcaaaaccagcgagtttttattagggattttgaaaagggaggggatgtatgaacagggagtaggtcacagagatcacatacttcaaagggcaataaaagatcacaaggcaaaggcagagcaagatcacaaggcaagggcaaaattagaattactgatgagggtccatgtcctgctgggcatgcactgtcttgataaacatcttaacaggaaacagggtttgagagcagacaactggtctgactagaattcaccgggctggaatttcccaatcctagtaggcctgagggcactgcaggagaccagggcgtatttcatcccttatctcaaccgtataagacagacactcccagagcggccattcatagacctccccacaggaatgcattccttccccatggttattccttgctgggaaaagaattcagtgatatttctcctacttgctttctgcaagaaggaaaatatggctctattctgtccaaccccacaggcagtcagaccttatggttatctttccttgttccctgaaaatcactgttattctgttctttttcagggtgcactgatttcatattgttcaaacacccatgttttacaatcagatttcatattgttcaaacacacatgttttacaaacaatttgtacagttaacacaatcatcacagggtcctgaggtgacatacatcctcagcttacgaagatgatgggattaagagattaaagtaaagacaggcataagaaattataagagtattgattggggaagtgataagtgtccatgaaatcttcacaatttatgttcagatactgcagtaaagacaggcataagaaattataaaagtattcattttgggaacaatgtccattaaatcttcacaatttatgttcttctgctgcgggttcagcaggtctctccattcagggtccctgacttcctgcaacagccaccagtccatcatcatgggagccccatactaacgaccttatataatcctagttacttcctgttatggtctggctctgtgtccaaaacccaaatctcatcttgaattataatccctatgtgttgaggaagggacttggtgggaggtgattagatcatggggcagtttcccccaagcttttctcatgatagtgagggagttctcatgagagctgatgatttcagtgtggtactccctcgctttctcttacacgctctctcctgccaccttgtgagatgtgccttgcttctccttcatcttctatgatgattctaagtttcctgaggcctccccagccaggcagaactgtaagtcaatttaaacctctttcctttataaattacctagtcttgagtatttccttatagcaacctgagaatgaactaatatacttcccaaaggccccatctccaaatgccatcaacatatgaatttgggggttaaatttccaccacattaaatttggggcatatttcaaaccatagccatagtaaaggaaaatagaatattttaacttatgatccttttttaaaaaaagttactggagatgctttaatgctatcaaaaatctagagatttataaagctcacaaaggatttagctgtaggcaagatagtggggtcataaatgtgggagtttcagggaagaagtgacttctattgtgtgtctcctacatgccaggcagaggtgtaggcatattaattcttaatcttatttattatttgctataattttggatggcagtcagatggtattcttggggttttacctaaaaggaagcaaaaactcaatgagttaagaaactcgccctggtcacatagagctgtgtgggaagaatgaaattagaatctggcctgatcatgaaacccatgatctttctactgcatgacactgcttactgtaaactaggaacatcctagttaagatgcatgctttaaattgaacattggactaaatgaataacagaacggaatgtgagaaatgcactgatttgaactcctgtgtttgtttgaatcatatacattttcagaaacagctaaatttgagtggaaaatacaacagtgttgtaatccaaaatgtcagtttatacctgacttaacatttattgtgctatgtgctgagaatcccaaaggcacatttaattttattaaacacagtgattcattccataaacctaacagccaaggcagtgccttgtcatcttttgacaacttaccatagtttacttcaagtaactaaaagaacatggcatcttcatgctaactagggtcccagatgtaaatgacaacagcaaacatcttagataggatgtgtggtggtgaaggaagactttggtgcgtaataagttatatgatggatttggtgggagtcccagtatcttatgagggtacagacacatggtttctattctgtcttaattcctggtgattcttcagtgtttgtatttaccaaagataaatagacctttcttactttgcttttagaaaatgctttcccgaatggtttttcagagaagaaaatttgttaccagatcaatgtacttaaggaaatgaaaagcccttgattagcagccaaggagcctcctaatgaaatgacatttccctccagggatttcaagtggttaataaaatctagtgttctcggtgtaaagtgcttatgtttgctatgtctgctatgtgctgttctgaggtacactcataaacattgatacattaagtggagccccaaaatagatgaatgtgtgtgtccacgtatgtactggagcagaagctttatctacgtctcacacctgagttgtgtagttgaaggtaaatttaccctatgcacagcttcaaatgaactcttcataaacctgacgccttcagaggggaaggcctcacttactaacctgaaaacagcaatagctcctaaaatcctgaggagaatgtaagactgtatttcaaggaaaaactatgccctggaccagacaaagcaattaatgcttggagaaactaatagtctctgatggtttctacagaggcaaataaaccattagactggtctttattattatgtcatttaagtgtgtatataaatatataacgagattattgtctttatgatgtcttcatataaatgtgtgtatataaaatgctcttattttaagtcttagaaacccactaattctagtggaaagcattttaatgttacaggagagtttcacagcactcaagggcaaggatgcatttggaatcagggactagcacgttctctctcagtaaactaactaaggctctctctctctctctctctctctctctctcttctctatttctctttgtgcagcttcttcattcctctttcttgtggggatttctgtagcctccacaagaattgctagttgggcatctttcccattaagagaaacactttgagagtagaatctcttaacttcaaatgcagattcacagtagacagatttcattctattaaagcattgtgattcatttcacaaactgaataaccaaggcagcgctttgtcatcttttgacaaagaaccatactataccctaagcgactgaaagaaaacagtattcaatgctaagaatatcccatatgtgaattacaccaactgtgttccttgcctggcttcagacatctgccgttccctgagacagtgagctgtagccaggagcatgtcactgggccagtctaatgatacgaggacaggcttacttcccctcaagaagaagatgtggtgaagaagttccatttttctacttcagtgacctcttagagttagattttagttcaaatgggaccactgcatttcgtagccaagcttaaaaatgaacaattattactgttagtctttttcatatttcctgtgaatttgtccctgcctagaatgtccactccgccacccccttgctgacccatcactcaccacctccagagctcagctcaggtgctgcttcctctgggctgacttcctcaaccactcccctctgtacttccatgacacctgattgttcattctttaaagaaacgcttgtcacactctttagtatagaacctgtttgaagactgtaatggatgattcacgtatggagtatttcatttcagagactattcttaaactctgactcctataagtaaccagagtaacatgtgaataacacatctttatttccttcatccatttggtgttcactgaaagctttaccaaaagtcccagacacaaagacttcatagttttgccttcattttagtaaatacaaaaatgattttccctctgtttcttcctcaaaactcattccaggttcttagacaatcagctccatttaaaaaaattattttggaacactcgccatgtttctactccaagtctgaggcataatattttatgcatttcttttataataccatatacacatatctgggagaatgtttgagaacttttacaaatacaatatagagaaacaaagtttgcacttatagctcacattaaaaataagtttgcatatttctccccaaaactgggcagaaggtgtacctcattggtgtatccctctcatgttctcctttttatactcacaagaaagaaagcattatccagctgccctaattggcccccgtgtgaatagctatcccaagtacatttcttggggtgcatttggggtgtcgtagaaattctgtatatgaacgaactagaagaagccgagatcatgccttaaagaatacctcaaagatagcatacttcctgcttatatatatatgtatttggaaaaggatacatactttgtcctataaaacattgtagaagtggttttatttcttttagctttgatgtttcatccataaaataagcctcatcatacctcactccccagatggttgtgatggtcgctattatttatctgaaactccaagcatatattatcatttccttcccctttttcttcaagttaaggatggcactgagaagccagctcagggtcaccactagacatgtgcagggagaaggtattttacatgctgtacatacacatactcatctcctgtatatttgtgggagtttatttccactaacccactcccatcacttatatttaaagtgtagtgaccttcatgatttcctcaggacccctgcagggtggcaggcacaaagggagagtgaacaccaggaccaaggggtcaaacagagacccagcatcctcaagtggtgatttgcgtggtggtaaatgatttaaagcactgtttttatgttaattcaagtaaacaaaaagagaaaccacaaaaacattgtgtgccaactcttcccagacaccatggtttcagtccacatgcctctactcttggggtcgtgggtggacttgagaagcccgctctactgaatattagaaagagctgtgagcagaataacctaccgcagaggctagaatttggcagcccacaaattccatctgaagtgcaactcgaatgtggaaatcagtttttctctttaaaatttttcctatcattcaaggaaatctctagaaagctacagccatatcaaaaccgtggaacataacactacaaaacaaccaaatgacctgagttttctaggatagactcaaattaaaatgttcccatgaatatgattgtatttgtcagagtatggactccattttttggttggtgaccttacctatacctatggaagaagcatatgatctgggactagagagaatagtatctcactctgcagataccagtctagaataagaggtagcattgaggttggtgaacctacagcaatgggctgaaagcgctagtccttaagctattttctgtttcatcctgcctgagagatgagtgacttagtggccttaacagagggtgtgttagaatgtaaaaaataggagccgaatttacagttttagagagtgccctggggatgtttacagggatcggctgcctgtagctgtgttgactccatggatttttgttgctatgctaaacgtattaaaagctttgaattattgtaccctgaaaggatttgttcattcatcaaacaattatcttctggtataagctaagctctatgttatgcaagggtccctgttacatacatgaagtttttctctacagtcttatattagtcagggttctgtagagggacagaactaataggatacatatatgggagtttattaagtattaatttacacagtcacaaggccccacaataggctgtctgtaagcttgaggggtaaggagagccagtctgagtctcaaaactgaaggacttggagtctgatgttcgagggcaggaagcatctagcatgggagaaagatgaaggctgggaggctaagccagtctagtcttttcacattcctctgcctgctttttattctggccgtgctggcagctgattagatggtgcccacccagattaagggtgggtctgccttcccagcccactgactcaaatgttaatctcctttggcaacaccctcacagacacacccaggattaacactttgcattcttcaagccaatcaagttggcactcagtattaaccatcacaagtcttttacacgatgtaatatatatatatgtgaatatgattttaaaaaaatcccaaaaggacagcttgtaagtgcaaccccttgcttattcctgtctcatagagatgaccgtgagtcaatccacctttcctttataatcatattattatatttccttaaaggaacgtaaaagaatatggaaccactttaaaaaatacctgtttctaaataaacttgtaaacaccaaatcatggtctttgtggtagttgaaggtgaatttcttcatgtctgggaagatacaggttttccgagtttaacaatagccatgtcagaggcaaaatatgaaagataagctactcatcttctccactctaaatgatttttaacaagtgcacctggtatcagccgagggtccccagagaatatatgttttatacataaatatggagatttattatagaaattgcttcatgtgattatggcagccaggaaatcccacgatctgctgtctgcaagctggagaaccaggaaagccgttggtgtctcagtctgagtctgagagcccaagaaccagaagcaccaacatctgagggcgggagatagataggtgtcccaattcaacctgagagggagtgaatttaccctcgtgtgccttttcattctattcaggccctcaacagatgagatgatgcccacacaccctgggtaaggtggatcttttttattcaagtctatcaattcaaatgctcatctcttccagaaacaccctcacagacacactcagaaatcacgtttcaccagctatctgggcatcccatagcccagtcaagttgatgcattaaaattaaccatcacatgctcttaagcatatttcaacccgactcaatagaactagagtcttgtaaaacatatgatatacacacttcagtggttttcagcacaggcagttgaccaggcttacttgttcaaagaagagaagatgggtttttaatagcactcacaaatcaaattcattaagtccctattttgatgtaggagaacagagctatcattgcagcaaaattttccaaggccagtgatgccaggataccaaggagctacatgctgtcatttgcttgggtctctctgacaaccatgaagacactgtcctctttccctctaacaacttgtttgtaaaattgttagactctcgacatatgggacaagtcagcagaatgttagacttcctataatatctcagcaagactgccttgagaactcatggcatgtggatagttcagggagttgtgtgtttttcccaactcagtcattaccaattgtacatcccacatgaaagtcactttagcatttttccatattttagggggaagtggtgactcatgcccgaggggcaggatgagaatataggtctcataggcatcttcaaaccaggttcgcctctgctccacatttgtgccatgaaagagcttcgtttcataacaagccagagaccaattctaaatcagtatctgcacaggcctgaagaattgaaggcttatgcaatagcagtcattgccagggtgggtgtggatcaaaacgcaacgtagaaatccttacgccattgcaagcagcttgtctcctctgccccagttgttcttgtaattttaacaaccatatgcttatcttctgttttctggcagcctagaactgttcttcatttcttttttagactcaatagaaattaagtggtttggccatcaacattcctgtctgtcgtctctcagtcttctgtgaacaggaccagatggaataagctctttgatagttacacattcattggaattgaaaaaatgggcagctgattttctattttataggcaaagtcccaggcctgcccctgtgagagtgtggcctgctgggctactgtcttattctgcaacaaggggtgaagccacaaagattatgtctaaaagagtaatcacagagacaggacagggtttaggcagaagcaagaatttcagagcatgtgagtgaggaattatctgcactggagtggacttattttataatgggaaaattctcagaatctcaaaaaaaaaaaaatggcagggagaggaagagtggcaggcgacaatctaacccagtttgtgacttggaattcataaattctttatctgtcgattggacagaaataatgaaaaagacttttttcattaaggaaaatcctacttcaaaatacaatgggctgagccttgcagtgtctcaagtcggaattcgcagtgggtttggggaagctctggtggctccactgggtagtgtctgctctctagaatggcaacagggtcaacaagggtgtgccaagatgccaggagctttattagaccctgagcaggaaaaagctactctttcagtctgatggagccctaatctgacagggtcctggaacaacagtgcttgtttcagtaagggccagctatataagaggtggttctaacatcattctcgtgattgatgggcattgtccaaaataaacaaaacaaccaaccttttcgtaccacctagcagctgtcaagtccctgtgtcacagatgtgtcactactgtgtgcttctttaatataaataagccacagctagtgaaagggctacaagagatattttagtttggttcatctcactgcatctaataatctcaagtaacttgaaaatgtttaggatatattatctatagaaatgaaacagtactgaacccagcagacttaaccgtcagataaaaggctcaaactatgtcaagaaatgtcctagacaggtatggtggtggctgcctgtagtcccagctacttgggaggctgaggtagggggatccattgagcccaagagtttgagtctagcctgagcaatgtatggagaccctgcctcttaaaaaaaaaaaaaaaaaaaaaaaaaaaaaaaaaaaaaaaaagagatatccttataaagaacatttaaaacctggacttaattctgaaccactagaatactagaatcttcatttgtgtgacagtttttctaagacttttttaaaagtttacctttcataaatttgcatccatttgaatttttatttgcattcaagttgatttcctggtttcaaaatcagtcacagcagttgttgacatggaaaaaaaatttgccaaagcaaaagttgagatggtgtgtcacaaaggatttcatgaactaaaagttaccattccttgtccaataacttttacttctcttttattccatgatattaggggttctgtggttaaaggcactcaggaatccctgcaggttggctttccccagaatacccttgaagcccagaatcatcatggggaccactacagacttgacctggatcctagggcctttatgaaaaagtcatcaccgcgcatccccttctctgcctccattccactgtactcatataatttcggggtatctgagactgcagcttaaagcatcattctcaaggagtctctgagtctgtcgaattttctgggtggccccaatcccaaaccatgacctggggacaaatttgggggttcttaaatttctgggagagttcagatcccacaattcaggccaggtcagccctgcgactcggcatgaatgtgagaagcctgcggaatgccaaaggactgatagctgtaatctgagacatgctgtttgctctttgatgagactagccatcaaaaacgatagcagaaaaatctcaatccttgccgatgaagccagtttctacctgatgaacagatctcctaagatgtgagcccagtgcttcttcagttcattccagggctctagggtacaacttactgcttggaataactcattgctaaacagtctgcagggtttaaattgtcacattccttatggagtcaaggttgctataatcgttgctgccgtctacagcagctctgggaagggcaacagggtggagtggaatttcacacatgccatatgtcgcttactcatcctgcgagatctggcttggacttgctgcagttgggaggagaggaggatgtatgtctggatgatacaatcacagggaccccagatcctgcgaggatggattctgagctataattgttcaccattgacgcatgtgttcagcttgattttctggtcctggcatttcggcactcagcagtcacctccacactgggcagagtgagaatttggtgcaccaatccaaaagatactgaaggcattttaaagggaaaccaattcagtcccttttctccaatcccaaagaaagtgtccactcactagggagaaataacaaaattagattttgatttcttatcttagaacagattgtttcctactaattgaggctcaaacacaaagtggtaaaaagtccactggagcagacttacattatgatgggaatactctcagactctatcaacactgaatctgttattaaacacaagataagtgtaagttttggggacagaagttatctaattgttttatcctttgccatgttttattataaaaaatcttgtctctatcgccactcccgccacaccaaagaatccccagggagcatggccccagtgagtcatgtttttattctggatatcctcatctaccaaaggtgttatcattctttcctttccctagtttttatttgacaaatagggatttttctctaaatttaaatatcataaataaaattttcaaacacaaatgcccttggagattctgaatcataactccattctcccccttccccctctctcccaaactttccctggtttgaattacaagcctagggggaaagaaataacagtttaacttgattaatggagcactcagcagaagcacccgcttcctattctctgccttgctttctacctcattgaataaatgtacgctattatctcagtctcgcttcaggctttaccagtgaaattgttcccaataggattgccaaagcccttttggttagccttaaccaagtgatagtctcagtcatgttttaaagtcaggtttatgaaagtataatttatatacagtattcaccttttttaggagtacagataaatgaattttgaaaaatgtatcaaattacagaacttccaacacatcaatgtgtagaaaattttcatctcttcaaaaagggtccttggccccattcagttgattttctttctgaccccagcccctggcaaaccctgatctgctttctgtccctatagttttatttttccagaatgtattattagtggaaacatgcaatacttagtcttttgggtctggcttctttcactggcatgatgcatttgagaggcgtccatttgttgcaactatcagtggccttttcctttttgttgctgagtaacattctgttgtatggatgtaccatcgtttctgtatccactctccaggtgatggacatttgtgttgtttccaggttttagtgaccatgaatatagcctctataaatattcactttcaggtttttgtatgaacatatgttttcatttctcttggataaatgccaaggagttgggactgccaggtggcatgaagtttatgtttaacagtatcagaaacgatcttccaaggagtctgtactattttgcatcaccactagcagtgaatgagagctcctgttgctccacatccttgtcagcatttgatattgtcagattttgttttgtttatattttggccagttgaaaggtgtgtaatagttttcatttgcattttcctaatgattaatggtactgagcatttatcatgtccatatttagatctgcatctcctctttggttaaagtacctgttcaaaacttttgcctatttttttgcttctttttttaaattgggttgtttgttttattattgttgagttgtgtacattctttatatattctgtataccagcctattatcagatacatattttgtgaatattttctccctttctgtggtttcccttttatttagcagagtattttaactgtgatcaagtccagtgtgttaatttttccttttatggcttgtgcaatttgtgtgcaatataaagcattttttctaacccaaatttacaaagactttctcctttgttttcttctataaggtttacagatttttttattgttgcaaaatgcacataatattaaaattaccattttaaccactttaaagtatgtaattcagtgatattcactaccttcacaatattgcaaaaccaacatcactatctacttcaaaaacattttcatggccaggcacagtggctcacacctgtaacaccagcactttgggaggccaaggtgggaggatcgcttgagccgggaagttggagaccaacctgggcaacctcgtgggactctgtctctacaaaaaattaaaaataaaaaattagctggggggtggtggtgtccactagtagtcccaggtactaggggggctgaggtgggagaatcatttgagcccaggaggatgaggctgcagtgagtcatgatcaccctgctgcactccagcctgggtgacagagcaagaccctgtccaaaaaaaaaaaaaagcattttcatcatccctaaaaaccccatacccactaagcagccaatccccattcttctctttcgccagccccaggcaggcactaatttacttcctgcctgtatggatttgcctcttctgagtgtttcgtataaatggaatggaatcgtgttacatatagtctttcgtgtctcactctttcatttagcataagttctcaaggtttctacatcttggagcatgtatcagtacttcattcccttttatggcttaataatatttcaatgtatgaatatgccatcttttctttattcattcattaattggtgggcatttggtttgtttctaccttttggctcttgtaaataatgccgctgtgagcatcggtgtacaagttttgtttgaagatctgtgttcactttttacacaggagtagaatttctgggtcatatgacaattctgtgtttaatttattgtggaatcatgaaactgttttccacagtagctgtaccgtttcacatccctccagccgtatatgagtattcaagtttcttcacatccttagcaacatctgttattttctggttttgctgttgttgttgttattgtcattctcatgggtgtgaagtgctctcttattgtgggtgtgttttgcatttcactggtgaccaacgctgttgggcatcttttcgtgtgtctgccgatcattcgcatatcctctttagagaaatgtctctttgagccctttgcccatttttgaattgggttctttgtctttctgttgttagctttatagttttgagttttacatttagctctatgacccattccaagttaatctttttgtatagggtccagtgtatttatcagtgttcatttttacacatatggttccagtctttgtttagcaagactgtcctttctccattgaattgccttagcacttgtgttgaaggtgtgggttctgttctctcccactgatctatgtgaactgccttcctccaaggaagggatgtgttatctcatatactcatagagtgtacagtcttcaacactgtaggtttacagtgaggtcatgaaatcaggtaggtaaggcctccaactttgtcttctttctcaacattgcttaggctattctactttctttgatttttcatacaaatttagaataaaatttcccatttcaaaaaatagcttgctgggattttgatggaaattgaattttaattgggatttattgcactgaatctaagatctatttggagagaatggatatcttaacacaactgagttttctcatccatgaacatgatatatctctccatctttcaggtcttacttagtttcattaataatttatagttataactaataatttatagttttcagcatacaaagcttacatgtatcttgttagatttatttctaagtattttttcagtgctactgcaaatggtattgcttattaatcttcattttctattgtttatttctaccatatggaattattgatttttctatatttacttatatcctgcaatcttgttaagctcctttattaattctagtagcttgtttgcatatctttgagattttctatgtagacaattttgtcatctatgaataaaaaccgttttatttctcttttattctatatatatcctgggttttttaaatctaattgctacagctagaacctccaatacaataatgaataggaatggtgaaagtggataccttttccttgttcccaatctcagtcctgtgttaactgctgttttgctttctcttagtgaaactacctagacttttgtgaccccacactctccggattcccattgaatcatcctccttttgtgggggccttttcctgcagctgcctttcagggtagttgttctacaaagtcttccataactcagtgctctgttctttctacccacactccctgtgttattgcatatactcatggtgtacccagtgtcacccatgtacggactcctaattccatattcagtcccagaccttctccagcagtcttatttatctaattgcctgccagctgcctgtcctagaagcatgttaaatttaatttttttttttttttttttagacagtctttctctgtcgccaggctggagtacagtggtgtgatcttggctcactgcaacctccgcctcctgggcccaagcgattcccttgcctcagcctcctgagtagctggtactacaggcatatactaccatgcctggctaattttttgtattttagtagagacagggtttcaccatgttggccaaaatggtctcgatctcctgaactcatgatccgcctaccttggcctcccagagtgctgggattacaggcatgggccactgcacccggccaaatttaatatttttaatatttactccatcactcctaccttctctgtttgcttccatgggctggtttctctagtgactatttttcaacacaaatctgatcaagttgccccttagccccagtgtaccttttaatgtacgatataactttcatggggtgtccagtcttcaacactgtaggtttacagtaaggtcatgagatcaggtaggtaactccttaccatggctaagaaggcctgcatgctctgacttttagttaactctcaggtctcatcttctgacactttccttcttgtccactctgctctagtcacatggacctccagtctctttcttgagccaaccaagtttgttctcactttaaaccaaaagtagatctttacatgactagagctttttggacacttaggtcatttaggctcacatgtggcctccttagtaagattttctctattcagtctaagaggaccactctaccacctacacatcgtctttcatatggtcttctgtcattttattcctaacattatcatctgaaatgacattatttaattattagtttcttatatcacttatttctccttctaggagataagctccttgagggcaggagcattggtcattttgataggagtccctgtgtctggtgcctatagcactccctgagcacggagtagatgttcagtaaatcatgaatgctgaatgaatgaattaattttctaattcaccgtccacctggtcacctaagccagaaacctgggtatcagttgattccaacagtgtttggtcagtaaaatagaaagcactgtagatattttaagcaagaaagaatttagtacagagaactgggaaattatagaatcaattaaaagccttaaagaagcaaaagtcagagaagccactgctagtctttcgggaaacaaattgcaggaattctgagggacttttaccaaaggtctcacctgtttacagcaccagagattctcaggagattgtgcagaagctcctggcaaaacctcatttgccatctgccaaaacccatgcacctactcactgttgctgcaaaataataagtttccttttcttctgtcttccgcatctttcttggggacctccatgggaggaacctaacatgagatcctgctggctagtaagtgaataatctggggctctggcaccttcaatacagaggagagtatagaagggaagaaaggtattgaaacgctgacaatccagcccaggaactcacccacctctaatacacgagcaagtgcaatcgattttacccaacatttccctcaaatatctgaatgtctcacctccactaatctccccccaacctttgcctccacttaggccctcattgtttttggcaacaactaactgttgtgcttttcttcagccttgttttcttaaaataatctaccagaagtactcctctgactgtgttattacccagcttagagtcatcaatgcttgtcatcacccacaaggggagttcaggttccatagctgagggagaaaggcctggcctttaacatctttgttcttccgcaatgccgcacgccacacatttgttgacctctttgctttgcttcgtctcacccacgttgccttctaagcttcctgccctcttccacctgacttgcttattttttaagacatggctcaggtgctacctgccccaggacactttgctttacgccctctccctcccctccctcttgcccctctgctaacacccccacccaaactgagtttggagcatctctccttggtgattctgttctgatgatatgagtcagtctatgggtctgcctccctcctagtgagtgaacatcttccagagctggattctgttgccttcatctcggtatcaagtgcctgcaatacaaagcacagagcaatggttgaatgaatgaataaatacatgcacacagaagtacaatgtgcattagatccccctaattattttttaaaggctgggtgtgagaaagaaatcgaattgtatttgaaagagggccagtacttcacaggtctcagagatcatcgctggtatttttttttccaagagtcacacatcttgtttcctcctgcctagttggatttgatagaagaagaagattggaatggaactaaaagggttttgaaccactcagatattctacagacaggtttagaggaaattagtagcagggtcatggatcagctatgcaagatactagcatagttattcatctgaataggagcagtcggccacacaagagagatgcttatgaaagaaccacaccaaaatccagctagattctatcttgtatgaatgagagatatttttggtctgcaaacaagcaggcattccataccttggcattctctttgacccatttgtgtgaggttgcctttctcagagcatttccataacacgggaaaattgacttttgtttgtttacccaaacaatattcttaaaatgaacaacccctgttcatccacaaatgaccgtggaatctcgctatcactctttgctactggtgacctctgccagtcctcccaggctgtagagctgtatttacacctcacagagaagcactggggtgaaactctgcgtggagctgtgctgctcagagatgctcctctcctctctttccacttctttcttccacagggtaagactcatgctgagaggctgacgatatcctacatcgtaagcacatggcaggatgctttatgtctccactctgcttactggagccctctcagttctgttctgaggccagtgtgccctgtgtttatgactccatccctctaaggatccttctttaaacaggccaaacatctaacgctgctacaatttacctagggtttcttgttccacctcacccagacccaaagcactgaatatttcagtttgtacaaactgcctttattttatggtggttcagcttttaatttacattttagagttttatacgtatgtcctttattgtacaggactcagaagacagtcccatcgaaaaacaactctttacagcactataaacaaattacaagcacataaagcttggagtacattcctctcttaagctctccccaggcctcctccctagggagcgctcagtgtgctccggcttgttcttgggaactctgactgcagaatacgtggatgttgtaaatgcagcagaaaagatcccttgcagccctcctactggaccgacccctggggccagggtcattgtcttcagaactgcagtaaggaaatgagtcctgggtaaaatagcctgaggaatcccagcgcagtgttctcaaactgtttcagtcctggtctaatgactcatttggaaattcttagaatcttactcatcttctccatgccctctttctctgctccaagccagcggctgaggttaagtcagaggcttgtatccaagttaccccgagtgtttgccatttgcatttgtcttctgacttagctcccctctgcaagtttaaaattctttttcacaatggggagcataagtcccaccgttactggatctttctgaggacagactgcatgttatgagaaagagcagtgttctccccttccttgcaaaataacatcgtgcagtgttggggccttgaagagtcagtgcctcaaaggcagggtgagaaagagatgtccagtttatgccccatggaaagcagcggtgcctgctggaaggacaaagaaacaacatagaaataaacaccgtgagaaccctgtggtggctgagcacacgtctttgtgagcatacgtgataccttctggtgattctgaccctcttggctgctatcagagacaggaggttccatgtcaaagtggtgagagtgaaatctggattgttactgttacttaactaggacttaactggtttccctaggacagagagcccgaggcagaggcaaagcttacatgctaatactgtatgcgaggagatagcggacatgccatcccaggatgcaagagtgaaaggagactgaagacaaggcaggaaaaaaggcaaagcaaatgcaaggtgacacatcactgagctgcccttagtttctcaagagcttttgggcggctgttgtgtcacatgggagtgaggccctaatggaactactgcatctcgaatctgctggctctgccctctgtgtcctctctgagggccagtgtcaattccccctctcctccaggctctcctccgtgagccccccagacagcccttggggcaaccagcgcatccgtgagttgaggagggtggagaatttccagggttctgacgcccctggcatgatggtggcctgcccaagcccccaggggagctagaggcaacccacagcgtgaggagatgagatggcagaggctgcggccatggcttcacagccatgggaacagagcaagttatagctaggcccactgcagccgggaagctgggcaggaagctaaggcctgtgggcggggccagccaggcctgggtgcaggtagtatgggtcccgcacaccctgctggggagatgcaagggactctggctacaaccaggtgctgtaaattataaacaacacaaacttagaaaagcatcatctgttggaattagtgtcaaatgggaaatgttataaaagaagctgtagaacttcagtagggacacagactttcagaccagaggaaatggaaggctgctagagactttctccacattcaaagaaaagcaaacaaacaaaaaacttcaagtggaagaggtgggactggcccaagcagccctacaaaagaatccagaatcttttttgttctcaaagcaatgtgggttttttttttttctattaaagaaattatgcctttggggatagtctgtatagtcttagagtaatttaaatcatttttcttttgagattcttttcatatttatgattttaatactttatgctgattaactacatagagattataggctttgcaaaaggaatatctcagcctgtcacagttacatttgtatgaaacgacctcactgcaggaatgttaacaattgtattagaggttccgtttctaagtttaaataggaataatctacctcaacctattcagttagaacaaaagccacttccgcaaagcaataagcatgtatcttcttccaacctagttgcatttgattaacgattgcatgagaacctttctcatacttagcttttcacctggggtttttgaaatgcttaagaaaaaaactattaaatacaagcattttaaagctaatagtttccctgtttctaaaatgtgaaaaacactagaagctgaaattcagcagtttcaaaaacatatttcaggttcagttttcccaggacagctgcaatgcttgctggaaagtcaatgacattgcaacttgtaggcagttctggcctttcatcttttttttttctagggacaaatagttgataggatctgtttgatgtaaaatttaaaaatccatataaacttggcaattttccggagcacatttgataggagcaagtttacttagatttatgtaattttgtttctggtgcgtataaagattagaactgaatgtgaggtcctatgcagaggcaagaggtataatgtgaataatataaagtctctcttcaaaacccttcactcataattaaatatccataagtgaagggcagtaagtagatgttcaagtgctgtgtgaacagaaacaccatacaactttagaattcgaggcagcttagctatctttgtgaactgaggactctggagtcaagaggtcatgggtgactctccctagatcacagagccagtttttagcaaaaatgcaccttttgttacactccaagttctcgcataatttctttgtctctacacttttaagtgttaaaattcaaaagaacatttttctataaataatgtggacaagaggtatttgatccttgggtgtgactgacattatagttacacagtgtagtgtcaagctctggtgcctcatgagctgggtttgaatagagaccccgccactttctatttgtgtgaccttggcaaattatgaaactttctgaggctcggtgtgacacggggataaaattcatgcccaattcataggttcattgtgaaaaagaaatgagcgatttccctaaagcacttggtggtgtgtacattataatcacttagtaaatattgtttgttgttatttaaattgcttttactaaactattatgaaagacttttctgctgtttgtccttctaatcactattgtctttgtctgtgtcccacctgacctctcctataaactgaccttttatctgtctactctgatgagagcaatggcagagtagctgctgctttgagcagaaagtaaagccgtgtggaagggtacagtgagacagtgtgacagggaaagctttcagttagcctcagcaggtcagtatgatgctcacacattcacttcccaactgcttctgtaaaacgctccatgattcttcttttttaagcaaatgagaaatcggttcttgatctgagtcccaagtagacatctgtagctcttcacctaaaccttttaatcagcaccacactggagctctgggtcatcgtttattacattcgtatttgggttccccagcaatattattataaataataatatttattaagtgaatattcacttatttaataataagtgatatttaataataaatgaatatttacattcactattttgggaacaagaagagcagcaataagctggattatcatgtcaacaggcttgatattctccttcacatctgtaatagacggtttatgggacttcttcagggaaacaggccgggttgagcctcctcagacactcctcatcttgggaaagtaagtctcccaccttcaagggaggttttcaaaactatgagtgttggctccagtcccatcatgttggttgctgagaggagataaactggctaaaggtttcctaatacttagtccccaatagctgaacactgctggtgcaaaaaaaaaaaaaaaaaaaaatcctttcaaaattggcaaaaatacaaacaacaaaatttaaaatctttccatcgtgatcaccttttttgaacagtgcgcaaatgaattgtcactggaatttttacttacgtaagcacattctaatgttctgttgacaaattatttttccattgtaatctagattcctcaggggaaaaaatgtcataagttcacctgaatgtgagataatatggtttcattccatcttccactaaacaagacaataaaattttgaacaccgttagaattgaaatgttctttaatttagtttctgtgattaagcaacattttaaattttaaattctatggtttacttcctttctcataaaatgattaaaaattgtttttggagactgtattagttcattcttgcattgctataaagaaatacctgaggatgggtaatttatcaagaaaagaggtttaattggctcacagttccacaggctgtacaggaagtgtggaagaatctgcttctgcggaggcttcaggaagcttttactcatggcggaaggcaaagggagagcaggtatcttacaggcaggagcaagacttagggagagattggggggagctgccgcacacttttaaataaccagatctccagggaactcactcactttcacgagaacagcaaggggaagtccacctctggtgatccagtcacctcccaccagtcccacctctaacacgggggattacaattcaacatgagatttgggtggcaacacacagatccaagccatatcagaaacgctttttggttattttataactttgcatgttaggtgcattttatgacttataaacatctttggaatatgctttgaaaaacaatagtgtaggggctagcaaaacgtgattattttttattatgtacaaatcaaatcaaatgtatactgatattctataatattaattaaaaatcacttttgagttttaaaatgtataaggcccaacctaggaattaattattttaaatagaaatatttacattcactattttggaaacaagaagagtagttctcatttcatgatctagttgctcctctatacggctggtagaagggtatacgtggagcactgattacattctgcctcatttgagaacaatttaactattgttttcttctctacatgaatgtaaacttttcaagagtaggtagggtatatttttttttgctcttaagcacatgatagaaacgtgtacatgctaacaatacaccataaagtatgtgtcttatctaattaatgtgtcctaagtgttcatatggtttggatctgtcccagcccaaatctcatcttgaattgtaatcctcaatgttggaggtggagcctggtgggaggtaattggctcacgggggcggattctatggtttaacaagatcctttgccttccaccatgagtgtaggttgtctgaatcctccccagaagcagatgccagcatcatgcttcctgtacagcctgtggaaccacaagccaattaaacctctctacagcagcacgagaattgactaatacaggtgtatatattttatactttgtgtttacttatgaagcatacatttgaaggctgtttaaacattattttatcatctggatatctattaattggcatttccaatgtcataatttatgttcatactgcccattggttaattctagaactctttgtggagcatatgttatgttccaggaatcagactcctggagctgtcagtccaatgaggaagatagacactatttatatgacgcaaaaacatcaagtgcttttgaatgcaatatatgaaacgaattatttccactatgattgtagtgttgcattttattacattttcatttttgtattaactgaaataaagattagttgagaatgaatatgaaatattaattgaaaactaaacattaaatttaattgaattaaatgtcctgtgtaaatccttataaaaccctatgaatttgatactataattcccatttttcatatggagaaatatgatgaatcccatagttatgtaattttaaaaactgataatccttttgtattttgtgtattgtagtaatctattatccaaagtatttctttttcaaaccattccatttaaaaagtgtgtttaaggcatatattaattacatagtgtagtagcactaattgcttaactggtttcatttgaaaggatttaattaggcaaacttaaaagcatagaagccacagtattacaaggtgataatcccaggagccatgtacatgataccatgtaattaatttgaattaccaggttctggaatgcttaagctttgctggacttttagaaacaaaggggacagtgacctcccatgaaaggaatgctgtggataagctgatcagttacttatcagccctgctattgtagctgtgccaaccagacatgttcacattacttggacacaatgtgcatggtagttatagtcagatggggtggtacagataaaatcatgacttcattttccatggataacttatcttttgttctttggaattagccattttaagaccacatatgaagaaaatgtgataacaaaaatgttccaactatgtacagtagtgcttttaatactctgtaacagctagataggaaagaccttagaatatcaaaactgctttaggtttctgccatcactagaagaaaagaattttatcaaggatgtaaacataagtttcaaaaaatattagacctcagcattacccctgaattcggactaatcatgaatgatagttttatcttgttcagaaacggtctccaacctatgctgtgaaagtaggttactgttctctcaaagtcctttatggggaagatacatatacacttttttccacaggagaactttgagcaaattgaattattacaaggaaggtttcatagactgctggtaaccaaatgtgcttttaaataaatcttcagaaaaaagttacaactgtgcacatcctagaccaattttaagcttgggatgagagtaactttaagatataagaaactgaaattaagaaaaggaataattctgtttcatcagctatcactggattctgctttaacctataataaccaaaacaaattgtgaccaaaccacgtccatggtgaccaaattctcccatactctcatttgacacaaatcaaaatcattgacttctaagtcaaaatgtggagtttatttttaaccagccaagatagatagaagtaaagtaagtaaacataatcttattatagttggtcagggtaaatttttgatttaaggctatttaatactctaaggcttttaagcaaaggtagaatcttaaaatctaagaaaataatacaatcttttttatagatatgtaacagcatcagatggggtttttacataaagttagatgattttaaatcttaactagtgcctagaaaagattccagacaagggaatgtctacctataacatgattcagcttaatttagggaaaccatctatcatggcataagtgcaaagactgaaagctgctgccttaccaagtgttaatattcaaagaactaatattcgtaagtttcaaatatattgaaattgcttctcttcaataaaaggattgatcatattaaaaccagagaacacaatactggtaatactatttaacatttattgaacagttagtatgtgccagacactatgctaagccctttgaaggagttacttcatttaatctttcaccattttaataaggtgctagtattagttccactttagagatgacagcattgaggtcttgttgacttcacagttttgcctcagttcagtcctatttggaaaaataggaaatgtattttttaaagcactggtaacatctcagagtgtagtggaaagaatagaactttaggagtcaagagaactgtccttcagtctccactgtaagctccctgagggaaaggactctgtcttggttaccactccatggccaacacccgtccacatacctgcggcataataaaaacttagtaacccttcatggaatgccggactcactgaaggagagcaggtgctgcttactcaatgtgtgatctggccaggtgatttaacccctcagggccctatccatttgttattcctttcctattctaacatcttccttgttcctaaaaatgatttgaggaaacaaataaaggattcagctgcacaagacctttaaagtaaagataaaaggtcaagagtgatgtacttgaagaagggagaaaactatttccaaagtcaaggctaagaatagctgcctcgtctgggcatggaatttagactgaaagttgctgcagcaacagagcctctgtggattgaagccaccccacctacccgctcttcttctgccacatttggccagagcaatctgctcctgtaggagtcttggaggaaagaagagaagagcccaaaatatcccttttgctgtctaattatttttaatgactaaatcatcccagttctagatgaccatgttgggtccattttagagtgtacgatcaagtgtacgatcaaaagttcaaatggcagaaaaaccttgagaagataaaaggctactttctctagtgaaatctgaaacaccgtgttgaatggaggaattagaatagcgcccaaataaggaagagttataaagagcaggtctaaaaaaataaaaaagaaccaagtcacagcaaaccctaagtacccatatagtagcacaagttagctctgggcctttctagcagaatggctactggaaacaacagaggccgtgagaaaaatagtagaaaaatgtccagccaccctcacacaaacccagcttaaggtgatggctaaccgccctcaggagggtgtttgttttgggttcagacagggcaatttgataagaaaagaatcttagccaaatggtgagaaaggtaaataattaaccatgttacttcaacaaacagcaccaacccaagacatttgggttacacttgaaaaaagaagcaatggaactagcaagtctctatcctgagaaaatgttcttgatcctttggccatgagcttttactttccccgaagaagccactccctttcttaatttggttgcacttcagagatcaaaagggggcctcttccaacacacaaaagatatgctcctacttcttcagcgtttatgatgatatttgttcagctgcttccttccataaccattttctatttgcagactcaaaatcagatagtgggtgattcaaagagctaggtggcaaaaatgtgctgacccacctcacagcacctatgtgtgctgggtttcagacctctatatggtcatcttgcaaatccattcattgggaaaattccaatagcttagtggctcattctccaaactatgatttgagagcatctagagggccaaccagaatgtgcattttctcactattttcctaagcaccattcaatgtgctacatctaggttaataatagtaatcagggaaatcaaagaaaaaaatgtgaagaagtcaccgtttgacttggaaaaatcaccagtacaaatgtataatcaaatggcatgcgattacaactgtgcctcttaacactatatcatacctggggcctggaactcttgggaaaattatagtggaaatttaaatttttaatttaattaatatatagagaatgcaggagtgttaggtatccttcccatactcttctttctcctaattcagtaaagtcatttgagctgaagatttaaatctgaaaaatccaattatttattttgagccatgcatttttggtagcactaaagaagttgggtagagaaattagcaaccatgggttgtatagagcagatggctggaattaagaatttatgaaaaaatatattgtgacattatgaaataatttttcatggatgttttagcttgatgtgtaagtaccgagtaggtgttcccatttaataaataatgactatgtgccagaaattaagagcaaaacttaaaagaaaactcattcttctaccttctggagagatgctcactctgcctcatttattcctttaatgtcatctcttggtttgtgtgtctgtgtgtctagtgggaacggggatggggatgggaataacagagcttttctctctctgtctcattctttctctcttttctactttctattgttctggccaatatttctgttcactttgtgtgtatgtaatcacattaatggtactgaaaaaaaatcctgaaaaaagattagtatacaccaagatctcaatagctggaatctgcatttcacacagatctcatagatactatgctactgttcaaaaaagccagctgcattagtacaaggatagggaagatatggcttaaaaacagagcttgatttgccaaccacatcacaccgtttacccatggagctgagagtccagtattttaatattagaccacatgtatagaggggcccaacagcaagagtatgatgattgccccatcctgttttacatggattagaaaaaacttggagcaatcttcgcaattgaagaggaaaagaagatattccaaggattgaggccaggttttggctttgaaaaggaacaagttttggaaactgagcacatttcaaaaaaagcgcagttccaaaatatgtatgtgtcacatatggaggatggattaaatctgatctgtgttgtcccataacatagcaatgggaccaataatggtaaaagctgtgagaaggcagattccagccacacttggagaagtctctggaaaagaacaggatgcttgaaactgtagttgcctccaccacaggggatggcccatcttggagtgtggctggatagtgacttgaatcgcctgacctgcaaagcccttttccaccctgggaatctatcattcaataaaaggaatggcagtagaggggcaattgatgtggggaggagggatgtttgatatggaattgatgtacagtgtctgccacttgggacatttaggatctcgtgttgctgtgatcggtgggcgagccatggttccctgccttccctgaggttaagctctaatatttttaattttgtgctacctgtcagggaaactctgtcttttctttctttgttgtattatagaaacgaaatgaccaggagccttcaaggatttcttgaaggccatttcaagcccatgataatgatgatgatgataatgatgattttagtggatgctacaatccctcatctctccctttcagaactaaggtgtccactcacccagctcccagagtgtgcattgctgagggctcacaagtgagtctgtctccaagaatggcctcctctggttctgcgtctcctagtgtgggcagcctgcaggcagtgggtggatgcagggctcccaaggtccaggctccttgtcttcctttggggcaactagaaggtgttatctcagcaccatagcatcctgtggcctctgctgaagatttatcaaagtttactttctccctttgtccaatttttcctctcctgctcccttacagatatgataactaaggacacatccccaaagccccttcagtaaatcccctccttaccgtgtttttagagaacaaacctaatgcagaggatgatgatggtgatgatggtgatgagatgatgatgatggtgacgatgatgatgatggtgatgatgatgatgatggtgatgagatgatgatgatggtgacgatgatgatgatgatgatggtgatgatggtgatgatgatgatgatggtatgatgatgatggtgacgctgatgatggtgacgatgatgatgatggtgacgctgatgatggtgacgatgatgatgatgatggtgacggtgatgatggtgatgatgacgatgatggtgacgatgatgatggtgatggtgatgatgatggtgatgatggtgatgatggtgatgatgatggtgatgatggtgatggtgatgatgatggtgatgatgatgatggtggtgatgatgatggtggtgatgatgatgatgatgatgacaatgatgatgatgatgatgatgatgatgatgatggtgatggtgatgatgatgatgatgatgatgatgatgatgatgatgatgatgatgatgatgatgatgatgatgatgatgatgatgatgatgatgatgatgatgatgatgatgatgatgatgatgatgatgatgatgatgatgatgatgatgatgatgatgatgatgatgatgatgatggtgatgatgatgatggtgatgatgatgatgatgatgatgatgatgatgatgatgatgatgatgatgatgatgatgatgatgatgatgatgatgatgatgatgatgatgatgatggtgatgatggtgatgatggtgatgatgatgatggtgatgatgatggtgatgatggtgatgatggtgatgatgatggtggtgatggtgatgatgatgatggtgatgatggtgatgatggtgatgatgatgatgatggtgattctgatgatggtgatgatggtgatgatgatgatggcaatggtgatgatgatgatgatggtgatgatgatggcgatgatggtgatgatgatggtgatgatggtgatgatgatggtgatgatgatgatggtgatggtggtgatgatggtggtgatggtgatgatgatgatgacgtagtcaggggtggggtacagtggtagcagtggagaaggaaaaccactgcatgtcacttgcattgtcctttatctcacaagtaaaaagattcatttgatcctcataatagtttgtgagtgggcagatgcttaaatcactcccaatctacaaataaaagaaccgagggacataaagtcaggaatttgctcatggtcacataattagggatcaattttatagtaaatcctgtcttctgattcccattttactgttatttcacctgactacagtgccctatacatcacagaagtcaggaaaaacatttgttgaataaattagtgtgatttcattggcctcttatccttccatttttttcctactgacccagtgaattaggtgaaaaaagagaaaaaacagtatatattgatggtcctgattttgcaaggtaatcataatttcacacattgtgaagtgtgtcttgcagtacattcgcatatcctcagtagctcacaggaccaacttgttctgtttagagactaggatgacttgtttatgaataatgcacagggcaaagaaaaaagaaaagatttataagaaaactccagaaagatttccatgacatgctgataggctctgctcaggtcctggatttgtggtgatcgtagaccagggtagcttgaagaacaggtagtagtggtcgatgagcataggcacctcagctaggtgagggtgcctgaggggccactctgagtgaaaacatttccaccaagtcctcaatatgaagaaaaactgtggagaaaatccccctacttctgcagagcacatgacctctgagggatattgcttatgatataaatgcattgatgtggcaaaatgaattttaaaatattttgtctgagtccacatttcatgaggtgtcgctgattaaaatgtggctgactgaaacgatgcttctccacttagattttgcttgaatggagttcttgtttggcttggtaagccatggactttaaatgctttcaggccagcttgtttaaccgcagaaagacttcctggagtgacctgggatgtttcactttgtaggagtttcaggtgaagatagtctatagccaccgagtgaggaagtcttgagccagctaggtcatcgcaaccgagaaaatcaaaaccattcttcttttcttcacagtggacttaggcccaatgtaaagaacatctggaaacaaaaattatttcattaacctcaggagtgactctgtagttagatgttcaagtggtattgctgctaataaagtaatctagcctctagatcatgataatgttttctcccctcccacaggcctgtgcacaggacctgagaacaacaaaaaatataataccagtattctgagatacagaaactgcaacaaaagtgatcaaaatgatttatcctagatcaatggcaaaaagaaaaataacagaaatgctgggaacatcaccatttccttctgatcgactttcaggaatctgatccaaataaaacaaacaggagtttctacatttacagacaattcattaaaacagtgctgaagtaagaaattctgcatagtattaaaatcaggtgattctttaaccttggaagtcatacattttttaagcctattttctcacctgtcaaataaaaataattcctgtttggcaggttttctataaggaagagatttaatatttctaaaacttgtagctagtgcctggcacatggtaatctgctaataaattacattgactgttattgcactgttttgaaattataaatgatactcagtacagtaaaaaaaaaaacaaaaaacagaacaaaatgaacaaataaagatattccccatgtgcctaataattctctgagattttaggcctttgaaagctgcagtaactgctttagattactggtggtctgaagctgctactaggacctgacctatacccaggggagggtgcagaatctcggagagcctgaattaagaagcagtgcctgtatttggagatgcaatgaaatcccaggtgttcctctcagaaactgatggctgaagagaacctggaagccccctgatcaatctcagaaaccatgtgtagggatcagcccgcctgccacccgtgtggggccaggatgcactttggcatgagagtgtgggttgggagatgttaccctggaagattcttctaaaaagagcaatcagtctagaggagatttggtagaatcttttcaacatatcacacctatccctttttgttgttgattcaattttataatggtagattcactctaaatctagcagaggagtctttctgccaattcagtaaaaagaaaaaaaaaagcatccagagatgcagtttaattgatcttttccaccagcatcctgggaattcctcgatgtatgaattgagttcagttgagttgtccctgagttggtttttcacagacccaactgcatagggaacaacagcttttttcccagaaaggattatagctgtaacaccataactgttatgggttgaattgtgtcccctcaaaagatactttgaagtcctaaccccaggacttgtgaatgcgactttatttggaaatagggtcattgcagatgtaacaaggcaagatggggtcatagggattaaggtgggccctcattcaatgactcctgtccttataagaaaagagaaatctgtacacagacacacacagggaagatgtgtgtgcagatggaggcagagattggggttacactgccacaagccaggtcaggaaacaccaagattgctggcagcagccaggagtagcgagaggcaaggaaagatcctccctggagccttcagagagaggatggggctgcccacacctcatctgctgacttctggcctccagtactgtgagaaaaatgtctgttgtttgaagccacccggtttggggtactttgctacgacacctccagggagcaaatgcagtaaccatggccattttgatacaaaaaaatgaggaccctgagagttaagtaggctgcccaagatgacctaacttgtaagaggtattcctaccctaagatacggtatcagctgctatctttaaggtgacttcccttagtagcttcacgaatttctgagatccaatcagcgggcttctctgcttggcctttttatcgaaccgcagacaaaccagcctgacttgttgatttaaaatgttctatttcatgcatgcacggccttgaaaaagaccacagaaaaattacacatgatgcccaatttattctgttcttctttcctctgactgtgatgtgtgactaataacactttttttcctgtctcgtggaaattgagaagtttcataaaacaagtctccatcttctcactgaattttttttaatattcatcaaagcttcctccacagaacatatcaggaaaactcaaatctttctctgacttttcataaagtcagtttactattgctatttttaataaccattttctttcagaaaatgtgtcaatttactaaagaatatacaaataaacaaaagaaaatttatacataactcaatccctcgttattaaacattgttattgttgagtgtacctcctgtctttttcctatgactatatatccaaaattttacttacaaaaatggaatggtgccaccatacatttttatgggcttattgttgttgctgtttatttaaaatataatgtgaacattgtaaaccaaaaagcatctgagacaggtctcaatcaatttagaagcttattttgccaaggttaaggacatgcctgagagacatgcctttctccaaagatgattttgaggacttcggtacataaaggggaaaaggaggccggaggggaaagaaggaaggtatggtcacatcactgaatccacttgttgcaagaggaaaggagcgggcaggggaagagtcagtacgtattcctctgacactccgtaaaacggcactttacataagataaggcaaacacagagtagctacctgtggagatatcaaaccttctatctgtagcttctgcttaggaacaaaaaggaaaggcagcttcctgcatgactcagctttcagcttaattttttcctttggcatcgtgaattggggtctcgagtttttattttccttttctttctttaatgccataattggaaaattctagcttaaaatgtaaaatctttatactcccggcgttctcagaactctcagaatgctgagcgcactctgaaactctaggcaaggggcatggtttgcaggatctcccaaccttgttttgcctgtggtgcccctgtagaatagcctgtcctggaacaccctgtggaaaatatcattctacataatgacttttcaacactgagcatctcccatggcgtggctgtgccacaatctacttagttcctgttcatagaagtcaagttattatcattcatatacttcttgcatattttgtaaagttcccatcgtatgtcttttctaatatcccagaaacaatgtctctgccaggcacatggcagttgtgtcaaccttgtcatatgcatgtctgtgaaaactcaccgaatacaaaaaatactgaaaacagaagcgggcactcacttcagaagcgctgctgtgccatctctcctgatgtgctgggcagcgtttcctcctctttgggggtctcaggatcttttggttaccaacaaggaatacagagctccaggcctgttggaacggcatgtggcccgggcctccatttcctccacttttcctggtaatgctgatgcacacccaactggggaaacactagataaaggatgactgtcaaaccctaaatagtaatgtcattcagaagagctgaatactgcaggtgaagaattttaagaatattgtagccaactaatttcacttctttcttttttctatacacagagtgatagaggatgaaatttaatctcaatacatttgaaacatctcttccaacaaataataataagactcaaaaaataacatcgtgttacaatttcattggcagcagtttttttcctttttggtggaacataaaatagtggtatgtcttataatttatgggtccttcattttgttgatatctcctcgggcaactaatatgaataccttgcacagaagaaggtgttcgagacatgtttcgtaataatgacgactaataaaagcgaccaaaacatcaaaccatgtgaatgactccattaaaatgtatttcccaggtaaatgggtcctagagctcctattctaaaatgcaagaatgatcacatctgtgttctttttatgactctatggtggggctgagtgtggtggtgcacgcttgtaatcccaacactttgggaggctgaggcgggcagatcacctgaggtcaggagttcgagaccagcctggtcaacatggcgaaaccccgtctctactaaaaatacaaaaattagctgggtgtggtggcgggcacctgtaatcccagctactcgggaggctgaggcaggagaatcccttgaacccaggaggtggaggtggcagtgagctgagatggagccactgcactgcagcctaggagacagagcgagactccatctcaaaaaaagaaacaaacataaaaacaactcaatggtggcttgttatttccaggaagataaggcccaaagttcttaccacgaaaaacaaggtgtttgacaaacagtgacccttccaccctgtccacctcgcctctgcttcctgccacaacacaggcttctgtgccactccacctctcagtcacagctgccacttcctccacctggaagtcctgtccctggcttcccaggcaggcgaactcctcttcagccacttagctcgcgtgtggccccttggtgaggcgcgggacggttcatttgttccctctgctccccttgccccccgggcgtgggcaaatcacactggaacatcactatttgttccctcacgttcacccacccagaaggtgggcagtgctttagtaatctgacccttgatgcggatcttcttgggttagttcaggttgaagaaatgtttgtcggattgaatcaagggatggccttaaggggcagatagaattcattcacctgggacccatgtggcccagtcatccgttcatttgttcattcggcatttctgtatcctccacagcccaggtacgatactgagccctggaagcagggtcaaaacaaaacagaaatgatctctgccgtcctgcagtttataatctcgcgggacagacagagattaagtaaataaaagcacaagtaaatgtgcagcgtgtgaagtcccgggactgccaggactctgctacagaactcttaaagaacacggtgcctcttttcttaaagggccctgtgtgtcggctgagacgctgtctgcaaggcctccgtaggccttccccgcaggcaaggtgtccgcgcacgctgctccctagcctctgtccctgtccctctgtggtctcagctccctactccttccccaactgcaggacttgggcacaccatgcccctcctctgaaggccagccctgccctggcagccccttggcatctggtcgataaagtccccactagattctatgaaaaggttaaatgagggaaagaactagggctgccgagagaataggaaactggtgccaatttaaattaaaggggaggggaggacatcagccgggaaggaaagcaggaggcagaagcgaaaaggcctcctgctggctgttcacacagcgccgcgctgtccaggtgaggttgcagggagcctgcgataagttcccactgatgacactagtgcctgtttctcctttgctgaagcccacggccctcaccgtctggaccattcttttgatgaacacatgcatttgtgttgctttttgacgctctggtccacgtccagctgatgtttcccacggtattggaaggtcccggaggtccgtgcccacccagtgccgcaccataaatcaaagatacaaaattcaagataatacctaatacccttttatgctaattaatggatttaattgccacaaccgccctcagaattagataatattatcatcctttcttatgaggaaacagaagcacaaagaggttaggcaatttgcatatcacacagctaacaaattgcagaatatttgaatccacaccatttatttatttgttccacagtgaatgaacaagtatactttgagatattgatatgaaaccagtataaggagagatggcaatgctttgagtctgtgctgaggagttaagcacagtggctggataggcaaggacacccccaggcaggaatgaaggaagggtgcttccgcaacccaccgagtcagcctgggtgatccctgcactgacaggtgaccagccaggaataaaggctcactgacaatgtccagaaatgagatagtactttctttgtacccaggctgacatgagctggcagaggcagcttgttgtctatccactccctattatcaatttgtttctcagtagtagaacactggtttacctgggaccaaaaggcgtccggctgaaaagaccacgtttttgagacttacttatcactcaggatgcaatgagatatcagcagaagtgctgggtgggaggtggggaaaagctccttcaaagaggccaactcaagcggaaaatgtgccccttggctctccctctcctcttcttgcctggaacatggacctgatggctggagcacaagtagccattctggaccacgaggattcttgaggatagaaaccagtttcaaaagatgacagaacagagggtaggagctagagtcctaataatcatgaggccaattttctactagcctagaactccttatttctcaatccttcaagtgagagaaaaatatagctctgtctcttgtaagccctgttatttgagctttctctcctatgcagccaatcctgatcctgtgataagactttctcatgtgttaccaaaaattgaaacacaacttgagtttgcttccaattgttggaagcaaaccatgtctttaatgaaggaaagatataggaaagagtccacatgccaagagaataatgggtccttcaagatgcaggtcaggtatcagctctcagataaattttttaaaatctacctttatgcctataggaaagttggttgtggaatgatttgtcatgctactttaaacctcacaaggaatgtttcttttcttttttttttttgagacagagtctcgctctgtcacccaggctggagtgcagtggcacgatctcggctcactgcaacctccgcctcctgggttcatgccattctcctgcctcagcctcccaagtagctgggactacaggcgcccaccaccaggcccagctaattttttgtatttttagtagagatagggtttcaccgtgttagccaggatggtctcgatctcctgacctctcacaaggaatgtttcaaatagtcttcctttgatgcaggaaatgtccagaagaatgttctcagttcaaggcaatgatctggcaattaggatgccagagtctgacttttaaaaatataggctgctgggcacggtggctcatgcctgtaatcccagcactttgggagggcaaggcaggtggatcacaaggtcaggagatggagaccatcctggctaacatggtgaaactccgtttctactaaaaatacaaaaaattagcctggtgtggtggcggacacctgtaatcccagctactcgggaggctgaggcaggagaatcgcttgaacccaggaggcggagattgcagtgagccaagattgtgccattgcactccagcctggacgacagagcgagactccatctcaaaaacaaacaaacaaacaaacacataggcactgaattctgacctgggtaggcttagtaaaataattaccattctgggttatagctcccatccaatattctgcaagcacgcatagtttatttttcctacctgcacgtgctgtcactgtcaggcctttaactgaacatctactatttccagtgcggattggggatttttatttttcaacagtattttccacttgttgttggaccgttggatcctaaaacgtgtacctgattgtattaatacatcacttgggcccatcttattatcttgaccaatgaatcttactgaacatgtatttcagaagcacttctagaagacacaaggtgaccctctaattttcacttcttttgagatttgcacatttggcagctgagggctttagcatgatcttcttcagagtttacggaagctgcccagtttcacccagcaccttctaatttgtttcagtggctcaggtgaaaccagaagcatttgttttaaaatccttcttgccaggttttgtttgctgagcctggtgcgtttcgttactaattcaacaatgccgtgacggcagagcccagtgctttttctgcactgggtagggtggcacgttgcccggaagtacctgggggccactgctgccacaggacacaatgctaagtgggaaaggtcatgggagctacactctattaatgtggtcagagtgcctctccaagaacaaagtgtggcccctcacaggagcatgaaagcagccagccctctctttccaggtcgctttttaagcttatcattatgaagtataaacagtcaaattccttgggagcaagtgcagccttttctgtattgcttgcagaatctctccccactgcaggtttaataaaagccaggagtacttttctctagctacagcaagatgtatttatatgtttgggactggttaacagggctgtgggagggggttaattgtgggtggttttttttttcttttgttattattggataacaccattattttttccccacctggtactgacacatattaacacacattttacgataaagtagttcctgtaagctgctgcaatcatagtcatttgcaaacccaaagcttgataaacctgaaatatttaaaacaatgttgttattattagccagtaaagaccgggctctccagacttaggactagctgaaacttcttcctgtacctcttgccacattttccttattcctcttaacctagagagtatacagaatttctagggggttctaggaacaactaatgggctacacacagtgtttttgtgttaataggtttggctttctctccagtttgttgaacggttttttattgctgatgtttacgttcttatcatttgctctctggcaaggttttgttcttctataatcattttctcattttaaattcatttgataagtgaatttccaaaaaccctcaactctgctgggtttgttttggttttgggcacctctgatttataaaagtcattctggatactgatcagggtcatacttcttcaggggatatgaacgcatttgattagtagcctgtgggtcagtctgctttccagcatatatttcttggggttggaatcatagaaataaatccaatttgtttgactgagatacttcaatcctcctcctaagtcagttgtcacatttcccatcaatgtcctattttgacattgttcacgtcattgtgagagtaactaaatatgcaaggttttggaataacctttgggatattctattttatttgttttaggaattagaaaattcaatctaagctttacaaaagtctttgctacctcataaaccatgcttcaattccagtctctaagttaagtcatatgacgtgtttctttgttgtgccagggaccagatcctttggtgggtcccagctgtggagtctgcagcagaagatgtgactagagaagaacctattgcttcaagcagtgatgattttgttgaattaaggaaacagactaataaggatttcaaaatacgaaccagaggataaatggtttaagatcagaatacagggaagcagtaaatgtagggaaatagcaaacttgtttcaagaaagtgcaaaatgtttccaatactctctaccagagtagcctcctcagagtaacagtaatggtagtaatcactttagttactccataacttattaacttctttagtttcaactctgataaatagttatgtcttcatcaactaatcttaaccttaactctgtgtctattctaaacactatttttattctcattttatttcattttttaaaactttgtatcttgaaaacaaatcaaacttatagaaaagtgcaaagaatagtaaaataaactgaaaatattctcatttaagattcatcaggtgttagcattttgcacatttgtgtttgccttccatagatgatacacagatgatagataggtagattgattgatgtgtaggtgtgcatacggtataacttaaaatagaagctagatagatagatagctctctctctctctccatatatatgtgtgtgcgtatactattagagcatatatatgtgtgtgtatatgtattctttgatgataatatatttgtttgaaaatccttctaaacaaatatttgtcttagaaaatcatattatggtgtggtattctacgctttcatactgaacataatttctgaatggagattttcacacacattctgtattttcatttcataataaaaaccaaaacaactagcagtgtgaattatagggttccctttatatgttagtggatatcttaataacctttaataatataacaaatttaattataatgtttaaatatatataaaaaatacctttatgaccacgttgtttaaaattccacactaagacaacaatctcaatagagaaaacaggcaaaagctatgaacagaaaatttacagaagagggaaccctgaaaaccatcaacaatgaaaagatgttcaatttgtcagtaattagagaaacacacattcaaacaataatgggccattactctgcacctattatattagcaaaattttaaaactagataatgccaagtgtccttgtcatagctgattggaccaaggcacagggcagcccatgtataaagctgctggccacataggtggtatctcacttgactcagaaagatgggctggaaaaatcagatttgtctcttggaaatctgtatctagcacattttaaaacaaacacgtttggaaggagaataaacgtcagggacctgggctagggcagggcctgaggtcagagcaatgccaatgggcctcagtgcaccaagttacaagggaggggcttcgagcaggcgaaggagccaagagccttggaagaacagactggcagcagagtgatgtgtgaaggccagtagagatgccgggagacgtgccacggggcaaagaggggaaagggattcatctcagttcctgccagcttcccagttccggttcagtgcaaactgggggacttccagttctctttggaggagcaggaattggaggtataggggaggaggagatacaagaagaaggatgaaggcctttgaaattccaaaggaaaatgacttcagatatttgtttgtttgtttgtttgtttgttttgctactaaaaacagagacagagtctccctctgttgccaagctggaatgcagtcatgtgatcacagctcactgcagcctcgacctcccaggctcaaacattcctccttcctcagcctcccgagtagctgggaccacaggcgtgcaccaccatgcctggctaattgtttgtttgtttgattttttttttttttgtagagatgcagtctgttgcctagactggtctcaaatcctgggctcaagtgatccacctgcctcagcctcccaaagtgctgggaataaaggtgtgagccacggccagagattcttatgccttgccaaccaatcaatcaagtgtgagggtataaagacattttcagagatacaatgaaaagaaaagccaccctaaaacatcaagtgcacctagagttttcttgatatccttttgtaacatgccagcattttgtcaaaatcactgaagttcttctgaagtgatgagtcaacaaatgtgtgatgttgaaaagtaaattaaaacacagatttcacaccagccagtcatcagtccctattcatacagtgtcgtaggtcctcatttagaggcattgagaaattagaatattccaagcatggagggcaaagaagacatggaccagattggcttccagagagttgatagaacagtctgggagtcagacataaaaggagaactgctaagaagtcccagggcgtgacaaggcctgtaatagcagaggtggaccccggtacaggggagtcgcagaagaggtcgctcagaccccacctgggagagtcatgagtgaggtggtccatttgggccaggtgttggaagataaaagaggaggcagattgggatggaggttaaaggtgctggggcgaggagcagtcagattgagaaggtttttaatagtagcagcatctgcagggcaaggaaatggtgtgtaatgcaggattctgaaacgtgggcagtgaatagtagaatgggaggctgagggcgaaggcaggggcacgctcagcaacagcaaatgcaaaataacttcagggaagggaacttcagtgagaaaaggtaggctggctggaggcgatctgaagcggtgaggactctcccaagcaggaaagcgccacccacttgtcctccatggatacgctgaccctgggtggctcagacctacctaatgtgaatccggttggggaggaaggggagcgggcatccccaaatctacatccacaggattcctatgcagtcaaaatttgggaattaatactgaaggcaggagtgttaacatgggtagggaaacgcaatactgacggaatcctaaatcaatgactacttagcaaatagaacatctatatttacaagtccaaagtgttaacataactatttgaaacagattgctagaaacaaaaataaatgggacagtgccttggaaatatatcagatagaatatgactggtgatagagtcctgaaaaagaagaaaagcctgggggttctgcagaagatttacgttgttcatggcattaatcatggtagattcccagaggaggtgaaatgttatggacgggtggaatgtgatccattttactgaggaagtaaaactattcttgccttgaaggtaatgtttaaagtcaaagaatttttaattaggtgcggattttttaaaaagaatttttaatttacaaataagattgagttaaagaatcattttctgccgtagaagcaataggattttttaaaaattctattttaaattgcataaaaagcatcttaaagtaatcagataagttgagccataagtaaatggatatttaaagatcttattaaaatagtctacctgatttagttattattctgaccctatatagcaattcacagggttttgtttcaattaagtggctctaagattatcatttaaaaacaaaaagtgtaactctcccgtttgcagctctctgcactcattctatgactggaaggtggggcttgttttgacaatgcttccagttagggtctcttaagtgatttgcatgttattaacctggatagccactaatagggcttcacttcctcgatttcatacatagccccggctcatataaaaaagagttcttcaggagagcagaaaaatcggagcacttgcactatcggtgaaatgtgtagaaagataacagaagctaccctcctcaaaaaaatgatgagtttgatgaaaagaaattaacaagctgtgtgagtgtgctgcacatgatcagccatgcttgctaagtctgtctgttggttgttgctatggctacgaaaagccagtggaacccaatgagctgtctgcagcagagctgagaggaccagccattttacttatggaaaacagtgtggcatattctgctgagcttcgccctggaagaagcctcttttatacatctcttcagggaagagagaagcaatgggcatgttagtatacaatgatcacagccacgcaggcctgcaagctgccttttggacaggctgttgactgccgttccaattagctgattggagaatgtggaatgcagagtgataatgctgcatatctgctatcaggcagcagcaaaggtttttgtcttgggaaggcaagctttccctgcaatattatctcagcagctccctagctgcttaccctgaaaacgagggatccaaacggagggtgttgcactctgctaacgctggtcctgtgcgtggctgtggcatatgagcggcaggtctgaaaaagcaggtgtgtgctgggacgggcactggactggaacgcaggcggacgctctcgggtttacctgcttcctgttaacagattgtgggctcccagggcatatgtctgcacgctgaggccgaggcggagaaggggcttcctgagcgtcccagtacactgacagaggtaagcttttttgacctttttgaaagcacagcataaaaataactggggcaaaacttagcctgaaagatttacgttgattgtgtgatttggatttaccaaacaaacatacacagacacatacacacacgcatacacacacatttctagaaaatagtatcagagacatagagttgtttcagtgaattttggttctagcaattggaagataaaaaacatgaccgatatgctttggggttttaaaaccaatatttactgtttgagcagactacgatggcttgttctgaaccgtcctcacagccaacaacatttctcgcttgtgaacaatggattctttcgtgacctgcactttgacttgtattcagagaactacatgaaaaagaactacatgagaagcatttctttttaagcctcgtaaatgatttatttaactcttaacacagctatgtacacacttaaattgaagaattctgttctctatgtgggtcataatagccagtggattttgtacttgcttaccctggactgagtgtcttggtgtcctgtttgatttagttggggtagttgtaaagcaaacagtgtaggtattggaagccgttcacacctcctttccgagtatctgcatgccttgctggcccagagcacaagacccccattgtgctcccccggctcagaatccaaggaaagaaaggaagcgaagcctctgcattgagttctaggacagctgaggtatgtggcagtaaaacttcttttcttgcacaatttttctcacaagcagataggtttcagagataaagagtgaaaccaaaaacaccgcacacctcatccaaatctgcgctcatacttgcagcaaatgtttgctgtcagttgcttcataataacagcacagaccccgaattgcaggaggaattgcctggtagtgagtatttccttgatttatagtctcttaggaacaaagctgttactgtggattgaaactggtcagtcaaatcaaaatccctggtaagaaaatgacggagtaaggattagattctggttcagcaacatttcagctttactcaagtcagttctttggttgttttgttaccaaaaatgtcagatcacttataatactattgaaaatatttaataaaaatgtttggtcaaaaactttgaacaaaacccctatctacaaaagatggaatctactgtgaaatttaaaataagtagtaactgagatctacttctaagaagtatatttttatttgctacctttttcctccaaaatctggatgacatgagtctcttcagaattttaagtataattttcactgatagatatgggcaggaaccgcctgtttcagagatgtagcaatgttcataagccctaagataagagaatgctaaagcagtaggagaatagttttccaaacttttgttctaaatgtcaaaatagtcaaaatataaagatagagactaagaatctcagtggagccaaacatgtgcaaacgtttggtgataagtgtacgcctatgcgggttgtaggggataaaatggtgaggtgacggccttgtacttcattatgtttaacattcaaaggaaagctaaatgaacagacttagttctgagtccaattctatgagcaaaaatatcagctaagtaagggattctatatgagctgaatgaaaggtagagaaaatctctctccaatttaatttccttcaaagctttacactgccaaaggatttcttagaattgacacagtgcaaagacctgcagcaagcacctgatttcctattaatttttcttgggggagcttttagaagaatgaggtgtagaaatatccagggcacacccgactgctgtgcctgttgcattgatagtggcaccaagtgagacaagacccttagcccacgggaggaatggcacacactttatacctgtgcaagttctttcctattttagtaaccttttaagatgacatgctatacacagatgaccattttaagttcaattctgtacagcgcatctccatagttaataattcaacaattttgagaaccaggttcagagacataatctctatccttcaagactttgcactttcgcttatggctatttttagacccttattttctgccactttccaactcttctgctggcaatatcaaatattttggaatttccaaaacatactatatcagatttttttttttttttttttttttttttgcaaatgcagtgccccctgaagagtcatttcctttaaatctcccctgcaaggacagctgctttcatacgcccttcaagtccagctagacatcccccctcactgtcccccaccctgcttggctacatctgaatcttacttctgactttctgtctgctgaaccatattgcatttgtccctgttcacagccttccagagctttgctggcctctgattctaaagtactttgtccagtgtccagaattttgcattcagacattgtactggtaacctcagacttcaatattttcctattagttactgtaaatatagacttgacctagaaatagaagtcctaatactgccttttatcaaggaaacttaaaacatttgaaaaacaacaatgaggctttcatttttctgatttgaaaatatggcttcaggatcccaatttcataaaagctacaactgtcctataataaatccaaatttcccgagggaaaattttacaatgtatgttttaaacaaaacaacttgaatgttttagtatataaataatactatttttctatccatggctattataaaatgtatagaaaatatccctattacaaatttgttatggaatcagactgtttaaaactaatgttgagttgatgatgattagtagccgattataatgtaagacacttatgaagttgtttttcttgctgaaaccagaagaaagtaaaggtcgtgaactggaaagagattaaataattgaaatgaagtctacaatggcagcatttcttttaatgttcctaagtaaacctaaaaggtgactggaaatcactagttacgttacactagttatgttaccctacaacttgagtacctgggtaagggagagaatattctcttagaatcactcttgatatagatataggtttgtttacagagacttcctaccctctgttctatattagataacattattagtattttttaaataagcctgatttcagtagcctttttatgaaaaaactgccacaatcaaaaataagaatgtacccatagttttattaagaagttataaatacataattccttgtctttaagatatctgtgttgaaagcaaaagttctaattaatactgtatgaatttttgtatataaagtagaattgatgaggaagtttaaaatatcctgatatttgggattagaaagtaaaatatttaggaaattatttaaattcatatttcttgacattattgcattcattccagcattgagttttctaataaaagtaagataaatagcaattcttaattatcatgctgtcctttaaagcttattttggctatcttccagctgattttaatgtacagcatgctataattaaataatagctaaagttggaattggttctattcatcttaaagactaatcatgtttaattattttaaattgcatatagtaattagatttcagaaaccatgattttgtaatatgcctgtactgtttctaacattttctattttaagtcatttataatatttttaaaggtctcagttatgtctaactacatggatagcataatgaaatgagttgcacttgtattttataaagaagacttgtgatatatgattgcattagataattttctggaagttcctcaaactaacaatttaattatggatatgcctgttaaatcctaaactgccactgtcacgtggaaaaatacagataaatatgttttcaaaatatgtttttctgtattatttctgaaaaactcaagacatggacatgcagttaaaaggaaacacttctgcaactgttgagttctgagtattggcaaataagaactcacgtttcagcttaagttcaattaagatgatatttgctgaataaatgacggggaaccagcaaagacgggtttttactttggtgtttgcagcataacagatccatatggaactccaccacacttcactgcaccttggtcttcaaaacggaaatatactagtttaccaagtaggaattttggccaaaaaagcagtggtttcctcttccctatacaggtgaggtagacataaattcagcattaaattctgtaccttagagaagcattatttgagcaaaaattcagaaagctttcactttcctgaatccaatcaagggtcttactttcaaagattttcccacctcaaaaaaacaaaaacacaataaaaaagaaagaaaacaaaaaggcctggtaatgttctcattatattttctaatttctctttatatattcatattataatttagggaaacttatttttaacaaagaacattatctgaaagtttcggtgatattttgtttttttctgttcatttatacggttgcctacttattaaatttttgattttttaaatttaatcagaaattcagtttttctctcttccctctgagatgttttcccagtggttaaagtaaattacaagtcttataatgaattatatcctctgctttgaatgggagagttcatccaatccattgttagaaatagttcttcttttcaggttccttgtcctagtacattttttctggaatagttgaatttgaggacaggggcaacataaacccgtcaggctccaaatcttctgatgttctattcaattcagcatccctcagagactaatatagctgcaaggattagccgcaaggagtccaacaaactatagcaaaaacaggattctaggccgggcgcggtggctcacgcctgtaatcccagcactttgggaggccgaggcgggcggatcacgaggtcaggagatcgagaccatcccggctaaaacggtgaaaccccgtctctactaaaaaatacaaaaaattagccgggcgtagtggcgggcgcctgtagtcccagctactcgggaggctgaggcaggagaatggcgtgaacccgggaggaggagcttgcagtgagccgagatcccgccactgcactccagcctgggcgacagagcgagactccgtctcaaaaaaaaaaaaaaaaaaaaaaaaaaaaaaaaaaaaaaataggattctagccaagagctgtgccactcgtgaagatcctctaagagtacaagcatgggatgccatgaagaatggcaagtgttttaaatgcacagaaagaaaaacatattcaaatgagattttggctatgttggagaaaatttattagtataaatattcattctagtctcctctaaacagaagtccctgtacttacttctcgctgaggacagccagcttctcagaggcactgagtcctctgaagaggtaacaccacagaggcagcagcctggctggtggaaatgtgcttcattaagccttcggctgcatggagaatcctcttccacctattgagaggagtcagcgacttctgcctcactgggtctttttaataccagatatttatacttcatacaggttgcctacactttatgctactaaacaacaaaagtttaagagagcaacgcttggctgcttaaaaatgagcctttttggtagattatcaagatgccttcacacccaattatttcagttctctgtgctaaagttaacgagggaaaggagattagataacaataacctcagctgttgttgtgctataactgtgtcatctggtgaagggtttgagcactttccaaaacgcgtgcatttaacccgtcagacgtattcttgcactatagtaaatactacatattttagtttgctcaatatctcaaaatctaggtttcaaaatttttatagcatagtattactagtagttaagatgaaaattgtataactgcttggttgctctgctacagtgtgaatagaccggtgttgttggatggacctagagcgccaggcttaaaccagtttacgcaaagggaggtcaggagagtggtgaatggcaagagaatggaaaaaggtacaggttacttctgcagaataaaagttacagggaaaacttgactcgctttagaatggcagccggaacagagaggccctcagcaaacaggtcaacatactgcatattcagtcagtatttgctgaatgaatgaacggcttacagcaatcagatcttccccggtgttgtgctaatgccaacacatgattagaaagtgctctttgaatctacagataaagtgacaattcagacatttttctgattttttaaaaatcagaaaacaaaggagaagaaaaaacacatgaaaatttaaaaaggctattattaaacatatatatatatatagtcttcctggtgagaagcattatactttaacaattatataagacagaaatattaccagaagcatagataaagctcaaatgcaacacatcatatggtgaataattcagaagataagaaaaactgatttctaatctcaatttttttaaagcctcttggtacagtcacattcatcaagaaatataatcaacctaaagagttaaaattttcttttgtaaaataaaaaagaataagaaagaaaagtttaaatccagagttataaaattgaagatcttcattttaaggctttagaatatagttgaacagagagttcaagacagaaagaggtatcagtctgggaagaccttttcaagttaaaaaaaaccatagaagctgcaagaccttacacagtcaatcaaaatatctgcttctgatttaactcaagaaaacaatagaaacctattaactagtattcagtcaactacgcaaaagattattcaaaaaatgttcaatttgttcactccaaaagatattgataataataataatttatatagatttcactctgtacttgctaccatcccaagagttttatgcatattaacttttaatgaaaaatctggaaaatcacaaaatctataagtataataccaaatactaaaaagtagggacttttaaggacgtttacattggaatttctcagaaacattttctgcaatcttaaattatttcccaaagagggatttaacattgaatcgctttgtcttagatgcgccgataccactttacatgttgtattatttttatatcatgttaatgaagtgttttgacgtgtccagtctttccatgtgaaagtgacctccacgagagagcagtcttgtttacgtgtttttacccaccatcttgccatgtccactaccaagagtgaacgaaggatggctgagtaactaggccaagtcggttattgtaacaaataaaattcacacccaaggaaagggacctgctgaaagcaaggtaacctgcgtgtggttccatgtgactttcatcaggagaaaactgatctggtctacatatctttaaatgtttgttttgttatgggttttttgtttgtttgtttttggtcagtatgctttttgggtaaaacactaagctaagtatcaaagcaatcctttttaagtcatcgagactttttcaacggaggaaacatgacgcaaccaaaaatgatttggctcatttaaaccacttgtagaatttttcctccgaatttaaccttctgagcaacttaactacatatgagttatgtctgacagttaagaaaataataaaaatatgagaaggcacacttatcttctttgtcagagaaaccatatctgttttgggagaagggctgtcttagggcagtaactcagatgactgataatatatcctgaattctttcacactcactttatttagaaacataactttttatatgatatgtgttctgaaatccgattatatcactcactgacttcctttccaccatagatttaattttacaggactaatataactcatttatataatgattaatatggcttttttaattaaaaaaatcttccttctaaagtgtgccaaggattttgactacattttcaattaatttttagatttattggcagaagagcagaattaccatcacccttatgttgtaaaagtaaatgacaatcaaagccataaataatatagtttagtttgaaaaaccaccttcctgttgacccgaagtcccaaatgtcctgtcagtgctttatattgacggttatctggtaaaatgattggatctatgtattattatgtggcataatattacatcataatgatttcgaaccctaagcttgtgcttcctttgaagatcgaattaggaaaacatacccttaaaacggtgcctcacttttttttggctctggtatttaattttgcaactgtcaggaacaaagagattatgatcagaaaattatgtttcctggggaatgttctgttaatgaattgcctcattcccaggctcctcagtcatggtattgcattctgcctttagcccagcctgtgagaagaggtgctgggtttgcatggtgcagaaaaggcctgagaggaggagagaacaggagcgtaaggataggacccagaaggactctggccctctaagtatttgttaccaatgggatcactgaaccactagagcttttgagttcagtaggaattaggaaaagtgttgccttgaaatttaaatgtttctgcttccaaccaaaagcaaagcattggagaaatctgcatgcactctcgctaacccctcagagagtgaaagagtattttatctggtcaacaaaacagaatggcctcttgttgattgacatggagaaatatcacccgtttaaaggtcagattattaatttgtcagtgcattctcttgggaaataaaatcagaatttcatctggcaagtgtcatgacaggtgacacatgatttttaagactatcaccaaaaaactatatctgcccaatatacagatcagtaccatgagttcctaagtgccaagtggcccacagtatctggagtttcccctcctggtagatgggcttgagcaggcaatgatgagttctctgctctcctcttccagaccttgaagactgttgtcccatttgttagtatgttagtgtaagttagctgattgtattctttctaatttgtttggtattgaaaagatggccttgatagggaacgtggagagcgagaaagacctaagttctgggtacaacttaacaagtggtcagacccaactgtggatgtcgaagttgtaactgtatattaaaaaaatcatacttgcattttcatataatttactcattcatttattatacatccatcaaggaccggaggaaaagatgagagaataagccaggaagccattgaaagagcttacaatttagtgcaggaagacaggaacgctagttactgtaatttaagatagaaggtgatggagtgctataaggcagatataatcaatgcatttatttattccttcaaaagacatgcgcagaagtaacttatacaataaagaaactctttgatcgtcttaagcaatggagttccagaagatgataataaattgctcagagaattgaagtttgttagaggatcgggaaagatggattagagaaaatggtattttaattggggctcgaacaaggtgggattttgacaatagtgtggaaaagcaagctttgtagcatcaagaattgttttataccactcacatgtatttggcaccccctcagtgctttcatgtaaattgttgagtctggctcaacagccctgggaggtatgcactatcatcactgtttcacatgagaaaagaagaaactgaggctcagggaagtgctcattgggttttacctgttacgagtcagtggccaactttgagatgaactttttgaaaagaactttgttcttgacagttgctaaagtgctgagattaaagcacatggaaagattaagaaatgtgtttacaactcaagagcatcacacacagagagagagagagagagagagagatgattcagttaaaaaatgggcaaagggccagcatagatagttttccaaagaagacatacaaatggcaaacagacgtatggaaacgtgctcaacatcactaagcatcatggaaaggcaagtcaaaaccacagtgagacaccacctcacacctgttaggatggctatcaccaaaaagtcaaaagataacgagtgttggtgaggatgtggagaaaagggaacccttgtaagctgttgatgggaatgtaaattggtacagacattgtaaaaaattgtgcagagtttcctcaaaaattacaaccagaactaccatatgatctagcaactccacttctggatatacatacaaaggaaaggaataaatatggaaacaacctaaggacctgtccatggatgaatggataaagaaaatgtggtgtatatacacacaatgggatattattcagccctaaaaaagaagaaaatcctgccatttgcaacagcatacatatgaggacattatggtaagtgaaacaagtcagacagagaaagacaaatactgtacaatctcacttatatgtggagtctaaatgttgaactcatagaaacagagtcgaatggtggttgccaggaattggtggggggaggaaaatgaggtcaaagggcacagactttcagttataggacaaataagttctgaggatctcatgcagcgtggtgactgtagtgaataaaaccacattgcacacttgcagcttgctaggggagtagatccaaatgttcttaccatccacaaaaaagataagaagtgatcactaacttgattgtggtgatcagtgcacagtgcatgcctgtatcaaagcagcccgtggttcaccttaaatgtctgcagctttgtcaattatacctcaatacatctagggagaaaatggagtatgcttttaagggtatggaagcaacaggtacaattaggaaataaaaggatggagggggcccagctaagacagcaggaagaaaagaggagagagggagagaaatgaagaaagagctaagcccatgcacagccctggggaaggcaccagcagcagagaagaaagctgcaagggaagcagggctaccccaggggcaagatcccagggaggacagcaaagagataggcccagggaccgaggacagcccagctcacagaggggagactgtgacctctgggacactggaatgaattgagcaagtgagctccactcctgagagccagaaggacagtcagggaagttcccagcggacgcccaggaacggcactgactcacactctcctccttcatacgctgggtctgaaagtcaaagactcatttaaaattattactataaatctctatgacttagaaagtctgacgcaggtgagatttcttggattcagtctttttcattgaggggaatatgttatagggtgattgctagtggttagaagcatggactttttgtattttttgtgttttgagatggagtcttgctctgtcatccaggctgaagtgcagtggcatgatcttggctcactgcaacctctgcctccccaggttcaagcaattctcctgcctcagcctcctgagcagctaggattacaggcgtgcaccaccatgctcagctaatagtatttttagcagagacgggtttcaccatgttggccaggctggtctcgaactcctggccttaagtgatccgtctgcctcagcctcccaaagtgatgggattataggagtgagccactgcacctagaaacatggactttggactcacacattgtcgggtgggagttctggtttagaaagccgattgcagtgaagtaagccgaggtacgaaaccctctatgccacagttccctcatctaaatgagtgtcgccatagtcccaggcattaaaggcacgtgtgttggatgttgatgagagcactgcatctgacgcaaagaaggtctcacagacgtcagccactactggtgttggttgttcctgggagtttatagaaagactctcttccaaattcctgtgctctagttactcatctctaagtaaactctggagtcttgagaagccaggtacatgtgtagtttaagggatgggcggctgcttctgccactcttcagggagatctaggcaccactacaattcgtgtgaagtgtaagtctcagcgacctcagcgggactctaatgctcgtcctaccatttgcagtgtttgatctgtggtgttaaaagactcaggcttctccttttacatagtatttgttagaaaacttcccactacccggtttgctaccactatagccaatgtcactgggcatctcacgattctctgtagctgttacaacagcatcaataggttctctaaaatgcagacaatggaaaggagttgctaaatttgtcaaactttaagtgaatctcatgcttatttttttggtatgttaggtggctcttcttggtggaaggctcacaacctgtaactgactccagagcttctgcttaccaattccagaaaactaggtttagagtatttcctctgagcattccttcatgtgcttttatgaggctaagtctccttccctatatccaagatggatacttcgggaaggtaacatgttctagttctcaaattgatgtcagtacatttatgttactttcttctctatttttggagcagtgagggaataatgggaatttatacaaataaagcacatgagtatttcaagttcaaaaaagaagacaggcttctgggtggatcaggccagtgggcagatggtgatgctgttaaccaaaatgggaatggagaagacctgttttgctttgcttttgatatcagggcaaaaacgtttagacatgtagaactttatatctttgctggaaacactggtaggcagtgagcagtgctgttctgggtagcagaaagaatggggcaaatcagggcctcacatgtagcctaattcaagatatggactgatggttgcatacagcttaattaagcatatatactagctttcgagacgcttttttctgataagaacatgtttaattaataagactatgatgatgtattttaagtcactctgcaaagaaagatccactttttttaaaaacgaggctttttaaaaagctattaagtgtagttgctaagtacacttaggttaaatgttgaaactgcctccacgagttttttctgcttgtcacacgtgaattttaaaagcaactcataatctttttttctttgtttaaaacggtaatacaggatttgactggcctaaatgtcattatcaggaagaaataatgcaagttaaaaaacccaggatattgggccaattttagtgattttatagagtttgatattgagcaaaagttatttattttatgttgaagttgttagaatcacaagtttattctggaaaaaataaataaggattaagatgatacattatcctaaagagtggtgggaggattgaatggattatgtattctaattgtgtagggtgaggtctggcatgtgggagatgctaaacaaatgtgagcaggcattactatcattcttggtgtatgcatgagttcatgtaaaaggcacacaccgtgcacctctgattctccaggctgcgtatgttcagtggtgactagtcgacttgctactcttggtgactgttcagtctttgggatgagggaggggaaactgataatcccgcagcatcacaagtgccgaggcagaaggaaggcacagagtagagtgtgactgacccttctaggcaacttcagtgtgtgcatggtgaaggcaggggcattagatggagaaagcattgtctgcaggtgaacatggtgtgaaagcacattgcaggctggatggtgcgtctggaatgtaggaacagtagggagaaccgggcgtggggtggtgtgggggcatggaagagctttgcagtcacataaagttggaattcattcccagctctgtagtgctaacttggtcttggggaacaggctcctgggcttttcctgacccctatttccctacttagggggaagagataatagcacttacatctgagtattatcattaggattaaatgagattactgcaaaatgaccggcatagcgcctggcacgtcagaggcagaatgaatggccacccatgcctatttttgtcatcagcatcaggatcatcatcatgttaagtagtttgggttaattctttagggaaagaaaaagagagaaagagagagaaccattggagcttctttacagaggaaaagtaatgatcatatttgtgggtgaaaaatatataactggtaacagtatcaaattaaatgaagggcacaagaaaagattacgaaatgatagtgtcgatgaattcgacaagaggaaaacttgggcatgaactaaggtgacggggccgggagaaatgagcgagggatgtaatcagtcaagccctgctctgtgtcagtcgctctcctaagtgtctggaacgcatctgaaacagtgtctgccaaacagtcttcggcacagacagctctactcgagtgtggtcctgcgttgctagaggcgcatgggatgcatagagtgagggaaatctgggggtacccgtggcttgtggaggagcctctgaggtttctctgaagaagtgcgtgaggtggggcctaagaatatgtccacattcgctctggaagctgcccagccccactgtgaccagggaataatagcgtggccacagagcccaggcatgcccagccctaccgtgaccagggaacagcgtggccacagcgcccaggcatgcccagcctcaccgtgaccagggaacagcgtggccacagagcccaggcatgcccagccccaccgtgaccagggaacagcgtggccacagagcccaggcatgcccagccccaccgtgaccagggaacagcgtggccacagagcccaggcatgcccagccccaccgtgaccagggaacagcgtggccacagagcccaggcatgcccagccccaccgtgaccagggaacagcgtggccacagagcccaggcatgcccagccccaccgtgaccagggaacagcgtggccacagcgcccaggcatgcccagccccaccgtgaccagggaacagcgtggccacagcgcccaggcatgcccagccccaccgtgaccagggaacagcgtggccacagcgcccaggcatgcccagcctcaccgtgaccagggagcagcgtggccacagcgcccaggcatggagcgatggatttcatataaatctgcagggccctgggagccattggtatggctggaatgcaggatgcccgatatggagagatagtgagtaaaatcgagcaagcagaccagagccagatggcagggcaactgtgagacatttcaagcaggaaggtgaaataggatttcctttataagatagtttctctgttgtgagagcaccactgaggtagggtgggaatgaattcaagaatttcacatagggccaggtggggtggctcatgcctgttaatcccaacactttcagaggcagaggcaggaggattacttgagcccagtagtttgagaccaccctgggcaacacagtgagatcccatctctacaagaaaatttaaaaaaaataagggaatttcctgtaggaggacagtacagtaatccaggaagaaaagatgaatggctcagctgagacaggacagtagggctgggggaaaagtgctggcgtggagagattatggagacagaaccaacagttctcagctggcatttgggagtagaagcaggctatggtttaatcaccaggtttctgtcttgggaaaacaagacatggaaaaagtgttttgggggaagaagatagtgaaactggtttgagactttctgagatggagatataggtggaacacttaggtggatatgtggttttaaaaaaaatgtctagaccaatagaaatatattgagcagcaaagagaagccacctatgtaatttttaatgttctatcagccacattttaaaaagtaaaaggaaacagatgacaccaacttttataatatttttaacctagtacagccaaaatatgatttcaacaagtataaaaaatagtaatgatttccttgacattcttttttttcgcatcttgtgtgtattttgcaggataacacatctcagtgcaagcaaggcaggtgcccgggagccacatgtagcccgtggttgccatgtagaccttcagagagaggctgggcaggaggtgtctgctggggatggactaggataaaaaccttctctgaaggtacagatcaaagattgctgaggcagggagggtgcagcagaggtgagcttgtcccagtggcaggagagaggaaggaattgccgaagctgccccgacctctttcttctatttttgagggtgtaggatgtgagattggagtctcagaaactttggaaactttgtttatctctgttgaaatttacccaacaagaatctgctatataaatttgcagggcccagcgcaagatgaaaaggcaattccaaaagtatgatgaataagttatagatgatgacagcagggtatcaaacagaacacctggccgttctaagcacagggtcaggtgcacatgctcagtttgcaagctcatgaagcccgcctatacacactacttgtgtttttaggcatcatctgtgaacactcttgcctactgtgaatcaaacacagtttacttagtgagatgattaatgactttgagttactgtggggtattgctgctgggagccactcttcctggctggaggtgaaagcagcttctccccaggccagaggtctgggtgcaccagtcctgttatatccttcccacattcctcacataggcaggacttcaatcatgctcagacaccatcaccctgaccctcagtcacacacccaggacctcagtcatgcccagaagcatcatgtcaaggggaaccaccgagtccccagcctgctagaaatctggcagctcctcattatcattctacttatagaaattcctctttctccacaccttgtcatggtaaaagcatccaacatggatgctttagattgggcttcctcagaggggtggcgggggagaactggacccaggaaacaccatctgaattccctgagatcagcaggatatctagagagttgaggctgggccatgtatctgcagttcttgtcccaggacaatgcttgaagacaccttatttagatttttatatttgtggctgtgactgcaactcccctgccttaaaaatgtaaatttaatgatcactttcaaactgtccctgtagtacattatttatgaacataggaccttgcctccctgaatagcaccaagcgcccatggctcagacactcatcagtggggccgtgccccacccactgcctggatttcctccctcctcctccttctccatctctccactctctttctgctgccctctctccccaccctaacgtcatttctttacctggttatttttaaaatccaaaaaacaatttgaagtgacatttgttatacttaagaaacaattttatgtcaccaatgtttggtcacttagttttaaaagtcagtaaataacagtatttttttttcttttaaaaaagaaagtaaaacaaatgctttttgacagactttccctttgtatgtgccttgtcaaaggcagggctcctccaattctgcaccaatgtccttccaattttgcaggacaggaaggggcaggccaggcaggagcctgcggggaccaaggcccagtcatggatttagctttcgaggaggtgtggccgctgccatgtgactccatatctttcaaccacaggcttggtctctgtaaaagaaggatgctgtgcatagatcataggaccagtcgttctcttatatgaagtaatttgtgcaaaggatacctcacagggcctggcacataactggctctcagtccataataacttcatcatcaataaaaaaaatccccagagatggaaaggaaatctttggcccagacacgctttgttttgtcaagatctcccagaggtattgaccaaacaaggctcaactgggtcaaaaataaaaaaatacacagaataaaaataaatttccataatagataaataaataaaaatcttcttaatatacaatccatttgactttccgtgatcatgttgttctttaactgttgaagtccaacttaaaactcaaagaaacttcattagagtataacaaacacactcttgtatcttctggtcccaattaattacattgcactaaggcaaactaatcatctggagataaattatgtggagtattcacggcaaaaatgatgacaggatagaatgtgggagctcactgttttctaaagaccttattcccaaagaacagccatcctgccactgcctaggctagtagagactgcagtgccacaatcctgaagcacttgcttgagaatgcatcatatgatcttttcccaacagaatttggatttacctgcttaatggtgtttttcttgggctgatctaaaatgagtcttcacatcacatggtattggagctttgcgatctgcagggttagttaagaaagtaaaataacagtaagtattcttataaataataataatggccaccattcattcaatgcacagtgtgtcaggcagcgtgccaaattctttaaatacctctcattgactattcacacaaacgctctgatgagtacattattctcattttacagaagaggaaacaggcgcagagaagttaaacaacttgcacagggtcacacatgtggggaaagtgggattccagcttgagtcggccacattccaaaccctgcactgtcaacagttttctagactgcccatttgtgggaactacagatcagccaaaagaaaatgttacatttctcattttatcattctctctgtattttttgctcatgggctctatggaaaccgttatttataagtgaacaccaaatttccgtatcctcaagatcagaaatagcacgacaataaaaagagggaggaagaaaaaaaacagtctaggatgtcaacaattttttttctgaagatttattttcttctctttgcttgttcatattttctttccttccttccttccctcctccccttccttccttccttccttccctccctccctctctctctcttctttcttttcttttcttttcttttcgatggagtcgcaccctgtcgcccaggtcggagtgcagtggcatgatctcagctaactgcagcctctgcctcctgggttcaagcaattctcctgcctcaacctcctgaggagctgagattacaggcacctgccaccacacccagctaatttttgtatttttagtagagacggggtttcaccatattggccaggctggtttcaaactcttgacctcaggtgatcctcccatcttggcctcccgagtgctgggattataggcgtaagccaccacgccgtcccatattttctaaatctacttaacgttatgaaaatttcaaaataaggagatgtatctagaatggggccaaaggaaatttaggtagcaccaatcatgtttagacatctaactaggatgccacaagactaagcaatagaaaacaaatttttaaccctctgaatataaacattttgtcaatttccattatcaaaatttgcatcaattttaaattgggacattatttagaagctgtcccattagaaaactgatcatcaccaacttgatcttcaatgccagggggcctgtctgtttactggcagtggtggttttacccctggattaagaatgattagctctactttggaaccaaatacagttcacatggagtttaaaaggaatccagagtcttggggctctgtacatgttgaacaatttccctttgttgactattagcactctgatctaaagaagaaaatggttactctgacggcatgtacttgtgggggaaaaacaatcttatttttttcacatttttaagagtatctagtgtgacaaatatcaagtatgagcactcacttttataataaattccacgttgcagattagtcctaacatgctaggtgaaagagttcacccgaggcacttagagtaagaaaaataaaaaacaagtcaagaggtcatcttcagaacatccactgtttatgataaacactgtacagcctcaccttggctggctttgtacgtccattattccatcattcacttttctccactgtgagctaggttttttctatggggcaggcactgtgctatatgaataaaacagaagtcatggccctcctggaccttccacacccaaggtctatgtataccttatatctgaagctaacttgcccagctcacaaacatgagtctgtacaaacaaaacaagatcatatgaagtgcagaaaagctttttcttaaacatttaatgtattcataaatgtattgcccatattttgttcttatgtaggtggtaaatttatacttaccattgcatggtaataaaatgtgacatgtggcaaaaatgtgctcattctaatttaaacagatgtaggttttaagtattgaaaattagcatactttcccaaattagtacttagagaaactttttaaattgtttatgaaaagtggcattttaataagcctcactacattgccatgctcttaaaagcacattcatatattttattatttttcccccatactcatgattttctactcaatgttcacatttttcagagaacagagagtatggaatattcatagctaagtaccaaaatcagccttcctttccattgacacaatgtggaacaggaatgcaatttctgtggtacagagtcaatgctgagtgacaaaattggatcatttcagaaaatgtgatcagggaatcttgaattgttccctaaataaagccagttgtttagtgataaacatattttagagtatttgtctgtgagatgagagatgctttcttatcagaccaatggactagtttatgaataatgaagttaacattcttagaattgaaataatagtttcttttacatgaatagaccatctatttatatatggctgcacaaataaattgagtaaaatatgagttcatagatttcttggctcttttaatgtgaaaataattccaactgtagagtcgcccagctcctcaggtaccttgtaatgatccctgaagtttagagtccttattcattggaggaagctattagtacacattcaacagataagtggcaaagatacacgtattgtacttgtagagccagggtggttatcatgtgagtgagaattgggaatgttttcgctacaatatgtctttttgagtgtggccactaatcagtatgggttaatagactgatcgaataatacatcattatttttgtgttttacatcttaccccaatgctagctactctcaggacaaagttaacataaccactgaagcagtgagtggagataagtgtagtttaacaattttttttcatagcaaatgtgttgtgcgcagatgactgtcttctcatatcctgaataaatccaacactatgctattaaaaaaaaaaagaaataaaactccagatctcttgcctcctcaaaatctgtgaaattagagacatgtttcaacagcctagaaattagcaaggaccattcatgaactttttaactacagtagatatattgtttctcagtgaaacagataacggcaaatgtagcccatggaggcactgctccagttgatttggaaacagtacaagagtttctaagtatttatataggtaggaagaaacttagggtcaaactcatttccaaatgcactaaaacagtgagaaaatggtcaagaagcaagaatagcagcaaaattacctaacaatacctcacctggcacattttcaaaaacttctaatgcttaaaaggagtttaatgaaatattgcattaaaaatcaagagaattaaaaagttataatgtctctcttgaatgattctgttgtaaaaaaatggtatattctgaggacaccaatgtatccatttaaacataaaaatagaggagactatagaatgaaattatgactttatttgctaaaattatatttaataatttatatttaaacattataagaaattatatttaatttcttgattatatataaatatattccatatttgataagcaattactctattatctaatacacaattatatattaattatacttataaatatgatttatttcataaattatactttgctaaataataaaattgttatgactttattttgaataattattgcatagaatccctgagtacctttgtagctaattcgaatctggataaggtgagtggagatgaatgagtattaggagttctctacaggactgcttaagagtagaaggaaggcagtctcatttctcatggaaaatggaaatatcatattaatctcaaagaaacacaaaaataagctttaacactggatcttaagctgacttttgagtgttaagaaaaagagcaatgcaatgttgaagacttcacaaaaaagagtataaacatcccaaacaaagatgacctgacctggtccttgatctgtaagtcaaacgccccaaagaataattggagtccagagcgcaggtgtgttctgcggcccaggaatcatgtattctccagctcatgttcttaagtttgtaggtcgtggcgtttgttagtacttgaatttccagcacccttgtggttaccgaaaatagaaggtggtacagaagtccaatttggagtctcgaaggtgtgttcaaatgtgtgcaactgtttttaaaataggccaagtggatagatcttaatctgtaacacgaaaacagagttcaagttgcagaatggtggaggctctgcaatttagaacccacgtttggccacagtgatgggcaccgttggtgaagagctttccaattccttcttctcttacccaacgttatatatgcaaatagaagggtggcttgaattgagtctttctctgtctttgcaggtaagattcattacagggtataattataaaattcaccaaataagtataccctaatataatgctataaagtgaactcagctgcaaggttctctttttcagaagtttcaccagcgagccttgtacgaataattcctctctgagattatctcatttctgaagtcatttttctaattatcttaaatggtgctattctcctttgatagttgactgattctgagatcacactgccgtacttgagtgtctggctatgactcaactgaaatgtgcctaatttgaaactttgaagcaccaaattttatttgtttttctttttaggatatagcctattaatttctttcccccgctgaatccattcttactgaaattattgcaaaccccattttctctgtcggtatctcttttctttctctatgaaaacctctttctgttgctccattgatgctaccacctgacacttcaatgagtctacgattgcgaacagcattaacagctcatttagttcatgaggggtttgagtagcaagtctccgacaaagctgctcccaggcagaacaaagcagcagctggcgctggagcagccctggtgctcacggaacagcccggcaggccccgtggaaagccctctcccatctcagatctggatctggaacatgctgcctgcgccatgtgatgtcacctgcccattcgccgcaacaatgtttcttagaccctggcgctggtcatggctttacctgtaaaatcatcttctgctcccaaattttcaaaatgtgtaggggatgattacctaggtttcgtaatgtgctttccagctatgattcaaggttaaatgaaaagtgagaactataacactcgtcctgaaagtctccagactaggccctatttaagaaatgctgtagagaaatgggcggtaggaacaatacgggaaacctgcccgcccacaatctgcgttgctggatttagccataaaacccaagagtacccaaagtggaggcacttaggatagggtggagacagatgggaggagggaggctcagagagaaatgagaagacctgaattttatataaaaacttttgtaaattaaaaaagaaatcagacagagctctcagaaatcataggtcaaagtcattcaatctttctacaaagtaaaaaatagagaggctatatagaaatagccccatttaaggatgctatttataatcccctcgggtcgtataacagtttctctgtcccttacggcttatctttcccttctaaatatgtgtgtgaagaagatgttgtcttttacgtactttttacttaatctgttccccaatgcatcagttcagtttgtccacgccagtctctcttaaccattttcacttaaacaagtcaagcctgctattcattattgctgttgtttgatctttccattcaaagtatccctgtcttgctttatttggtgtatattcactcagtacattctagcgaccagccactgtgctgggaactggttgtattttgtttttaaaggaatcctatcctcaaggagcctgcagtgtagtaggaaaaagaggtaaacagcaacaacagcctactgaacccctcctctgcaaccacttgatggagtagccaatattcatgcaaagtctcatttaatcctctcagaaacctcccagagaggtagatggggttgtctgctatttttttttttttttgagacagagcctcaaaaaaaaaaaaaaaaatggatgaacatccagattggagtgcagtggcatgatctcagctcactgcaaactccacctcccgagttcaagcaaattctcctgcctcagcctcccaagtagctgggattacaggtacacaccaccacacacggctagtttttgtatttttagtagagacagggtgtcaccatgttggccaggctggtcttgaactcctgacctcaagtgatttgctcgccccggcctcccaaaatgctgggattacaggcgtgagccacgatgcccagcctgtctgctatttatagataaggaaatccaggctcagggagattaagtaactctcctaaagtgacatggcttgccatgggagaagccacgccttgagatcagctgtgcctggttccaaaccctcagttctttccttggaatgtaatcactgctgtgatagagggatacttcttcaattaccattcattataaccatagtcaatcaatgttaagttagtgtgtatttgtttgtaacaaggtagataggattataactctgctcctccccctgctagaggaatgatagactctcacagggccttacaaagtccattcttctctatttcttccaggtcatttcttttaacgccactacctttcctctttagccttctctacttactaaatgaagcagtggtaatgctgttgctcgaaggagactgttatgtcaatcataggacaaagtgattagctcagatatggggattttcttaatccagttgtttgacagtcccatgtattcttgtttaaaattaaaatagaaaaaaaaacccaaaacataaaactttgaatgtgagctatctgaaataaatgataaggaaattaaattcaatatctaggtgtgcccaatccatttcattttccccaacagcaaagtaaaagtctctatatttttgaagatcaatttgcaaataatttttttccgtgtaatgtaaacaaaatggtatctaatgattccagtgtgccaggtgtggttttccagcattatattcttcacccctcttcttaatgctttaaggtaatgaacgatattcccattgctcagatgaggaaaatgaggctcaacgattatgcccaaaccagggagctaattcgaggaagtaccagaaacttaactcagaactcttgattctccaagcccatgctcttaagatgatgatggaaacagcctcagccaacacgtggggagggcctcctgtgagttgctgttgtttaagagctttgcatgtgttaactcatttaagcctcacaacaattatgagtcaagggccacacagtgcctatttggtgggtaagagaactgaagcccaagaagattgtagcagccacagaagctggcagtaatagagttgggtttgatggtggcgggtaagtacagaccacgctctccatcattacactctcacacagctcttggcacatgtgactagaaagacaaaatatttacacgagactgtctgttataaaacggaatcgttatgatttatattcatttcttccattcatgatacttaatcagaaaccatgacacaggaacgcttagaacaattttcatgttgcctgtgtatttttaactttgtttaactctgaaaattcaccggccgcctaatcaaacctaccttcccctccattatgactgacagcattcaccattttaagaaaccacagtaagattcttacaggttttttgtttttttttttaaacgctcaaagtcaataccttatggccttgaataaccttttcaaaattgctttttctgtcccgaggacacatttcatcttcaatttagatttaaaaactccctaaactccatcgaagcaaccctgttgaaagctctctgaacaatgatctggcagtgtccaccgagaacagaataaacaatgcgttcctgttttgtgtttcctgttgatcactgctgtgttcttatttctcttgatatcactgatcagtaaattgtagttttagaaaaaagagccaactacttcactatatttagagtcaaaaatattcaaatgatgcagctcccggggcgttaggcatgtcggctcatttttcatggcagattttgctccattaggaaatgataatgggccggagacttaatgccacaactgttgtaagcattcgttgttgatgcccagaagttctttcaaaacttctggaagtattttttaactaatatcttaatggcaggcctaatagtttattgctgtcgttcagccggtctaatgtaaggaaggttgtttttagatgattgttttgtttctgtttctagctttcatggaacagatgacctcaatacagtcatttcaccaggttgggtttgcctcaaataacaagaaatcccacggacaggtagcccagagtaggttcctctctatcctctctccatcgctgtatcatctctctgttagcatgcacccccacagaatgacatctgcatttcagtctacaaaaagaggagcagaacaaggttagaaagaaaaggacagcctggcgcggtggctcacgcttgtaatcccagcactttgggaggccgaggtgggcggatcacgaggtcaggagatcgagaccatcctggccaacatagtgaaatgccgtctctactaaaatacaaaaaattagccgggagtggtggcaggtgcctgtagtcccagctactcgggaggctgaggcaggagaatggtgtgaacccgggaggcagagcttgcagtgagctgagatcccgtcactgcactctagcctgggcgacagatccagactccgtctcaaaaaagaaagaaaaggacaaggaagccctcttctcgggaggttagtgtcgttactgtgcatatgaaattttcaacaggatgccttgcctttagcttattggtcagaaactgcaaggaatccaggcaggtcagttgttaactggccgtactgtcaggattctgtagtgaggaaggctgcaaaatggatcctcaggaggcagaaggaagtgtctaccacacctcttacctacttgacttattttacagagtaatgaatatgggaatagtgacttaattgtaaaataaaacatcagacagaacctcaaactgaaaatgatcctcgaaggaattcttgccaagaaaaagagggcccttgctagaaggtcaaaatgtgagcatttactctgattcagagggcagcttcctgcctctctgcctgaaaccaaaatgtccatcactgcgggcaggatattccctctcatgcctgccactggagaccagtctacttctgcttaccccgagggtctgaacaaagacttcgcattttttttttaaactacaacatggttactgatctcttaacgtgtctctcccatacctttttgtttaatggattgactttgctggttaaagcattcccttccagacttctctataatatactatacataaaatcaagaatatttgcaggcacagaggtaaaccaatgaggttgctaacagccagaggtggccagtccaggaactttagcttcccaaggcctcacttggccacctgagaactgaggagatctatattactgcagcactgtagtcgttgctaacacagaagtagaagtagagagagagtctgcttagaagacagacaacgcagaaaatattcctatgtccagtctctgagggtttgtgtttccagcctcattcatttaggaagtttttctcatgtacttgatataaggaatctatagttccttctacctcttgaatgctggtcaactgtccttcattgggcttaattcgtccttcaccgtcatgagtttcaaggacactttcctagcacggtgtgtattatgtactatccctgctaaattaacttctgtggtcatagtaattatggaattgtgccatggcttgttggattaatttattcagttttttaatgtctcagaaaagatacgtttcatgctgtatcttgatgatttcagagtgttttacacatgtgtaaagaatacattttaaaacattgttgggccatagcaagccttcctgtgcccaagtggtagaagaaaagtttccatagctcctttcaaataaatgcagtgaagaccaagccctctcctatcccaggctttgacccctgctctacagtgtatgacacacaaaactctccttatctctcctgttgacatgacttggctatttgccagaaaataagattgcaaatctccagtcttctcagtcagtgaccattcattgtctgtttataacttatgcataatatggccacaagaaagagtttcataccattggaatgactatggcctgaccaggtggcatggttgatgtgttactttatatctgcctgtctgctcataaaactacattataaataatcacatatggtttcaggtggtataactgccaggcaatatatagacaaatacataattctctcaataaccctaatcagaagaaatgtttatcagggacctcactctaccctagtagagtatcacatggttgtgaaaaaggtctaggaatatgatatatgaatgcaagtaacttgttttattgaaatctattttagaataaatgcaaattaagataacagaacatattatatcctgaagggaaaagcaagtggcacctgcctcttaagacagcttctaaaccaaatatgtagctacaaagcaatgtttcagagaatcgtcttggttggaaacagctgcttaattagaatacataatgttttgctttttacatgatcagatactttttatttcacaagttctgataaatatagaaccaaaaaatgtactcttgtgttgcttaatgccttcggcagaacttatttaatcatttacttattcagcaactacgtattggcccctacttagggccaggcagaatgcagtacctgcgggaggaatgtaagtcatgtgaggggcaagcgggagctgataggctagtggaggagaggggctccgatcaattactccaacaaattcaagcaactgaacctgaatttagaaggaatgaggaaggtgattctttacgagttaaaaaaagggggtggcggggctacgctggtggagcagggaagtccttcctgaggaagagacacgtgaaagctggaggctgcatggcattcgccactgggcagggaaggcattcccatcacattgagccaggcaagccagggccctggatgaggcacagtccaggaatggaagggaggctggagaggccggaggcaatggaagggaggctggagaggccggaggcaatggaagggacgctggagaggccggaggcaatggaagggaggctggaggggccggaggcaagggaagggaggctggaggggccagaggcaatggaagggaggctggagaggctggaggcaatggaagggaggctggagaggcgggaggcaatggaagggaggctagagaggctggaggcaatggcactgggaggaaggtggtggagatctgggcagaaatgctgcagaacaccagatcgtgcagggccttcagtgggccacatggagaaggcttcacaattttcatagcagatttagcgactgttgcatatgctcaatttcaaatggaatagaaataacaagaaaagctaagtcatggttacataaacagcagaggtgctctttaaatacacaaagaattcaggcagccagtttaaaacaaagtttcaggctgggcgccgtggctcatgcctgtaatttcagcactttgggaggctgaggcaggaggatcacctgaggttaggagttcgagaccaacctgaccaacatggtgaaacccgtctctactaaaaatacaaaaattagccaggtgtggtggcgcatgtctgtaatcccagttacttgggaggctgaggcaggagaatcgcttgaacccaggaggtggaggttgcagtgagccgagatcaccccattgcactccagcctgggtgacagagtgaaactccatctcaaaaataaatgaataaataaaaataaataaatgaaacaaagtttcaactagaaaattgagcttctaacagaggttttaagaagttatttctatataatctctttcaatgatactggtcctttaaccttttgttaagattttcacctcacttgataaacctcaacccagatggcaaaatgacacatgtgatgacaaatcgcctactaaaaagtatttacttaacatcaataaccaggcagtagaagtcattggacgtatgatttgactcctttcaaacagtgctgcaaaaaggcgtaaatcatggcagactgccgaatgtaatccagataagcccaagagaaagcataggtttaagagtcagtaaggcagttgcagtcccatgcctctatctgcctttcaggacacaagtgtagggagcttgcatgactggtctaaagtcactcaatgtatgggctttagtttccagcccgatgcatgcattacattgttcagcaggtggcataccatgggtgaggttcctgtagatgacccgacggatgcttgctacgtgcccagagctaccaggtatccttatttttcttgcatatgcttcacttcattgagtgtggttgaagcagacaagcataaaaggtgttactccaggccaggtgcagtggctcacgcctgtaatcccagcactttgggaggctgaggtgcgtggatcacctgaggtcaggagcttgagaccagcctgaccaacatggaaaaaccccatctctactaaaaacacaaaattaaccgggtgtggtgatgcatgcctgtaatcccagctattcgggaggctgaggcaggagaattacttgaacctgggaggtagaggttgcggtgagccgagattgtgctattgcactccagcctgggcaacaagagcaaaactccgtctcaaaaaaaaaaaaaaaaaaaaaaaaatgttactctacttagtctagccttcattttgcttacaatgtgcgtgacttcagcacttccctgttcatccccatcccttcttttagtcagcattagctgatttctataggagaatctgactgctgtttcaatatgtctttgaaactcacgccagtgtttcagatggtcttgctgcctcgccctaagcactaaaatatttgactaagagaatgacacattgttctcctgggatactagacaatgccactagaatgacagggaccagggaggtctctaaacatctatagcacaactcactcttcaaaggactgcaggggtaaagaatgttctctagaaaacaatactcatgggaaaactacatttacttccttcctactgggatcctctcaaataataggaagcgatgaggaatcaattgagaattctgtgctgtcttgggaaaaaaatgtaaaacaacactcagagaaaccctctaaatatatgtgttcaaaaactcacgcccatgaaagtccttggaaatcaccacagtatcttttaaaaattactaaatttagccacatatggaaatctgcacagtttttcaaatatattttgattatttaaccaacattcatataaaatttacaaagcagcagatttttccatggctgtttcaaataacaattttcaccctcacaacaacccaataaaaaaaggtctcattacagaggaggaaaccgaggtatggggaggctaagtaagtgacctacagccacagccacgcgtaagtggcaggatgaggattcgaacccaggcaccctgactccagactctactcttaagtattatgcacttttaaaagttttctgaaaggttcaaccaagaaagtgagaagcaaagctgcagatggtctttgcatatagaattggaagttttaaatgttaccagcgtgagcccagattctctcttacagtgaggattttatttttaccaagctctgtgaaacacacaacgctcaggtgccgcctgaaaatgtgagaagtcattcggcaaactaatgaggttattcagacacactcttaaagttggcgtgctcgtttatttaaggccggaacagaggtggagcgaataacagaaggcctctctactccaaaatatgggtctttctcaccagttctaacaattgtagagttattggggttaacaagatcctcttttgggatgtaaataccctctaatatggtttgatctgtgtcaactatgccttaatgatgtacaaatgatctagatcctggcctttccacatccagtctgatgggactcagtgcttgctttaatctggaatcagctgttcacgtatgcagatgctcgagtcacatccagagtcattaaatctgactctctaggggcggggccggggtactggtgtttgtaaaagtttaccttatattcacccagggatgacagacactacttcatatcatttctctcaagtttcaacatgtttacacgcagcctggggatgttgtgaaaatgcacatgctggctcagtaggtctgggtggggcctgaggttttgcgtttctaacaagatcctaagtgatgacgttaatgttggtccgtggactacttttttaagaagcaaggcccaagaccagcggttttcaaagtgaggtcaagaatcacccgggaatttgttagggatgcagaatttcaggccccgccagacctactgaatcagacgctctggggtggacccagcaatctgtttttacgaagcttctgggtcattgatgctcactaccttttgagaaccgttggcctgcatggcactgcccagtagaaatagaatgcaagtcacataggtaattttaaattagctagcagtcagatttgaaaaagtaaaaaagaaacaagtgaaattaattttagcaaaatatcctatttaacatactatgtccaaaatactgtcatttcaacacataatataaaaattaatgtcataatttacattcttttttcaacgtgtggtcaatataaaaatgatatgatagtttacatgttttaggaagagacaacattaatctatttttatttgtacaaatttgtggggtacaaggagaattttgttacatggatggactgcatagtggtaaagtcacggatttaatgaatgtgtccatcacctgaataatgaacatcgtacccactgagtaatttctcatcattcaccttttttttttgtataaagacctcaaaatctagcatgcattttacacttatatgacatctcagttctgactagccgcattgagctcagtagccacatgtagccaccatatttggagagcaaagctttacacttacagcagagatgatggtactgactttcaccaaatgcttgctgtgtgtcagacattacccaggtaagcattttctgtgcattattcctatgagccctatgacaactcattattatccctgttttatacgagagtgggttatgttgatctttgtttccttaatgccatagcttctcaaggaaagccaatatttaaatgcattatacccttttttggtataaactattataaggaggaaaaagaaaaaaacaattaaaaaatgtgtctgtctgcagctaggcttccaattattaccagtagaattaccattccacattgaggccaagagaaacaaatatcccatgttagattggcaggtatttaagacatagtaaaatgtaaccatttaaaataagtgaaaagaaaaatgctttattctagagtcattttttaaagcctggtatacatttttaaaacaaagttgatcttatttataaaattcagattagagatttcaaagttaatttataattttttaatttgaaatacagttttaatataaggtctattgagccaaaggatttcactgtttttaaatagtacttgaagtagtagtcatgtaacccttttttttcacatggcataatcctcagtattttccataatctatttcagtgtctttctttaatggcaaagaaagaattgaatttgaatttgatataagcatctagcaaccaaccctcacattaattataaaatatatcagggcattttttttttttttttttgagatggagtctcactctgttgcccaggctggagtgcactggtgcgatctcagctcaccgcaacctccacctcccggcttcaagcgattctcctgcctcagcctcccaagtagctgggactacaggcgcgtgccacgacatcctgctaattttttgcattttttttagagatggggtttcaccatgttagccaggatggtctagatctcctgacctcatgatccacctgcctcagcctcccaaagtgctggattacgggcctgagccaccggcagttttttatactgaattcaggttgaagactctcttttcatctcccgatggaaagcctctcagcagtactttctgactacttaagcattctttttgtaatggggagtagggggttgaaaaaaaccagggatttcatctattggaatgaaagcgttcataaacatacttaactgcttccttggtagaaagtaagtaattttcctccctggtggtggtgtaaaggcacaatgactcaatggaagcctgaagttggtctgatgacacacagtatcttccttcatccacaatagaaagagatctcagtcttcagctgccatgatgtgaatagtctcatcatgtgaaaaagtctggaaaatatttaaaaattctgtttttatttattctcactgcatctgtgtgctctaaacccctgaaggcaaggacacttcattctgcccaccactgtattcccagagtgcttggcttatagtaagctctgaagtgctcaccaaataaatatttgctgaatgaatgaatgaatacgacttcttaatttttatttctagaaacaaaatgaaggctcaaagtttgtcagtcattgccagtgacccaaccagaatgatttcttcattggcctgtggaggcagaagcaggggtcactgtttgtctgcctcatgtcactgaatggtccccagtctctgccaatagataagagatgtcaacgcttaacccagtagctttcaaaaatagcatagttgatgaaactggaaatttaggtgcgggctcttttaagaaatcatttgtcttcagtcttaagaatagactgacaacagatactgctaccagagggctctcaactatttcttaagaccccctaggaaatatcagaagaaaagcctccttctcaataaagcataagtaggacatctcgttttcagtgaatcaggtaattcattttgaaaacttgaggagcactgtgtttctttaagattccagtcaactttgggtttgttttgttttcaatggtgctggcagttttcctcaaaatttaaatgaatatttgcacaatgaaccaagtcgttgtgggtttcctggttggtgttttctcccccctggagtggggggtggcgatctgggcaaggcattttcatccctttgcagacaaccccggctgctgttaatgctgaaaatagctcaaatgctctcagaacagtagcaccacccagcagctgggattctttccctctctcatttgcctctctcttgctttttttccttcagacacttggattggacttaatcttaaacctctggagttcaagaccttttaaaaagggctaaataaacaatctctacatgtaaaaggccactgactcctacttcctctgtatagagcaactgttgaactcagctgcctgtaggtaagattttttattctggaattatttaattgttttctggtatgttcataactaatgtctttaaaataacttacttatagtgaaaataataaggggagttgtgaacaattttcaggtaaacacggtgttccagaatacagcaggagcatctgggcatttttgtggctgtaagttttaaactttgcttaaagctctcataatagtgacctgcagtacacgcttgactatgactaagccatggatcagaggtctaattaagcctgattgccagagcaatgagaggatgtttcagacatcatatttttgttgtttagactgctttatttttaactttccaggggcattaaaaaaaaaaaaagaggaaaaagatgcaaccatccacctgagtaaagataatatatataagtaattgttctttaagggcaatgagcgagccgtattgtataatgttctcctttcatcactgtttcgttcattgctcgtgtggaattagagtggttgatttgggggaatctgggggttttgtttttgttattgttgttttgtatgttcctagcacattttaggggacagtgttgaggattccttactaagctgactgtcttttgctgggtacatctgctggcaggtttctctaacgtgacaatgtgatacttcgggtcagtttctgtggctcccctctccccctcgttacgcttgcacttgacattttgcgaagtactttgatctgtggactttaacttcaaacacagcatttactttgattgtggctatttactatgctcagtaaaaagtctccttttttttccttttggtttaatgctttcatagcatttcctttaaacaatttattggagctttagttttcctcactgatctgtcttagatttcacttctagagggacccccaattgtaagaaaagtgttctctggtaaagttctccccaacacagacttcaggacagttcatggcccctgtctggcagatgtgtaagagcaagcagcaaatgagagtgcacagagccccgcgctggctgccctgctgcctcagaatctccgtgtgccttggggcccaactggtgctttttaaaaacatggatgctgaaatctttggagttcagaaatacttttttttcagaaaagtttattggtatcacagagcacatatcaaaggaaagcatgcattttaaccacataaggatcgtctgagtaacaaaaacgggaagaaataacaaagaaaaagaaaattagaatcaaaagaaaactggaaaaaaaaaaaaaaccttagtagccagaagtctgttttacgagtgaaacttctgctgtgtaagggataagggatttcttaaaaatgtatttcctaaaatgggcaaaatgtagcacttactagccattcaatcagctttggaatattctcttcattgtgaagaaagcacaggtgtgtgtgacatttgttcccttcttctttcccaccccaagcacaaggtattttcacagtcctcagccaaatacagagtttgacgttccctggcaaacggtccctgcgtgttctgttgaaggttaggagtagaatgagcctaatcctgtcaggagactgtttaagtcccagtcaaggacgctagctcctcagcgctgacgcagtctgccccgtcctctgcaccttgctaagaaggacaaacgcaagtggccacaggacaaatctccaaaggggcggagctgtggagaaagctacggcagagatctccctggattaggagcagatgcaatcgaatctccagaacttggatttatagtagaaaaacctagagatgttcagtctaatctttaagtttcccaaacctgggcatttcattgccacttttccccttcaaatctacattataagaagcatgtcaatcatcgcatttatgtgtatggttaccattttaaatcctcccgttattttgagcctgggctttgttggggggatggggtgcgtctagctagaatactcactctcccttagtactgggaagccttggtctgcagggctgagtgcaaatatattgctagaggtgatagtccagcggcaaaattaaatggcaccaggatgaaatctttttggagaatggtaggtgatcattccattcccaggcaagccattttccccctgttttgttttgttttttttttctttctgtttctcttcacccctgaattttacgttgaaactttggattgtttgaatgtgaaacttcaggtgaaagctagccaaagccaccgagtttcacccagcttccacatgaaagaagtattctacccagccttgcacgaaacttggcctgtgttgccaaaggtttcatgaatgtcagtgagcctggatttgaaacataacccaaggccaggtgacttctggtgactttgaggctttattgtattagtatagaatctgctgaacagggacagtcctatttccgcatcttctactatagtttcatgagggcacacgttttcccccagtaaactcccatttatctcatgatgtttgaaagccaggttcaatcctaatgtgaatgtttgtagccgtgggatcgaagcactggcagatagaggtctgcgttttaaattccagcagcctggccctcagtggtgtgaacatgttggtataattcagctgaaggaaggaagtcccgggagagccgtggaatgcctttctttgcttaaatatacctctgtgctcgtgaggaacaaacagtaacattttgtccaggtctatccgcttgacagtatgccttttgttccctctccaaaggtggtgtcaaatatattggtggaaaaataataaacttccagatattttttttccgcctgctcaactgatatactccaagggaacattgcaagcattgagaagttcagtactgtggctgggaatgtaaggtatactgagaataaaggagctctcagtgaaggcaatgtccctcagaaaagcatggcgacccagagttgatgtgggtgtgaacggtcagatggtccccggttgggaaggggtgtgtgtgtgttttctgggtcggggtagtagcgagcagagaggaaaagggagatttgtaagctttgttcagcaaatctgtcacatcgaaaacaaaaataatcaagcccaggatctgaaaacattcctttcttttgtagatcatataaatttgtgttggctgaatattgaatttttttgtattatttttctcattagagacaccaagcattaggattccaggcatagtaaataatctccaatgaaaatatgacccattgggaaacataaaatcattgcagataactcccatgagtcagtcccaggaaggtcctcatggttctctggcagttatgaaatgctaagccacccaggacactaagatctgacttgtccttttcttagttgggagatttctaaactcatgtgaagaattttcataaaaatgaatgtgtggcctcactaaagatttaggctatctttggtgagatacatagatatagatttattataaaattaaattgccatcaaatttcattttgaaatttcatagtcacttatatattcaataaaacagactttcattaaagatgtggtttgcattttagcaggtgacatgcagtggatgccctagtagagaaagcactggaaaagctagcaataacacaatttggaagtgccatatgtagaagctgctttttagcactggcttcaccagtcatagtgtagcatttatcagcatatgtgatttgatagccccagactggtacagtgagcagaggaaaggaagatgttcaaatggaggttctagagaaaatcattcagaaccatcccacaaggaagctctcactaaccatatcaaggtataaggagttcagtagttttaagacattcatcatccataacaaaacagaaaaaggggaaggataggcttggcgtggtggctcacgcctataaccccagcacgttgggaggccgaggcaggtggatcacttgagatcaggagttcaagaccagcctgaccaaaatggtgaaaccccatctctactaaaaaaaaaaaaaaaatgcaaaattagccaggcatggtggtgcacacctataatcccagctacttgggaggctgaagtgggagaatagcttgaacctgggaggcggagggtgcagtgagccaagatcccaccattgcactccagcctgggcaacaagagtgaaactctgtctcaaaaaaaaaaaaaaaaaaaaaaggaaacgatgaaaatgccagggaaaggattaaaaaaaaattaaaaattgagaatcaacaccaagctagtgtatgtgcaaatatttctctaaatcattaaaaatcttatttcaagaagacttcatttgtcatttaagaatgcaaaaatcagtgctttaaaaatctttttgtgcttaattgactgtcagagaaaaatggagtccatataatatttatttctcaaggatatattattacagtctaaatttacatatacaatgtacttgttttattttttttttaaatcagtgtttgtctgatcaggacatgatgacacaaaacagtaacagcagtagtctcccctttgcagtagagcaaagaggattatttatcataagcagattaaacagtcatttctagaagtctgcattctccaaccaagtttttattagttatttggatattatgtttttctctgaaataagaagtagtagagcctgagcatctctactctaaaagtccgaaatccaaaatgttccaaaatctgcaacgttttgagcaccaacatgatgccacaattggacaatgaagatgacattaacacggcagaaaatgtgcatacagatgccacagtgacaatgtgatgggctaattgaaggactagagtggagtgcattcctaacagaataagcagtcatgtccatttagaaactcaaagagagacttctaagacaaaaatcgctgttaatgaggcagatgacgctggagaaaacattttaaaagccatcctactcgggaggctgaggcaggagaatcacttgaaactgggaggcggaggttgcagtgagccgagatcgtgccactgcactctagcctgggtgacagggtgagacttcgtctcaaaaaaaaaaaaaaatgccatccggcagaatgcctctcatttctcagaggacccgcttcatgatctgtcaactgcttcagatgtttcttatcacctaaaaaagaaaaaaaatacagtgtacagtgccctttactccaaacacagcatcataggtggcaactgaaagcctgcattgtttgttgctgctgttgtctaacagctgagaaaggaaaacggtctttttcctgtgctgcccagttacctaaacacattatttttcactgtattaataggatgtatctttactgtttaaaaaatagtagtattaggctgggcacagtggctcacgcctacaatcccagcactttcggaggccaaggcgggtggatcacctgaggtcgggagttcgagactagcctgaccaacatggagaaaccccatctctattaaaaatacaaaattagccgggcatggtggtgcatgcctgtaatcccagctactcaggaggctgaggcaggagaattgcttgaacccgggaggcacaggttgccgtgagccgagatggtgtcattgcactccagcctgggcaacaagagcaagactctttcaaaaacaaaaatagtagtattttctactgttaagtactcacgtctgagtaagagcaggaaaatgattgcttattggtagcaaataaattcagtcaggaatgatggtgatgccaaacaacaccagattttccatgtgggtggctgagatattgatgcctttgctttctgacggttcagtgtacacaaacttcattttatgcacaaaattattaaaaacgctgtataaaattaccttcaggctatttggatacactacatataacataagcgaatttcacatttggatctgggtcctgtccccaagatgacgcaggatggatatgcaaatattccaaaatctgaaaaaatctgaaatccaaaatgcatctccagtctcccatgtgcctttgacttacaccttcatgctaagggttgacttttttttttccctggtactacaagatgctcccgcatcattttgtacatttcatgtcctagtcctaaaatcaattatttcttcaaggagctctggttacttttattgaaaaatggtatcagtaatcaagaccagggcatccatttttaatttttgaatgtgaccttattggccacttacttttttcacttgaagaaaattttctttttgtgtatggaatttcactctgtagctgtcaataccttgatctggtgtataaagataacctttcttgctttttcagaagaacaggccacatgtcgcccttgcatactcccctttcccttactttgaaacaaattcaattaaatatgatcaaatttgcatttttttttgtttttttgtttttttttttttgagacagagtctcactctgttgcccaagctggagtgctgtggtgcaatcttggctcactgcaacctccgcctcccaggttcaagtgattctcgtgcctcaccctcctgagtagctgggattacaggcacgtgtcaccacgcaagctaatttttgtgcttttagaagagatggggttttgccatgttgcccaggctgccaggctggtctcatagtccagacctcaagtgatccacccacctcggccttccaagatgctgggattacaggtgtgagccactgcacttggccaaatttgtttttcattgttagtcttggtgagagattcaaagcctttgatatggtcttgaaatgcaatcttaaaagatagaaatcagttgtttcttccttaaatagacgtgagaacattgtgcattatttaaaatgtgatcagtctaggcccttcaatgaacatgggattctgttaccaagccttgtacgtactgtgtgcaaggagccgtgccacaggcagatgaacagtctggtaggagagctgggcacatacacctggatataacactctgcaaaagaagatgggcaatgtgaagtcccccagaactctaggagctcagagctggaattgggagctgggcgtatattgtactagaaaatcagtggtattatcacaaaggaaaagctgtactggaattaggattttggtttggataagagggtattcaaatggcagaaggtgatggacagcaaagattcagaggagagaaaactcaggactcaaagaatatttaggtcccatgcaaagcccctgggaaggtgcattgagtttgtgtttatttattgagaacaaaagtctcaccatcaggctcatgtgttagtaatactgctgagcaatgttcaaggtgattagagaaatgaaacgctggacagaccctgttacacagatgtaactgagaagaggaggacaaagacgagagcacttgaaataagatgagaccaattggtgcagagaccgaggcctcggggcagtcagtactgccctgtgtatctagactttgtcctagaaagtaaaacttacctgtaaaataattgcacctataattttatttaatgctcagtattatcagagatgaaaggttgtgtttttattatttcaccaaatgcatagctctttcattttctttctcttttttttttttttttttttgagacagagtctcactctgtcgcccaggctggagtgcaggggcgcgatctcggctcactgcaagctccgcctcccgggttcacgccattcccctgcctcagcctcccgagtaactggaactacaggcgcccgccaccacgcccggctaattttttgtatttttagtagagacggggtttcaccgtgtgttagccaggctggtctcgatctcctgacctcgtgatccgcccgcctcggcctcccaaagtgctgggattacaggcctgagccaccgcgcccggccagctctttcattttcaataaaacaagaaaaccattggtccaggcagtgaagacgacatttcaaatcctaagttttggctttctgtacttcactgagagaaaaacaagcacgggaggtgaagattacagagaaagacatgaatgtgccaatagtataatgagccaaatgttaggacgaggctggttgaaataacctgtcggcataccgaaaagaatcgagttaggaaattgacacagtttaaaaaaaattttaaagaccagcttgatattagaaaggatagaatagaaacattattctcttgttctcaaataaatttatgcctgaaaaaaaaagagattgaatttagcttaatagaaaaacacacgtacagcatgtatttttaaggcattgcatgttggctactgtgacccctggaatatgctggtccaagtacaaatctgaattggtttaatgctagatcttgacatgccctcaactcagtggtacttctttagttcaattttgcaaacctaaaaaattcgattggtattgaatttagctccaggtggtatccaggagttttgtgtgtgtttgaactgaactttgaaatatttcaaaactatgtaactctcaagttttagaacaaattgttaattttcaaaacactcaagaatgttgaaaagttacagatgggtatattttttgtgaattacaaaaatatgtgaatatacaattaaatgtggttttcaaatataactttgatctgtagatctacagtattttctatttcacatttatcttttttaccataagagtattcacttttaaaacaaaaactgttgaagaccatggttaagaatgggagactatccgaaacccaatatggccatctaaatgtacggtgagatgagaaagcccatccttgtggtcccagcagagccaagtgttggaaggtgtggcctggcacaccagatggttcatttctgtgcacatctatgagtaggcccatagtgaagggactcagccaggaattgttggagataaagatggaggttcagtgcaaattcaagaaggatgtcagatgtcagactaagggatccacgcctcattctgaagtagaaaatggtttttccctctgtttgtaaagggcagtaaaacactcccttttggagaaaacttacagagtgacatctcttagcagcagaaattcgatgttttctttaaaaattgtatttctgacatcaaattaaatcattagaattttctttttatatccactatgactatttttattcaaggcagaataagacaaaaattaagtgtaaacaagtttataaagtttgtattgatataatagaagactggcttatgatggaaaactaaaaaaacaagtaaaaatgaaaagccgagtgaaaaggtaaattcagaggtagacttttatgtggaaaaagtaataaaatactacctttttctgtggtaaaaaaattgatgatgcctacttgtctacattcaaaatatattttattttgtgtttgagcatctttaagaattaacggatgtatttcatatttggaaattaatttagaattggcacacacgtgtttttttgtctcacatggtgagatccacctcttaataaccacagcttgtaaaaacttgtctgaaatcaaagtgataatttttatgcaaaggtgagaaagcttgattgcagtgagatttttatccccttacaattttttatgtattttggatatcaaaattaaaaaacgtttgatgttaaaaatcatttgtgtccacatcataattttttatgttcacatgtataatttttctaatcaatattctaaaatacttaaaaccacaggtgtaaaaacatttggcagaagactatttggtatgtttaaccctcagctgtgcttattaatttaagaattatctaacatataaatcagaaaggaaggaaatgaggaattcactagtaaaaccaaatagtgttttaggtgaccatagataactacttttaatgcctaaagcaatttcattttcattgaataaaatattttcatgagggtcttttcatattgcttcatttatttattgaaggcatttcaccaccatatatgaatcatatgagttttgtggtttaaaactttacattctgactgtagatcagtctgaatcagtgcagaaaaaaaaactgatgaaacccaacacaggctttcaagataaaaactcacaaccagacaaaggaaggaattactttaaccttaaaaagagtattcattaaaaacctacatcatcataatgtaaagaaatatatggactgataaatattacattcagataatggttacctctggaggtaggaaggcacttccaattagagacatgtgcagcaggctttaattgaattagtatcttctattttaagataaatgatgggtacatggacatttgttatattattctcttcatcatttgaacgactcaataaagacctgcattaaaacatctttccctctatttgctatttcttaaatttaagataaattctacataggaagtaaattgtaaatatctttcacagctgctaacattgaggaactatgtaaaacataaatacattacttaaagcagcccaaattttctgaaaatttatcacagatagtataatgtttggcctatacttccatatttttggtctagggctcaaaacttctataaatggtgaattcaaagagaaaatgaatttagttccttagcagacaaacatcttttgtaaacttacattcaagatggtttttgtagtgtgtatctttttgtatggcattgttataaatctgatatttactctttaagttatcaaatagtttgtcattatgttttatgaaaatttataatgggctttgaatctagcagtgtatacattatcttaacctctttaacactggttttgggtcaacaggttgagaagaaaggatttctgttttaagagaatttatgtaataaatgtatgaaaagtgagtaaaacagacaagcagtcctctcagttgctacaggactatggagagcagtgatatggctggatatgcttgagtttcctgttgacacgataccaggcaaaataggactacctgtttttaatataaagacttcattctgtagcttatatatttcgtgtaatttaatttattcagaaaagcttatatacacacagcttttccttaataatatttatacttccttaatgttattggaaaaagctagtgacttttcattaccatttggcaggaaccagtgcttaattttgaggatttttattccaattttttctatttgttttatccatagactcattccaattatgctaaaatgcgaaagctggtagacatcactatctttttaagagttttgacaaaatggataatattgaataatttttctttacaagtaatttcacatgtaatctgaaaattcagtgcaagccaaaagtctttataattttaaatcattaaattcaaagaaaagatggtttctatgtttctaggtgtaaggaaggcaaaattatacctctcctctgttaggatttgttaggggatggggcacgtgggtgttgtgcctgagaattaaattgacataagacagatccacaggagaaaaacatatacatttatttaatataagtttatgtggcatgaaaaccttcagaatttgtgaagacccaaagatgcagtttgtattgaccacttatataaggaattagacaaagagcagtaaattgcagaaatgtgatgaggtggggggtcgggggcttgggccagggcaggtgattggaggagaatggctgggaaggaagggccagtatagcaggtggtacaggtttccctcagcctcagcttctggtccttgcccataggaatcatgcctcccacctggccaagggaggacacctttcacatgggaatgtcatctcctgcttttcagaaacagaaggaaggtcagagtgatcttcttgtacctgctttttgtttttgtttttgtttttgtttttgagagagtctctctctgtcacccaggctggagtgcagtggcgcaatctcggctcactgcaacctccgcctcccgggttcaagtgattctcctgcctcagcctcctgaatagctgggattacaggcacctgccaccacacccagctaatttttgtatttttagtagagatgggatttcaccatgttggccaggctggtctcgaactcctgacctcaggtgatccacccgcttcagcctcccaaagtgctgggattacaggcataagccaccacgcccgacctcacctggtttttcttaagtgcctttaactaaaaatactgaatatgccagagtggtgtattttgggatgccatgttcttaactcgttcataagtaaagttcatgaaagcatataaatatatttaaataataataaacacactgagagaaatgacacaaaaaataattttgaattttctcatgtcattgttactaaagctgagaaaccagatattacataattaacataaagcggtattggaaacaaatgtggagacaagtcttttagattactggcattacatgctgctgactctcgcatcttcatgaaatctgttcccctttgccttctgtgacactggaagcttctgatttaccttcagtctctctgattacatcttctgaattccacttacaggtgcccttttttttttttgcccaaccttaaagttactcccttgggttctgtccctctcgtctaaatctctgtaatcttccctgagttcacctgtttcttccttcacgataatccctaatctctatccctgatctcttgtgaaagttccagactcacatttccaagaagctggtgaacattccctttgaatgtcttctgagtacctcaaattcaatgcgtctaaaactcactttccaactcccaccctgctcttccttcccagggctggatcttgacgatggtgccacccagttactgagaattagaatcttagacaagcattcgaatttttcttcataccaacttagtccctactcattgattctacttacatacacgtcttcaatatcactcctttcctagttcacaggctattgcaacatccttgactaggatttctcagtagtatcctgactacactttacatccattctctctgccttccgtgtaaccccttgcggctgagttatcttgccaaaataaatcagctttgcatgtagacttcccatctaccaaacttctattacatagcaagttgtgcactttgctgtctgttgaggttttgaggatcaggaaagataactgtgtcaaccaatgaaggtaaattcagtgcattgtgtttagacataaatagccctgtgttttcaaagataaaaggcagggctggcaacatttccagattccttagtaaggaaagggtgtggctcactgctgggcatggaactcagattcaatgtcagccctgctactaacctcaaaacacccttttcctcagattctctttcggacacaatgttcacaaatcacttgcttcgttgtcacttactcctaatttccttcctttctgattcacatataagatcattcttcttcaattaataagcacaacaatcatttgttgagagcctactcaagactctgtacttgtccgtgacagtcactgggagcatagcctttctccaatgacatcgccctgaacatccactctaaaaatgcaggtgaatttatgtgatggcctttgtgccttgggaaaaatatcttcagaatgagagctatctatagtagcatatatacattatccatggattatagagatattgttgtatttgcttctatgtaaatatcaaaggagtattattctgatatgatctatggaagttgaatgtgactttggagaaaaacttaagctttcggtacagattttcaagatcaacattcaggaaaaagtctaacagagggatattgaagtaaaatctctgaatgaataaagacattactgatggcagctatgaattcaagtattttaacatatgttcaggtgtttgctttggggcatggaaggagttaaaagtgaaggaaaatgtttaaagttttcttcttcactttgaactacatttcaaagaagtacataattttgacataaaagatatatttccttcatagactaacacaagtatatgtgtgtctgaatgaattaaatcttatgtttggggttgtatctattaacttttattatgtaactgaaatagcaatcatttaaaatgaaatgttttctgctctgctaacatggtgacagattattccgagtaggattggtgacactgctttcttctgctccttgtcctcagtcacattcttgaaattggcaacaaagcagatttgatttaatttttatatcctcatgcaactaatgagaaggaaatgtgtttttaatgcactgcacacttttatcttcctggacgtgttcatgaactcgtatttgtgaaaggcagccgagcttttttgtggtgtatctttgccagggatcagtattgttctatccaatgctgctgcatcccaaagcctgtgtagacgcattatgcagacataggatgcctatacagatgcattttgttaatttttttttttgagacaaagtttcactcttgttgcccaggctggagcgcaatggcgcgatctcagctcactgcaatctccgcctcccaggttcaagtggttctcctgcctcagtctcctgagaagctggtattacaggtgcccaccaccacactcagctaattttttgtatatttagtagagatggggtttcaccatgttgaccaggctggtcttgaacttctgacctcaggtgatccacctgcctcagcctcccaaagtgcagggattacaggcatgaggcactgcatggctgtaatgccagccacattttgttaatttttcagagtattctttcctcatatttggccaacacatggagagtaattaaataatgagtcactgccaattcgatggaaacaaaacatagtacatatggttgttcctgatctgagagttgaacctgagagctgggaagtctaagcatggatggagaacgagaatctgttgtataaagttaaaattgaaatggcatttggagtcccctaagctgggctatccttgagtacacaccatttcaaggagccaacgtggagtctacgatggaaatttgccccataggaatatgaaagtgctgtggcatagagtattttatagaagttaaatgtctaaccttaatggattgctaacgttggcttagattattgctaatgactacaggattttacagaatgtgataagctttgaaataatgactatattagtaacataagaccatgagagcaactaacagaattataactaaggaaccctgttacaggcaatagaataacgattgacttctatctaaaacatcaccatttatctttgaatatttatcactggggatgattcttagagcattcatcaaaaccacagcttaatatcatcaaattattccatttccacattcttttaaaactgtaacagaaaaaaaaaaaaccctttcaattcctagagaactcacccgtttgagagatttcttaggtcttctctattcattcaccatcattcactattatgagatttttgtgaattgttgcacctgcgttctccctacccgttaaatatgcaatatcctttgtcatccagctcaatccttagaaaaaggtacacacccccctcacatacacaaactctgttctgtttcaagatacatccaatggagcaccttaccctcacatgtacaaagagggcaatggaacttgatagcatatggtattgtgagaatcactgaggcaagagcaagcaactccttctggttggtaattggaaaatcctcctcttacattgggcagaaatcatttttaacgcctactccatatctttaagcgagaagctgttatctcctctgcaggctctgtcatactataggatgtgcttcatttctaaacctagcaatcctgacatcctcatcactctggagagagcacagtcattcactcatgcaaatccgagcactgtccaaaggcaaaggactgttctgagcgcttgagacacatcagtgaacaaccttggtaaaaatccctgcccccacagagcttaaattcccatgggcagaacacacagtaaaaggtaaacatgttaggagattatacagtaggtaagagagtaaaaggggctcaaaacatagcagggtaaagaggatctggagaatgtgttgaggacagtgcagcttggagtttcaaatgttgagcaaggaagttgaagggggttgcccatagggttacccatctgggggcagaaggcactgcctctgcaaatgccctaaagtgtgagtggccttccagtatgaggcacagcaaggaggccaggatagctgcaaccaagagaaagaaagggtgagtgccagaggttgaggcttttgcactgaagggagtaggtggtaagaaggggaaggtggaagctggagactaattaggaagctattgcaacggccaggtgaggaaggaaggtgcctggaatgggtggaaatggaggagacggcaagagatggctgggtctccatggtgtttaaagccttgagactgaatgaggcagtgagtgcagaaagaggacaaaaaggctaagaaacttcaaggctaaaaacctccaagattgagaggccaggaggaggaggagaaccctatcaatgaaactgagaaggcatgcccagggagataggaggaaggcaagcgggcacagtgtgctgacagccaagagaagaaactatgtcagagggggaggtgcaatcaagaaagatgatggcttagatataacctgataattttacaatatggacctcaatggggtcctggctagagcaatttggtggaatgctgtaattctggaaagtctttcgcatgatatttaattttaaaaagtcaagtgtaactcaaatgaaataatgctgatttactaggtatgtgaaattatcggttaggacccgagagtttcttcatcaccagcctcattaactgtgtcactagtttcatgccctggtgtcagcaatgctctgaacagcagcctccacacaactctagataaacaaaatatatgcacctgtaatctggtcatcagtctctatgttaacaatccatagcagtttccatttcttacactcaattccatcagtggctcaccagattgtatcagcaattgcttgaaaatattccaaaaatatgagtaaaataggaaagctgccattaggggtctcatttttaaattttacagaacacctaagcctgatcttctccatccagttgtatagatctagctggagagaaagcagatgttttaagaactcgaaattgctgaactaatgtatacccttgtctctgtaatatgttccacaacatggaacaatccataccacctaggcttctctctgctagaccatcatgcctccatgtcttcttatgtcacctggaaggagttgagacagtgatttaatttcccaggacatggaataactcttaaaatggaattgtgatgttggtataaagcaagtggccttaatgataaatgctattttaatatcttgaaattatgttatacaggcattcatttctaacgtttcttgaatatcaaatacaaagttaacaagaaaaaggaacattaacagaaatctctaaaagttagaaatgtacaggtaaagactaaaaattgataggaggtttagttgtgtttcctacccggaaatcaaaatttgaaaagcagtaaaggcatttgccctgctctgcctccttcacataggtgcatttcctgtccatttcagaagctaattatgaaatggccacacaactggatgtttctgtttataaaatagtgttccttggaggggcttgcaacatctaaatatcttatgtcagaataaaagccactgagatccaaagaagtggactaaacttgacaatatctgaaagtcttctgctggaccaggaacccctacagtggacagtgtgcttcctgcttttccacgcagttcgacaggaaaaccatcccaaagtgaacaaaaatggaagcctgcgaagttcatcatgcaagacattgatgccactcacgtctttgtgatagcagaattggttaacgtcctccaggagcgagcgggtgaattaatggaccaaaatgctttttcccttacccagaaatgaaaatactcaatatggaccattcaggaattataagcagcaaatgtgaaagacttgccactcgatatcttaggtgactgattagacgtagagggttgttttagttgttttaggagcatgccacgggaaagaccaaaggatcatttgttcagaaaaaaacctggaactgattttgttataccatagaattaaaaaaaaaaaaaaaaaaagctttaacagttggctgtaatttggcttttattaaccttcattaaaatacaaatgccaaaaaaaaatggaagcccgcttcaggatccatccctggatgttacttatattacatattacctgtaagcatatgtacagatacatttttatagactgaccatatagttaaggtaatgtaaagatccagacaaaattaacaatgaatagtacttgagtttttaggtggcttaaatatttttttcttttgtgaactgactgatatgatttctttctggagaatgagttacctagaaccaagatcctagaacagaagagtgaattttgtgaaatattctccttatcaaattgactgccttcgtgtttggaaaatgtaattaaaaatccatgtgacataaacagcaaaattatagctatactaaggggaaatttttcatgcgatttataaaaatctttaaattttacagagttacgtgttctaatatgagtcatgacttgtaaggacataaaataacagttatgaactgcatagagaagagcttctgttgagcatcttgtattcgattttcttggaacatctttctaatgagctgtcaatgaaaattcagctgatttaatgtcaatgctgccaaccaccagtccagatcacttgcatactatgaaaattcttggatgtcttcacttgttttaaatcaagttacctcaattttatggtttctataaaacaacatttgtaaaaatctgagacctcttttgctttttgttttgcattttaactgatatttacttcagatctgttttctgacatgcagagttacatttttttcttctaataaacatgaggaggtatgggattaagataagtgagatgaacaaacattagattttatgccaagtgagatatgaggaatgtaaagacatttcctttcttatgtatagttaaagggaaagtcttgaaagaatgaatgtgattattcttctggttctaaatgctgagtgataagagagtctaagtgagacctttagcctttgtggtctgagttaatgtgtggtctagccctccttgatagtcaaatgagttttcaagacttgttgctacttccaacctctatgagaattttcattgtgctgtctcctgctatgcctgccagtaaaaatgtggctggcaggattcaggatctgatatttataccaactttcaagttgtgtattttatgagtagaaaactgtcttccatgccaaacatctcacatttgtgtatgcttctggtgcctattattttcttgtgtcttttacctccaaatagtttaaaggagcataattttgatgtagtctaaggatagtggagtctatggtcacattccaagtgacagtgactcttcccttattcagatgaaaatgcaagtgacactagtcaactcttttcagtgaattggctgtgcttgcgatgggaagcaaaggtgtcagtcccaaagtgggaagaggagcatgattgcctggaagaccaggagggtaatctggccatgctgactgtttgacagagtctgttgtcagcttgccaggacacatgctggtcatcttgacgtagcctaatattggccctgtccaaagctatatttccaatcggcattctgccaagggcagagaattggtcattgatgatacatctctcaggtatataaagatatgacattagtgggttttttcctgccagtttgtcagagataatgctgcacattttcacaaagcccatttcccttcctcctgggcacacaggtagattacattccccagcctcctctgcagttggaaggaatcgtgtgacaatttctggctcgtagaagtgatgtattgcccttccaggtctgcctcatgaaacccatacctgatcctgtacattctcgctcctctcagctaacagctggactcaggggatgtgaaggactgtgagaccccatggtatggtggagtaatagctgcaaggagcatcatttctaaatggctgtttggaacacagccccccaccccacactccactgagctgcactggatattccattttccattgttaagccactaggatttggaagatgtgggttatggtagttggccgactgtacacagttggaaaaactgtagagctagcagactctataatataatatgcaaatgtgccttagtagatttagtgattatacataaaacgtgttatcaagggtaaactttctgtttttattattcttttaacttttattttaagttcaggggtacatgtgcaggtttgttatatagatagattgatagcatgttacgggggttactgtgtgttatggggggtttgtgtgcagattatttcatgacccaggtaataagcatagtacttgataggtagtttttcaaccctcacctcctcccaccttccaccctcaagtaggctgtggtgtttgttattcccttctttgtgtccatatgtactcaatgtttagctcccacttatacttgagaacatgtagaatttggttttcttctcctgtgttagtttgcttagaaaatgacctctagctccatccatgttgctgcaaaggacatcatcttgtccttttttatggctgcatggtattccatggtgtgtatataccatatcttctttatcaagtctaccattgatgagcatttatgttgattccatgtctttgctattgtgaatgatgctgcaatgaatatatgcgtgcatgtgtctttatgataaaatgatttatattcctttaggtatagacccaataatgggattactgggtcaatgatagttctgttttaagttctatcagaaatcaccaaatgctttccacaatggttgacctaatttacatctccaccagcagtgtataagcattcaggggtaaatttttaaaaagataggtgaataatgttagaaactcacatccattggtgctatgattttgaaagaatacaagaaaaaacaccagagaatttcacttttctattccatttaaaagcatttaaattacatgtatgtcttttggacagtgctgcttaaacatttctgcctactgatagaataagagttattctattgagactaaaggatgcacagacattgattcttttaactcccaaaacaaaattatcttttttactttatctgaaaggagcatttttataatctataaaaatagacttgaacctgtttaatcgaattccaaattggtacccaaattaaagtttgccagattatatttttataaagtatattttacctttaatttctcaatgaattaaaataagttaaacaaggaagttaaaatttctttttacaaagtattttgcattgaatccttatgcaatttctaattctcccagtaactttctagccgcatctatcttttcaaagagcctcccaggcaattcatcattattaaatgacttaaggaaatgaaaaatgttccccaaaaccttttttattttttgtgtttatgggttggtgtcctataaaagaatggtgaatacagaattgaaattcatcattaggtccaattaggatcaaatatttactatgcatcagcagctgcactgaatgcacttcctcagatggaaattgtttatggctaacgtgctgtagcagccacgaagccctcatggccgtggtcactggttctgagatcagtttcctccttgtggaatgtctttcatcttagtagcagcggctttgtatatttggctagaatttccccagtactctaagtgtggcatattaatgtcaatttaaagatcaactattgtgaataataggcatgccatatttccttgccggctaaacatccattaagtacctcaaaagggatacagattcttcaggatatatattttgcatgactaaatgggtcagaattcattagcaatttggaaggataaatagaaaatggaaccagtagctgggtttcattaagttgtcgcttctttcaatcttctttaaggttattttccacttattctatctgaattatttctgtaaaggactgtgcttagcatgtcattgctttccatcggcatgattttgacagaagtaatttcagttttttaagaaaagggtgatgaagctgaatatatctttttaaaagtctgctgcagggctgggcacggtggctcacgcctgtaatcccagcactttgggaggccgaggcgggcagatcacaaggtcaggagatcgagaccatcctggccaacacggtgaaaccccatatctactaaaaaatacaaaaaattagctgggtgtggtggcgggcgcctgtagtccaagctactcgggaggctgaggcaggagaatggcgcgaacccgggaggcggagcttgcagtgagccaagatcgtgccactgcactccagcctgggcgacagagcgagactctgtctcatataagtaaataaataaataaataaaagtctgctgcagtatatgtacatattttaaaattctaactacagtaataaatgttgcttacatttgtttttaataaatgcataatgttaacatttgtcaactgtacaatactgggtaatgtttatttttaagatacttttctgttttccctgggatcctctaaatttggtttctcagccttggtgccattgacatctggagccaggttgtgggatcttcttgcgtgctgctgggtgttcagcagcgtctctgtcctctacccacacgatggcagttagcacccccatccccactgccagctgtggcaaccaaaactgtctcccagttgtcaaatgttccctggggagcaaaatcgccatggttgagcaccactatcctagataataacatatttttaaatcgcaccttaatgcaaaggtactctgcttgtttgcgatgctgactctctagcaaaaacccctctccagtgcatcttggagttgttatccccactgctcctgtgcagaagcttctcctgtggaatgtcaggcatctttccttgacttcccttctccctgtatttcctctcccctctgatgccctagcctctttcgttcatgtgtacgtgtgcacacacacacattctgtctctgttgtggtcagtatgtatctacactctttggagtggtgccttcaccatcttctgaggacctactgggcagctgcctctcctgcacctccctctcatgctagaatcagtcctcatctgccctcatcaagcttggtcagaggttgcctttgcctaaggatacctgtttcttgctcctttttcacctaatttagcaaaatgtccaagatgatcaccaaacttctgtcatcttgctttgtctcatctcttctcactttgtctcatctcgctttgtctcagcctgtctcgtttcggtttgcccttggtcttcctcatctcttgattctcagtgtagttcctaacatccaaactgacttagccacctacatgcttctcaaaaagttcatttcgtccctgtcctttacctcaatcctacctggacagttcctgaatttctctctctttctctttttttttttttttttttagtatttagagctaagagcattcctttaccatttaatggaagaacccatgttatataacaattcctctatgatttgttgagcccttgtttaaatcctgtatcatgaacttttcgtgtggtatgttttgtctccccaaacaaggcaataaactttttgagacagaaactatattgtaaattttttttggatcgctaaagtgccttatatatcatgtacatttgaatgctatttgctcatgtgatttgaattccaactccttgacccacctaaggtcaaggagaagagagagaaatgatatcaaaagggcagggggaagaaataagggttcctaagcagcttgtaccttacccccaactttccaaatgtaattgacagccaaaaatctaaatcaagagcccagttttcttattcaaattgtctgtcactcatgagcactactcactgcaccaaagggagcattttattctcaaactagcaatagaggttgaaagttattgtttgtttgttattttagaattaatgtattttcaatatggtaccaaataactgtgtaaggagtgtattagccagcttaatcaataaacttcagcaaggatcggatgttggggactgcacagcagcaattgatccactgcagagctttctgtggtgcagtgtgagtgggacactggaacagcatgtgtaataatcttagctgttatactctgatgggtcctatgatgctacggaatatgtgagtcttttcacacctatgattggagccacgtggatcctgaatgcagacccgctctcagttcttcctgtttccactgtttccaaacacacagtgttgtcgggattatgagcaaatttaagcctatggtttgatggtgatgaaatgaagcaggattttacaatttgttcataattggtatacacagtgaacacttaaaaaatcatgctttgccatccttttctttttgcccatgaggaatagtttcgaaagagttcttaagaacttgctgtgagttacatgtctagtgagtggcagggcaggggtgctaacctgggtctgtgggacactccggcgtccagctttagtccactgcacgtagtgtctttctgcaacatgcagatctgaacagagggtggtatttgcacatatccacgtaagtggggacatttgaacagttaactgtttccccagtgagttctcttagcaaccaaccttccagtgtttggtgtttatagatggaaaatgaagccatagccccatgacagagcagcaggagagcaacagtccccaaagaataacttctcatttctgttaataaggagcctaatgggtggacgtttagtcagcatgcattttctctctttggttgcattaagagctgtggtctctatttctgcatttgttttctctaaatgagcaactgaaactatttcattagatccataaactcctggcaaactagtctatctggcccattctgcttttgcaccaaaattattaccttaaacactaatgcatacattgaactaatgtatctttactgtttcttctctccataaaattctactggtctaaaagtccatataccctaaggtaacacagtgtcacacacttatgtctgtaattctgagccagaatgaccaggaatcagaggtctgtgtgattgattaattgattttcaatcccatcaggatttcatcttaaaagttttttttctttcttgtcattgcttaatacaaaatgacgactctatctccttctccctgaagggtgactctcaatgggatatcaagaaggcaggaagatcaaaacaattaaatcttctctgacagctctgctgttcccagagggtggctcagagaaggagcagttcctaggagctgctcttggcaacaacctcaggccatcatcaggctgttgagctatggcaatcccagtccccagttgctttcatgctgactgtccctgcacctgtctccctcccagatggcttggagcagcatccacatcccaaaccctccctgaacaccactccagtggttagctggggcaatgtgcctgccgatccctactggtggctgtggagttccctaaaaggttcttgctataatctttttttaaaagccaaaacagcagcaagccgagccatacttctaacatctttttgggaactttctgccgtgctctgagtttgaataccatcttagcttggggctctcctgcattcttccccaggtcctcatccaagaatattgtaaatggggcccctcattctcaggtggaaaggtgcttcttggagtagggcacagaagctcatcaataaatgaggctccagaaacagcctagggaaatcctccacttgccgaaggcaaaatgtaaaccagctctaatcataagccaggtttagctatcatttttcagtatactacttgaactatccaaactgatgagtgagttcactaacaaaatctaattgaatgggaaaattattttgaggtagttaacatatcaaccttatttattcctaaaatgccactaatggcaaaactgcagatgcaaaatccgtaacacaccatctctcgtcatcagtgctgaggtccttaaaattgctcgtgaggcctcccttgctaagctggcatcctgtggaggctgcttttgcttctgtgtggtgggggggcttaggcagtccttcaagatttcagagccctacttcccagctcgccttactccaaattctggaagcagatgtcagtgtggaagaataagattgatggagactagactatgaaaatattttcaagaccatattgcctaaatcaaaaccagcatgattgaaaattctccctgaagaatacgcggggctcctggtgacagagccagtcacacacagcaactgcactcctcgcacgccgaggccctgagctgcaacttacttcatgaaagcccagccctacctgatgaagccccagtcatgtgcccagatatggtacagctagatgctaattttctagttccaaagcaagtcaccaagagcagggctctctaccttacagtgggccacccgaaaacttacaaaatgtaccttaaataaaagcaagctttgttaccagattttagcacagcttaaaatgagccagggagaaatgtgagcatctgtggaagcagcaaagaccttgttttttttttgaaactgagtctcactctgttacccaggctagagtgcagtgttacggtctcagctcactgcaacctccgcctcctgggttcaagtgattctcctgcctcagcctcccaagtagctgggattaccggcgccctccaccgtgcccggctaattttttgtattttcggtagagacggggtttcaccatgttggccaggctggtctcgagctcctgatgtgcccacttcgacctcccaaagtgctgggattacaggtgtgagccaccgcgcccgagcaaaggccaatttttcacagctccaggcacggagtagtgcaggctgggggaggacgaggagaaaccactgccctgaccaccatgggcctgactcatctgtccagggccacagtggggagcagcaagtgaccagtgacggtggtgtcctggaagcttgtgctgcccctgagacagggcccaagtgccttgtcttctatggggctcttcacagaggggccaggtacccctgagcacactgccatgaacttgtgccctctgcttctttccagtcagatcactgactattgactaatgcttacactcaagcgtttgcaagaaattcaaattactggtcctacaataaagtcacatcccttgttcatcgtttaaagcctgcaggttgtattagtctgcttgggcttccataacaaagtaccacagactggtggctttgatggcagaaatttatttctcaaagttctccaggctcgaggtccaagatcaaggtgagagcaggtctggtttcttctgaagccttcctccttgtcttgccgacggccaccttcttgctgtgatctcatatggcctttcctctatgaatgcatccctggtgtctggtgtcttttttgtgtgtccaaatttcctccttttttgtttcgagacaagtctcacactgttgcccaggctggagtgcagtggcatcataggcgtgagccactgcgcccggcactcttcttaaggacaccagctagattggattaaggcccaccctaatgacttcagtttaacttttcccctctttaaagtccctgtcttcaaatacagggcacaggcacattctgaggtcctagggggccagtccttcgatacatgaatttaagagggcacaattcagcccataacaaggctgcaacaaatttggtggaaaatctggtagatgggagaagaaagtctcttcataaagtggtagattcttacagagtctaagcctcacacaagagtattttgcttgggtattcctcaccatgtgtcaaccacaggatgcatttctcagcttgtcctaacttggcctggtctgggactgctaactccattcccacctaagaaactctaaccagataaggccgggcgcggtggcccacacctgtaatcccagcactctgggaagccgaggcaggaggaccacttgaggtcagaagttcgagaaccagcctggccaacatggtgaaactctgtctctactaaaaatacaaaaattagccaggcatggtggtgcacacctctagtcccagctactcgggaggctgaggcaggagaattgcttgaacccaggacgcggaggttgcagcgagccaagatggtgccactgccctgcagcctgggcgacagagtgagactctgtgtcaaaaaagaacaaaaagaaaaagaagaaactctaaccagataagagagactacgtggatccaaagaaatccatcgcccttctgaaaaacacccctgaaaccatgccttctggtgatgtccgcggaggactttgagacacaactacgagtgtttgaattctgtcgcgagtgagtcctctttccatgacctttcaagtcccagaggcgcagagaaaacattgtctcctgtaaatcttacccaaaggccccttgatgaaaagccacctgctgcttttccctctatgcttctgtcactttgttattccctctattatttcttctgctgcttccttttctgtagttcacagagtgggaggatagagttaggactttggtgatatcgtttgcttctctttctgtagagacaacaaaaatgtgaccaggaaacatatctgtgaggcttaggctgcctcacttttcagagaggccaaaatggcagtaacagtcatggccaagagcagtcactgcagcgatcagtcacacaggctttcctccccacgtagcccgagggatgtcttcaaatcgggggagggggtagataggcttaaaaatgaaatatatccgttgaagaaaactaaaaagagaatgcatttgtctattgctgttttgtcttttggctgtggaaataatatttaaatttaaattctctccaagtattaatctaagtattctactaaatatagctattaagtatagtgtgattgcttgcagtctaaggaaatttgtaataggtcgccatcaaatcaggatctgcacctcgggtgcacaggtgctatgaggaagatgtgatgtgaggttggaaggagcccactgtggcttcagtcctccttgtctacctgagcataagtctggaccatgattagttaattcttaacgcaagtgaagcaggcattttttttaagacaactgtctaaaaaatatgaacgccaaaaattggaacagtccctgatctctccttacttgcgggagaatctgggaggtctagtttgtgttcttactggccatgttcaggttggtgctcccctaccaccggcatgcactctcggatagagacactgcttccctagtccccactgacagcacctgctcgggcatctttgcagcatccctccctctccatccctgattagtcccacatccaccttcccccgctgcaatggagatgtactcactgcctgtatgcccacctacctcagaacaagccacctgcatcacacagggagagcggccaggtactgtccatccctgagccggcccacaagtgtcttctgttttctttaccctctccttagcaccagctgcctaacaaagtcagcgggcagccagggcaaagaacagtttgggcgacttcaatatgactctctcttctgagcccccaatccaaaagaaggctcacccttagtgaatgtgcctttgccagagggtcttccctagggtgaaggggaaaatcatgtttcacaatttcagggaagtctgaatggtaggagccaggttttcacattctggtctttaatgcatagtggccattcattccattaggcttcttatgtcatgacataatttcatctctgaatgttggaccatttggtggacttggacattgtcagttcatcaaacagttttgaatttgtggaaagttctcattctgagattctgaacattcaaagattaatccgatgtggcaggctcattagtgccaccacctgcctgcatggtttgcaagataacatcacttcattgtttgatttgagctaaagaagattaatgatctgaacaatgataatttatcaatattcttctatgaaattcaaccaaaaccatagatctcgtttcgtgatgcagagtctaaaatagtcaatggactatttctagcccaacagtacactgtagactagagtaatatgctgatttagtgaaacagaaacctggatccaaaacccacaaagtactcttggggaccctggaaaagcctgcatggacctcctacagttcaagttccacatgaatgcaataatgcatacaatggggtacattgtttcaaaaccaccagcccacatgtaatcattgtgtaattgaataattataatagcatccaaccatatgaaattttaggaagtgaaaattggagatcaaataacaaaaaaagagagaagggaaggaggaggaagaagaggaaaaggaggaggagggggagaagagaaagggggaagtggaagaggaggaggaaaggaagggggagaaggaggaagaaggggaagaaagtggaaatgggagaggagggaaaggggaaaggtgagggggacaggaggaggaggaggggaggaagaagaaggagaaggagaagaaggaggaggagaaagaggaggaggaggaaagaaaatagaagaaggagaaggagaagaagaaggaggaggagaaagaggaggaggaggaggaaagaaaatagaaggaggaggaggaggaaagaagatagaagaagaggaagaaggaggaggaagaggaataagaagaagaaggagaagaaagaaccagaagaggaggaggaggaggaagaggaggaagaaatcatctgaatcaggaggaggaggggctcaccatcagagtcttagtttgccctgtccttccactcatttgctacctgaaccctctttcatgtagaatttgtgggagttggggaggggaatgcaatgtgactgaatagattttgaagctaacagagttctaaactactaggtgtgtacatggaaaggaggtgataaatcattgtgtatcacagtttttagctctatgttttcatcctcagcaatgaaggacaatgtggaagaagccatcacgaaactcagcctggtttgggactgcttttgcttccgaagggctatttgtctgttcttcaccatcccaggtagcaaatggggagcaaattgggaaatctgcgcaaaattaatagccctatcaggaatcaagcgggtatgccagagagagagttgaaaacagtctgggttttcatgctgcaccaaaatttagtgagctcaaaagacttattaacagcaaatttcccctaagcagcatgttgtcaaactagcctgcctcactaggatgccacgaaaaaataataaatggaaattattgtaaaaatataatttaaaaaggacaatgtgtctaatagagtagcactccggaacctcaaccttaccccctttctaaccttgagatctaaggcttagatctagatttctttcacagatgggtgtaaaggagatgcctctccaggaaaccagctggtcgccaccacgtccaaagggctgggaggtgcattcgctgtgcccgcggggctctttagaggttaggatggtgctgactcatgctgcaagttgtgcagctgtggagtgtgtcagatagagtgcagacagtctgaacttcagaagctcgtgtgtcccaggtgtgcaaatcccacatcaagtagcacaggtcaaggcttaggacacgcccagaatctaatgtgtcagattcatgaatgattttggcaaatattcctcttgcctgactttcctacattttctctccttttcactatagcaaatatatctttatttatgattctcacctcatttagttaaaacctttgctaaaagtttatttttattgttaccgtgataacagctaatggcatgtgagtgtttactgtgtcaaaggctctatgatgtatagtttagggggatatcttattggatccttgaagaaaaatgccctggaatggaaaatccacgaggctgtggcctcttaatctgtgctggacatttctggatccgtatgtctgggcagtagtaggtgctcgatggatatttactgaaggaatgaacaaacggatagaagactaaaagaacaatctatgaagcaggtgccttattattcccatcttgtgatatgcaaggttaagtggccaatcaatggtggcaatgagattcaaagccaggcagtctgtctgcacagtcatgctcctgggtgcatatgtttatttaggcctgtggtttttgctttgttttgttttgtgttttaattcaccacttgctttagccctaaagtgccagccaacagccttgaaaaataagattctcaagggttgtttgaacactacccccaaactgtgtagccagggctggcccctgagagctagagattatcgtcttcatcagaattagcagagaaaacaagccagagagacaagtccaatcagaaataatgcagaggagccaagatgccgatttcagagaaaggcaaatcagcggatggggagggcctccagccttggcaggaccagcagctgtatcaaacatgaactgttgggaaatgtaggtggtgagacaaagtgagcacaggtcagggtcagtgagtgaaggacccgtggggcgggaggccacgagcaccctaatacttacctcaaaggacaagcatttgagttggctcccaaaaaccagcccagtgtatgatttctggctgggtatgtccaatgctatggaccagaagtaaagcaggtaatttttttttaaatgtattttaatttattttatgtagaccctgttgctgtgttcaagcagggccacaagagcaggagtatgtgataaaaagtgaggacaggccgggtgcggtggctcacgcctgtaatcccagcactttgggaggccaaggcgggcatttgaggtcaagagtttgagaccagcctggtcaacatggtgaaactccatctgtactaaaaatacaaaaattagctccggtgactgaggcaggagaatctcttgaacctgggaggtggaggttgcagtgagccgagatcatgccactgcacttcagcctgggcgacagagcgagactccccctcaaaaaaaaaaaaaaaaacaaaaaaaaaagaaaagaaagaaagaaaagtgaggagagggcagctcttgggcctgacctctgttcctaatgcaattgcaggactgaagaagaaaaaagtacttttcatgcatgtccctctgttattctctctgcctttcttctacttgagtcctcttgccctttctgacataatgctaaaggtttctaacgatgcccctctttactgtcttatgttacattatgcctacttgtgttcatagacagagtcatatttagtcaaggtactgaccacaggtcctaattttgcaaattttggttagactttctcgacatatttttggagtctgagtctatgccagagaatcagtgcatgctaggctgagttggtgctggtttgagttggtgctggtttgagttggtgctggtccgagttagtgctggtttgagttcgtgctgatctgagttggtgctgggctgagtttgtgctggtttgagttggtgctggtttgagttagtgctggtccgagttagtgctggtccgagttagtgctggttcgagttggtgctgatctgagttggtgctgggctgagttagtgctgggttgagttagtgctgggctgagttggtgctgggctgagttggtgctgggctgagttagcgttgggctgagctggtgctgggctgagttagtgttgggctgagttaatgttgggctgagttaatgttgggctgagttagtgttgggctgagttagtgttgggctgagttaatattgggctgagttaatgttgggctgagttagtgttgggctgagttaatgttgggctgagctgcctattttgcatttggggctcccaaaattcacttcctgctgcagcgcagattggatgaccttcaaggctctatttcactgactttcagctttcttgacgccaaagccacagagcattcttgagttggaaattacctctttgcaaaagcaaagagcactgtaaagaacttggcctgcccactccacagtgatattccataggctcaagtttctgtgccacttgaattctagcagtttagctccctgccgtttacgtgccagcagggatgaatgtcctgacagcgtgtgtccactgtgcatgtgcttccacttgtcagcatgggcgaagcccaagtatgatgtgtagacaagaccaccgcttctctctgctccattcctgcacaagccacacacagcagacttgtatttctgtcaagggctccggttttccatcatctattttttatagcactgatactcaaccagttgcagcaaatgaagggtattatttctggtttgagggcatcgcgatgctgatttgccattcctaggaagcaaactcaccgtgttgggctctcattttaccatgggagacccggctccacaaaacgtaagtgtttggagatgcttgatattttcacaatgtaaataacaatttccccatgcatgagggggaagggtcatatcataagatgggagagggatggaaattttattaggttcaatttgtggcagggtgacagtgggttgaagacaagcaaaataatttgctgtgtccttcagtttcttagtgtatcattaatctttgagagaatttgggtatattctgaagcaacttggtagcatttcagaatcagtgccatgtgctctttctgaaatgtcacatctcctcatagcaatgtgctctccatataaagtaaacctgcatttttagattttaaaaagagtgatgaagatttggaaaccaagaagcttagagggaaccatttctaaaggaccagaagccctcatcctgaacacacacctcaatacgcacatcccctcatgcaccaacaaacacatagactttcagaatttccctgcaaactagcaataacatcaatttagaatgcttttcgcttatagtagatttacttacaaggattagttaaatatcaataacaaatacatgcattttaagttgcccaatgttaagtttcaaatctgtagcatattaattccaccaggcctttggtggttttgcaagagttaatgccctacaattcatttctctatgaatatttttcacattttaggtgtatagctattattgctttttcaagcctgtgttttgttttgccctatatttccaactgtaagactatttattcagctttttgactttgtgaatgtaattaacattttaactggtaaaaaagaaaataccagtccaacccatacaaattgctatttttcagtgttcctatgtgcctatgctttatccagcagcaagatcaatagaacaccagggtggagacaagtcagctctcagctgcattattcacttgctatgaaccttgacagctcatttgcaagttcacacttttttgatgctagagttcttgaatccctgacagctgaaccttctaactccagctaactatgcaaatagagaatggaacccagagggtccccttgcactggtatcacttccaacatattattttggtcaaacacaccaatcaattcttcttgaatgctttctaataaaaggaaacagtatgtggagagtgaaaaaaagggagacttgaaagtgtaacaaaataagcctgaactttgtgagagtcacaaaaagaattcaaggcctaatatttaatcaaaattaatttaacaaaattgtattaagactcctcccttagacccacttggggaatgtttcggatgctttttctatataaagatatgtttaatctgatagagcaagtggaatttttataacccagaaaaattatttattcttagaaaagaaaaaatcctggacatgtgaccagatatgggaaaaaatatttaggggtgacattttttggcacgaaacaaaaagaaaatagtttttttatgaaatacttggcaaagtagaaagcttaaaaatatttcgaaacttgcccggttgcaaaaccacacagcatgtcttgttttttctgttttgggaaaaggaaaatctccgggctgggatcggctttatgaatcccaacacttcacttcccctgacaggaattagttaaatcaactgaagtcctgttggaatgcctcgcctgtcatctgttctgcacaaaaatgaaacacatggcattctaagaaaatcccgaaagcagccaatttctcagaaaatatttgaatgaccctggaaggttaatggcacagtcatttacacgaaaattgctttagatgtggaaagggtattgttctagggtcagtaaagtgtatgtgtcatctcaaagctccacataaacaggctgtctcgattgacttggaagtggaggcagatgttgaggaaggcgtggacagcacaaaaacattctgtgattattgcttcttgatgccgtggcttccctctcactgttttccatcccgtagtgtgtccgtttcacgaagcagtgtggctgccattgtgaagggacacctgagcgtggcccacactggggagcgcctgtgcccctccgcctcctccctggagctcccaaatgtgtttctgtagctgagcggagggtggaaaggtttgcttattggcaggaagcttcactgcactgttaaaactgttttcccattttacctcagaactcaacatgaggtctcgatctttagacggtggacagaccctgacttcgtgaaggttttgcatggtcaatgggaaagtccttgccttcctcatatctgcccaccacgctgcggtgcccatccccgcagaggcagccgccttctccacggctggcctgagaccctgctcacggccccacccctcgggtccccacctatgctccgaaagcagggtctccgagctctcatgggtctcacaggctgtctaggttttgaccagacagtattttaggttttatgtttcatgacagaattccccgtttctccccactgcccactttattttaatggaatttcttttgaattgcacctgtattgtcagcacaggcctccctaaacggtacagccatccagggagggcgatggttccagtaaaggagcagacacattcctgaccctgatggaggagacgggagaccacctgctctccacaccccctgtccccagccactttgctttctcctgcagccaggcctgggctgctgcggttcttttctatcaaacctctttatacccccaacctggaacttgaaagcagaggaaattctaagcaagattaacctctccttctatcttgccttgaaaacagtaaggaagcaatgcttttggagcacttaaataattgctgaaaagggaaaaatcgtgggcaattctgacaccagtgagcattgccagttcttccttcaggcactgttctatagggaaggaggttagaaactcagattcatggatgttgctaagagcaacccggaactcagacatttttcactgtgctttccttggcatgccaactcgaaggagaaatgttagcaatggggcacagggagaaaccgtgccagtaggtatggtattgttaggtaaaatggagcagccttgcttgtttggggaacctttcagtctccccaactatggactatcgggttcctgattttccaagtccctgctgagggtgggatgttgtgtggatgatgtctttcccctctgcagtggttgtggcacacacagacgtgtgaaccttgaccacaggctcgacacaccctggtgtcatcgggtgggttgtgttccagtggccctgagccaagcaagaccccaggaaagactctggaaaactgaagggggctggatgtcacccacagtacataccttgtgcctgtaacgaagcaggcactggtttcatttaggaaaggtattgtgtccgaagccccatttttagactgttaaaagtatacaaacagaaacgaacaccgccatcattaactgacaatctgccttctcttcctactttctctggagtctcaggtctgcccagtaacctccagaatgcccagttgctttgtggtcaggcttcttttacctttgcaggcccagggcactcacagaccaggcaagacttttaaatgagaacatcaatttgctacttgctttaatcccaccattgccttaggtgcaaagcacacttttttattttaatagaagcccaggcttgcacaacaccaccttcatgaagattggtcatttctgaggatgacaaaaccacaaagtttattgagattgctccttcattgacagtctctaagcacttcagaagcaatgacaaggcaaactctgtgggatgatgacaagggtccctcgcgctgcggcagtggagagtgtgtctgagccaggctgtctgtggggagaccccaccccacccctgagacctgggtgacttggcacctgtccacggctctgcttctccatccacaaatgggaaatatcacaggccctgccttgtgtgttattgatataagaacttggaaaagagcttgctgtaatagtaagcatggtagatgttggctgcaataaataattgtgttgctgggaactcagcaacattaggataatattaaaaataaaatttaaagatttttctgggatatgtgttaattgcaacggttaaataaggtaaacttcatgaagacatgtatagaattttagttatctataggtaaactacttattttaattcatcatggactaaggggacaaaattgcacccacacacacacatacacacacacaaacgtacacacagtaaatattttcatgatatcgtctagggatgtcaaattaacaaaaattaacataaaaacagatgcattttcaatgagattatcatcagatattatttatgaacagcttaaatagaatgaagacttggaaggatttgggggaaggctcgcatgtgagtgtgtgtgtttgtttgtgtgtgtgagtgtgtgtgtgtttgcccttttttccctttgttttcaggatagttccatttagaaaaaaaagctttcctaccaaatttgcagatatctgcaaataatattctgccaagaagcaaaaaaaaaaaaaaatagtttactctgattcaatggaagcgaatctcctaggatgtcctcctagcagaggacatgttgctgttagagcactgacgtatctgcagaaacatgccttgcttttcaccgtgaaatcagggccatcccttgaaataggctgattaggcaactgtctcatgaagggatatgaggacccctggcaagttcccaccagcccccaggcagctccccacatcccatgaccctcttttcctacctggtctcaaattcctgctcattaggtcaatcctgtgttttgaaaatgcacaggccttgtataaaatttcttataatgtgtctgagagaggagtgtgatccttttctgtctgcacagtgtagagccttaaatggtcagataagctgctgctgcagccatataagttgtagagagcagtccctgaaagggaattccaatagtgaaaagagtctgcaacagaagattgttgccaaatttagagaaagaaaggatcctcaagagctggtgtaatgatcaaggatgagggggacctgaagaggcttccttgcaccctgagtggtttcaggtagagggaaggctttgaagccccagtagggagaaggctatggagagagagagcattttgggagagctgactttaaaatgctggaaatgactttgcttgcctctcacccttcctagctccctcctctccccatcatcctatgcagagttggaaaggactggaaaagcaaggaggaggtgggaacggcagatgcgagggatattaacactatggcctttgctgtgctgcacccttccattctattaaaatgctgaccagtggccacacaggaagctttgtcagaggaattttgtatgaaatagggggcaaggaaagaggaactgaatcagcaaaaccaaccatgaggctgccaatatcaccctgcctgcttcacccccacctaaaaccaactctgggtaaaacagccccaatttccccttttctatataattagctaatggtgactaattgtagtatgtaacaaactaaaaacagtaagtatccacccagtttcctttccgcggtgtttgttctgagaagtaggtaggtatcaaactgtgtaaagaaaagaatatatgatgataacgttgtcctcagtttgatctcgccgctgttttggttgttttggggagtgtggggcagaccccacccacctatttattgtgacatttcttttctagagcgagaataggacagactcgtataccattctgatctgggtgcatttcttcagaaggtacgctgtcctcacgggaaaccgcccgccactgcctgggtttggggctgatgaggccaggaagaaacttaatgcgtgcactctaacaaaaagatttcccagtaagttaagaaaataagacggtgggcaccaaagaatatgcgcatgccctgacatctccttgacgttcacgtacgtgccactcccagcagcatgtctgtcttgagaacctgcacagacacccttgatttaggctgattgatttgcaagagggcaggggaacatcagaggaaatgaggccaggagaaagcaaggatatcaagagaactcgcttttttctcccagagtgattgtttttgaattcttcactctgccttatttcagagtggaatagcaagctgtaggtctaaggcacatggcgaagaaactgtaactgatccccttgtcctaaagcgccttccttcatgctgcttctcccttcccatgtagtgtctacctcttctagaggatgcctcttggtcactgatgcttcaccggggaccaggaacgcccttatccccaagcacacaccttgtctcagcccctccaagcccctccagcccaccaatgtgcagtttcctgcttctccacctggctctgcccagtggggctccagagaagcacgggatgggcccttgctccaatgtcactgttcgctgtttcggggccagtgggcggacccccgctggcctgctggctcccaggcctcctggctctctctttctgaaatcatcacactcaagggttatctggattttaccaccaccacatatcactcatctaactcagcatggagaaacttacccaaatctatctccccaaaagcaaatttatttagctctcttaccccttcaagtagcactggtgcagtctttggattgcaaaagaagagacacctagaggctctgtttgagccactgtatcagtttctagagcgctgcaacaaagtgcaaccaattgggtggcttgaaacaacagaaatctattgtctcacactctacgtgggggtgtagaagtctgagatcaaggtgtcagcagggccgggttgcctgtgaaggctccagcagcgaatccttcctcacttcttcccacttctggtggttgctggcagtccttggcttatggcagcatcacccatctctgcctgcattgtctcgcaatgttctttctatggatctgtctccaaatctctctctccatgtaagaataccagtcattggatttagggctcacttttctccagtatgacctcaattaactggattacatctgtaaagatcctgtttccaaataagatcgctctcacaggtactgggggtgaggaaggacttcaacatacctttttggggaacaccacttgcccgcaatagctacttttggatattgggtcatctctaagcaagaagcagctccaaattgtctactgtaagctcaacacacagcctttggttcccaaacccaacactcatcccttcccacatctgcagaactgacccactctgcaggggccccaggagggggcctaatgtctgtggggcaggactgacccatgtggtccaggctatttctgagtaaagccagaacccagaggactaataacccctcacagtcacataggcactttggtctccctgagaaatcatgaacctctaaaaccctggaaaatatctatatgaatatccacataagcctggaacttactttttcctaagtactatgatcatgcttgtaataggtgactcttctctgacactctctcggtcacactttgatgctcttcctattcacacatgctattgagattatcttccaagggaatgagtttttctaaagcctgatgtgtcctcttgattgttctgactttggagagtgacggaatgcctgggagtttacttattctcatgcacataattgagaagatcacccatctccactgaactttccatcttctactgatgcattactttcaaaaggaaagggttaacttcctcagtagtaaatcaggtttcacatgtgcatattttgcaaaaaaggaggtcagatattggagcacagacatcagattttgaaatttattatccacaagttacaataataattttgtgatactctttgtcctccatctgcacactgatttgattgtatatctagagtgagacagagaaacagacatatatatatatatatatatatatatatatatatatatatatagagagagagagagagagagagagagagagagagaaagagagagacaggcagggagggagggaaagagataggcagggaggaagagagagagacaggcggggagggagggagagagatagggagggagggagagagacaggcagggagggagggagagagacaggcagggagggagggagagaggcagggagggagggagagagatagggagggagagagataggcagggagggagagagataggcagggagggagagagagagataggcagggagggagggagagagggaaggagagagataggcagggagggagggagagaggcagggagagagggagggggagagagataggcagggagggagggagagagacaggcagggagggagggagagagacaggcagggagggagggagggggagagaacactttctaaaagccagtgcttggttattgcatcagagaatctcactgaaaaaataaattccaagaggcttagttaggtatggcagggcaaagatattttataaatattttggcaagtagagacaagagaaaatgatgcgtgaggtattttcaatagaagccaattgagcttcctcatttgcatgaagcatctgagctgttttcctaagttccagttcctcctcctcaggtgggcagccttacagcctctgcatttgactctgtcaagatgagactgtagtaaagtgagctctttgtatcattgatgaaagaaagaaaggatttaaattaaccattgggactgagttaaaataaaataaagctataaaaagatcatggctgcttgaccatgagaaaaacctagaaaatagtcatttgcatgagtcatttgttccccgagaacagcattctgttgaatggtgtccatgaggaaaatgctcaaatagataccattggttttttaaaaaattatttcatcagtaacaatgcaatttgggtacagcctgatctgcagctacgtcaggctgcagccttttgaggcttcacaatggctgatacatactcacctgttcccagcaggcagccaggtacctggatgtccagctccaaaggcacagctgcatttaacgcctggacctgcccaagtctgtgacctctgggactctaggggctgacctgttcccttgttctagctctgggatagcccagtgcaaacttactactgcaacccggttgtcctctccatggcctgcagctgttcacccaaggagtgcctgagcatcctttcttggaggaactacaaagagactcgctcaaggacttcctgtcagcagcagaaatgctgagtcatcagtattctgttacagttcattgaaagcagtgctgacagtggtgcggccagatggacaatagtgagagctccagggccccagctcagtgctgcacacaatgggtgacaccaaagaaaagcttttattaaaataatacagtctataatgaagaaattaaattttacaaaacttcaacccactctccagatgattaaatgaattattaggaatatttcttttccaaaaaaaaaaaaaaaaaagaaagtatattgacctttaaaaaaaaaaaattagaattacactttcctggtttgtaccttgtacttgcacatcattgtttggagaatatttttccatatcattaaaacattctttgaaaatgtaaacttcacagatcgagaccatcctggctaacacagtgaaaccccgtctctactaaaaatacaaaaaattagccaggtgccgtggcaggcacctgtagtcccagctactcgggaggctgaggcaggagaatggcgtgaacccgggaggcggagcttgcagtgagccgagatggctctactgcactccagtctgggcgatagagcaagactccatctcaaaaaaaaagaaaaaagaaaatgtaaacttcactagctacagaaggaattagacagtaaataagtaaattacaatacaccccaatgacagaatacgaaacattgatatctaatgttagagccaaaagttcttctacactgcgtgttatatttttctcacttccctgaaaaaaaattacataagttgtactgtacaagaaatgttttcttttctctctacaaagtagatcatgataattctaaacttaggcagaaccatctggaatctgagtcattagactaagtagaaagaaaaagaggaaaagtaatgaagcactcccccaggaaactgaagagctgtactattccttgtctttcacagagtagaaattagggaatctgagcaaatgttagactggatgattttctggaactaactgacctcgagtacacagatccacgtggctacagaactgtggtcatcactagactggacagtgaggagtgttctccccacatcagctccataaggacgaagcaggcagaggaggccctgagagtctagttccccttgttacttattcagaaaatggaaatacggatggaaaccctgtctatagttccttacagggcagtcctctgaaaccggggatttgctgagcgggcccagaaagagatgagtagaaagttaatgaaaaaactagattttctctcattttaaaatatgcagacttaaaagttagtagcacattaccctgaacaagagttttacttgttgaataccagtggaacttatacttcaccacataaggaaataaaggaaagtgggaaataagaagcaatttctatgactcagagatctgcccttcctgtaggaagatgaacaaccgccatttatagaattcttctcatgtgcccattcactgtgctaaatgcattacatctatgatttaatcctcacaacaaccactggcaaataggtattttgtcatcctatttgacagctaaggaagaagagatggaagggctgacttcattcattcttccacttactcccctcagaaaacatgcatttggctcctcgtgtgcacccagcacagttccagggctggagatgccactggcagcaaggccatcatctctgcccctcagggagcaaatggcacatgcagctggggtttgcatctggtctgcctggctccaaagcactgaaaccaaacactaaatgggcgatttaatgagaaacctgggagatgtcaccctgggagagaagaaaatagcattgcatcttaattaattttctccctgatctgagaatcgccatgattaactttagaattaggaacgactccgattaaaataatgagtgctcctgcgcatccttttgtgatgacaggtgaacacagaaggcattcagttaaccagatttagaaacaagagcctgtggttttgctgcttcaccagaaatcatcttaccgaccaccatgcttacacaaaacaaatggagaaagaagtattaccagttttcatccagagcataagagataagagccatcaagattactagagctagatggaatggcaaagacaggaccctagcaaaatacttccaactgattcccatccagaaatacaggggtttttggggcaagccaaaagccttaatcaaccctacagtcaggtgaaaacatttgcctaagtaacagacggtagaaccagagcttgaaagcatggagtcctggtcaggttctgtccagcacgctactcagtggactttctcggggagcacagtcactggttttgcataaaaccttccaggctccataatggaagggagaaccttagctgaatcgagttcttgggcaggctggatagacccgcagactcagaaagcaagcactgggttttcacaatagaaatatgtttttgaacattctaataatcaccacaaaagttattctccatgagtttactgaaaaaaatcaattataagaaattgaccatgtatagttttaagtgtttttcaatgtctaactcctagtcaaggattataccataaggatgggtttaatcataaaagccaaccatattccagtgaaagtcatcaaagaaaacataaaatctgtctggagcagattcagggacaaacattaatcagtaactcaaaacagtgattaaggtgcatttttctgaagctttattttttctgaacaagctgtttatcttgatttatgttaaaatgtgtagcaaacctggtcgtatcaaaataaaataagcctaatcatgggacatttttgtaaatcatgctttttgttacaaaatggtttaataaccttgataaatagggctggtttcctaatgaaagcctatttatttacagaagcttgttgaaatgaagttaataatgtcttcaggcttttcttttttaatgtaaacatgatctgataaaagcttaatttagtaatctgataacaaagttattaacctgtcactgatttcagaacaatcaaatacattgaaataaataagatttgctaagtataaatgcctgacacaaacgtatagttaaaaagtcaattaccaaatttattgaaatccttttaacttctacttgtatgtgagtattgttactttgaaggtaaatcattgacaaaatccattgactgcacctatctggttagctgtaattgtgacggcataagcaatagggtcgttaatacaaacgtggacaatccttaagaatctgtccactcttcagaggggatgagaatttgctctgatgaaactattttgatcacatcaatgtaggttgaagtgaatgactcgtttagtagccatggaaatcacaccaagcaatacaaagagatgagcacgtgtacttccagatgctgctgcttttgtggtggcgtctgtccagggcttctgatctgttcaaagcgtacttaatgtccctaaatccaaactcgcttggttttgctctccctttacactgtagttgattctctgtaatagcctcaagtaaatataaaacaaggcaacccaatactttacccacaggaccctatgttccttccagaaatgtgtctcctatttaaagatgcatgcccaaatgtgctaaaacagaccctcctcccggatgcatctccatagcttctatttctgaaatccctggtttatgtccaggcttccatactatatttgtgtctatttttccttcatctgtttctataactttctaatatattaatatttatacatttgtagaacaaaccgtgtaagaaaagaacatcaaggaaataagcaagcaatattctggttcattcaagccaagtctagtggtgtaacaaaatatattatatatataatatattatacatctaaatatccttatgtttctgtatatgaggtttccagaactattgtttgttagcttaagtaacagagcttatacaaagtaagcattgtaggttaagtatcttgggggaatgggtcttttgaaaaatggtccctgaaaactttggttattattctatttaaagtcaaattgtactattacattcctttgatatttaacccatatttattgcaagcctgttatacataaggtacgatgaaagacacagatgtgaataaagcatgatccctgccctcaagaaaacaccaacataaataacataaagtaagacaagatgaagtggcacagaaaaggaactatattagtttaaatgagtgagagggatttatgtggttttcataggggactattttgagatggacttctaaaactgtgtgtaattttaagagtaattagaggtaatctcaacgaataaaacatctcacaaaagatgaatcaaaatcacacctgcctcgccacaccagtcatgggctcctggaaggcagggattcttttggattatcctgacactcctactacccagaaaatatctgacacaatgtaggcatctggttaaaatgtgctaattaaactcaaatgaaggctaaaacatgaaatgtacaaaaaaaggagcaacaaaaagttcagtttgactaaaaaacaaaaaaaaactgagaaggaaaataaattcttgaaaattaggttaggatcatgttgtgttgggcttggtttagaatttattaatagataatgtgaagtcagtgttcctttcaaaatattagccttgcaattgcagcttggaattaaaaggagagagatcaatattagggggagaactagggacaggagagccaatgaaaagattattatgataatttatttgataaaataaaattaaaacgacagaaatgacaaacctgaaattagaagccatattaataagtactatatgaacaacagcaaaaacaaagatcaagacaataatagcccacatttatgatcaatccctatgtccaagcacaaagttagaattttgattaattacttggggttcttgccacacaaagtcgttactcccaagtttataggtgaggaaattgaaactcagagagattagctatgtcaaagaagctctgctagaatctatattgggatgctaaattagacggcaagtatgtttgacccactggcatagagttctacatggtaggtggcagaacccacatttagaagctttctcaaatgccgcttctcctttgaacacaagtgggtagttagaatatccaacagcagtgtaataattccaaacaagaacctctgcagcctggcgctttttgcaggataatttccatccttttgtaactaatggattatagcaggctgtgatggtttctagctgttgaccccaaaaggctgaagttcaatataaatattaacaggagaaatgctcaaaaatagatctgcctaaatccctttttgaactagtcaaagatttaccataattgataaaagaaaaaagcctcttcattaaatgataaactggcaacaccgtcttatgtatgattcttttgtttttaagtacactgagcatgaaagatatgcaaggtgctgaactaggagcagtgagagataaatggtgaaaaagacactatccttaatctcacagatgctgcggtgagagaaacagacgtgaaggaaactagtatttagcattgctcaaggaaagtgttttgagaacacagaaacaaagaataatcaactcaggaaaaggaaaatcttgaaagatgggtagaattttgtaaataaaaaggtcagggaaattctacatccagattcgggaaacagcatgagcgtccatggtggattccagggagagcagatagtctggcaaattgagagaggtggccgaagacgagagtgaaaaaggagaatggagtcaggtcatggggtggccttgaggtcacactaaattgttagaagttgacctctcagacagcagaggccccccatactttggctaggtattaggaagagtcctcaggcaacaatataaatgacagtgaagagaggtaggaaagttaggttagaacacccaccggagttctcaaaggcaaactcagtctcatcaccggttggcccataggatactgttttgtgggttaattctgcaaatatcacagcactctagaaaatactagattaaaggataactggtggctatgaagactattaactagctgctcatccttttgtctttttttttttttaactctctgggcagtggaatatcccaagtattcaataaaaacatgcaaaagttgtcccagcacagcttaagatcaaatttatggtgtttccactccccaaacacccaaacatcatcaaaaaaaagccaatactgaaagaaaataagaaacaagaggtaggttaagaaaccctggatctttttcatactaagcttcttttattgttaacttcacttggaagttgaaacaacgaaaggctaatttattagacccttgaaagcacttcctgctgttcaacagtacagaaatcggcatgccgagtagaggaggaaataacttggaatgtcaggtgctgatcagtagatgccaaaaacactgagaagggttgcttcttagttatctgttcttaatgtacatggcacaccaagaaaagtttgaagtaagcaaagtgattgaaaatatgtagctgccacgtggctggagcccatggattaatatactgaggttcctcttccttattcccttatgagcccaggaccttgacgttcactgaagaaaggtcagcgtgctgccctgtgtctatgaattactttctttcctcaactccacagagatagtggaactagaaagatgcctgctttaaaaaagaaacattacaaaacttcaaaagctgttacatttccaagcatggataagacacactccctacctcaagcccccaaattctgtatgccttaacaaatactggaaattactctaaggaaatgaatagaataagactcagactactgcttggagcaatcagcatctctgctctttctggctatttgagtgcactggtacgggctgtcctttcttctcccaacttcccttagagcctctgaattattttctcacgaacctcatggaaatagattgctctgttaaatacattgcttaggttttagcacattaaaacataccctgttctatatgatccatgatgcaagctaaattggtgctccttctccaaagacataaaactgttttcaaagttcttaagggagacagagtgaaacagtccttgtctctgtgttttcagcgaagttgccaccatgctaccagcaagaagccatctgtgttatgtcaggtgcttgcctctatggccagagttgtgccccaaatacgatatgcttttagtggctgtgggatttattttattttatttttttttaatggttattgatttattacaattttataaattaatttactaatttacaaataactttctgagctcttacatgtgcaggcactgtgctaggcctgttacaaactctggagaactgagttatccccatatacagatgcagatactgaggccctttggggttgggtgacagctcagatcggctgtgggatttattaatttctcagatgtttgccttcttcccactgtgatgacatgaatacagctctggcgcattttagctacaaaacaaaataaaattatactgaatcttagaaaactgtttattttcctgggcactttgggtaggcttttgggtgacattaaaagtgttaaaagctcatgctgctggttagtaggcacttaatatcaacaatattatcagtgattcagcctttaattaagaaaaaagagtcaacattcttagccagagtatgggtgtgaaggaggaggttccttatgggctcttcaaacaagactctttcaacaagtttctcaaaattctgtctcagaataactaataatctattcccaataattttttttatcaccaatcagatgccagacacagattcattgtagagtaccattctgcaaagcctgaagtgatattcacagttttcacacttctgaaaatatccaaaaaggcaatgtagctgcttcgtgttaaactacattagaataaattgcagagactgttttccaaataatgccactttttaaattaaatgcccacatgaatgataataatttagaattaacataatttatcatagctaattagaactgaagaatcattttgcgatccaaagaattagaaactctttttgtcttaccagaatttcacagatgtttttcatattttttaaacaaaatttggaaagtaacccatatgtccctgacactgttctctggaaagatagataaagcttatacgtgatcatagccgtttcatcatcctgtctggacccagtgacataatatgatctcttttttgtttatttttgtgggtagttctgaagcactgtttgttccaaacatctcttacagaattcacgaccttttaacaggtattaatggtgtttatatagtgacttggagcttaagtgattgttttggctgaaatctaaagaacttctcattttttttcttccttgactacattttgctacatattgagaaggttgttttggaaaaaaatgtatatatgtgcactctcacatgataattctctctaaattatttggaagttgagcaacacagggcctaattatacggaaccaaagtctgtaattcctaagaggaagacctcagctctctggagcagtgccactcctcatgtgattgatttcgtcttctaagacagcttttgttttcccttctttccaatgcgtgcaaaacataagccacttgactatgcagaaagatctgggtattttcttcttccactttacagtaaaatatttgactttgaaactgtgcccaagggttcatcttccggctataccaaaaaagttatttctccattatgcttggtttccaaaattccaactgaatgtgacgaaaaggaggggctctgactttcttgggctgctccaggaagtttgcctgcagaagcttcaggggctccagttctgctaccagttctgtcatttgcttaggaaggtagggcaaagacccagtcaccgtgctgatcttgtctgcaaagagatcaaacgttcacatctgtcatagttaaagagtaggtggggaccgggtatgctggctcacgcctgtaatcctagcactttgggaggccaaggcaggcggatcacccaaggtcaggagtttgagaccagcctggccaacatggcaaaaccccgtttctactaaaaatacaaaaattatctgggcgtggtggcaggcacctataatcccaactactcaggaggctgaggcaggagaatcacttgaacccgagaggcagaggttgcagtgagccagatcacagccagggcgacagagtgagattctgtctcaaaaaaaaaaaaaaaaaaaaaagaataggtgggaaagcaggagttaggaagtggctcacagttgtactttgtggtagattgtctcacactatcctctgagcaatcccatgaggcaggtggatgaggaactttagtatcattcccaatgcaagggtgagaagattgaggcccagggagacagagcgatgggcctacggtcacgcggctgtcactttgtgtcggagccgtggctggaatctaagcttttaaggtcctggttcaaggttgctcatcccacacggcctcatttcaaggggtgaattatcagtacctccactgtgaaaaaactgcaattcattctttgagatgatcatgtaaataccagtcaaaaaattcagtaaatgcatcctcaaggtctccaaaccaaaatataatttgcaaactgttttctagcacctggcacagttttcacataagatggagtcacaaggcagagcacctgggtaccggaggcccaggccaatctcttagatacatggaaggaaggaagaaagggagagagggagggagggacacagaaaggaaatacagtctttaaagaggtgcaggtgaagtgacctgggcctaaggaagagaaagcaattgcatgggtgtgatctactgggttacagtgccacagaaatacgttcaatagccgccgtgtcactcaacccaagacagttagaaggaatacagagtttaatgtaaaattggggactttcttcttatgattatacataaatataaaatggaactattgaaattgtctggattctgactgtgggaatacatttattgcgataaaacctcagctgccgttacagagattcaaattaacagaggttaaacataaaagatgtgtattgctcactcatgtaaaagtacagattggtggtgcaaggctagtacggaggcttcacaattctgggaacctgggctccttccatttattgctctgtctttctcagcgctaaacatggcttcccttggtggtcaagagggctgccccagctcctgacatcagttctgcgttccagccagcaggaaagggaaaagcaaagagggcacctcttgcctttaaggccacagcctcttggaagatgcacacagcatttcctctcacacccactggtcaaaatttggtgataaaacaagggaaactgaaaaatgtaatcttagcctggctaaagccatgtgttcagctgaaacttccgttataaattaagaagagggactgggtgcaagaggacacgtagctttctctgccatgtgtaataaccatcccacaagaccctagagcagaatccagttatacaggcaagaagaattcctattgcattatgctagggcttttgttttcaaaatgtagattagaaacacgtcttggatgatttcaacaattgaaggaagatttctcaccttgtcaagtgctactcatttgcggctaaaaactaacatctcatgctaagctagtcagagccaaatatagttagtttgatgatgcttgccaccaaaatatcaagacaaatgttcttgaagcatagcactttttctctttgccttttccccacattcagtctatttacaataaaaaagtaggttgagggatggagttgcagaaactgatccttataactgttactctatatgtcacaaaactgataaccaaatgctggagagaaaaacgtgtctgaattctgttagtatagcctgacctagcctgagcacatttaataattaattgcagtgtacagttcacgctggtttgagagtacctaccggcaagtctgattacctcattcttcaaggagctttcttgctttggttccagagctgtgacttttacttgctgcttctccaagccagaaaaactaaatttttcttttctcttttctcggtaacctctctctaagaaaattatttgccagagtagtttctaaaacatatactttaacgatgctatcacatacctttctttatacaacagagaacaggtacaccgatttttttttaaaaccagattctattttagaattattgggcaagcttgttatttaatggaatttaataatccacttgtagagagtgtgactcatttgcagggcaaaaataaatcatttacctgtttctaatttataactctgagtttccacatgacaggtctgcatagagcaaacctgcaaagaaaattaaggcacacaactgctcttatgaaggtagatcagaacattattttttttaaaggtggagattaagggaacataacctgagtgtctgactctctcactttgcaaacgagggagcagaagtccacaaaggtggaatgatgcctaaagacactcacccagttaatgaccagaatctggaatgccccagctctcccaaagaagtgcattgttttgttgcttgacattcagaacaacctcagacttctaagtggaataaacataggtgtccttgtgcacaggatatgctcaatcagtatccagccctaggtaacctgtacgccaactgtgcacctatcatggagaatgaggtggtgatcagcaaccaacaagacagcagatttaagaaaactttctcagcttctcttggcttccttgaactctcctgctttcagtagtttgtcctgtttatacaaacttgtcttttctcaagatgggtgaccttctaattttttgtaattttatacaactgatcctgaaactcttgagtactgttcagctgcattcagagcacaacgaaataatgtttatgatgctaataataataatgaaaatgatagctcatatttctgtaatcatttgttctgcgccagctatttttctaagtatattacatattttctttttttttttctttgagacagacactctgacacccaggctgaagtgcaatggcgcgatcttggcttcctacagcgcctgtctcccaggctcaagcgattctcctgcctcagcctcccgagtagctgggattataggcgcccgccaccacacccagctaatttttgtatttgtagtagagatggggttgcaccatgttggccaggctgttctggaactcctgacctcaagtggtccacctcccaaagtgtcggggttgcaggcgtgagccactgcgcccggccatacatatatgatttcattccattctcacggtgatcctatcaagtgcttactgtaacgtatttcggttttatagttgtagaaaccaaggcacagagagagaaagtaactcaccccaggtcatgcggctaataagcagaagagttgtgttgtaaacccagattgtgacttttaagccctacctgatattggctgtcacggaaaaagaattgtctatctaataactgcatatacaggagatagtgtggcagagtgaaatgtcttgggctcagaagtatcacagtctttttctactttacctcaatccagggcgcccagctaactacactcctcagtttgtggtactttatctcctttgaccacatgcggcttctacctatatgtgtaagccctgcttttaaaccacaagccaccccccatgcctatgtgtaataccgtctagcgtcttaagaaattactgaaagatacgactcaatttgaagaagcaaataatacgcgttgcacacaggatcgctattggaggatgtcggccttcctcagataatagttgccatgtttctgctacagagatatccatggctcccttagtctcctccctttgtgcaaaacaatatctcacaggaagtaacagaaaaaaattatgtccagcaatcactgcccttttcttctggcattttgacagtggcagggttatgccctataatcaaaggaaacacagagcggccatctcctagcaactccctgaaggtcgctcccggggaatcactgctgtggctgggtgtgggtgcacttcacttccaggtttgaagacagcggcgctcccacgccagccacgagctcttctcagtatacttccaatacagtgaacctgtggtgggtagtgttgcaggaagaatgagcactaaagtgtcctaagctcggacagttttatggaaaatacatggaaaagctttatcatcttcttggttgtggttaaaaatctaattgcaattaaatgtcactagtaatcaaaatcatcttgctactctgccgtttccctttgccaaagtctgtttcccacttcttttctgtaaagggacatctgtcatgcaggggtggaccgctcacagcatcctccctccactgatgtttcctccccgtgggcctctgacccgcctgcgcagtctggtgtgctggtgagaccagtcaggcagaactggctcccactcaatccagggagctgctgctcctggagcctaaagcaccagcggaaggtgcaatgaacacagattttactccaccatctgtggagtaaagaagcaaatgtgagcccagaagaattcatccttcaaaccaagatttagtagacgcccttaaaaaaaactcatttatacaagagaaaacctgattcgtgaattcatttgaatgagggaccaaggcaagaaggggccccgtatctgaaatatttcaaccgctagtcacacctgtcggtgccaaggcaacatcccctgtttaatagcagcaggagtcacatttttggcagtacctgccagactcacttctaagtgcttcgtgtatacgcatccactgggtccttcagccaccccaggaggttggcaccgttgttatccctgtttctagaggaggaaatgtgggcaggttcagagagaggataagtcactttctgaagtgatccatctggatatggtagaatgggcttttcacaaagctggcttggctccagcatctacactcttgactacctcgccagcctgccccagcagcaggtgttacgggagaccacgcccatctctgtctgggagttgagcagcaggtgatgccacagttcttaaaagtagcccataatcaggatcataagccttcgttatgaaatactttttctatgaaatcctctgatgatataggaactgtctatttctatttattagaagaggaagaggactactttctcttaggtctctgactgtgtggcttgccatagaaaaagatgttacttctaatctctctccagcagtcacattgtaggacatggcacagtgggcatgactgttaagaatagccttcctttcagaatattctgttacacattccagcaacatttattaagcacttaagatttattatttatctattgagcatttagtagttttcactctttttttatgacctctgtctttaagccacttgtagtcgagggaggaaaacatggatggagctgtcactcctgcatatttctaaaggatttagattctgtctacatttttggtctgttgtatttcaagttgttgagttccagaaatgttctactcgctacataaagtactttttaatctatttctatcaaaaacaattttgaaatataatggagtgtcttttaatcctggtaagttagggcttagggaaaaatagagttaactttaccagtttttttctgattttaaattttcagtctcatgtttctttagtcttaattattctaggttaaattatttctttttattttttaaactaaatatttattttattttttatttcgtgtctgttcctttggccttttcatagggcttttctcaactttactatctccttggggtacaggagtggtgtttcttggagagaaaagctataaattgctggagactaaattaatatcaaaatagaaggaattttgttacatcatctctttttcgccttattgcctggcataatcccattttatgcctgttacatcagcataaatactgataacttctacttttagtcttaacatcactctttcagtttaggcaacttatttagtcatgctatccaaaagcagaataaagctaatgattaagtaaatttattctttgcaaacaaattcatggagattaatgagaaaatgttgatatttttaaaaaatctgtcgtgaaaaatgccatggtaaagtggtcttctttttaatgatttacaagcctttaacttataacccaaaacacagttgcttatttctttatagactcatgtgttctgaagataagtgaaacttttaaatgatttgagaggtttaggtagcatgcctgttgatatggtttggctctgtggccccacccaaatctcaccttgaattgtaataatccccatgtgtcaagggtggggccaggtggagataattggatcatgggggtggtttccctcaagctgttctcgtggtagtgaatacatctacgagatctgacggttttataaaggagagttcccctgcacatgctctcttgtctgccaccatggaagacatgactttgctcctcctttgccttctgccatgacggtgaggcctccccagccatgtggagctgtgagtccattaaacctctttcctttataaattacccagtctcaggtatgtctttattagcagtgcgagaacagattaatacacctgtatacctaattgctgttgtgaaacacatttctgcacaaattttaggttataggttttctgtgttgatgaggtgaaaaaaaaaagcctaaactaaatttaagtgaagttatataaacattacatctgccattattctacttaatgccacctaagtgtatccatgaaactcagtatataaacctggtatagaccaagtgtagggtcagaggctggctgagggagcaatgggatgacgtgaagctgaaagcaagacactgctgcaaaatatcctacactctagcctgctgactcctcccattatttgagatactcctttagaaagaatggaagaaaatctgttaaaatgcaaatgtattattttgataaagcaatgcctcatcattcataattttaacaaaacccaaggaaattaaatgtaagatagaaaatcaaccatatatccacttaaataatgaaggttatgttatcaccaggaaagtaattttttcattatacttaaggataggtgggtagctgttccatcccatttctagaattgaagtttaagatcctgtgtagtggtggtgattccatatttcacagaattgcctcagcactgtttgaaatcaatgctaatggtcagagtccaaagtcagattgtgatgtttgtctagtttcacacaaaacgacaaaggcaaataatggtgtgcagtatgaacatatggcaatattaatgtgtaccaggctgcaatatcatgacagtgggaaactaaatgatagtaatgattaaattatagtaatgattacagattctactcactaaattataaagcaccgatttgtttcactctgactttctcttgcacccttttccacagcagcaatatttctgcatttgcctaagtggtgaagctgactacctctttgcatttgctaaaggaaaaaagtatatattgttttcagcaacttgtaatactcatcccttcccctaactaccctgtgtagagccacacgatgccagtacgtggactgaacgtccttataggttccaccccatgattaaatttcctgcctctgaatcacgttctcctgatgaaagtctctgctcttctgagctaatccttgtggtgggaaagagataaaaagcaaacacgtaagatgagaggtgataagaagtgttctgcagaaaaacttttaaaagacaaaggaaacatggaggactgcattttatatggggcagttaggaaaggtctctgatacagaggtgctggagcataaatctgaagaactcaaggagagacctggggctccagggagaggacagtgtgggcttggagtgtccaaggcttaacgaggtagccagcctcattagaggctggaggacaaagaggaagagtggtagccatgagctagaggtgcagtgagggcccaggacacagaggatgctgccggccagcaaaggaggggagatgggaggtgactggagggctttgaataggagaatgcctgatgtctctcagatgtttgagcatcactctggatactttgggaacagtggaacgcaggtgatgtcaatggaggaagggagaaaaaccataaggttactggaaagctagactaaggtgttaggtggtaaacagaaggtggtgatgagaggtgtgcaggttctggagagattttaaagagacagtagcgatgcaggatattcccctgaccccttcacggcacttgcgaggggggtgcctcatttactcagcctgcccctctcaactcctcacaggagggagtgcaccagcaagcagagtggaagctggcgtgcatgagcgctggaacccgctggccgctttggcactggcaggagcgaactccatgcagtccccgttcgagcatccaggtgggggtgcctgtgactcccaaagccccagagggcgtgttgcagtgctgttctagctctgctgtccacgggcggcttaagtgttaacagcttagtgggccctctgccttttcgcatgaggcagctacccccgccagcgagggcaaaggccagtgtgacagccttttatatttgcactggtggcttctgagctcttgcctggcatccaggaaaaatgaggttgcacaaacaaattgaaggatgataaatgtgggggattttattgccgataaagtggctctcagtgggaaggggagctgaacaggggatgggcaggtaggtagtcttccccttgaatccagctgtctctggctggattcttctccgaagttacgccgtcaagctgtccctccaaagtcaagctgcttctctctgacattcatctgtagtcccacctaccagctaagtctggggtttttatgggcacaggatggggtggggcatggttataggtagtttaggaaaggcaacattttagcgggtaaagagggatacaagttctcactttgggccatggtttcaggcttttcagcttgagggtggggttttgctggggaatcacccttttctgcctagaatttctctggcttctgttcatatcagtaggatctgctccaacatgaggatagtaggaggagttatgagtcaaatatgatgtcagtgttttggggctggacaagcaaaatggtgatgctcttgatagaaaaatgaaactccatcagtggagaggataggtggcggggagcacggtcagctgagtgtggtgttgggcagcttgtgcgtgtgctgaataggtgctgatataccaagtctggccttttaaagacagacccgggcttcagaagtacatttctgaatcttcaaatagctctacatgaggttaaacagcccctcattcaaacacatttggacattcctctacgattgcctcaaatattattgcctaaaccccaacatatgttgggaatttggatggggaaggatgtagaacagattgctttgagacagaaaataatgcaaaaagatgaagggaagtgaatacacagtaaaaatatgttagacaccaaagattagcttcacttacactgcagtttttgtgggcactttgacacttagaactcacctggctgttgctgtacagcaagagaccatgtgaactgaagcattggttagacctatacatttctacaaaccgctctagccctagttgaacttgggaaaataaatatctgtatgaaaaagttgtctagatctgttacacaattactatcttgtttaattgtagaatgcatgaaattggttgtaaaatggcctggttaagagtctcatgtcagggccaggcatagtggctcatgcctgtcatcccagcactttgagaggctgagatgggaggatgagatgggagaggctgagatgggaggccaggagttcaagaccagcccaggcaacaaggcaagaccccagctctacaaaaaaaaaatgaaaagatttgctgagtgtgatggtgtatatctgtactcccagctactcaagaggctgaggtgggagggtcccttgaatccaggcagtcaaggctgcagtgagccataatcacaccacggcactccagcctgggcaatggagagagaccctgtctctaaaaaaaataaaaaataaaataaagttatcccaaattaattaataggatccttgttccgttttgcacacgatttatttgcagtttcctgacagggatgtgactcagtttgcatctgggagagcacatcggtgtttaccgggtttccctaagctcatcaggcagcaccacctctccacgggcactgtgcccgctcacctcccacgctgcatgagcaacaggctggccagtgcccaccgttaccatcagcagccacgacgaatccatcactcaagttctgaaactgatgagacgggagctccctccttcagcacaaaagccactgcatagctcacacagagaacaaaggcaaaaaccaaaaccccttcagtactagaatctaatgaccataacacaaacagtcagcatgtaggaaagaaaaaacttgagtggtaaatataggagaaaacacattcattccatcttcaaaatttgggggggagtgtggatctaatataaatcctaagaactcagacacagtcgattgagaacagagcaattcccttttccctcgttttaaagaatcatgtacataaaaggtttgaacactttgaactttgaataagtttgaacacttcatgccttttggccactagcatgctgttattttatgtcgcaagacgagcaacaatgaggcatccacagctcccaggcgtcaagactgaaggacactctgcctctcccttagggtttgagatctctgagtcagggaacactgagtgaaagcaaagctgaaatattactggggatcttcagtcttggggaaaagagttataggtgttggattaacatcgagtgaaagcaagctgaaatattactggggatcttcaaccttgggaaaaagagttataggtgttggattaacaacattcggaggcctggttcccttcattttacagatgaggaaaccgaggccaaaaacttcaagtgactttgtccctctccttaacatacttaccaatgtagccagaaaggcaatgcaggctggtccacagagtgagtcaccttagtcaattacagctgaactccttgttccactctttcttccttctcactactgcacttgactagtcttaaaaaaaaaaaaggcaatgcatataaaaagttaaattaaatggcagtaatatcagaaatgttgcaagacagcctagattcaatgtcagatgaagggcacatgcagtgagcctacagtaatgcagagatgtgggtgacggggcaggtgaggagatgggaggatcttgaactcaacttcaaaaagcaaatgagtggagtttgctaacagaggacaggatctacagatggccacaggcattaaagggaagtttgtgttagggaagggtaggttaatttttctgccttatcataggaatatattgttttaaatgtaggggtagacatgtatgctataatttatatgtctttttcatttcattttaaaagtaacaaaaacacatttaaaaagtaacaacatgtattaccaacacttggaaaattggcagagaaagtcaccaataattattcctaccctaataaaaaagattagtctttgtatgaaacctgccatttagtgtcaacaaaatgtaagtttctttatttctttattgtaactttagtttccttttactaaaaaaaaaaaaaaaaaaaagatttggccagcacagcggctcatgcctataatcccagcactttgggaggccaaggcgggagttcaagaccagcctggccaatatggcaaaaccccatctctactaaaaaatacaaaagttagctgggtgtggtggtgcatgcctgtaatcccagctacctgggaggttgaggcagggagaatcgcttgaacccgagaggcggaggttgcagtgagcagagatcccgccactgcactccagcctgggcaacagagcgagactccgtctcaaaaaaagagaaaaggttgaagagttctctggttcacaagaactgaattgaaattttttgagggacacatacagtcatacccacgtagaaatagatataaagattggagatccagaaataatattctaatgcagattttaaaagatagtagtagattataaaagtcatgataaaaataacatgaaactctctagaaaacactttatttggatcttggaaaggcgctccacgtttcagagccaccttttgtgggccttttcccccttgccttaatgatttgaaggttatcaaaaccacatgtttcttccccctttcctttttgattagcatgaccaagaaagcactgggaaggggtaaaatggaggcaggcatcacggagggcggaaagaagggctaagataattccaggaaaaactaaaaatagctcattagccttatgccaaatgtatatgaagtcatttactttttataaggttcatccagctgaataaagtgatttcatttttgaatgctcctgtgattataactaaaaggtgactcatccaatctgatggctcataattcctcttgagactaaacattcagaatcagcatgaacaaaaaattaatgaagacacaaagggtggttctgatgatggtttgatccttgcaaagttaaacaaacgctggttgtgctccctgtctttatctattacatgtacctgtgacaatatagtttcttgaccacatttatttatcgtgagttattatgtagtgacagatattaacttaaggaatgacatgcttaatatgtttgccacaattccatacattgatgaggatgctgcttttctgactaaggagaatttttgttcatctaagaacatctcccctggagagtgagagcccaagtcggctctgccttaaattcatgatctgattttatgagggtcacccagaacccactgtgcccttaacactgaagcctaggagaagcctgggctccttcaaggggaagaaagatgggcctgaccatcctatggtgggtgataacaataaagtgctcagggatgtttgtgagaaacacagagaaatactgataaggtttggctgtgtccccacccaaatctcatcttgaattgtagctcccataatcccacgtgtcatgggagggatccggtgggaggtaagtgactcatggggtgcgtctttctcgtgctgttcttgtggtagtgaataagtctcatgagatctgatggttttataaatgggaattcccctgcacaagctctcttgcctgctgtcatgtaagatgccctttgccttctgccatgattgtgaggcctccccagccatgtggaactgtgagtcaattaaatctctttcctttataaattacccagtcttgggtatgtctttattaggaacatgagaacaaacaaatacaactaccaccacggaattgtgagaacaagcatcaaaagcagcagctgtcctattgaaataaatttatgtgccttgtacccatgataaaaaaaaaaaacaaagatgtttatgacatttgtcttagagtaattatagtatacatgagcatttccaatattgctcattacagggtgtactgtacctgattaatcctgattatgacagactcacactcaaattctggtcaataactaagttatgtgttataaactgttgcaatcctttatgtccttagatccaagaaagacattatagtacaaaaactctgaagccaaactgcctgcattcccaagcttcactcactacttaatagctgtgtgaccttgtaccttccctgtggtttggcgtttctttgcagtaaaataagataacaatagtatttagcttgtttggttgttgtgaggcctcaggtcaattaatatatgtgtaatatgtaatatatatgtaacacatatgtaattaatatacatgtaatatctgtaaatattcttagatcagtttttggcacatagaaaatactttttaagtaggagctatatcatttaaattatctgccaagcagttaattcacaagaaaagcattaagaaacatgtacatacgtgtttatgacagaactctccaatatagcaaaaatctagaagcaacccaaatgcccctgaacaggaagtggatgtacaaaatgtggtattttgacaaaattaaatattatataggagaccaagtgaacacactacagggataaccaacaatatagatgaatcttagcaatgtaattatatgcagcattatatcattataaagattaaaacaactaaaataaatgtgcttttagaagacatataaatacaatgaaattatatgaacaggaaaggaagagaatgataagcatggaattcagaatgatggctactcaaatgcatggagctgagggatgttataacagcagaagtcatctggatagacacaggtccttacgaaggtctatctttggctttagatggttggtgtgtagatgtttagtgacagaaggaaggaaaggagggagggggatgtacatgaccttgtcatgcaccaaggattgtggtttatccatttgtgtatacttgagacacaacccccaaagtaacaataatcattctccattgctacaatcaatatcacttatgttatattacaactaactaaaagagaaaagagtcaagggtttgtttgcttgctgtttgtggatctgattttggttgggatatgaagtggtaagatatatacaaacagcccatgtactgagaatttttctaaaatgaatatttgtattagtcttctcttggaaaaacaaaaatcacaagtcacattcatgtttagggttcaatagtaaaaatgcttttgtttaaaatgtatgatataatttggtgatttagaattgattgattaaatcaacgtggcaagcataatattttcatgatactgttggtattcaggaaacctaaataacttcttaaaatacacttcagactcaaacaaaatcatcctgccaattgccaaaatatcagctcaattatctttgccattttccagggattttcaggaatgagtgtggatttgttagcctgacacctctaaatcatctagagattcctcaagtgacatatgctggaagacaatgtaaactggtgtctagggacaccattacattcaagatgtccaatagcaactcagaagaaaggccctcaatagactagaagagccaaggggtggactgtaatggcaaatgaggggaatcctcaagcccctttgtctaactctccctgacaaaccacttcacgatgggagtcattccatcatgtctgtaaatgaggacatcttctttctataaatattcactgggtaaataatatgtaccagatattgttagaggctgagtgtatagcagtgaaaaaacggaaaacccccattcatgtttgcatatagaacatatcaatattaaactttaaggaatttttttttatttttgattttatatatattttttgagatggagtcttgctctgtcgccaggctggagtacagtggcgcgaccttggctcactgcaacttccactttctcggttcaagcgattctcctgcctcagcctcccaagtagctgggactacaggtgcgcaccaccacacccagctaatttttgtatttttagtagagacggggtttcaccatgttggccaggatggtcttgatctctaagaaatttttttaacgaacaggtccagtgtttacataatccatctgaaaaaatgtactcctaaaatgtttttgataaaacaaagagaggattggaaaataaaatctggacaaaagtgatattatgattcctttgaggctttaatatcgaccaacttctgggtagtcctgtactgaactaggaagataaaatccacaaactcgtggcctttgagacaactgggtggggaacacaacagcatgtgtacgtgtgcctgtgcatgggcacatgtgtttgtgtatgtgcacatgtgcatgcacacactgctttttctctcacgtttatctgccatgctgcccctacctgtgtgacactggaacatcatcatccatttcggatccattgctgttatgggaaagtgaagcaacagtataactcctgcaccgcatgagctggtcagagactcccatctgcccactctgtgttaacctgtgcctaacctatatctgacctgtgcaaaatcaaaaggactagaaatgcttatctttcatgcccaagtctcttgggcaaatgaactgtgggactgagatagaagcatgctgcccttcccagagctgaatgtttcttgtcttatttctcaaaacatggagagttgagggagagggaacatccagggtaatttgtggagtagaatgggctctcaaactttttgattaatgaattgaataatgaatgaatgggccaggtgcggtggctcacgcctgtaatcccagcactttgggaggccgaggggggtggatcacctgaggtcaggaactcgagactagcctagccaacatggtgaaaccccatctctactaaaagtgcaaaaattagccaggtgtgatggtgcatgcctgcgatcccagctgctcaggaggctgaggcaggagaagagcttgaacctgggaggcagaggttgcagtgagccgagatcacgccactgcactccagcctgggcgacagagtgagactctgtttcaaaaaaataaataaataaaattgtaaaaaataatgaatgaatgatagcattctctgaggtgaggaatactggaaaaatggggtgaggtttggggagaagcgaatatcctgactccaacatgaaatgggaaataaatatgaattatgtctgaatcgtaacttagacataccaatttagaaattgaggtaattcagtgagagtctaggctgtctttacttttgataatattaaaagctagattcttaagcaaagtgctagcatacttatactacacaaaataaacctttttagaagcattcattccatatgaattgatgttagaagtacaaatcattcttatgtattcattaaactaggaccctggaggatttattttaggtgttattgccttgacctagagttaatctgtatttttgaaggaaaatacgttgccttttttcacaagcactttataactcacttctccctaattcagattgcttttcttaatcatttgaagttaatgatacaattatcacatagtagccttacaaatagccataatattaaatcataatttatgtaaagtaaacatccaaattccaaaacatctgaacatgggaacaggctgattgaagtttttgtgggtcataggaccttggcaattgtttgtgagcctgatgccgacatttctcaacagtaatcaaagcacagaacaacaaccatccacatgaaaaataactcaaattgtcattgtacttcccatgctattgtcatttagcaagttatggcatgactgattcagccagtaagaaaaatgtgatgagaatattggctaggagtacagtctgcttagatcttttagttttttttccttcaaaagccaatagacttttactctttaaaataggagctatgcaaaaacgtaatatttggaatgccaagctgcctccatgattgagatacctgttttgaagttctcctctactgtaaattctaacagaataaaaaaagaatcaatgattcttgttacctccaatgtacctaccacactactcatgaaaaaagctttaaaaattaatgaaaattgatggactgaagttctgtctgtttcttctggtgcagatttataaaatggattctattttaggaacgatcaaattctaaaattgagaagctcaagggtagggcactggagataatatagaaagacatgtaatatataaacaattctctagatcttatatctggagttaagtaaagcagacaacaaagagggagacagcttggttgtcaggatggtggcttggacatgtgttaatatgtaccccatctcatcatgatgctatcagaagcacgggtctttaaccatctcctttttctgaattttaatatgtgaatgagtcattaaatattggcttccagttagtttctgcttgatatgtacaatcatgacagtagcatagtggtttgcacattaaaggtcaacaaatgtttgttggttgaatatacctttcctagatttagcaaaatttcaaaccataaaagtcccttatgtgcttttatattttaaatcaagtctttcatgttataaactttaaaactcaggctcatcgaagtgaagtgatttgcccaagcataccttcccacacaaggcttaacaccgactcccactttagtacaataaaaaaaaaaaaagtcatgtaacattaagagcacatacctggaagtcccctaaaacataggttgttgaactctgactctgccacttcctcgctattgatgtgtgctatggtctggatatttgattcctccaaatctcatgttgaaattcgatccccaattggagatggggcttaatgggaggtgtttgagtcttgggaccagatacttcatgaatagattagtgtcctccctggcagagggagagtgagtgagttcttgctctattcattcctgggggagctcccttgagagctgattgttgaaaagagcctggcaccttcctgctctctcttgcttctgctctcgccatgggatctctgcacgccggctccctttaaccttctcccctccaccaggagtggaagcatcatgaggcctctctaaaacccaagcaaatgtcagtgccatgcgtcccgtgcaggctgcagaaccgagagccaaataaccctcttttctgtatagattacccagcctcaggtattcctttatagcaacacattgacttagacaaggtatgtagatatatacttctaaagtggcttctcccacaaaaaagaaatttgcggcccagcacagtggctcacacctgtaatcctagcactttgggaggccgaggtgggtggatcaggaggtcaggagatctagaccatcctggccaacatggtgaaaccccgtctctactaaaatacaaaaaattagctgggcgtgctggcacgtgcctgtagtcccagctactcaggaggctgaggcaggggaatcacttgaacctgggagacagaggttgcagtgagctgagatcacgccacttgcactccagcctggcaacagagcaagactccgtctaaaaaaaaaaaaaagaaagaaatttgctaactttttggcccatccattattgtttgccctctcccaatatgagtgacattttcttaccctctgctctgtgttaggaatggcagacagccaacatcccaataataatagttcatgttaacattttctatgtactatagaaaagcgatcactccactcaaacataattaactagaatcaatgtaaatgcatgtggtcccagcgtgggttctggatttcctttaccaaatgctgcagcacagatgacaaagtgcttttacgctccattataaaagaagaaatggaaatgaagtcagtaggtatcagatcagaagtcagtgggtatctctgtccatgaagatgtccacacagacattctctacctgtggacctgaaggagaacaggctgagtcccagggtagagtcgatgcgaacaagaggcccaggttggatctgtaaggtgatccatggccctgagcatcatggcagactaccctggagctaaaaccaggctgccctgaaagagttcgtgtagttgggaagtcaaaaggaaatttttctgcttttccaagagtggcaaaagtccaagataaaagaaagagtgttgagagtttatttctgtagataaaagggggagaaatggctaataaagatcagactgagtaggatttcactacatatgttaaaatatgccaactaacaatctcaaaaagtgttctgatcatttctacctttagccagtacgtcaaataagttagagtattatgaaacaacaaaaactttgttcaaataagcttcactgttctccactgtgtaactgtggaatataaatttgtatttgtatgttgtttttcttgcctatttttggtggattgagtgaaagttttagctttaaatagtggcagagcatgaaggactatattaggtatgaaaaatgaagaatgctgggaacatatgtggggggtaagaactagaagtgaggtcatctgagttggcattttgctgaacaaaagggcaatagacaccacatcccattttgttgtacagttctgaagtcttaaaccccttatttctaggatggacttgttttcattctttctgatgacaattgtgaaccagatggttaaaaacccagcactgagaaacagtcttatttagatattatgtttcttaaattcaggtacatcttgagggaatattgaagcttctagctgcaactgttatttatacatcttcttgtcaatttaaagcataaatttggtatatttaagagcattaaccctaagggccactgggatgagttccacgagatgaaagaaaaaaataaacctcaagtacatgtcagtaacttttcctgttgctgctggtagtcacctggaaactcaccatagtgtctctaccatatcgttctgtgaccctccccccacccagcacagcctccaaagcctgcctagagactcaagttcatgccagcctgactcacgcacagactcatgtggacactttaaaagtgaggcagctggagcccaatcttccttgattcatgaaaccactgttcatttagacattgatttaattatatttttcaacaattgcattaaagcccttagacttattccatataaatttttgaaaagccagtctcttcaacctaatcatgaaatttagtttagccaaatttaattcagcctgtcaagatcatctttctacttattacctattcccctctcgtgtgtatgccttctgcagaatcaataaacacaccactttgtttttccctaaaataaaaatgttgcagacacagtcggaacagggtactcctcaaattgagtaccttttattcacctatgattctgcttaacacttgtacatttagtacatagagaaatgtaaagaattttttcaaatgtctgaataacaatggagcagcagtatataaatattaataatacatttctgaataatacatttccattaaaatggaagatatctgtctttattgtctacttttattagatcccaaagaataatgtaataaactatccactgttcaacacaaatatcaaaagtttccaacttttaatgcattcaaaatttcttcagatgatatttttcctccattggcttattattttctcgttcaaattttctaaaatgaatcaaactgccttaagatgtacaatttaagatacattctggccaggcatggaggctcacacccataatcccagcactttgggagaccaaggcgggcagattacctgaggtcaagagttcgagaccagtgtggccaacatggtgaaaccccatttctactaaaaatactacaattagcctggcatgatggcacacaccggtaaccccagctactctgcaggatgaggcaggagaattgctcgaacctgggaggtggaggctgcggtgagccgagattgcaccactgcactccaccctggccaacagagcgagactctgtctcaaaaaaaaaaaaaaaaaaaaggtacatttcattctggataaactttgtaagtaatgtattacttaaattttaagactataagatcaaattagagcaaattttcccctgccccaaaatttaaattccacatagcaagtgggatttcaccattgcatatctgagacacatataaacatgaatttgtaataattctgacagtatattctgtcaaaaattctgacaaaccttgacattgctaaagtatataaatgttatttcaggtgctcaggaaacaggtgtattcaatcagaagaaaagtgtggctttttaagaacagtgaattaacaataagcaggcttatttcactgtaatactttcaccacgtaacattaccatgaaaataatttaaaatagatatacttactaactgaaaattctaaggatttcagaaaaaaaaaatcaatggctattggtctaggcttagaccaaggaggtctaatatgctttgggtttagtagacctgattaacactttccatttggacttgtgctgtgattgggcaaaaggaatccttgtcataatcaaccactgttttcctattagtcttagaggaagaaacatatggttctatgttaacagttcttattttatttatcaaacagttttgccttctaccacaccgtcttctcatattttgttcttttccctaacccctgcctcatatgattcagtacttaattaagcagggtactgtaatattttaaagggaaagagcttgatttcctatgttgtttttctgttttgtgttttgttttgttttgtttcatttttttgagatggagtcttgctctgtcacccaggctggagtgcaatggtgcgatctcggctcactgcaaccttcgactcactgcaacctccacctcccagcttcaagccattctcctgcctcagcctcccacgtagctgggactacaggcatgtgccaccatgcccggctaatttttgaattttagtagaggcaggggtttcgtcatgttggccaggctggtctcgaactcctgacctcaagtgaccctcctgcctcggcctcccaaagtgctgggattacaggcgtgagccactgcgcctggccaagatcttgatttcaaatgacgttttaagattccttaaaggaggatgcctattatttgctaggagtcaggagagatgaactacttttgagtatctgcttggggcatccatttatcttatcctcaaatgtctaaccctaaaaatgagttggttgatctcaatccctaccagagcctttgatgcttgcttctacttaaagtctaagtatgagacatgcaaaactagactagattacataattcttttgatatcagatgatttttatatttcaatatataaaaattaaaacggaagattttaaaattaaaagcagtgagaaacttagcaaagcataaaattttaaaaaatggttctttaaaaagatcaaggcttttctcctcaaaatagaaatgtgtgcttctcagtacaaggtgggaaatcagaggcactttcccttattgaattaagcaggagtaggctgccatcaggatgttatcactctgcaatttgtcacacaatttgttatgtgacattttatagacatctctttccattcagccatcgctttcggctatcagctgtcaaagggaaagagaatgatttttttaaaaaagctaatcgtcaaaacctttatagtgtcactttcccttagatccagtagcattgtctatagctgggctagaaggcaagggtttgattcaactattttcttaggttttctcttgttcatggcaatgtgtgggggggaaaatcttagctaaataaaggatctttttaaggaagaaagaaagctgcctggaaagtagaattccttttcaattccaacatgttgctaagctgggtgtgggacaattgggagacgggaaaatccatagaaatcagtctaataaaccatatggcttgcttcaatctaaagcaatacaataatgccccatgtattttcaggaaagtctagattatcttcttaagactcaatcaaaggtaaagatctgcttcaaaatatttgaaatattagtgaatgggaataatgccagtttgccagattggggatgctttgctgtctagcgggggagtcgatgataatgacattggtataaattgttcggatgcatagaaatgggcagaactgggatttgagtcaagctttgcctatttcttgacccattcttccaacgctattcagtttgcctatacatgtgttatagggatattctaattaattcctcacatgtctctttgataaggtgcctgacttatgagatcctcagtcagaatctgaattattttcattagaaatttttttggcttttgatttgcacattataagccaatggaattctcctaatactgtactatcaagttgaacaaatgacttagtcttagaaaaaagatgcacttgaaaatacttagatgttgttccgtaatgatccctaagattacaatataaaactaaggaactccatgaaagtagggtggctaggcacagtgactcacacctgtaatcctagcactttgggaggccgaggcgggtggatcacttgaggtcaggagttcgagaccagcctggccaacatggtgaaaccctgtctctactaaaaatacggcatggtggtgcatgcctgtaatcccagctactcgggaggctgaggcaggagaatcacttgaccccgggaggcagaggttgcagtgggcaagatcgcatcattgcactccagcctgggcaacagagtgagattccacctaaagaaaaaaaagaaagtaaggtgctggaccaatgttaagtcacatgaccatttaaagcaaatagtgaaatgagtgattcaccaactttgagaccttggaataacatcagaaggaatcatttaccaggtgatcaacttctaatcagtaaagtctttagggaaaattgataagtattttgaacagcttacattgtaaagtctcaaaaggaaaattgctagtttccttggaagacatatagtgctcttttttcaggaaatttttccaaatatcaggacatttggtctaattaaaactaacactccgcgtattctcataaaaaattatcaacggcctcatgttcatttatttctttattatttgtggtaataatgtctccttattcctagaaatgatgttgaatgtgttctggcctcagcatagataaatagatgccgcgggtaattcggctcctgaataataaggaacattttcaggcactgttagcacaggagttctgggaggtacttggtgttcttatgagcatggacagtcatgccgctactgttgacttgtgtgccacccactcaggcagaggagtctctgagccaatttagagaaactagtcagaagagagtttctaaactcacaaaacaaactacttggagttttcatgtgactatttcaaagcagcatgttgacatataggaaagataggtgaagataaatgtcaacctgaattaagtcatttgactataatagaaaagtgaaatcacttggcatttatgaatacttcttattttaccacagtcagagatagagagagatgcattaatacattgatcacttagggcagtttatccaaagagagtgctacaaatgatcccatttcaaaataaataagtaaattcaagttaaaatctggtgcataaccttaatatgattgtatttttatgttcatgtttaaaatacatctctttaaaaaaaaaaactaacatcctgcaatgttttcctactacttaaacatcaatatgtccttttttgaataatatatgaactgtgaatatgttaatttcaaaataacagtagcaatgtattggcttaaggttcgtctgtggaaaatcttttgggcaactcctcccattaactgagctaaaattcagtcctgtagtttcatacatggtcttggtgcttaaattcaggtctacaaaaataaaatgacctacatagaattcttagccaaaactggggaaaggattttgtctctgctgctcttcagaatgggatgcctgataatcaaaacaattcaagcagaattatgagacaacaggcacaaaggcatgttcatgcccatgcaggatcaaactccttaggatcctctttcaaaagttaaattacccattctattctcttatacgtattgagaacacagcctgctctgattccgagaaaaatgagatgtctgataatccaaagaaattcaagcagaattggccaggcgtggtggctcacatctgtaatcccagcactttgggaggctgaggcgggaggatcacaaggtcaggagtttgagaccagcctgaccaacatggtaaaaccccgtctctactaaaaatacaaaaattagccaggcgtgatggtgcacgcctgtaattccagctactcagaaggctgaggcaggagaatcctttgaacccaggaggtggaggttgtagtgagccgagatcatgccactgccctctagcctgggcggcagagtgagactccgtctcaaaaaaaagaaaagaaaagaaagaaaaggaaaaagaaaaagaaaaaaaagaaattcaagcaaaattaaaagactatagacccgaagtcatgctgtttacagcccttccatgaacaatcaacacaatctattgccatatgtattttgacagtggaggctactctaatccataagtaaaaccaatccattgttgtcacaaattaggacacatatgaagttgctttttatatgaaactttgacaaaagtaaacacaatcccctagcacctattgaaaatcatgctgacaccttcatgttcggagacttctttgctccgtggattgtctgctaaggctcaaggtagtctccatgttatggtcagttctcatagtctcgtccctggttcaattccaagttaagagaatacttgagatgctgttgtctagcagcatgcaaagactctaggaatttgatgctttccagaataatctgtgcttgttatgtaagtacaatcaaggacactttttcagagcagaacaaaagagattagattcgctttagtttgaactgtctaaagagagttctcagtcgtggatttgttaatggacttagcacaaataagggaaatagaatcgtgcatttttattagtcacccaagaagcctttcggtttcaggttcttcttgagagctcaatcactgggattcttcttttaacgacttggaaaatgtcttgcttgattaggaagttagtcatttcacattttgacatctaaaacaatgggaagttaaaaagcctcacaaattacatttataagtaacaggatacatcactttaaagatgaaaacctcaaggatttgtggcgcctttctttgttctcgttaatcctattttactttttgagtgttagatattctgtaaatatcggcatttgaattcaaacaataggtgttgataactagttctctaacttggtacaaaaacattattattgtctgtcagcagattttgtattctgagagttaaccttctgtatttgatgttttctttgtcaatcactattattctagcccgaatactgtcttcctcattccgttttaaaaccttaagcagttgtaagcacagcgttgcctggtttcaaaaggaatgaagaagtcgaatttgggaaaggtcctcataatcctcattttctggaggttgtttatcccttcttgttttagaagttgcctcagtctcagtcacagacatcccctgaggcttttcttttccatttattttgtccatttaaggttaacatattaggagttttgctaccaagagctaccgagagattaaactaaatacgtttgaaggagctttcccaaagctcctgtgctggccgctgccctcttccctgacttcatcggtatccctcaatacaggcggtcttaaggctaccaagctgagtttttagaaatacgccacattttttctgtgtaattctggagaagaacaaaacaaaaaagtaaaacagaaatgtgcctgtttagttgcatacactgaaaaataggagataaaattcaccatcataaaatttccctcaatcatttttcagagtctgttggcctatgaaatgccccagtgaagttccccataaccctgtggaaactcagttctagcctggccacgctaagcatggctcctgccctgctccctacactgcaatgatgcccagggcagacggacaacgatatgacactgaacacagaccacacaaaaattaaacaccatatagtaaggatatcgtctatattgttttcagcgtagagctctaaaaacatatactgaggtgattatcagtactgtgattttacctattttaaatgttcattaatttagcatttattgagtcctaaggtattagtaattcaatctaggcaaatatacgtgtgtgtgtgtatgtgtgcacatatacatgtgtatatagcaaaacgaggattacactatacatatatatctatatataaaatcttgctttataattatatttcataggacttaagtgtatttttaatgttattttctttcatcattttccccccactgggagagaagtaccattatatttagctaatattcacattttgattttattattataatttttcatcagtaatgaacaaagccaggctttccaaaagaggtgaactccaatagccacattgaaagaaaataatagttgtgagttgagcagaggaaatggtcagaagggagaagagggtgagaaccttggcagacaaaggcaagaaagccaggaagctcatttgctgctctttttagagactaaaaaatctttatttatcaaaagtctttcttgacaggtgatcatgccaatgatttcatttcaaatttatcctcattcatccaaaaggaataaataaaattcttgaaaatgttcggatgttgcagtactgatgcgcctggaagctgtgagtgtgttgtgctgtgcgggggggttcttgtggatactcaacaacaggcccactcaggagcaaaggccaagtggccggggtcagacagctcttgcagggagctcttggacttaggagatttgctaccttatcagcgtgtctttcctctttggtttcagggtatgggtaaataagaaactccataaatgggctaagagaatatgccagagaaagaactaagtcatctcacatgtcataaaacgatacacaatatttaaaacctttttctttgggaggccgaggcgggcggatcacaaggtcaggagatcgtagccatcctggctaacatggtgaaaccctgtctctactaaaaatgcaaaaagaaattatccgagcgtggtggcgggtgcctgtagtcccagctacttgggaggctgaggcagaagaatggcgtgagcccgggaggcagagcttgcagtgagccgagatcgcaccactgcactccagcctgggcgacagagcgagactcatctcaaaaaaaaaaacttttttctgagacaacccctttctgccaaccgtttctagcgaattaatctcaattgctttgcatccaacatttcactgggaaaaatcagcattcaatactaatgcagagatggattttgtagtgaccatctatttcctgtgtctttaaaaaagagaaagatgaatctcatctttcttgacagtgtcctgaaaatatgcgttacattcattacatattccccggtagtcaactgacctgcacatgtaaggcaatgattttaaagtgccagggtcacttttaaaactctggaagaggacacttaacaggcaatcatttcaggcttagagaacaaaaaccatttgtataaatatttgtaaaagaaatttaattttttaaaaggaaaactcaaccaggcacggtagttcacacctgtaatcccagcaccttgagaggctgaggtgggaggatggcttgagcccgggaaattaaggccacagtgaactacaatcacaccaactgcactccagcctgggtaacagagcacaaccctctctctaaaaaagaaacaaacaggccgggcacggtggctcacgcctgtaatcccagcactctgggaggccgaatcaggtggatcacgacgtcaggagttcaagagtagcctgaccaacatagtgaaaccccgtctctattaaaaatagaaaaaaattagctgggtgtggtggcatgtgcctgtaatcccagctacttgggaggctgaggcaggggaatcgcttgaacccaggaggcagagattgcagtgagccaagatcgcaccactacactgtggcctgggcgacagtggcggactctgtctcaaaaaaaaaaagaaagaaaaaaagaaaaacaagcacaaaacgtctccattttcatccattaatgctcaccattaaacaaaagcataaaaacagaatatgtctgttttatgagcatgggaccaataattaaagtttaacatgaacagaattataaattcttcctaccttattaaacactgatttaaataagactaatgataatgtgatattaacttacaggtacatcaaaaacaaaaatgcgacacactttcatgatattttcttccacatgctagtgaacaattatgcaccatttttttcctacaggaaaactgaagactttaataacaaactctccaaggtgaaaatgaacacaggtatgctgtctgttagttttaaactcttttagccttgctctctaaaaatcatgttggccctaaatcattagtttagcactcttctgatcctaaatgtgattctgagtttctgattagatacatagcatagattcattactttctttctttgtatttgtgccccactcttatagccaccaaacatagaattttctcttctattacttgctcctactccctttttctctaatcacatgttaaaactaactcctataaacaataggaagaggtagtatgtcgtttgtttgtgtacttttgaaatctctcacttaaaaataggctaaattcaaaggcaagttgctctagaagaaaatattcaaacttacctgttctataaactctttatgttgaagaagtcagcagatagagtgccaaagttttatacaaaatcagcttaattaacctatagtcacaattcccatagtgttataagcattatatgtgtagatgtgagagtagtatctccaaataacttaacaactgtgtctctaaactgtattgtctacattttaactgtaaaagtgttcatgatacatgctttgtacatatgaacttttttccacagtagaaataatttggcttataattttgccttccccccaccttgaaatatacaatacaaagtaattcaagaaacaactttctcgttgaaattttgtaacttgtgtttaaacgataccatttcctatccacaagtgatcactggaaagttgtttgagccgtcgcgccatggcagagtagaaaggatggcccaagatattctctcatgtccagctggttgcctttttgaggtctcttgttgcatcaagtgctacaaggaggattacccagccactggcgaggaccaatacctaatccccaggtcgagtgcagagccttgcgtcatgtgccatgtgccgtagtggcctcagagaaggctgtgcgggcgggctcctggggatgcagtcaccttgcagacatgtggacaacaggcaagatgaggatactggagacagtcaaaacacacaaggaaggctcagcaatcaagagaagttataaccctgcatatgcaccacacaaaggcaacttgatgattggagatgtcagaagtagacatggggaatgaagtagaaaatattagcaggtaaaggagacagaagaaagcaaatagaatgtagagcccacagctggactagcatcagccatgttttggagctacaaagtcactccagcagaagttccacatgaggaagtgatatttcctgatccttccaagacatttccctgtagacttaagtggatcataactcccagtattcctcattttactgagtgctgattttcctatttattataacactattatgacagggatatgcatacatgatatactgaatatgctgtgttgatgggcagtacactcaataattaaccttcctattcatataattcaatccctcatagcaaaataagcacatacaaatttgtaaatttgtttaagtcactaaggtacttgacccaagttactgcttagcagcataaatgtaaccttctaaagcatcttctcatttctaaggagtaagcttgactctggatgggatgcaatttgtataggattattttgcttatttggatgaacttccacttaatgtataatgattggaaaatatggtattcaaacatatgcataaaattgatcaaaagtgactgaaaacttttgctcaaaattccaaaataataattataatgtttttataaaaacataccacttttaaatatatatgtatatatatacacacatatattgccttaggaatttgaaagcattgttactgtgtttacaaaatgaagtaggaatttgttcctaaagagctagtcaataaaactggcctgcattatctatctacagatagacagatgatgatagatagatagatagatgaataaagtggccccacaagttatttttctcatccccaaaatagcttctagctcttctgacttttttgtctatctatctatctatctatctatctatttatctatctatcaatagacagatagataatgcagataatatatggatagacaatgcagataatctatatagataaataatacaggccagttttattgatatatatatcaatattcatttaaacaggaatatatctctttattgatagatatatctatccaatatatcaatcattaaaaatatatattcctatttaaatcttcatgtgttggtcaccacggctaaaaagcattcttttaagttaagtatttgcttttaatcagtgcataataaactagccatggggaatgtggttaatttttcatactaaagtgtctaaacaatgtagaaaatatatacaaaacatgttatatgtccacttttagaatgtttaacacattactttcttaggcatatcttagctattgaagaaaggagagaaggaaagacatcaaataattatccatctataatttacccatatgaggggtttccagcagtaggaacagcttccaggaatcttgcagctcaggggaagagtagcctagcaaggctgcaggtcattaatgaggacaaaaggcaagaccagcgttaggattctttaggataaactgacacatgaaaggtagcatccttgttttaagatcttaaaaatatcttcaaggagtatcagaaagtatcaatacaaaaggaagtagaaacacaatataatagatcattctgttccagcaattttacaaatgcctcaagttttagaattcagccctttattaaactttattaaagacagagcctccatttatttcatctaagacttagagcttcctaaaatacataaattgtctaacccaaggattcccaaactttcttgttttacagtgacctttaatgtctcagtaatttcttcactgtgctcctaggtcaaaaatatgtaacacttctatttattaagtagttaggtgctaacaacttaataacttaataattactttataaatactttgttctaacaacttagaagccatttgacagaacagtacacataaattgaaagaaaatagttttatttctttctttataacaagaattacttactaatattatgtgtgtgcctgttgcacactgaaaaatttctcagaccttagaattcgattgtacatgaccactctcatttactgatctaaaatgatttacaggccagacagtcacggtggctcacgcctgtaattccagcattttgggaggctgagccaggaggatcgcttgaccccaggtgttggagacaagcctgggcaacatagtgagaccctatccctgtaaaaattttaaaaattagctgggcgtggtggcatgtgcctgtaatcccagctatgagggaagctgaggtaggaggatcagtttgagcccagtaaggtccaaatgcatcactacactccagcctgggcaacagagcaagaccctgtctctaaacataaataaataaaatgttcttcagatggtacttgctttttatcatagcaagtatcaaaatcccagtttttccaaaatatgatgtcatcaaaaggaatatagcgcgtctattatgttgaaaccaggcactgccccaagcaagtagttcattgagtgtccaacagttagcactgtgttttccttaaaaacaggaactaccccccaacaccctcatgaatgcaccagtgcagcccagggcatcgcagcccacagtttgaacaccagagatttaacctgtgaccctggatcttctcattctggaattttctcttttcacctatgtgcttgtgagatgttcagaattaacagaactaggaaataaaatcactcttagagtgatgtcagtttttactttcaacacctttgactacacaaccatttcaaccagtttccagctcctggaagcaataacatcacctccatcttatcagacgcacttgtctctaagcactttcagtttgctgagttcgctaaaatccttttggagcctttcctgaaggaatcttcagttgtttctcccatttgtgtcactttctttgggttcttaattataacctttgatttatttggttcattttcttttaatattctttcaagttggttttctggtttaatgattttctacattaagaaattgttactttaaacatatactttaaaaaagtgaagtaagaatcactccactgcttttaagttctattaatcttactatttataaattttatgaaaaattccttcaaattatacttccgagcatctttaccaatctaaattctgtcatgtccaataaacaaacttgatactttccttatgaaaataaagaaaaaggaaaaatggaaatgtgacaatatataatgattatattattatatcggtggttatattgtctttttttataactttcaaaaagatttaatttaatttggttttactcaataagcagaatgaggagaatgagcaaaactatttattgccatgccatattacagaggaatgtaagaatggaatttgaatctggtcataaatagaacattggccttccaattttaaaagacttctcttccaaatttagaagtctaaacttctcatagcacattaaaatggctgatgaacttacactgattttatttcacattatgacttgcataagtttaaagatatgaatcatagtacacatattgttaaaagtataaaagcaataaatgaggccaggtgcggtggctcatgcttgtaatgggaggccgaggcggaaagagcccttgagccagggagtttgagaccagcctggggaacacagcaagaccacatctctacaaaaagttaaaacgttagccggtgtgtgcctgtggtcctagctactcaggagactgaggcaggaggattgcttgagcgcaggaggttgagatggcaatgagctgtgatggtaccactgcactccagcctgggtgatggagcaagactccggccctaaaaataaaaatttaaaaagtaaaagcaatatactcctttctttaaacatggtcatttcgataccatatatatcaatacttttattttaataaggctagttatttgcataactaacactaactacaggaagagtggactttccatgatgccatgtgttcctctatgaatcctaaaaaaatgtatcatacctgtgtcactaataatttttactgcaagaattattcaagctctctttgggaattataacagctagaagatggtaaaacttaaatgatattaacttaaaagtatgttgtaccatagcctttaatcctgacatggagctaatccttgactctaaaagccagatccagtgcttatagatttagtataaattgaatttaaatggtataaacaaagttgagttctgtgcctgagttttcacaaagaaaaccataaaatgttaagtattaagtcttccatgctttcactaaaacagtgatacctatttctaagacagatccctggtcttcttttgttttgtttcgttttgtttgttttagtttgagggtggtgtgaaattggcaggtgcattccatgattactaattctaactgttcatctttctcatggatgtctggcacatttctcttaaaacgcatgatattgcacgtgcttttcccgttgccttggcctctgctatatcatttttttgcttccagatagcggtgggtgtgctcgcaaacgtgccgccatgtctgttacgctaacatctgtgaagagagtgcaaagttctccaaacctattggctgcaggtataatatcactaactcacacaatgtcgcacttgaatggcttctagctcttctgactgtttttgttctaaacgtaaaaagcaaaggaaaatgagatcttgtaggaaacattttaaatgtgtaattaaaaacagcagtcacttgccaaaaataggttgagtaactgcgagtgttaataactattcacgtttttgttatctcatgaacttaagtagcataatatttcattaagataactcagaggttttggggtttttttttttaacctaaaaacttttggggtaggggtacaggggtacaggatgaaaaaagggatttgtaggaaactgaatcttcattaactggattctttgtcaaaggttgtgaacagaatgatagaacattagttttgaaagagacctttgctttcctttaatccaatcagcaaatacccttctactatatatatttaaacataccaaaatcttgaccaattaagattcacatgtacccacagataggaagtcactgggggtgcgagatttcagcatccactcaggtggtctctttttaataaatctctgttgtgactacctaagccacagtaccgaagttaggcacagtacctaaggcacagtctgcactgggagggggtgcagctgttagaaggtcaaagggaggccagcaagcccagtgcctccagaccctgaaatagacccacacctgttggtgatgggttggttggtgggttggttggttggttggctggttggttagctgcagtttggggactgcttgttttttatttataagattaatgggtcttacagcagaagtgagaaagggatggggcatctttaaataattttaattctcattatgcatatcacagtcttctacacacatacatctagaagttgattaaatactcagggtgttcttcgctttacagccacttaattctaaactactgagtttttcttgagaaaaaaaaatgaacttccatatgcagaatcccacttccgttcaccacctctaatccacaaatggatttcaacgtccaagtttaaatgccaggctagtgagttcagttatatattaagttaaaagaaaatgcaagatgcattgcaaggtttatagtatgacctcattttggttaaaaaaaaatctctatacaaatctctatttgtatgtagtggctcatgcacgtatgaacataaaaaggtgttagaaaaactacagatgtatttaccttggataccatgagaaacaggaatgaaggcaagtaagacaataaccgtaagagttcagggccatcgtgtaattggaatgccaataccctgaatgtcattgacatttcaaccaaataggatctcagtccaacctactcagacgtgaaccttgacgcacgtaccagggaacgccacactgcttccacagtgcccatgtggagagtcgaaactgaactacatgcaatttcatataactcgacttcatagaaaagatttaatgcttcggaattacaacagcaaaaaagaaaaaaaaaacatttcacactttaggaatatgaaataatcttcagtaataacaatgtagctttgggctattttaagttttctatcactaggcatatgatttctagagaatgaagtccactgaattttggacataattgtttaaaaacagccctcttttgtgtcaattagacgtaaagtaagatccctttttctttttcttttcttttctttttttttttttttgagacgggtgggtcttgctctgtgcccaggctgcagtgctgtggcacgatcttggctcactgcaacctctgcctcccaggttcaagcattctcctgccttaggctcctgagtagctgcgattacaggtgcctgccaccatgcctggctaatttttgtattttttttagtagagacctggtttcaccatgttggccaggctggtctcaaactcctgacctcaagtgatccgcccgcctcagcctccgaaagtgctgggattacaggcctgagccactacacctggccccctttttcaaagaagcttccattatatttttgaataaagaagttagcattaatatgcacaactgcattctatgtagctttcataagaacttatatgatacagtgtctatatgtgaatcaaaagggaattgataaatatttattgccttcgatattgttaaaatacaacagcctttatgtaaaacctccagaaaaggtcccaagccattttcactcccttctctgatcagacagtcaatctgagtcaccacctatttgtcccctgagtcagtctgtctttctcttttccttttataagaagtaaattcccactggacaatccatcagagcacacacggatattttaaacctatgccaaaaccaagacaatgactattgagaaacaattgaaaacattttatttcaccaaaaccccttgtcagcctaaaggaatgccgcagtatggggaccactccgccaagagacagggtcttgtcgataccacctgcatgtttcatgcccttaagaaaattagtctgtctagatctcatttcctttctttccaatgaaaaattgtttgtcatttcttacctctctgaaagcttaatcgtttcccagactcacaaggatttgtcagaataaatgagaataaatgaagaaaataaatgaaaagggttataattgtacatagaaacacagtaggcactcaattagttgacctgaatttaatcaacattttaaaataattcttaaaaagcacttgagtcttctaaagaaatgagttataggcatcaaaataataattttcaagaaaaatatagtgatagtgtcaatagagcatatcagttaaaagggatttaaataaaacctgagagtagagattacgatgtgacacgtatcacaaacacagctacacgaaagctgtcatgttagaatgataacagtggaaagggccatggagggcatccagttccacccctgacatggaaccgggaatgtcttgcacaaaatctcagacagagactcaccagtttgtgcctcgacacaaggaaaagggctggtaagagcacgtggagctcttcattcttcaagaccctatttgttaaaatattcacatgcaaaacagccaggaaaggggaaaacttacaccatttagtcattcgtggattttcagtgaagcagtgactgtctactaaagaacactagaaattaaggactctggcccctagtcctagctttgtgtttttttcacaagtgaatgtgcaccaataatgctgcagatctggggaaatccattttccccacacatctgccaagccatttacctgggcgacttttttttttttttctaacctatattctctttacttgatgtggatccatgatactttctattacctgctccaaagaacaggtgtcctccctctcctagtctttcctgcagggataaaataaaagcagggctatgctaaaaagtgtccacatagaagactataataaaagagcaaatcaggactgggtgttccaagtatctgtaattggatttattttaaagaaagagaaatgaatgtactttagtctccttgagagaccagccacttcaaggcagactttaatcatcaacataagctttattaaaatactggttcatcctgaagttcgactcaatggccattttctcctttctcttaattctgcacactcgtgtccactgtgcgatgcaagacccttcagaacagcccacccctcttactgtctaatgtttccagtggcacagggacagattcatttggaaatccctgggcccagtgtcccaggaagaaacccacagttgagcctggagtgactgtcctctgattctcacacttaccgtctcctggggctcctcatcttcaacacggtgaccagcgtgaagaaacagagcctgccccctacagactatcatttagagggagtttatttctagtgtccttcagacccgcccagtacaccttcttctttctcaccgcacctgcacccttgcacctccaagcctctgggtcccattacctcgtccccagcgctaacacacagccttcttttttatctcagttttaccaaaccaagcataaaagaaactccctatcctcaagaaaaaaatcagaatataatcattgttattaatgctgcttctcttttcataaagtagcattgggctattttattgctttttcccaaattccaaaatttgcttttcgttgtcctttcccaaatcccaaaatttgttcattgtccacagtggatggcagcctcatggttattaaatctctctcctgagtgccctaaagcagcattctgatgattgctctgtattttttgtcaaactgtatttttctttatcttcatcatatagctgattaagaatttcaatcatttctgcttccatcaaatcctagaagaagggccaggcccagtggcacatacctgtagtcccagctaaccaacagactgaggctgtaggatctcttgagcccactatttcaaggacagcctggacaaaatagcaagaccccatctttaaaaaataaaataaaaatcaaaaaattgtacaaattctagaagtagggtccaataaacatttcatgcataattcttcaaagtaatttttctctatggtacccattttattactccaattttaaattcattggagataaaatccataccaagttatcaatgatcataaagaatgggaattcattagtcttctctagctcacctgagctggaatcattctaatgtactctgtgctgactcacatttgtgttccttcctttgatttggaaagaacccatatcaaatattttatctaaaaatcagatgctcgcatttctcagcccatttttatcattctaagttcatgtgtttaaacttgaaaataactgtgctgaagcactaaaagaaaaacaaagacttttccagcatgtaaaattcctgttttatgaattgaaatgggaatctaataatggtcctggggaacacgtagaaggaatccaggactggacagcaggttgggctaatgatccaacccctaggatcacctccaaagttaaagcttaatgaatctaagtaaagttgaccatgtgctttaataaaccaggcaacacaagctgatgacttaaaatacacatgagttaaacgtgcaaactgattacctcaaatgtgcatatagaagattttggaatatataacttcaataaaattgataacaaatatatcactgataacttgccaactgccttaccaaaagcaatttattagtcctgaaatttattttccacagcttactagctgaaagacagtggaacatgttgtaacagttttttcatatttgagtataaaatgacttttatattgcaataggaaaaaaactcagtctcgagaataatttgaaaatgtcacatgatatggtagacaggtctacagtttcttaaggtaaaaaaaaatgcgaactacagaatacagttctgtaacacaggagttaaatatgcttatcaacagcagggcattggaagctaaggatctggcagtttgagttagtgctgtttataaaccagatctcttttgatcctttaatttgatatttagaaattcatatattcatctttgccataataagattaaaattgcatgttgcaacattattgaggggaaaaatgagtgtttactatatagatatttatatattatagatatttaatgaatgacattctaattgaagtaaaaataaatgtacaagcctccctttggcatgtttgacatacccagattttaaaactgaaataatgtttgcaaaaacaatgcatatagttctttgccatgttatttttactgggttgttcatttatttcaccttagtcttaatttcaacatttttttttctttcagggcgtgattctcagtcaccagactcaggtacagaaaaaatattctgaataattattatattatttgtgacttttagaaaacatattcatagccacatcgctgacttcatgttaaatttaaatttcatgtactgttatgcatattaaattaaacctctagtaagaacactacaattttggaaataaaaatgattttggaaataaaaataaattttataaaaaatgtttaagtgaacgtagatatttttgtatccaattgttttcccttaatgaaagcttggagatcttacaatgatggcaatcaggagacactgaacggagatgctacatattcctctcttgcagcaaaaggttttagaagcgttcgaccaaacctacaagataaaagatcaccaactcaggtaaccctgcacactcttggctactgcattattttaaggcatgattattagaccactgcttacagcctctttcctaatgtgcgtatttcaatacgttttatttttaatatgtttttgcttttgtatttagtttgcttgccaggtttgtatttacaacatggagaacaaattttaacaaacaagggtttggtttggttttgtttctgattaagcttatcaaagtatgtcggtttttaacataatctctaggatatattctaattctttaaaagctgacagctgatgctttggatttaaactgatgaggtcagcaatacattatgtattcaataactatgagtatgcaactattatattaactaaaagggctctgtgttggagatattagtaaaattgtgccacaagcatgaaaattgttataaaacaatgctattaaataaactatatatatatatgtcaaagtctaataaaatatgccaagagaacatatgttcacttttaacataatttccctgaatgtagatggagcaaatgttataatgtattctctggcaacacttttttccccaagggcaaacattgataataaacataagtgcattctaaatggaatgaaaatgatcactcaatctagctaacaaaatggatagcataatcagaaggtgtggcattgctttacttctgtaaaggcaaggttgacactggtttctttcatgactaacttggactttctctgtttttctttcaactttatttctttctctggatcccattgtcaatccaggcaccccctccaccagaaagaaaagagagctttcatagctctttgataaccagtcacacaaagggtgtcattttagaccagttagtaactaacacacaaattccctccagtacagagtactttgctaacaaaaaacctcttcagggaactatgtattccaatgaagattcgagacagacaattgtatattctgaagaatctaacacaaccatgtcatatacacaaaaaatcactaatccactaccagcagcttccagcacggatcctgcaccattcgctaacatcaacaccccagttctacaagaggactacaggcaagattctcaaactcggaggatttctaccttgaaactaacccataaccaggatctaggaagtagcagccccattagtactccacagttctccaaatctgtcgaagtaccgtcatttctcaaaaggccccgctcactgacccctaatccagtgcctgagacacacacagcatctctttccattcagatagctcccctttcaggacaggatcttgaaagccacaaacagctacctgagctttctccagagactgcaaagatacctcttcagcaagagagacaaaaatctgcagttgcagcggcctctcagtcctcagactgcagagtggtaccttaagcttctcagtctcttcgtattaatacatgcgtatcgtagagaccctaactcctttggtttgggcttcttatatgacctaatgctttcttagtttccaagcaggaagggaaaggagaaagaaaccattttccaatttaaaaccctactaaattcatcagcaaatgtctaggtatttttaaatgtaaatatgcatatacagatctttcatccagaaatcatgttctaaatttttttttttcttctagatgtttatgggaaatcattgaggggtcagttatcatttaagacattgcagactacttcaggacttaaagcatgtttaggtttcaaagaaatatttttcatattagatctttttgcacttagatttactttatttacatgtgtaaaacctcttcagataattgtcaattataatttgctttggcagggaatagttatcttaattttaagcaatgtctatttctttgcaactcaatattcattttcactaaaacttaatttatcatttcagaaagtgtattagccaacttttattatccagactttcaggaagtaaaactttccatgtgtgtagaattctctcatagcatccttctgtttacatgtattagtctgttaacaggagaaatgtgcttctctttttgacttctccatagaacaatgtagtgctaaaagcacaaactttaaggataagctgtagattttaatccaggcatcatttactatgtgatgagacattcatctaaacttttctgtgagtccgaacaaagaaatgagaatactaattaacccttaatttataggttatggtaagactagggaattaccatagactaggctagagcaagcactcaatgacagctgttaataaaagatataatagtagcagcaacagcgctagtgttaatattgaaaacagtggtgcctaagtaaataatttgtataatactcctttttgtatctgtgttaataaagatcatccaaaacatatcctcgaggagatatacttttaaactgtacagaaaatctccaaaagataactaattgacaccaagatccccccacccactcataaagcagacgagccttaaacagaaatgattaaaggacaagctggtattatcatacctctactaaaatatcttctccatcagccaatcaagatgtgcaaaattcgttcagtagagcaatttcttctaattaaggtaatatcttctgaaagcacctatgaaatcagatgataataataataataacattaataggagctaacaaatattaaggccttactctatgcaggcactgttgcagcttgtttatgtttattaataattgccacaatctcatggagtaggtattactactgtccttattttatggctaaggaaactgaggcacagaagtaagttgctcccccagggtcatgcagctggcaaaaggcagaaacagaatacacaccctggcaggctggctgcagggccaccactctgaaagagtgctacttctcgttgtgaagtcgttactcagcagtgacgagacacggtgccatgatggtgggagctgaggcagatgcatcttgatcgggttcaggagtccaggaaggtcggagggagcaaaatccgtctgtgactgtacagacaggcccgtgccagtgtcagtgagcagactcgccagtgtcccaggatgggcacgccaggaagcaggtgtaggagaagtcataggaacacatatcagtcattggactcatccaacctggtttgcttcttcagaatggttttgtgatgtttgaaaacaagctgatacctttcgttttgcatggttttatccaggctgcgcagagacggttagtttgattatattatccccagggtatcggcaccatctaaaagttaagatttgagatcctgtcactgctatttattcaagaaatatttattgggtgcctaacctatgtcaagtctgttctagtaacagagttggatttgaaaccattcctgcttaaaatttgtctgtgtgtggcaggaggagcaagcattaataagaactggagtaaattacatatattagaagattatggaaattgagttatgccatgcaaagtagagatgtggagaccagatatcatgtcaagtatggtaactcaatatcaatagacctcactgaaaagagaacagctttgaaggaggaagaatattctaggcagagggaatgtcttatgtaaaggctttgaggttgatcatgctggggctgtgggaggaccagaaggaagcctgagggagggagaggaagtaagtgaggtgagagtgataggaagtgaagtcagaggtaacaaagaccagatgacaggaggccttataagccattgcaaggattttgacatttactctcaataaaaatggaggtcactggaggatgttgaggctaccaccattattatttcccttatattttaacaaaatcattctggcagctcagtgaaaaacgtaccatagtggggcaaggaggagatcaggcaaaccagttaggtaactactgcagtcctttaggtaagaaatgatggggctcaaagcagggggcagcagaggaggtggtgagaaatcagactgtgagaatgtattttgaaagtcaagcaaacaggacttcctggcagattgcatgtgggatgtgaggaagagaaaagtcaaggttgactccaactggaagatagcatcgccatcagctgagactggacagctgtgggtggaacaggttggtggaaacttcagaggttccatttgggaaacaggaagtttgaggcatttcttagacacccacattaagtggtcaagtgagcatttggatgtaagagcctgtacttcaggggaaaggtcctggttggaggtatcagccattggctagtcgatgggttttgtggccatgagacagagtgagatcagcaggggaaggacagagaaaaggggaggaccaagagttgagcctgagtgaatctcaacattaagaggaagaagcagtggaggagactgaaagcagtgtcctctaagggaggaggaaatctgggaaaatgtggcatcctaaaagccatgtgaggaaaatgtgtggaaagaaagggatggttcaccgcacaaatgctgttgatgagacaggtttgaaatgaaatctgaaaacttaccattgattccatagtggggaaggaggctttcttggagtgggtatgagagagactgggaagaaagtggttgggcagtcagctgtttcaagatcttattaacataaaaccattcatctagttattcaccctccccgagcagcagttttctcatctataaaacagggacaatgatagcaaccattcatagaactgctgggaggtttgagtaaggcatataaggatcttggcatggtgcctgcttcatggtaattcttcaacatacagtagctgtcatcatcattaaataatatttttccaaattatgcatctgattgggaaaaagaaatatattattttcaacaatacttcattttttttactggtaggtaaaagtttatttcaacagactttcagtttgttccaagatagcgtgtcctcttttctaaggctttttaaaaaaggtagcatgaagctgttgcagtttttattctctgtttaaaattttggtaagaacatttaacatgagatctgccttcttaacaaatttgtaagtgtgcaatgcagtattgttaactgtaggcaccatgcagtgcagcagatctctaggatttattcatcttgcataactaaaactttatgcccaccgaatagcaactcatatcccccttccccaagcgcctggcaaccaccagtctactctctgctcagatatttgtccttctgagacaggccttcacttggtataaggtcctccagattgctccatgttacagcatgtggcaggacatccatcttttttaaggctgaatagtatcctagtatgcgtatacaccacgttgtctttatctatttgtccatcaatggacatttggtttgtttctacatcttgatgattgtgatatgcttcatttttaagtctcattttccatgtaatgacctttcacaatggtgacctttccattttaaacacttgcactccgcattctggcaagtctcagccaatgccaagcactgtaagctataccctgtgagtcagccaaatatgtgctccattataaagaattaggctcccaggaattagcaggtccaagcgataaaagtacaccaagatgtgaaaagtacatttcagtgtttcagaagttttatttacatagttttgttattattaatgtctgctcattaatttaagaagaaaactacaggtcactgttagaaattctcttcatatttgacaatttttcatagtgttttctaaacggcatgtgctttaattgacctcctacaaacagaccagaaatgaggcatgttatccttatggcactgtgtgatcagatatcctgttgctaaaaatgtcacattgttctcaatgtcaagtaagtgaaggtataagccagacactttggaaagccagcaaaaagctacacccccaaacagtttctatggcatctgtgctatgttccttgcttcaggaagataagcttgtcctgtccgttatgaaataacataatcaatcatttgccaaagcctcaccttcacagctgccactgcacatatgctggggactcacaggggaacttgcccgactgtcatgtagaagggagaggaaactcatttcttttgctccatgggatcagtatgtagatactaaggaggacagagtaatgcagacatgtcagcagtgtgggataataggtgcagaactgcagaacgcactttctggaacattgctatcaagaccggccccaatcattgatgtcttccattagtatggcttcctttctgtgggctcgtaatgctattagttgatcaggtctttggcaatttctccatttgatgtctgtgcatgcgcatgcatatgcatgtatttaaataattgaacattagagaatacttgggagtccaacatgagtttacaaataaaacgtcctcttcaacatctcccaatagatgggcatccagccttttctgaatacacttaatgaagagctcagttacattccaaggcagcagtccagtgcttggccatttctgagatcgaattattggaaagaatttctaataccacgtcatgatctgccttccttaacttctgcatggttatccacagagcaaaagagacagaatgttcttccgcctctatctgacagtgttcacgtgatccttctcttccctaccctgctactggctttgtgcagagcattcctgttccttcccagcattttaattttgtaaaacatgattctcctttttttgagagctattacagcacaccaggcactgtgctaagcactttacattgccctacttaatttttacaggctttaagagatgggttttatccatgcctatattttacacatgaaggaactgaggccaaggaaattaaacaagttgcccaagtctgtctgactcaagatccacagctcagccactagcctctgctacctctatgctctcacacaagctgatttttaaatcccatattttgataatgttcttaaaatatgacactttcccagatgcaaaaccatattcccgatctgaataccacagagtacagtagaaatatttactcccctgattcagatgccacatgctgtcagtgtgcccaatctgtgtgacaattttagatcacttgtcacccagctcttgggtggggagtatatggttaaaataatttttattatgaggctgtcagacaatctcacatcattacaatgcaggcaatacagccaggccttagggaaacggggcaatggccaggcagctaccctccatccttctcagtcgtaggaactgcatagttccctgtctgtctcttagtttctgctctgtcgttacttcaagttgcccatgggtttccatgatactctctgactccttgcatttgggtacccgacagctacctgaggggcattcagtgtcacgtaattcaaattcccaggagggaggcagggccccactggcccagcatagtccagttactcccccttcctaatcagctgtggccagcaaaatgatgatccggcaacagacacagctgccaggcaggtctcctcataccaccaggacaggccatgaaaagagggggcacattttccctaaaggatgtgtggatgggaggtaaagattggtttttttaaaaccccttccagccgggcacagtggctcatgcctgtaatcccagcacttttggaggtcgagagcaagactccaaaaaaaaaaaaaccccttcctagatattttcttttcaagtaaattactatcattggaaaaaagagaacaaaagcctgtcagatttctttgcttgacatttaatatatattccttatgttccttgagaaatgaggcctagaagctcaatgactaaaggtgttaagagagagatgttaggatccttgacctcagggccatgtcaagccaactggaacctgaggtggaaggaaattctgtgcttccttatacctgttttcatatattgggaatgagctttttcctagaatgtttaagtcattagaatttttttgaaaagttgaaacgcacgttattaacactcacacattattttaagcttaaatattttatttaaagcaaaataaaccttttttttttaaatttgagacagagtcttgctctgtcacccaggctggagtgcagtggtgtgatctcggcccactgcaacctccacctcccaggttcaagcaattctcctgcctcagcctccagagtagctgggattacaggcacctgccatcacgcctggctaatttttgtatttttagtagagacggggtttcaccatgttgtccaggctggtctagaactcctgacctcaggtgatctgcccgcctcagcctcccaaagtgctgggattacaggtgtgagccactgcgcttgccctattacatgtttacttcaccttaaattaattacaaattatttaagatggccatcagttaattggaaattgtcaaacatgtctattctctcaactaaaactgaaataagcaaaaatgtagattttgaaaatattattgatgagttttcttgcattaaaaacgccagacccagactctcttttcctatggcttggcatgcgctggtcttcatttatattttcgacatttttgttcagtatggggtatttttgcttttttgcattgatgttgattttctttcaaagattgcattgaaacagaatttatctcaattactgagttttttgtcactctttaagttttgcaccccaacgagcactttcccctcctctcctgaggcctggccatgcactccttcttcacatccccgctccacagctaccctcttccacctccagcttccacatctgctgtgtcagcaagtgacagcttaggggcttatgactatagatgtgttgtcactgagcttatgagcgaactaaaggtcatattacccatgactatggtggtcttagagacagtaagctttaattttcatcgtgtttcaaggcaaaggatatgggtcaatgacgcccgccttgagggggaacatgacttccgcattctgccatcggtcccatcattccctgtcatccaacacgggcttgatttgcacatcctggatactttcctgacccatgatgggcacttgagtttgcaatgccttcatccaactcaatacactttttccactgctgaagctcaccctcccttgaatctctgtgccccttcattcctcaggagctccagtgttgattggtgagcactctcatccacaggctctctttagcattctgggttggagtcatttggacgaagaagctcagtgctagtttgagtaagcaggtgctctctcttggtatatgaagcatattaaggtttaagcaccgtccctgtcctttgcagaagaccaggcagcccctggctgctagctggtgtttctcattaccctcttcctgctagctcaagggttggggaaagaaaaaacaatttatactcacaaaaagttggtgacccttgatccctattcaaacaccttagccttccatggtcttgaaaagaaggagacctaaaacaattaggatgattacctgcagtcatctacttgccactcatgaagtaagaaaaaaatacacttgtttaaagccagttttccctatttttgaggtagtccagattgggaaaatactgccttcttcccctttcatacctttcctgctgctcttctgattttcctcaggagaaacacgtgtaacatggtctttctttccccttgggtctacagggtatattccattcatgtgaagattggggtcttgtcaaagcttttttgtgggtgaccagtataactgttgaattattgagttttatctgtagaaatttaagtgtgatgtgactcaccacgaggcatttcatgccttacactcacaaacacacacacgcacatacacacccatacacacacgtgcattaaaagactcaaaaccaggagcatgtcaggaggtggtgaaagaaattcgaaaggtggaataattttgttttctgtggacattctatttggaagaacaattgaatgggtaaggaccatccccagacacagtgctatgcaaactaatgatcatattacccgtgacaatggtgattttagaatacgctttagcttttgacatgtttcaagtcataggatatggacaagtcagtccaatgggggttaaagtcattagatttttttcttttaatttgaaagggaaaagtctcatgagcagataactcaaatccttttgtatgatttgtattatttcatagttttcatttagcataaataaaactaaaaagagattcgtattacatggaaacatccttagtaaagctgaattattaggggaaatttcattgacgctatccaaagactgctttatactgaattacattcagacttatagcaacattttaatacattaagttagaattatgataatttcataatattaaagtttcacctccaataagattgcaattattgtaaacactcagtaataataaggatgcatccccaccaaaacattttaagttctgggtaactaagatttctgtcagttatttctagagatttaaacaaccatgaacagtaaaatatatattatatatatacgtatatatatatatatatatcacatttaaaatgactatgtttaaacaagaaaaaaaatcatattaagtaagattaggacaagaaaatctgtctttttatccaaggttggggtttcttaacccattagattaaggttatgctttagagtgtctctgtccccctgaagtttatgcagaactttctgtatgtatgaatttgtgcatttccccaaaagaaggatcagtcacatttatcagatttctaagggatctatgattcagagagacctttttatatgatggattttttaaaagtattcaagtaaaagtctgagaaaaaaattattgcaacctttttattatgctaacaacgtgcatgacatcagtcattatgaaaattatggctgccaaagaacaccaaattgtttaacttaaacatttactaggcagtatttctaagtgtaaacagttctccttcattcattcccatctttgtactaatatctcacaatacctctggccatctatcttaaaaccatttcctctcccaaacatcccctccaaaaagtgtctgttctgaaaggtagaaaaaataagtaagaaaagttgcttcggagttttattcacttacgttgaattgagtacttatcatcctatttgtcacgtgtggtcaaacgtcatccaggctaccacaggtggttgtaaaatttcaaatggtcatcttctctcttcctcctacagagcatcccttcgctatgtttagcctcttgggctatatatagccttggagctgttaaatcttttatttttccttcagtttctttctcctttacctaagatttagtgccaaccatagttctaactaactagggtacattctaactattatcagtggctggttttcattttcacacatggtacctctatttgcattgctaggatattttaaagtccaattcttttcgtattttgtagtgaaatcaaagaacagatttaattagtggaaaggaaataaaacatcttttccatttatcttttctgcttagttgtgtttagtattatcagtgtttagattcataaaccaggaaaaaataagacaaacagatttatgttttggggacattttggcaagggggaggcaattatgctattagatttttctagtgaaggacaaaccaattctgctgaccgatagtctgatatcttatcattgtcacaaatacaaaaactaaaactcctgaggaaacagtttcgttatgccaacactctcaagcccctaaccagaattacattgcagtgctgtgtgaaaaccggccttgtttcaaaacacaccgactggattcactttcttcctgttttcacactttttctgcactgtgtggttggcacctaacccatctgaatgtaactccttaaagtgcttgcaaataaaaccgatgctttgccttctctgccacatcgcaaaaagaggtacttttgttaattggataatttatctcttattattttttcctcatactcagcttggaaatcagaacttacctgccagtgtgttggaggtaaatgcttcacagacacacagacaaaccacaccagaagcttctcctccgtgccctccttccgtggtacctttgaaccgagccactttctcaccaggcagtggcaccagctcagcatcactcagccttccgccccccgatggtgtggggtcttcacgcctgcataatccccagagcctttcccattgcttatacaaacacctgctcccagctccagaaagcctcatccacagccacgacacaggctctctgacaacagactcctccctggccgagcactcctcccgctcggagagtgagtcctccacagccatgctggaggagctgcagattggtgactctgacaccactggccgttctgagacaccctcccccacctggggtcagaggtctgctgtgacagatggcaccaccttaaccacccctgcggccactcatgtaattattctgcctttctttgcctccaccgtttccttgaaaggactgatttgttgtgccatctcatttttcggctgacatttttatttacataggtgttgattcccaaaccaattctatgccatctgtcagggaaatcattagtcatcctataagcttgcttaaggctgaaaaagtcacttcattctcttcattcattttagaattacttatagttactctaaaatagttacttacggtttcccgtgttactgtagctggtaagttctacagtgatttgccttattagctaagtatacatcacaatatgttgtgatcataaagtctaaaatttttcaaaaaattttaacccagtattaatacatgttagcagtttttctcacagactcacattaatgtgtcctgtgtgactcttttctatatcctttttctcacataaatgattactgactgcatgaggctaatttttcttgttcctccttctctaacagctacaacttttgaactcatctattgtccaggagtgaatgatgtcgataatcctatctacctttcagaaatttagctgtacgatttttaaaaattattcttcctgagccatttcaggacagaaatttatgaatacattttttattttgtttatcaataatttgtctttcatttatagcaatatatacatcttttccatacatatattatttaaatatatctatgtgataagcaatccctaataaatgatctgtgaatggctaaaatgtttcaaaattttatggcacagattctatattgcatataatgtctaagtaatggcttccatttaagagacacatagcttcaggcaaaaaaatcagattttttttttaaattgatattataatgaagttccgaataagcactgtcatagacaaaattttatttgtgctacattgttttatgttctatcaagctgataagtctgcaaattttatgcgcagagaaatgttataataagccatatgttttttaagacactacaatttacataaagtaaaagatgctttttttggtaatgggatttggtattcccccaatggctgtgtctaacactttgcattcaaatgctccattcagagactggctacagaaggagcctcattttccaggcctaaccccatagcgagtccctccctgccacagaggaccagcccaactacgggcaccaggagcacagcaggtgtgggttcctcccatgccctactgtgcttcaatggttcttagcttttaaaactttaccaggacctttaaccaaaaaaagaaggcagtgagagggtatcaatctaccaactaacctgttcaattttctgtttttaagactttacaggagactaactgtcttatatacagtcttgtgggcacgagcagagctacttgtaagggaaattaattgcaattatcagtttaaaattgcaaatagattattcatgacatgtttttcctaataatgaattcactataacaatacagtattttctaaaatgctaatgatagtattttagtcataaaatcctgattggttgaacacaataaaagaataaatctaggccgggcgcggtggctcacgcctgtaatcccagcactttgggaggccgaggtgggtggatcacgaggtcaggagatcgagaccatcctggctaacatggtgaaaccccgtctctactaaaaatacaaaaaattagccgggcgtggtggtgggcgcctgtagtcccaactactcgggaggctgaggcaggagaatgacatgaacccgggaggcggagcttgcagtgagccgagactgcgccactgcactccagcctgggcgacagagcgagactccatctcaaaaaaaaaaaaaaaaaaaaaaaagaataaatctactctcagtgtttacttttttaacccctagtcaatattattgaaaccatcaaaataggattcagagcaagtttgtaggtttagcaatatagttaacctgatggtttttaataagaaggattcttcagcttttaacattaattataacatgttataatagtattacaatgatattgacaaagatccaccaaacttaacttgggcaaggaggtgaaagtgttctcaaatcatccatcagaggtacataaaagctctgaagatttgggcaggcctgtgcctcacagttatttgaacgtccagctctctccagggagcaggtcctcaagatgtggctggttatgatatgagtgtaatttttctaacagcttagagaattatttaatcaataagcacaaggcttgtaatgaaatgtttattgatttggggacataagtggtatggttatacagtaatgaaattagacttattctaggtcatttgaaaacccatttgctttaaagtgaaatcatagaaatacacagttactatatctatgtttcaagcctgtggaatagaagtttgttttgttttaaaataagtagaaaagtttcacaaattatgcttctttatctgtgtgcctatgtgtgttgtgtgtatttagctataattttaactaaacgttcttactaatgtttgatcttatttgcatgcattgtgtgcgccctgtaatgatcagtactgtgctgtgggtagacaggcatgcttaatagtcctgagctcgatatctgtgaactaagccgattcagttccatcagaatagatacctattgaacatctactctgtcatcagcactaggctgcatgttatacaaaatattaaagaagcatatatatgaccatcttcaacaagaagcttgagataccattggggatataaaatagtcagatacggaacaatcgaaacaatgaataattaagaaatcaaacagagattcatgaagtgctcaatgaggctgaagtagggagaagccagtggttgaacatgtctctctgatcctttaccaggtatttgatccttctagaataggttgcttcatgatatatacatccaaacaactaggttccttatgttattcaccagctctggaaacattcattcactagaagatatccctgactaagtctgagaaccaatcccttgcctcatgtcaaaggacatccacgtcaatgctgcatgcggaacagcaccaccgtgttctgattgctgatgttacgactgtcagagcaaagtcgtcctccacatttacttggtactgactcctactgataccatttggcacctctgttggcagagtggcatgcccactagtcagccactttcattcttcctaaccactccctggaccctcagatacacaagagagtgattttcagaaataagggaatagagagaaggcaaagaatgtagcatgccctctgacatcagttttcaaaataaataagagcttggcagctgattactctcatgtgattggaagtcttttattatcacctaatggaatgatgtttacagggaactatgtgctaatttaactcgatgcctttgcgcttttctcagagccagataacagtgaatggaaactcaggaggtgccgtgagtcccatgagttactatcagaggccgttttccccctcggcatattctctcccagcctcactcaactccagcattgtcatgcagcacggcacatccctcggtaagtaatttactcaccgtgatttccatggcaacctcaatgcggcaagtacaaccacaggagaaagatatgcggcatcaaggtgaggcgggagcgctcagcactcatgaccctatccccagggagaaactggggcagaggacccaacatgggaggaaatgggcaccatgctattccaagaccatgtctccacctgtgtctgagcctggtgtgggcacttagatgtctgaggtggtggagtagaaagaaaaagaaaatggctacttagggcaagggggtttgtgccactggaggacatgaatgcaggttttccactagggcagcttgttcggacttggaagagcttccaccatggactatttcctggggtctatataagggagaatcgtttgacagttaaaacagtgtaacaggaggacaggctgtcccacatagcagggacgcagtcatctactggctcacacaaggagaaaaccaccattcaaaccaaggctggaagacctgcagtcagggatatggtagcaggaagccacacaagagaaacttaagtgttcccttaaatgaaggttctgtcattgtatagagcaatcgttctcaaccctctgaggactaggaattcagtgaaagatagagctctcctccagaaaacaaatggacatacggacgttcataaaaaattgtaagcagataatttcctggggctcatggactttttgtggcctcctgtgaaagaagctttgctgtacagtgatagaaatgctcttacatggtcaagtatgttcagatagttcagaaaataatgtgataaatactttttttttttttttcaagatggagtctcactctgtcgcccaggctggagtgcaatggggcgatctcggctcactgcaacctctgcctcctgggttccagtgatgctcctgcctcagcctcctgagtagctgggattacaggtgcccgccaccgcacccagctaattttgtatttttagtacagacagggggtttcaccatgttggccaggttggtctcgaactcctgacctcaggtgatccacctgcctcgacctccctaagtgctgggattacaggcatgagccaccgtgcccggcccataaatatttcttagtttgtaaaaatgtaacttaaaaacctaaaatatcaaaaaaaatacgaaattgaactatcataggaattcaggctgtacaagtttccatgatgtcgactcactaggaagcttctaggacagcagggagcagaggggaattctcaggacagcagcaccatcctgcacctcccagaaaaggagaggcctggtcctctggccacaggggccagcaacagggggaaagaaactaaaacccaggacttgaaccaccatgtcttctttgacacagacagtgcacctccttccccagcactgattcagtattgagaggctatgatgctgttcgtttattcagggatgttttatgtcaccatccagcatgtgcatggtggaactcagcttctgaggtcaaccaaagctctataactataaaactttaaaggtagccgcgggacttattaaagtctaaatatatctgtgccttcgctgatgctatgcctgaggatcatctgtgaatcctacaatgatgtccttttagagttaagaaagtaaaactggtttatgccgaaattttgccctttaacaatcagcccatagtgtggtgttataatggaagtccattatatctagattgtttaaaatggaactatgcatttacacacatataaagtaaaactcgacaaattattctagccacagctttttcccaaataattattaacaaagcctgactctgtctcattgcctgtcttagtgaatgcagttttgtccctatccccacccaacaacaacaacaaaaatacttgaatgtagataggctttgattttagaatatattgataagtagattttacatataaaatattctgcatgggaagaaattcccaatgtaaacactgaacaaattccagctggccagtgctgtgataaggtttcggaggaatatgtacatctaccttgccctagatgaattttacacttagtttaggacaaaagattgctaagatgacagctagtggaccatatatgagaataataaaataaagggttaacttatattgcataaggtatgggttcatagaatgtaatggatcagatgtgaaggcagagttgattctccttgcttagagtaggactttgcacatgctggtgttcaaaaaacattcgtcgctaataaaaatactagtatcatggaggcccactcaagtcctttttggaattaaatagaaagtcaattagtgtcaaatatctcaccgtgtcttaataaggactagcttagccgggcgcggtggctcacgcctgtaatcccagcactttggaaggccgaggcgggtggatcacgaggtcaggagatcgaggccagtctggccaacatggtgaaaccccgtctctactaaaaatacaaaaaaaaaaattagctgggcgtgatggcgggcacctgtagtcccagctactcgggaggctgaggcaggagaacggcgtgaacccaggaggtggagcttgcagtgagccgagatcgcgccactgcactccagcctgggtgactgagcaagactccgtctcaaaaaaaataaagaagtaaaaataaggactagcttgaatgttattttcacattcaaggggccagtagcagggggaaagaaactacaacccgggacttcaaccaccatgtcttctttgacagcagccagcacacctccttccccagcactgattcagtgttgaaaggctatgatgctgttcgtttattcagggacattttatgtcaccatccagcacataaactgcacataaagcagttttataactagccttatccattcttcatcaaaaaatgtattaaaaatgactttctgatgcaaactaaattgaaaatagtcataatcatagtaatagcagttacaaatgttacaatggattttacctcagagagatctgaattttaattacccttatattgatgagttaaaatttcttaaaaagcttccttatggccggccacggtggctcacgcctgtaatcccagcactttgggaggccgaggcgggcggatcatgaggtcaggagatcaggaccatcctagctagcatggtgaaaccccgtctctactaaaaatacaaaaaattgtttgtattttgtacaaaaattttttgtacaggcatggtggcacgcacctgtagtcccagctactctggaggctgaggcaggagaatcgcttgaacccaggaggctgaggttgagaccacaccactgcactccagctgggtgacagagcgagactccatctcaaaaaaaaaaaaaaaaagcttacttattttatacaaatttttcatgaaaaatacatttatacatgatatatatcatatacacataatgatatcaatgagtcccaccctgaaacatgagaatttttttcatttccaccttaaaggactttctgagtggcagtcctgacaaaccatgatataaagagtatatacaaagtgtcattctttgtcaccaacattttcaaattaattgcagaaaaatataaaggcatattattaatcataccagaggaacggtaataatgatgatttttttaaaattcctgtgtattagaagtaaatggactatatactgcatgtctgtactctgttgcttctgaaagtattctagaagttactaaaaaacatgaagaactcgataagcctcatctaaattatatccttagggcagtttttgtcatcaaagagtaaaaagtcatagtttttgatattttaaggtaaaaatgcacataggaaatcgtactaataattttacagcatttatttattcagaagctttcatgtccaaaggcttggatgtgaagatttttttaagtgatttttggttttgcttcatttttatgaaatcactgttactgactcaacagtcatgtctttgtctggaaatacatttcaaaacctataaataatagtagtagcagtatcacaagaataatattgatgtaaatgatgacctgagggaaattactgaacttgtctcagctcctgccccttatctataacactggttcttgctccccctatcctgccctccctcaaagattactggaaggataagaagagataatgcatttagagcacttcctaactcagaggcctccacacagtcatttaacaaatgccattcttccctcagccttcttcataaaatggtgaggcccttgttggtataggtctgttccccgcacacctacacagtttccaccagctcagatggaaagtaaatgagttaaaagggacagtgatggcaatatggtctctgtgttacagttggcataaatatacaacaagacacatgaatttatgattccctgtgcaacgaatacgttccatgttaccaaattttctgtgcagattccacagacacatatccccagcatgcgcagtctctggatggcaccaccagcagctctatccccctgtaccgatcctcagaggaagagaagagagtgacagtcatcaaagccccgcattacccagggatcgggcccgtggatgaatccggaatccccacagcaattagaacggtaggaaatgccagcgtgtgcgtctgtctggggctgtgcacagactccacaaaggacggattgtccacggctttgtgcattcctagggtcttatataaggaggattgccctccgtgccatccgacttctcatgaatgttatgctgtgtgtggcagagaaagaaagctgttgatgggagagaattacacaatctgtttttccatttgaatgaaacatcatgaacattgcgattttgttaaatggtaaaactgtgttgtgtggtttagtttgtttgtttgtttgtttttcttttaccttttaccaaggaggcttagggcaatagagagaaaagagaaggaacaagacaatggaaattctttggctgcattgaattcccacatgcattgcgaataaagcagtgatgtgttcgttttttgaaatagatgtgtgttaacaccgggagattggaagctgtgatttgggagttgggaggtgagatgattggagtgaagagagttaatgtcatggaaaggaaaagctgtctgaagaaaaatacacattttaatgtccctcttcagccgtgcctgctgagagctctcctgggatgataagtgaaagtgtttggatttttttttaagttttaaaactctgccaaagcattgctcagtgtatctgggcagccccttccggcaaaacgcagcagtagcagaggcagcttctgagagcctgggcaggcagcagctggctgaccaagtccactggaagagaaggcttgtgccagccgggagaaggaagccggggacaggatgaaagcaacaacacctttgcaggtgaagttgggggccatgcggggagggactgcagctgcatatactttgcagcaagacccatgtaaagctggggtgtggccaagagctgctcccctggaatgcagacctgggcagccaagacaataagggatagaggcaaagaatgggaaagagagcaggaaaaaaaaaaaaaaagccgtggtaagattggaaacagtcaaaaagaactaacgataaagtgtggggattttcttctctccttgactttacattcttatatggggattatgtgttttatatacagacagaagagtttaaaatggattattctcagcatctatattacaattgaaagccaaaaagtaaatctgtacagcagttactggggttttagactctttagattgaggaaacgttgaatgtgatatgacattctaacaatctgtcttgaaactgacgattgccatatttatgtgccaaagaaaagttcagggattatgaccaatattcttcattttatgatgattacatgtttctggtgatgatgttttcttgttcatttcccttctaagatttctgactcaaaatggttaaatttgaaactttcttctaattatatagggatagacagtcagacagaaatggtgtcattggttttgtgtaactggcacttgaggcatagtatagacaaaattaagaaagccctgattctatgtagttatagattctgtctgagaggattttatcaaagatatctgggtatgtttttaggtcaataaatgatatataatggacatgcaagcctggtccatgttttcttcctttataagacataatttccttaactaaccagactttgcctggttagtttcaaaaggaaaaactgagatgctagagatggttgatgaaaattaaatcatcttaaaatttttaaaatgtttatcaactgccaaatcaaaagcacgtttgggtatgcataagcaaacacactaaacatttaatgccagtttcccttctataaaatagaaaacacaatataaccaatgcagaagttccttataaggaactgtaatttttatgcacaattgttgtcttacttggacctttaaaacttgacaaagaaggtccaggtctatgaggactctcctcttacactgactatacagccctccagagtacatccccatgtatagctgtggttataaatgtcaagtcaggctgtctctgagccacagcaggccaagactctccaaggttgtttttctttctcatgtgtagaaagtaatgatgatcagattcagtgtatttgccaaaggcggtactgtcacaatgtaccatgctgcagtatcgttttagacagccagcctatgccgaggaaacagaattttgtaaagtcatccagaaactctagaaagccaagagtcaacaaacagtacttttgagctattttaatgcagggaatcagctctccagattgccctctctcatgtgacctgggacatctatgtgaacctttcagtgctgttcttcaaaacaacaaaaatcgccagggctcagctcccatgagattgtgtcattaaggccagctagttaagtgaaatacaagattcttttcttctacttccaatataacacttgtttgagtattttcaaaactgaaaaggagaaaaaaatagaacagagtcactgtatactgctatgtagaaaatatgtccttttttatcttttttgaaatctctgcgtgttaaatcagtgtagagttctgatgttttgaaaactgtaggaatgtaaaaattcaggtctatttagtcaaggttgtagaaaaaacggcatagtgaattgctagtagctatttttcatgcaaaatgattttacgtacaaaagtaaacttcctgaaatttgagtagactattttcttattctcagccttaggcatagcgatctccatgatggcatttacaaaaggaactttaaatgcttagagtacttcttttagaaagggacatagagttttcgtattttatttttccagcttcatatttccctttgccagcagggcattttctggcatctttgtgctcaccatataaagctagcagatggcatcactgtgagatcctacctgatataggccctccagcaagtgaagaaaaaaaaacctgtctgtcaacatgtattgccatatacagtgataggacttacttagtaggcttccttgttgccatcagcacgtccaggaaaacatttttgcacaacactatgttgtattttctgttgctttggtacagtaaaagaaatgaggtttaatgaaagagaaatcagtcctttataaaaataaactttcttgaaagatacatgtttagcaactttgaaccagcaaataatagacctttgcttcaccactgcaatcccttccaccatgtcccgtcctttgactgaatagtcaatcaataacctcaactcttccatggagaaagagccgagaatgaagagctgactcataacgaagtcaagtggcccttcatgttaacctgtatttggggtgatttttcagaataatatattctcagaggtcaaaataaatttagatatagcacaaaacccttaatgtccagaggaaaaatgcagtgaccacatttctggggaaaaaaagatcaggcaataaaatctaacccaaagctcagtctagtaagtataagaatgctttcgtatcagtcctaacagaagtttttaaatcgagatctgtcttggaacgtctggtgtgtttagttactataagcagaatcatcaagcctgttgcccaggtagctctcagagagttggggtaagatcttgccaagcaaaatctgtgagtacgattataaaagcatgtgtctacttttacaggtatccagaaaggcagagctctatccaataggctacgttcattcattatttcattctacaaatatttgcagttccctagtgttattatttattgagtagttgttatattctaggcattgttctaggtcttgtgtatacattgtctcattcgatttccataacaatcctatgatttagatataattatgtcactttagagaggagaaaactgaggctcaagaaggtgacatgacttgcccagattcgtattgctagggtgtattaagcagcaatttaaggaaccaagatttgaatcttagttcaagactctacattaatttcatctttccactacagcctactgctcccctcatgtccgacgcctggatccgtaaggacttctactctcaaggaacctacaattttagccgagcaaatgttgtatacactctgttatcatattagcatttttgaagcaatatctacattcttaaattttccgtaggactctgggatgcctactacattcagtattttagtagcttagactagtaaatagcaaatttatttctctagagccacactgatcagaatacaatttgagtcaaaaatattccccagttaattctgaaaacactgtcttacagaacattcaataaaaagcatctaaggataatgatcattatctaccaaaaggagttaaacaaattagtacaacaataacttacattaagtgaactttatatatttgtgcaaatatcaactctctagtgcagggtacagctataacttgaaaaaataaaaccatagcatctaatgttccaactcagcctaaattcaaacacaaggccatatgtttacaaactgcacacataactaagtaaattgctgaaactgtcatgaagccatagcaaagagtcagaacattttatcacagaatgggactctgttattaagaacataaaatagagaaatgaaaacactgagaagcgatgttgattggaagccagtttgtaaccattggacgctctcttcattacagacagtcgaccggcccaaggactggtacaagacgatgtttaagcaaattcacatggtgcacaagccgggtatgtctgctgctctgctttctgatgaggtccttgtgggttgaagggactacattcgtcttttgcatcggtttgattcacacacaatgtcaagaccccagcaaactccgtgtcccctttcttttcagcatgcctcctgttctccttctgtcacccctccggtgacagatccctgtgcctctgcctcccacctgagctgccaagaagcctccccatggaggacaaccaggcactctggcctcagccctccatcctcccctgtccacagtctaaattggtgtgttgcctgggtgaaaaacacattgttcctctgtccacccctgtctgctctcatcaggagagtgagcctgcgcgggtctgcctgagcctgctctgtagacaggagaccactaaagcacttagtaaaggaaatttgcgatccagagcagagaggtttctggggaagcgaggacaagggcctgactttgcatgctacgaagagggcagcaagacgaatatgttacagataaaaaagggcagtttgcagaggcctgtggtggcacacacctgtaatcccagctactcagaaggctaatgtgggagaatgatttgagcccaggggttggaggtttggaggctgcagtaagcaatgatcaccactgcactccagactggacgacagggtaaaaccctgtctcttaaaaaaaaagaaaaaaagaaagaaaatggcattatgaactaggaaaaatacgttgcttttctaacaaatttctgttgtttgtctgaagttctgctgtctcgttgtcctttggtgacaatctatattaccataatatttatgtttcattttctagatgatgacacagacatgtataatactccttatacatacaatgcaggtaggatgggtttccttgctcgcaatgactattttatgctcagcaatgtttggaagaacgacacggtcaccttttttccccttctgtttgagcacatgttttcagttcatatattaggaggaggatttcttttcttttctcagagcgtgcataacaaaaggattgacttttctcatggaaatgagaactaatactggtttatctcattcattcccactgttggtttattctcagcttcaggaatgtttaaccaaagtgtgaaggataggctgaaaggacacactgtaacccagggtacaaaataagataaagatcttttatcagcagagagaatgattacaattgtgtaagatctttcagatacacttcaccaaaaacaagtcaaacaaagtattctgtgaccttgtccctgccttttgctccaaaatgcaaccattcattgaaagagtttaaaaatcccccttggcggggccacttttctgactcagaattgccagtggtcacaatagaatggcttcagttccaggcactgccacttggattggcgagccttggtatctcgtgcaggggtctgcaggctggaaggagggacccctgacaaatgtttttcccttcatcactttctcctgagtgttgcctcgggattctgcccagggctcctctccctgcccagtcacaggctcaggacaggtgcacaactattttttttcttctttctttagaccaggctcggaggctggcactgctcccctccccttcagcagctgcaacctcacttggggtcctctgggcagcctggggtcgcatgatcctcctgttctgcacccctggagaccacattcaggccctttaactatttgggattgtgctcctatctccaaagacaaattgatagagggaaaatcagtagaacaaactcagcaagccctctgggtttaagtcttggctcgccccactgatagcttcaggcccacaaagatgtttcccttaatttcatccctgctcccacgcccaccaaactcacctcctttatttagctcaaaagttgaagtccgactgttgaatccaagcaaaactgtaagtgtagatgttgtctcttttcatttgctgtggaaatgtgcatggactttcaggagaagcgaacgggtacaaatagaattagctccaatgattgggtgcaggaaaatttagaatttttataactgttttaatattgaggtttgtgtcacattagtgattagtgaatggaacagcagtgatatattactttgtacagccctacaagctgatcatttgatcagtggacgagtcaactgcagctagtctctttgctctctactaaccgtgcaagccatggcttcacaccttgcacttttctgcctttttttctataccatccctgctcccctcttgccctgctcaccgaaactcattcagggctgactctggactcgtgggttccataataccttctctgagcaatctaccacctactagcatcctttaattcttactatgtgttttcttcatttggtctttattatcttttaccaattattttccatcataattctatttgtgtctgattttcccaggtgcactctaagcatattgaggactcatgtttccttgtaccttgcacagcactttataaacacaactgtgtgcaatattttgtttgactacaattagcatgtcaattttcatatgtaaatcagggtttttaaagtattagaagatatttggaaacagttccgtttttaatcttgctctgaaaactgaactattttcttagtgtatacaattgaagagaaaatttgctgagtgcttataagtctattcctagtaccagtctgaattattactagttctgaaataattgacaaagatttactgtaatcagggcttaggtacagaataaatttgtaattaataaattaatggaaattagtacattaatattaataaattaagaaactaccttctaatgtatgcattatgaatatgcttattgataataatttctatgcaatcattggctattttgagggggacaaataatttaattcatttttaagaggtgatttgcttctgttttttgtctgcttttgttttttgtcatgataggtctgtacaacccaccctacagtgctcagtcacaccctgctgcaaagacccaaacctacagacctctttccaaaagccactccgacaacagccccaatgcctttaaggatgcgtcctccccagtgcctcccccacatgttccacctccagtcccgccgcttcgaccaagagatcggtcttcaacagaaaagtaaggcatttccccccagggtggcctatgtttcgcttaggataaaaataagtctacatggcattcagtagaagaatcagtgcacctgccacagagagagcggatgtgtaatcttgctagtctatacatataccatattgacctcctctgctgggattgtagcaaatgttttccctgtcttctttcatgatactggagtgccctaaattagacttgaagtaatatggacacattttctgctttttgatcaatacatacatataagagacaagtaaatagaaataatggacatgtacttcctttggcataccaggttacaggctatgcagttcattttctgtttccccaggtctattaataagagacatttttgaaagcagggaaagttattcaaaaatcataatgaggcattagttaataagtgtctgtgacttgtttctaccagtttttcaagctaatacgagttttcctttctccactgaaatatttttatacaaactatctacatgaaaataaaaatttataaacacttttttattgtgttatttttactgggattatgactaatacttctacttataggtaaccttcattgagcgctcattacaagccaagcactaggctaagtgctttttctgtgtcatatcatttgattccgagaacaacccagtgagatactttctattttaaagaggaagaaactgcagtttagaaaatggtaggaacttactcagctcatgcagctcgttatgtccaagccagggtccaagctcagctctgattaaacccaaggcctatgctatcctagcaattaataaataagaatataaaaattatttcttattaatactggttattaagtgttatcatacccattccagaaaaattgtattcaacaccctattgtaccattaagagtaattgatgatcaggccaggcgtggtggctcatgcctgtagtcccagcactttttttttttttaaatggagtctcactctgttacccaggctggagtgcaatggtgtgatcttgtctcactgcaacctccgactcccgggttcaagcaattaccaagtagctgggattacaggcaccagccaccacgcccggctaatttttgtatggtgtttcaccaccttggccaggatggtcttaactcctgacctcgtgatccacccaccttggcttcccaaagtgctaggattacaggcgtgagtcactgcacccagccagtcccagcattttgggaagccatggtgtgtggattgcctgaggccagaggttcaagactggcctggccaacatggcgaaatcccatcttcactaaaaaaaaaaaacaaataaaaattttataatagagtaattgatgatcatatagggcacagcatcccaccaaaacacacacatcgtgtgtgaaaggggtctcattttaataccaatctcctcaggatgaattatgtgaggccttaaaattgagaaacagttttctagacacaaattgttatctttgtcatcaaaaaataaccaaaattaacgttttgatttaaaggtattacccatctgatatgttttgttaaaattaaatatctcattaaaacatatgataacctcctaaaaaattccatatggctttcatatgtattatctcatgtaatgctcaaaactcctctgcaaggaagaacaacacattattgctgtctgtgttttacacaaatggaaaaaaatgaagactgagaaagtttaaggggtcttgctccatatcagtcatgaatttagtagaaagctagggcttgtccctaattctgtctcttagagtatttctatttccaacgggccatggagcaagaatttcattccattccatggaagcagaattacccctatctacagtcagaaaatccttcctcctaaaaatcatggcccctgggaggctgaggagagaggatggcttgagcccaggagtttgagtgagatggcagcgagctgtgatcacaccactgcactccagcctgggcaacagaggaagactctgtctcgaaaaaaaaaaaaaaaaagaagccttcttctttagctcagtagcctagaaaagcttaattttgtgaaacccttttttgaagctttccttcgtaagtcttctgacagcctcttggaagatattccttgggggaaaagtgctggttcccatgaatgagatgtttgactctggtttttcaaggctcacaccaaaagacgacctcctgttccacactgcctgctctggtgcacgccaacccacatgacacttctgtgctcttcccaagcgatgatcccacttcaagaaataagatcaaacatggtgtgtgcattactccttgtcactttggatcaaggatcccaaaggtcacaaagtggtgggttaaatgctcatagttcagcagagcatactgccacctattttaagcacaaatatacacagctgccattaggaacccagggactcactctctgcgcgtctacaaacccctcatgtgacttttggagccagtggcgggggaatgtggtatttttcacaggttaactttttatcctgagagattttttttaaaactatgctaaaagtaatgttgaaaacagataactggttttacacaattgctttaagcaaaaaggattattttaatgtgtgatttattgtttatttctaggcatgactgggatcctccagacagaaaagtggacacaagaaaatttcggtctgagccaaggagtatttttgaatatgaacctggcaagtcatcaattcttcagcatgaaagaccagtaagcacttgtcattaaacagaatatgccagctcgctgggctcccagggctccccaataaacctgaatttcagacccattagcaatttttgtcacaaaggtaatcacttagaaatcatgtttattttgtataatgatttgtacatctcatctcagaattgaaagatacatgttctaatatattgtctttactgaccaaatacaagtgtatgtgtgtgtgtatgtgtgtgtatttatatatatatatatacacacacacatgcaggtgtatatacatacacatatatacacatgtgtatgcacacacatatatatatttatatgcaagattcatttgcatgtaactctaactgtgcctaatcattaatcagagtttaacttttaaaaaagttcataagtgcaatacttaattgctatcatagcttgctaatgagaaaaatcattaattaatctccccaatatacatggacccaggcagttccatcccttgttttccatattggctttttaatatttctttggatgaagggagaattttccaaatgcccttttcataacaagttgttttaattgcttcttattaaatccctcctcaggttaccaagcctcaagcttcctgattgattgtcattctaatggatcaagattatatttcactttgcaggattttttccaattatttaattatatgcaaacaaaaatatctatacacttaagaagaaccacttgcctcctcgaagcgcaggttcacacataggtcttcccttggccttctttggttttgattccccaatactcccttgcatgtcctttgcttcccctcagaaatcagtgtcctcaggattttctttgaaactccacagttcctctgcatctccttccaagcctacttctaggaaaacatttgcaatcaattgcaatttactctcatttttgctttaaaagaattttaggtgtcagtgaacaggaaaaagagagttttctttgtggagctccttcaagagtctccaagaaatcacactcatatataatccaaggccagccctgtggtttaattggaaactctagccttgccacacccaacatgagtgtccttgattgagtctttgaaaccctgtgtttgcggttgtgttctggagaagcatgttcaaaaccttatcatcagataattcatacatgatatttgtctaagccttcttaccctttctttaaataactcatatcttttagagtaacaggactacaaaagaaaaactgaaagaaaaaaaaaatcactgatttgcaggcaccattgcaaacttgtaacccatttactagtttctgtgattgagtatcatgctactctgaaatttccagaatgagaattgagtgaaacacaatgtcatcattgcagaaaattgaaaacagtgaaataatatatctcagatttaaattaaataacaaaattttaatgatctttctagtaatttatgagactcttaggataacgaacatggtaatggtattggaatgctttggtagccgtggtgtcaggaaacaggattggttttagacgctctcccaccacgatgtttctattatttagtcattcagtaaaactgactgagcaccagctacatgccaggctttatgtgaggtgcacagcggggaacaggacacactctctaccttgaggaacttcaagtctatcatttaatatctatgcaagactagatctgagtttgtgcaaagtaaacagcctcttatatggttaaaacagacgcacacctaaaaaaccctccctttgctccctttagggtttatacattgaccctatcattgttattgaaattgtcacattactcttgtctttgggttaaaaaagactttaaagactcctcgttttacaatagcaataataatagcaatagcaatcattgtaaatctttattgagcactcactatatgccaggcgctgtaattagtaatttatgccttatctcatgtaaagtttccagcagccctattaagcagacacatggcatttccatgttacagatgaagagactgaaacacacattagctcgccttgccccagggacacatggtgggagccagaactaggagttgagcccaggcatactgatgcctggtgcacttggtcgctgctgtacagccactccaggtgtggctgagcaggaaacacattgaagtagcagttatttgattcccttatttgatgattttgcagtataaattaatttatttattggctaatttacaataaagtatacttgatttactttatcagaaacttaggccctaagtagttaccacacaggaccagtagatgtgactggttgtaagacaggaaactctggagccatgagtgtgacagagattcgagtgtggataggtctctgcagccacaggagaagataagtagaaggaacttagaaacttggaaggaagtgagaatggctatcttatggagaaatagaaagaaccaaaaatgttaaccctcctaaacaattttggagaggaccagccttaagcagaatggtttgagctggccatatgggacatgttggccagcctttccagtgtaggaccagctcatcatctttttaaaaaaattagtcctgacttcgtttcaattgcctctataaattagaaaacaaaaagagccaagtgggccgtggtgatgtagagactggccgcgtactgatatagtttacataagattctgaagtgttgaaaatacaggctagaggttgaagagcaggcgtgctgaatgagagtggcgtcgcagcgatggccagcgctgaggggtatcaaggtcttattcatgcattctcatgtcttttgactccaagatgccttggaagcattcctttgctcttttcattttcaatttttgaaaaatatacacaacacctgggcaattctgtgttgctcttttgaatctctacatggcctctccatctgcccacttttccaaagggtcatcttgggttttcccctctcctgcagtggactcagtgtcgcctgccaggagaagtgccactgctgctcctctcttctggcccacaattgtccgtgcctgggctacagtgacagccacctgattcatttccctacctctccagtctagtctccacaccacagcgaaggcaatctttagaaaatctttataaaacctccagctcaaaattttctctggctcttcactgtccttcgagcaaaatctgaaaccctgagcataatttatagaagacctgtgactgggctccagctgacctctccagcctcatctctcctcccaccctccctgcctcgctaggttccagctgcacagagaactttcaattcccgcattgctgggcctctgtaaaggctgcacctccccaccaggaaaagctctccccaccacctcttccttcacatggagaattctatcccatcctccaggtcccagcacagtcccacctcccccagggaatgtgcctgactcctctgcattaggttggaggctctccctgctgtgtgcccatggcacactgtgttcctcatgagatcttgagcttcttgaaggcgagggctgtgactggtccaccagttgtatcccaacacctgggacgatgcctggcctgtagcaggtgttcagtgaatatgcattcgtggaatttctaagtgaatgaaggaacacaggtttcacccttgcagtcagtggaaaaagttggtgagggactgaatccttgttctgttgtttatccatgaagcctatatatttctagtgcaaaaggcccagtgggtctcaaaacattcttggaggggtttgacacactgctattagtagtgactcataattccacgattccctgggatacagagaaggcaggggggtagtactgtttgaacaaaaatcttcccaagaccctggcaaagagatcttccttaggaatcagtggcatatgcgtttatgttctttaacagggaaagtaaaagtgagcgcacttttttgaagctcataaatactcatgtgactgtaaatttagaaatgttaattaattgggcctaatgtttgatctggaaaagtacttagcagtcaccaggaatttgccttgaactgactcgaaccacaaatcagaaccgtatttccacaatttaatttttccatgagacaatcataaaaactctgctgggattatattactaaaacctttatatcccattgcattggatatgtttgtaggtgagtaatgttaaatttaaaaaaaaaaattaataaagcatttgtttaggacctctgtatgcttgataaagtaaaaaaaaaatatatgaaaatgttaccctaacctacaataactaaacttgaacataatgataaaagcagaagaaaatagtcattgaaaacactgtagcagagttgaaatgcaacttaaacccttaatgaacttaagcttctttatcaataaagattgtcagtcaatacttaactataaaaatttaaggagtttcatctgatgaccattaagaattatcccaactaataatgtatatagcatttattgtgaaaccacaataaatataaaacacggtagtcaatgtcattaaaacttaaaatggaatgagcgtaatttgaaaaacaaaatagccctggcacttctttttgtttagaacaacgtatagaaagcacatgcctcactgagaatacttagtggaatctcgataaccacaaaagcaattaaatgcttttaaattatagaaaacactaaaatttttaaagttgttcacccttggtagcttttaagtaaggatcacttgtgatttatagttgtagcttttcttgaacacgtcctcttgcactgatgactaacaaagttagttttaaacggaggtttgctggtgggtttttttttttttttaatgaaaagaaacaacaacaaaaaaatcacaccaaggctagaaagatgcatatcagtatctttgctcttttgccttttatgagcaattagagtaaaccataatcatacctcctaaatgagtttctgagtgttaatattagtgctgtactcaaaggaatgtccatgttccacatggaaagtgttaaattactgagattagtgatttgtgtgtatatccatctgttgactgaccatctgtatgtgtgtcactgactgttgcgaggcttctgtgttccttagcagtgcctccaggtcaccataggacatttaattattgcatgacttaaaagattcaatacggcaaccacagcaaagagaaaattctagttctgccactaacacttcctttaacacaactctgctcaaacatgtgcctttcattgcattccaaagttatcgataattaccagctatcattgttttgggtgttttctctgctaatttctattggcatgcattctagatagttgcccattgtaactataaattgactatttaaataaacaaaagcataattcatggaaaactgccattctaaggtatgatgcaagatggtagatattctgcttccttttccatattctatcatagagatgcattactataaatcaggacttggtatatccatttgttacatattttcttaatgtgggagtcaaagtgaagctacatagctaacaagtcttattcatttagtaagttggctgccctctgctgttcataatgtttcttaaacagattcgtttcctctaagagaagtttctatctccccttggcaaaacaaaatactattcttgaaaacagaagttataataattaatgatatcattcagtgtgtaacattagaaactatgaagtttaaaagagtcagaggttagttttcctgtagaagaaatagtatgtctctctaaacagaagagaaattactggaaattctctctcctgtcagttaccctaaaaaccagctccagcaaagccatttcacgaacaattatgcatctataatgatctaaataataattggagaaaaatagtattttatggacattaaaatctcaattaatactattgcaactattgaatcaaatataaattgaattaaatttttaaattcaacagaaaatagcaaattggttactagaatattttgtctctaccaatttcactattacttctgaggtgtaaaccaaatataatactggcataaagaaggaaaaatatctcaagatttctaggcattttcctatgtctaatagtaggatgttctctctgaatttatttattacaaaaataacattacaacaataaagcaaaataatatttaaaagaaagaaaaaacaaacagtcgcaataccagaacaccattgtagtcgtttgtgtatgtgtgacttctttactgtgttcatgcagagacaagctttgtaatacctttgtaactactgtacaggtgcgtggttagattccgttttgactgcttggtatctcattgtaagcatttcccagggacactacacagtctttataattatgatcactacatcttttggataacttaggcttttgcactattttgtcacgatgcctcaaacttttctatcattgtctgtaattactcctataatcttttattataaaatattgaaacaaagtcacatcactaaaaacactgtgagtataatttattagtaagtgtagactgtgtatcattagcaaaacttgtaaatgcaacgagtcaataaaacagtagaacaatgtcaaaatcatggcttttgttggaatatggaacatttcaagctcccagcactgcgaaggttacatagcatttttttcacaaccaagatgtcgctattcagtttaagtccctgagtttctttaagaattgtaagcaaatgatattgaattgttctgaagcagtgagcacttaatagtcctcctagaatatgtcttgggagtcacagctcctctcctagccagagtgaatggcttttagggaaccatataatttttcttagaattttttttctgacttaagatactgtactcttcaattgtaccacatttaattagtgtcatatagtaattatcaaagaagtaataacttgtatatagtactttaagctcttagatttactacaaaatcagcagcctaaatcaatctagtcagccatgtattatttgaaaatattaaggacactgctgggtaaggtaaacactctacatctgttttctattactagaataattgtatgtattttctccaactgtttatattaacactgctagttttttcatcttaaaaacaacattcagaaacctctgcagggaagcaggtcaattataaaactggctttttctctaaattagaacatcgaggaaaccaagatgggattttaccccaggctccctccccttccccgccatccacggtattgtgaagaaccagatccccttctcagctcagagcaggcagccgggaggtgaatcctggggatccactcctggtgggcagggcttcgcagcggcccggatcgctcccgaggcgtctgggtccctagggacacttcgccgtccggaggcctctcccctcccggcctaacgcaggcacagcgcgctgccagggtgtcctcgcggttccgcccagagcctccatctaatgaaccagtttctgcacccctctttcttgcagccccctctcccaacaactccgacacctgttccaagggaacctggccggaagcctctttctagctcccgactcggagaagtcactggtagcccctcccctccgccccggagtggcgcccccacaccaagctcgcgcgccccggctctgtctcccacccgggtgagctccttccttccttacctttcttcatgcccggcagaggtgcaggtgcagcccttgcttgctcagagcctggcgactcccactcccccgggtcccgctcgcacccatccaggccccagaatcttctcatccacaggcccctgagagccccccaatgccctgtccccctccccccagctcgcctgtcttcccacccctcccgcacccttccccatcccaggcttaccacctgcctgcacccgagtgaattgtctgcagactgcgggctcccatgctgggactgctagccaccaatgagggcagggacgatgaagtgactcgcccaaaagagctatttggtgactgggttgagcctattccaaacatcaggcgtgccagccagacccagtctcgctgccgcagagagtggtccatagttcatgcctcaagcgtaagtggatcaactcaagcaagagttgcccacaacttatgccaatcagaaacgatggacgcaggaaacagctagggaccccctgccatggagctcgccttcacatcctcatgctactcgttttactttacttcctccgttctctcctgctgaggttcgtggggtgagagttgatgcatgtttgcgtgtcaatgcgcgcgtgagtttttcatgccacacagcgtttccctcactttgctcagtgtgccttttccttcccttttccttcacatctgctctagactgatcgcataaatccagatgacatagatttagaaaatgagccctggtataaattcttttcagaactggagtttggacgcccggtaagtgaggctagactattaatataagaaaactaggagtatactgtttgatttctaaaatacaattatcagtagacgtgggtgtcattcagagaacaaaggccgaatgcataatgtatacacacacttggtacagcgtagtccagattcatttctgtaccaaatggtcaaatgtgctcagacatttcctatgtggtttgtaggtcattcattaagatttctttacatctaattcattacaagttcaaaatcttgaggtagtttctgtgatggaatattcagacaattattacagctgtatagaagatttgtatttgtttacagtctatttggtctagttcaagcagaagagcaccttgacattgagtcctgtttgctgagcaaacatcaggcacctggagagtgcgggcttctgtcttcattatctcctcgaggcctcctgatgtcccgccaagaagaagaaaatggggactggaggggttaagtaatgtgcacaaaatagtaaatggcagagtaagaagttaaacgcagagcctgttaaagaaaaatgaaaatctctgggcagttctcactataatatactgccagagtaatcccactacaaaatacagtcacgtgttgcttaaggatgtggacgggttctgagaaatgtgtcatcaggtggacttgccattgtgcaaacatcgcagagtacttacacaaacccagatgctagagcctgctacacgcctaggctgtgtgctatggcccgttgctcctgggctacaaacctgtacagcaggttcctgcactccatactgtaggcaactgtaatgcaatggtaggtatttgtgtacctaaacatatctaaacatagaaaaggcatggtaaaaatacagtcttataatcccataggaccaccatcatatataggtgcatcgttgacggaaacgtcattatgcaacacatgactgtacctagtttaccattagggatataaggaaagaaaaaaatcaggaagtcctgtggatcttaatttccagacttgctagtgaaagccatcacagcttctctaatccccagactcccgccagaggaagcccagaggttgggccttattgcttagcctgtttgggataaagagtcaacttgaggccgagcacggtggctcacacctgtaatcccagcactttgggaggccgaggcaggcggatcacgaaatcaacagattgagaccattctggccaacatggtgaaaccccgtctctgctaaaaatacaaacattagttgggcatggtggcgggtgcctgtagtcccagctacttgggagaccgaggcaggagaatcgcttgaacctgggaggcggagattgcagtgagctgggatcacgccactgcactccagcctgggcgacagagtgagactccatctcaaaaaaaaaaaaaaaaaatagtcaactggaggttcagttaacaacttccctgattaggaactgtatccaccaacagcagtgcatttgatgtgtgtcagttacacacgtttttatgcgttttagactcttaaataacctaccaattacactgatagtttttttagaaatcaggatataaccatttctataccatatgctgatttatatacttgcatatggaccatatatggtttactgattggtgatggtagtctcttttgtccattaaactgcaaaggagacttggttagactcaaggtagcttattgaactgaatcaaaagtgactgtaaacgaatataaaccaaaggatttttcttagggttattatctcataggaggaatgttttctctcattttttctcatttgtatcttagtgtgaatgtaaatgtattttatttcaaggaaaaacattctctagctttattttatatgtattgttgctgttggttagaaagtttatagggacggccaggcgtggtgactcacacctgtaatcccagcattttgggaggctgaggcagacggaacacttgaggtcaggggttcgagaccagcctggccaacatggtgaaaccccttctctactaaaaatacaaaaattagctgggcatggtggcgtacgcctgtaatcccagctactcagggggctgaggtgggagaatcacttgaaccctggtggcagagattgcagtgagctgagacggtgtcactacactccagcctgggtgacagagtgaaaccctgtctcaaaaaaataaaataaaataaaataaaataattcaaaaagaaagcttatagggactattctgtactgagcctaagttatcagcattttccataatcattttcagtcacacatggaaactcaccagcatgctatccacttgctcctttaatgtttctttaatttaccttgcattcctctgtggccagagactaggagtgctaatgaaatttgacaaaatgaatttataaatatactaattgaacactagccaattttcccagtgcttgagaatatttgcagacgttgcacacttcctcccagctgcccccattttgctccattcatgtcattctgtttgtgtagctggtgctgtcaacactcaatttctaactgttgtcaccttttccacatgttcattccttgctgccattgactctcctccattccatccctacacttctgcttctgtggtgcgtctacacccagcctcctaaaaagcctctggactatgttcaagatcattcttctggtgttttcaatgaggtaaaaacacgttattctctctttttcagatatctcccttagaggctgtgactgtgattctgcacatctgtgttttacaattctctgtaatgtctaagctatttttgaaaaaatatctatctttgcatcattatgttgcatccagtatcattgcctggacattaattataccagagttgttggctatctctggactctgggtgaagaatcattccaaccacaactgctagttatactattctatgtagttctggtattcagcagcgtgaaaattaaaaatcaaaagtattagtcttagtgcatatattaaccacctctttttatgagacagagtaaaatactacaagaaggcttcttagaaccattctattataatgcttggagtgtggataatcagatgcctatgtcccatatatttctaaaatttatttttgttctttcattttcctaaatacaacttacggattgtattatcagtcaagaatagggctggcaaatacctggaaattgtgtatcacaacttcccagtttcatacccatgacagacatgactactccttttcaacactgtaatccaggcagccactataacaaattatcattggcatataaaatgaaatgcgtttgcaatctctacttaagagcctataataatcaactaggtgaaaaatttatggcagccaatgtatatttttatttgaatcagagttttatttgaaagagagaatgatacaggcagaaatgattcagagtcaaaagcttgttaacctgctctctgcaaagaaaagcagaaaattactttagaaagtggataaatgactcattagaagacacaagcagaaatggcactgttttgctagccatcagctatataaaagcctccttgcaaggaactcttagaagcaactagcatgggaacgaagtaaataaactgttttttgcacattagttgctctgtggtcttaagtgaatactataacacaataaatatcttattttcattaaaagtcttaaatatgtgcaactgggaaacacaaccagtagaaccgttgtgttgtaggaggtactactgacacatagtggtgaccactggaattgcaggtatagagtctcaagaaaatatgcaaatttctagcgtctcaacttgcaatttcaaattatttaccctgtggtaaacatcagagtgtgtgttaaaactgagaagtgatcaaaatatttatatattaaataaaaggtaaaatagagtaatcaggaacattctgggttattgaattcagttatttctaaaggcttacattttatagccaggcaggcaggcatgtaatctgaagaaaatcaaataaaacaaggggttatattctgtatgttatgttaccttaatatctgcagaaagagtcttatttcaacatatgaacaacccaagaatttattttgaaattcaatgtggtcagatatttttctcagatatttctagggtgtttttaaggtagttggttcatagataactgaaatggaatttagagtgcatcatgtccaattcactcatttttcagttaaaaaaaaaagtagagtgcaataattttaagaaataagtccaaaatcacatggtaagatagtggcagaaaaaaaaatatatctctcttaaccttcatttctgtgctatttcctttatatcacacttttcagcacttccaagatatatatttagaggataaatcttttaaaaacaaattacttacttaatattatttcttgttaactattgaattcctgtgaaaagagttctgttaattaatattacacaataattcttgggcataaaaatagtagaaacttaactctatgcattctattatgtgatggtagtggcaaaaaaaaaaaaacaacacataaaaagcactttgccagtagttgatctatttgccagttatctctgggattgagagggggtgctgtatgattctaatagcatatgttaactatgttattaatttcacattatagtttttcagaatgtaagaaaatatattctcttaaggttctggattttgtctttaataaccttttgttattaaacatttctggtaaaaacaaatgtaattgattagacattaccttagctaccgtttatcaactgcctggtatataccatgaataacatagattttaatccataactggaaaactggcattaatgaagaacagttacggatatttaagcaaaatttaatctcatagctacttaacagaaagagtgattcagtatctgtacttcactaaattgaccttctaagtgtgttaaaataatggtaatatgtaaatagtagatcataactggtaaaatttgtaacctcttttctggagataattttcattttgggatgagtacacttcttacaattattgtacaagtttttctctcagtcatcaatctagattttttactcttatcttacaatttaatactgaactttctctgagtgtacatgaaaccgcaaaactggttttcatttattttgaatgtagaaaccagtacaaggagaaatagtagtttcttagcctaaccctaaaacacaatcagttcttacactatgttttatttcacattacaatattgtttaggctcattataagttgacaattcaaattttctgatcactgtagggttgttctaagagtgttgtgaacttcacactttttggtgatcagctgtgtgtgagggtgtcccacgaaagccgtgatctgcacagacgccgatgctctcaggctcttcagtgtcgctcttctgcaaacgagtagaattaatatttcttaattgtaatataacgatctgattttattttacttgtttgctttctttcatatttagtatctatttttctaccttcccagtgtctgattcagagctcagcaaattaaaataaccatgtacacatatcagactagcaaaccaaacttttctcctgattttatatttgttgagaacctagaaatctaaatattttctaggaactaaaaatattacaatccactttttctgtctaaaaggaggatgggaatattctcatgcagagatgcttttgtttctagacaagattccattttcatttagtaagatagaattaaattaaaatattagttaatagaagcgtaagttatgcaaaagggaccttgtaagactgatatacatacagaattgcaaaattgtattgttttaattgattaattggtgctaatttaccaattaatagaaaactgagttatagaaatagtttgtaaagtgagatttgatttccactaagtagatgtttaatactctgataaaatgtttctagatgatggcaacttaagacaacatttgtcaaaccttgcctttctggctgacatttttaagctttcatacagacaaatgtttttaaactagaattccagttcttcatcaaaccaaattttatctgtgatgaattgatcatcaaatatgaccaaaggcaaaactatctatacttggtatacatctccctatactttctttatacttttgttttgttttgttttgttttgtttttttgttgttttttgtttttgtttttttgagatggggtttcactctcatggcccaggctggagtgcagtggcgccatctcgactcgctgcaacctctgcctcccagattcaagcaattctcctgcctcagcctcctgcgtggctgggataacaggaatgtgtcaccatgcctggctcgtttttcatatttagtagagacagggtttcaccacgttggtcaggctgatcttgaactcctgaccacaggtgatccacccgcgttggcctcccaaagtgctgggattacaggcatgagccactgcacccagccatctccctgtgctttctggacatcataccacagtgtcacctcaaacacttgatagctcagtgtcctctcttgccttttagatattttagcaattatcccagcagatgccatggaaaataaaaaattcatattatcatttttgcttactatctatttcagtgtattattcagaatgaaggaaaaatttaaaagcgcactttaaaaaagttatattttgcttcattagctcatttattttaaactagccctgaactcacctaattgtaaaagtataactatttacctgattgaagtaccaggtactttatttagtttcttcaagtcaaactctgtgggttttatttaaacgtcatgtctatgttgacagatgaatggtgtcttaagttctgcttatgtgttacattctgaagacaatacttggtaacaacaataacaaaaactttaaaatgtgatgttttataaggattgaatgatgactacaaattttttaaaacatcaaaccattcctttctgtaggaaatttctatttacagtcaacaggtaagattctgcagttcaggctgtaggataactttagctcttatttcagtgtccctgagaaaatattattaatttccccccatgcaatgcttgggttgtggataatttgagctacacagagaactgcaatgcattatatcagaagggaaagcagataggtcccaagtagaaatcaggtcgcatgatctctctttgggaagacatttttatagtcataatgaatggtactttcaacctcaatttttataatattctttttaggatacctaatttaatgttgacaagtgaacaaaattttgccacggtaaaatttttcatggtactattatcctatcttaacaggcctccttgtatcagtcctctatagacagaagcctggaaagacccatgaggtaagaatcttattatgttgtagcagaatattctataccagtggtttctttttcaacaataaaattattcagtgaagtagtaatgagtatcatgtatcactcatttttatttgaagtaccatgcctcatgaagttgttttattttgtttcagcatcattttatatgatcatttcaagaatttctaaaaaattagtgaactaattataaattccttcacagactgagaaatccttctcttcccttagtcccctatacccagttttcttttctttagatgggaattataagtaactaattttcaatgttgttaaatggcccttataataatatatttgaaaaaaattatagattaaaaagtgttatacacgtatttgttaatcatactttgaccacacaaatcagaaatactgttattaatactaccaataaatgaggcataagtacaaaacatattcaatcctaagaaaacactatggttaaatactattgtccccactttatctctgaggaaagtgacacctaggcttagtaacttaccaagtttacacagttggcaaggagagagaaaaaaaagaaattgaggcaagatagcttgtcaccgctaggcctaacttccctcagagttcgcctgaagtaagttccattagctttaaatatcacactttttaaaaaatattacaaaattcatggccaggcacggtggctcatgcctgtaatcccagcagttgggaggctgaggggggaagatcatgaggtcaagagattgagaccatcctggccatcatggtgaaaccccatcactactaaaactacaaaaattagctagacatggtggcatgcccctctagtcacagctattcaggaggctgaggcagaagaatcgcttgagcctgggagggtggaggttgcagtgagtcgagattgcaccactgcactccagcctggcaacacagcaagactcagtctaaaaaaaaaaaaaaaaacaaatcacaaaattcagacatattcagacatagttcaatagtaatattgaataatacaaactcccagccatattgtaacatcaataacaaatatttatctagtagcattaatttacccttctatgtagatttctttgtgaattgggtcaatcataaattgggtttctgagtgccatccaactgcaataacatccctgagaaaggaactctggaacccctcctttttatcttctgcctctatctatgcacctaaaatatttgaattttagagttttaatctaatctacagattgccgtaaagacacacagaccctcacatgacaggacagtcccagcaaaaacaggtctaggagatgcatcctcttcagaagaggacaaaccagttctgaggtctgcctctccgcttgcttccgtacatcccagacacatgtattcactttaccatttgtaaaactgagataacagcatatacctcatcggtttgctgtgtgggctaaataagacaaaaacataaagaaagcacatagcattctgctgggctccataggagctggggttgctgctgttgctattatcactgttgtctacacaagtcttgtctaagaatccagtgatttcatgcacagtgtgctgtgccatatgtggcttcattcattaacattggtcttaaatgatactgtactcaaactcaaaaccatgacagaaactccctgctgttctagactattgacagtattttatgcaactgaggggaaggaatctttaatagttaatttgctgaccagattactggtactgattgattgactgactgatgagacagggtcttgctctgttgcccaagctggagtgcagtggtgcaatcatggctcactgcagcctcaaactcctgtgctcaagctatcctcccacctcagcctcctgaatagctgggactacaggcacatgacacaactggctaacttttttattttctgtagagacagagtctcactaggttgtccaggctggtctcaaactcctgaccttgagccatcctccagccttggcctcccaaagtacttgattacagacgtgagccatcatactcagccttcattcattatttaaataaaaaatgttggaattccaatataacatcttctaaagctaagatgatagagatgataggacaagctgcaggcaacccttgaggtgagagagattttcctctcttgatgtcttttttttttttcagttatttcctgtatttggtatgcccctctggatatattcatgttgttagaactccgctttatagagaaaagatacaagatacaaattatagcactgaattctcaatcaacatattacactataggagaattttgacgttcaaagatgtttaaaaacttaggttcacacaaaaaccagcaggtggttttcttaggagcattatttataattgctagaagttggaagcaaccaagatgtccttcaataggtgaatggatacataaactgtggcgcatccatgtaataatagaatgtgactcagcaatacaaagaaatgagctatcaagtgacaaaaaacacatggaggagccttaaaagtgtatcaccgagtgcaggaagccaacctgagaggccacattctgcatgatatcaactgggcatggtgaaaaggcgaaactgtggaggccgtgtggaaagatcagtgggtgccaggatgagcgggaggaagggagggatgaaaagctggaggacagaagctttttatggcgggaagactattttatatgattgacacattaatgatggacacacatcattatacatttctcaaaacccctaaaatgtttaagacaaaacatgaactcaaatgtaaactatggacttggggtgacgacgcatcaggaaagattcatcaattgtgacaatgtacccaccaaaagaatatgtaaatgataagggaaactgtgcaagaggaaagggactataaggaaactctctacactttccagtcattatttctgtaagcctaaaactgccctaaaaaaatttagttgtccgggcacagtggttcacgcctgtaatcccaacacttcaggagactgaggcttgaggattacttgagctcaggggtttgagaccagcctgggcaacatagtgagactctgtctctacataaataacaaatttaaaaaaattagccaggtgaggtggcacccacctgtggtcccagctactcaggaggttgaggcgggagtatcccttgagcccaggagtttggggctgcagtgagctgtgattgcaccactgcgcttccagcctgggtgacagagccagaagccatctcaaaataaataataaggtctattcattttttaaaagatccttctagagaaatcatgttgaacatcaagggatgagttcctagcaatgcagttttggggatagaggtttaggagttacgccattgtcactagcacgttccaccggtttttctggtgcacacccgaacctcctccagtgccaatcaaacagatctgattccttctttcagttctgcaagcatggccagtgacttcaggaagcggaggaagagcgagcctgcagtgggtccaccacggggcttgggagatcaaagtgcgagcaggactagcccaggccgagtggacctcccaggatcaagcaccactcttacaaagtctttcactagctcttctccttcttccccatcaagagcaaaaggtgagcatagtaaatgaaaacacaacaatttactagtttacgttttagcctagagcactgtgtgaaagctggcccagtgatagtggcatgtgccagctctcacctacagtgtctggaataaaatatagttttagaacaatagccttcttcccacccagactgactcaagctggcgagccacttaggttgcttaaagaactctgactagcatctgctaatgcttttttcccccaaatagatccctttctaaacaaattgaaagtatcaaataatgtatcatcaggctactaaaagatgtattttgtaaacattgacatatagtcaaaattttctaatgtttctacaactagcaaattagtcaaatttataggataaaaattacaagcagcaacagagcaaattgttggctaaaatatacattggtttggagggttttaaaaaattattcaattctagattttaaaaaaatccgacctattaatttctttagccatttgctgtatattttgggccaccttcacatgaacagtggagcatccacctcctgccatgtaacacagtggtcaattcacagcagctcacagtcaggactaattggtcccaaaccataatgatatcactgaggaatcaccaagcctttttttctggatggcccgtctcctctctgcaagtgtagggagctcactgttgaaagaagtcactccttctggtttctggaagaccatttagtggtattccttgaggacaggaatatttctgagatggagagtgaggattgaaccagcccctacagggagctagggctctaccaaatgtgggaccccacaatctcctctaatatcttgggattgaaagagaagagaaagagattttgaaatgtgtaaagaaattgagctctaatgtaagtttctataaaaccagaccaattcagctacacctatcaactatagtcactaaaaccattgccacatggtagttaaaagtggtagctgatttgtgtgcaaaaggtattctggtcgtgatgattggactctgagtaggtggatgcctagcccttttaaggccttgtaaagctgtgatatcagctgatggttcagggcgtgtgagccccatccatcacatctttcctctgaggagcagagatgccttatcagattcaactcacttattcaaatgaatatcttaaggtaacaagtaggtcatgaaatgccattgacctattattcttggatactagccaaaagttaaaagggttctgataaatgtagatatttgtttcatcacagggaatgttaaatcaacttcctttcccagacagtacagatctacctaatgtgcttatctacttttaaagaatttagagaacattgtaaggtataagtattgaatagagatattttcctccattagattttatttctaggaagaaaatgtcctattagatataatttggctcctcatttattagttgactcagcaaagcaaaagaacatttccatagctattcaaaattgaggccaaatgtagatctctattatcaaattgcaaatgatttttcaaagaactcttccgagaaaaaaagcatggtatatgcacctctgatgaaagttttgcattatattcagttttcctatgagaattttgtacctaataaaaggttaaaggtagagcaatttaagaggtaaattcgtttgtttaaagagctttagctatttttttctagaaaaatgttagcagcaatagttcacagcattttgattttgcaattttggagaatactttgccttatagcttttaaaatctaaaacccacaaaaaattatttgatatagtcatgagagtattaattcgatgtaaatgtataaacccttcttcacctatgtatcattacgaatcaaatgaggctcaaattccggccctattaaattgcgtaagggtataacacttttgacactaattgttaaaccttcactaccagatcatgctatcagctgaagcagcactattgtgttttggcaaacaatattgtcagaaaggtgtatgaattatgcagtaggagtaggtgtatttgcttacgtcggttgcttcttatacacagttttgtcaactctctctgcaaagctacattcactgaaaaagtattagctcgctttagaattagaccttcttctctagagttgaagctccatgtgtgaacaatcagcacctagattaaaacacactaactgctttctccttgctatgctgtctgatgctttactgacatgctctcctctctttgtgaaccttttaacttctccaaatgtctctcttctaccacgctgctctggattaaaaggtggggatgatagcaaaatatgtccatccctttgcagttactcagggctcaacggcaacccctccagtgagttagattactgtagcacttacagacagcacttggatgtccctcgggactcaccaagagccattagtttcaagaacggctggcaaatggcccggcaaaacgcagaaatctggagcagcacggaagaaaccgtctctcccaaaatcaaatcccggagctgtgacgatctcctaaacgacgactgcgatagcttcccggacccgaaagtcaagtcggaaagcatgggctccctgttatgtgaggaggactccaaggagagctgccccatggcgtgggggtccccctacgtcccggaggttcgcagtaacggcagatcaaggatcagacacaggtcagcccgcaacgccccggggttcctgaagatgtacaagaaaatgcaccgcatcaaccgcaaggacctgatgaactccgaggtgatctgctccgtgaagtccaggattctgcagtacgagagcgagcagcagcacaaggacctgctgcgcgcctggagccagtgctccacggaggaggtgccccgggacatggtgcccacacgcatctccgaattcgaaaagctgatccagaagtccaaatccatgccaaatttaggggatgacatgctgtctcccgtaaccctagaaccaccgcaaaatggcctatgtcccaagaggcggttttccattgagtatttgctggaggaagaaaatcaaagcggcccccccgctcggggccggcgaggctgccagtctaacgccctggtgcccattcacattgaagtcaccagcgatgagcagccccgagcacacgtggagttttccgacagcgaccaggacggggttgtgtccgaccacagtgactacattcacctagaggggtcatccttctgcagtgaaagtgactttgatcacttttccttcacatcctccgaaagcttttacggatccagccaccaccaccaccatcaccaccaccaccaccaccgccacctcatcagctcctgcaaaggcaggtgcccggcctcctacactcgatttaccacaatgttaaaacacgaaagagccagacacgaaaacaccgaggagcccagaaggcaagaaatggaccctggcctttctaaacttgcttttctagtcagtcctgtgcctttccggaggaaaaaaaattcggctcctaagaaacagactgaaaaggcaaaatgtaaagcatctgtgtttgaggctctggactctgcccttaaagacatctgtgaccaaattaaagctgaaaagaaaagggggagcttgccggacaacagcatcctgcaccgcctcatcagtgagctgctgccagatgttcccgagaggaactcatccctgagagcgctgaggaggagccccctgcaccagcctctccacccactgcctcccgatggtgctattcattgtccaccctaccagaatgactgcgggagaatgccccgcagtgcctctttccaagacgtggacacagccaacagcagctgccaccaccaagaccgtggcggtgcactccaaggtggatgagcttttctttctttttccttgtggttcagagacccaccctccagctctttcattttccattccaacatctcatcactcccgagctgggagaccatttggcgtcgttatgtgttgtgaagcaaaaacttgttgtgcaaatatgtcttactgaatatttctcatttgcccatgtgatatttggacttgatgtgtggcttaaagtgatcatcaattcacaaaaatttactctttcgaaaacgagagggaaggccattttgtagctcagcattagggttgaaacaaccactactcacattgagacaataaattacgttgtgacatgaatcaaaacctatagttccacaaatagccttttaaaaatgtttatattaacgttaaaactttatattcattcagttaataaataatttgtcacattctatatagaagatactatatcaaaacattcaagaagcaaaactgaaatatgtgattagtaattgatggacacaaagaaattagggtttgtttaatagctttctccatttcaaggacacaatggtgataaaatttttgtgaatgtatctttaagctatatatataaaagtcccatttccaccatttagtgtattcattttctcttttccattacttaattcattcactttctctttctgctaaaacagtcctgtattgaaatttgaattacactattcaggctaacagtgactctaaactctattttcatagataactttgaagtggcaacacaagaataaatagcaattgaaaggcagaggactatttttgagatttatataacttacagcccagggtgttttaatatttgtgaccaattattttcattaattcttacagcacatctgttcactacgtaaattttaagaggctggaatgaacattccgggctgaaagttggtcaacagagaaacttctatgcaccagacactacagagtgctttacatacattatctaataaaactggcataggcctatgaaatgggtgttatttcaaaagccattttcaattttggaagttgggcccagagaggaaaggaaattcgtccaaggtcacacagagagtagataacagaaaagagattcaaacccctaataattcagaatttatagtataaaatataatctcagacaaaaaaaaagacataattcacagttcatactagtgtcaaatatggctcgattgttaattaacttgcacaaatctacttagtctttatgtttgctttcacttttgctacactatacacttacgtttatctttgcctacccttaggctgaagcaacatgcttcaaaataataaattagaatttaaaaaatcaatttctacaattcaaaattttcactaattgaaatgtgtcagaatctcattttttaataaattagctaccttctccaggcttttaatatcctaatataaccatctctcaattttatgtgcagataggagtacatttttgaaacgtaacttggaagggctttgaaatgcatttaaaagtattttgttttttagtaaaatatttactttccaattgtgtttcacccaagtgaaaaatagcttatattccctgggttagaaaaagtaatttaaaatttatgatcattatgaggccctatgatcataaaagtatattaacttagaatttacatcatcaaagtagtcaaaatcctaaaacaatgttttcttattatgaatcagcactttaaattctttcatagatggataaaataaattttatttttaatgcttcttgttagtctggataactagatatatttaagggataaaagaaagaattgacaaatattgacccagttgtactgataaaattctataacatagactactggaatacatttaatgtctagttacatctccatatgtaagtcacgtaagtgcaaaaggtataagatactattaagaactacatgcaatcaaaattttgtaatgtgattatttatgctttgctttaagatgaacaaaaataattcaatatttcataagcaatttggcaactgacatgatgctttctgtttatcccttttttgcttggagtaagaagaaacaatatctctttgtttctttgctttctgataaggtgtttatcatctgggcacaaaggaaggtcgtagataaacagcatggcatcttgagattcaataagtatttaaaaacagaggaagagcgaagaggggagagtaaggcagaaggagaatgttcatcaccaccctcctgtcatcctcatactttctttggttttatctctttctttttcattactacagtcttaaattactccacaaaatgtttctttttctacaaattgttgctattttcaaattctccatcctctgtaaatcttataatagtaattataaataagaagcaaaggcatagaaacagaaagctttggaaaaaatttatatgaaaaatccctctaactataaattgtcttactgggtgtggcaatataattaatcagcaatgtagtaatcatatttatatagacaattataattctgcaacctcagatatttttccttttgaaatgctcttgttttgtgtcttatttcacaactttgtaatgaactatgagttttatgcccatgtgttcgataacggtgtctctccaaatttggggaaaaaagtagtggccaccagggaaaatggcggaacaggttggcttgtaattaagtggatactcaccatgactggccctgttctttccaatagaccgtgagtcccctagaagttactcatccactttgactgacatggggagaagtgcaccaagggaaagaagaggaactccagaaaaagaggtagttaatttaatagcattggagtctttcacagcaacacacttgatacagcacttaccagccaaaaattatcccaaaccagtaacgaactcggacaggaaatgtgaaaatactgagaaactagaaacaattttccttggggcctgagcatagcaactctgaccctagaagcagtccacaccctgaccctagctgtgggtcttccctagtggtggcccagttttggccatgaggcttctccgagtcttgacctgatgcccatgaacttaaccattatgacctaaaagtgtcctgagttagggcacctcgtggaggcaataggtttcctctacaatttcttggcccgctggtccaggagaaagcctgatgtcaactgtgttgtaaatcaatacagagcctacagaaatcatttttgctggcttccttttattggagaggatccctaaaaagagcttttaaccagcccagttctcgggatactgcccctgggaaccacccaccaactgaactctgtccagggccctgagccggggctagagttcttgctcaaactgccttggagccatgacggctggatggaaactaaaagctggacttggactggtagccgctccagaggatcttataggcgtctgatgtagtccagagcctgtgggatccccaaagaagttagaaatggtccaggattcctaaagttcaccagagtcatgggggaaaagaatggagtgaagggattgttggttggtgaggaaggaagagctggcctagctagctatagggtacagggtacctcagggagatctgtggcccccagagtttgaggatgggcacgtgtcacatcacatcacaactaaaagacgagtggctggtggacagagtgttgaaggattcctgagccctctagggaatgcaagatgatcacacctatacttttgcccactaaccagcctcccagtgataattgagctaatattttttgctaatatgttaataagtgtctaatgaagggaatgattacttcttttatgacatctggtccttttattatgattcagagggagctgtgtcaatctccatagaacatagagccattgaccctccacatttatcctaggaagagcctttgtaacagccaaaatgatgcctaggatgcaaacctctgcaggcattttattctctcattataacattaatctaccttagttcctaagattaaatatgatggtgaataagccttctattatattcctattatagcttaaatatctaaatgaagaatgaatggacttatttataaattgcttacaggattaacattacatatgtttgatgattccctgaggtttcctttttctttaaggcacattaaactactttcttgtagaaaattcaaattttaaattagtgctaattgtttatcttccttttcagaaattgcctgcaaaagctgtttatgattttaaggctcagacatctaagtaagtaagataaatactcatcatatgatttaaggtggttttaaatgttagtaatgctttaagagataagcattgcagtaggatctgttacaaatgaggtctaattcccaatgcagcaatctactctaattaaatggttccttcagaattaccttttattttaagtttagttgagaattactgagttttaaattacattaaacatgttaggtagaacacaatgaattctaaaggataggaaaaacaaaaagaatttaggaatatttgtttttagaattttgtgtcaataatgaattaatgaagtattgggggccaggcacagtggctcatgcctgtaatcccagcactttgggaggccaaggcaggcagatggcttgagcccaggagttcaaaaccagcctgggcaacatggcaaaaccatgtctctacaaaaaatacaaaaattagctaggcatgggggcatacacctgtatagtcccagctactcaggaggctgaggcaaaaggatcgcttcaccgggaggtagacgctgccataagctgaggttgcgccactgcactctagcctgggcaacagagcaggaccctgtctcaaaaaaaagaatgaataagtaaataaataaagtattggggagtaattaacactagctgggggaatttgataacatttatttatccaaatattccaagcatagtttgtggggttgatgactagaacttagtacaaagattcctgtattgaagtctccatcctcagcctgcaaagctcagagattctgagcaaagttttctcctttggtcttttggtgtcggtgttttcaccatcctgaattgcaatatttcttttgcctttattctttgctcagcagataggcatgtggttgcggaagcacataagcagacttatatataagagggtgttgcccagattttttgtggcctatgtgcacagacctttaagaaactttgttctccagtagaattcaagacagatattgaattcattgtaaattgtcattaaattattatatgttgtttacactgaatatatatatatataataaccaaaataatttactcataaaaatgcatataatatgagttaatagctctagaaactgtctctggcagaagacatatataaataaatcactcagaatttggtaatgctgctgagataggaaatgaactagataagaaaaatcctgtttagaaattaagatgttgaacatggcttaaatctggcctgaagaaaagcttacatctttttttttcaaattagagaaataagatgctttgtttctactgtactccggtcctaactactgttctgtggatatggtgtgacaatttgtacaatgcatatcagttttataaaataatgttacggagcacacgtttcatttcttctttgtaaaaatcaatccatagctttcttaaatatataaaaacctgaggaatggcaggggatgtgaagtaggaagggtgtccacccaaggctcacgaggtcttctgagaagtcttaattttaaaaagcagctgggcacggtggctcatgcctgtaatcccagcactttgggaggccaaggcagatggatcactcgaggtcagaagttcgagaccagcctggccaacatggtgaaaccccgtctctactgaaaatacaaaaattagccaggggtggtggtgggtgcctgtaatcccagctactcaggaggctgaggtgggagaatcacttgaacctgggaggtgaaggttgcagtgagccaagatcacaccactgcactccagcctgggtgacagagcaagactccatctcaaaaacaaataaaaataaaagtgaggggaaaaaagcaaatgggactttaaaattctaggtctgagatgagagggacacagttttgaaaacttaagagtaagactttcctgtgtcttaaggacttcaaaattttaaatgcaacctatacaaatacaaaagagtctttttcatagctttgaaaaattggttgcctctgattcatatgttcatattatattttaaaaagctagtctcatttccagaaacaaaacatacctagtacaaatgaaactgttgtgttgtgaacattaaatatcttgctttgctttgttttctgttttttacattaggcatttgcacaaaagaaggaagcactgtatttgaatgtaaagctccatgaatcttctttgtttttagggttactgaaaatttaacacattttcaattgtgaagattttagcacttctaaatgtgtgatcattcttttaatataccaccattttttcgattaattcttttaatcaatgagaagtgttctccatcaggtataaatctctctccatcaaacggcctatactaataaatgatccaactgaaaattctgaaccaaaattttttaaaaaaagattaaaaaatgaaaattctgaacaaaacaatgcagaagattccagagtgggagggcagatgtattgcaaaatgaggctcttgggagaagatacaaattaatcgccctccatccaagaataattgcggaggcaaaataatgaaccaacctaatcacctgggtgattaagccaggaaaaattgatgtagtgaaggtgataagtttaggtgtgaattattcaaaatgcataatgtcattataacttaaaattataaatacccaaatcaaatatacctacaattttcttagaaacagccaaaattgaaaaatatagtgtcttaaaaatatttttattttttgtaaataaaagatagaaaggcaagcattggcatatgtctttgcacttaaaacacattcttcttgccccactgaaaattaaaagtgtaagatcttttctgttacacaaaataaattccttatcaagatattctattaaaatacctgtcaaccaacttcaaagatccacaaataaaatttgttctggtgttggcacttctattctgaggctacatgatatttgttttccttcatgtaagcttcagtacatcaaaaggggctggggggctagtaactaactagccaactagcttcaggacaaaaaaaaaaaaaatcagtgcagaactattccatcatttttccaagcttcaaaatgcctcttctctgaactaatggtaaagtagcaagagtctgtcccctcctttaaacttcttattaatctgtctgtgatttatatccaatggaatgtttatacttactctgtttgaaatcatttctaaagttataatgttttaagtgcattctaagaatttgcaaggatcattcttatctaatcggactcaatatcaattggattttttaatattgtaagtatatttgccaaacaaatgcagatctagcgagggtgttgatcttgagaattattgctgtacatcacaaaaagaccatgtcaacgtgtctcttccagggagttgtcatttaagaaaggagatactgtctacatcctcaggaaaattgatcaaaattggtatgagggagaacaccacgggagagtgggcatcttcccgatctcatacgtagaggtaggtcctctccctttctctcttggatggcggtggtttcaaaggtcaccgcagatttgagaataaatgactatttccttcatagaaactcacacctcctgagaaagcacagcctgcaagaccacctccgccagcccagcccggagaaatcggagaagctatagccaaatacaacttcaacgcagacacaaatgtggagctgtcactgagaaaggtagcccagctggttttttgtttgtttgtttttgtttgtttgttcttcagtgggtttgaaaaggctgtatattttcaaaactaaaataggttatctttttctttagacatttttatgtttaccctattttctacaaaggactctttaaggcagcccagagtcacggttccctgctggtccctgtgtccttttagaggagttccccgtgggataccaggcttctccctctgtggcttagtctgggaagccgggcatggggctgaaaatcaaggacttatacattcgggagcacaaaaggaaaaagcagtttgatacacttcaaaatatgttgttttgctgccttatttttcagtcttttaaaaacaagatattccaatccttatcttcctctatcttggaatctaggaatggtcctaggtaaagaagatccttcctcttgggggagccgctttaagagccatctctgcagtgctcttccctggatcatccttctttgggcctcataattgacccaaatttctctagcagcccatccaatcctagtatctcttcttaataatatcaaaagcctcgaggccgggcatggtggctcacgcctgtaatcccagcactttgggaggccaaggcaggtgagcgagattccatctcaaaaaaaaaaaaaaaaaaaaaaacacaaaaaaacaatcaaaaacctcttttaacctgctagtttacataattgagaatgataaatgaattattcttattgctttctaaatatgacatatatttgtttgaggtaactgcctctgcacacaacacaggcgaggtagtaatatttagagtggctctaggacctcccacacctactagtgaaatccttagccaggtgcgatgaagagcaataccacagtcctggtttgttctggtcctggcagaaccttgtctcattctctcccatcagtcttaattctgcatcatcagccgattccttctttcctatcctctgggctgccccacctagcatgagaaccacagagcattacatgaactctgtctcctgttccatgttctacagaaaggcttcaccaatgcctcttacagctcacacaacagcctagcaactacctgttcttggtatactagaaaatcggtgcaattttcagatttggggagactgactttttttttttttttttttttttgagatggagtgtcactctgtcacccaggctggagtgcaatgtgtgctctcagctcactgcaacctctgcctcccaggttcaagcgattctcccacctcagcctcccgattagctgggactacaggtgcccgccaccacacccggctaatttttgtatttttagtagagatggggtttcactatgttggccaggctggtctcgaactcctgacctcatgatccgcccgccttggcctcccaaagtgctgggattacaggcgtgagcgattgcatccagcctgagactgacttttcttgagtatgttctgctcagcggtggtgaagcacacaaaatcaaccatccagcgtttcaacacaaagagaacttccaagtgctactcaaggtcgaagttcttcttgggtagcacctgaagaagggtgccctgttgggctgagattaatgactgtttcagctccatcacaccatcaggtgccgctgcccgagcttctgtatcacctgctgaatgcagctgcagtttttgcccggtagcatcaacttgcctgcctacttctaggctacgtgtagttttgagttaaagtttaaactgagttctgcagcactggctcggtcatggcaggtggaagtgattctagaaagttctatcattgtgaaagccaagggttctattcaaatctttaatgacaagtatggaatggtcaccaactactcagatggatgctgggtttccattgtcagggtgaagaccaggggaatgccagtcttgtcacagctattgatattctagggcgctctctttcccccatccctttagttcactctgtcactacttagcgcatgtagattaaagaagaaaaggggccgggcacagtggctcatgcctgcaatcccagcactttgggaggccgaggcggtcagatcacttgaggtcaggagttggagatcagcctgaccaacatggtgaaacccctatctctgctaaaatacaaaaaattagccgggcctggtggcgggcgcctgtaatcccagctacttggtaggctgaggcaagagaattcttaaacccaggaggtgcgggttgcagtgagccatgatcacaccactgcactccagcccgggtgacagagtgagattccctctcaaaaaaaaaaaaaaaatagaaataaaaaaagaaaacggtgtaccattcgatgttctcccttctagaggtgttttctgtaacccatttcagacagaccctcacagcaagctatggtgcactttctgaagctcttcctacagaaggccaatgcactgaacctgccagagataaaataatcctattgtcattgagacattaccttttacactattctgctttttgaaataacttagacaaataatttcacacaataccagcataaacaagtataaacccgttcacattaatcaggcatccttagggaagattctgatggcctgaatggacatttcaattacatatatgttgatcatgtgtatttttctagtaagcactagtaccttacttgccctcccctgattaaacaaaaactgaaggtataaaacctgcccaaatggaaacctattttttcatagaaaacattgacaattatattttcatgttattctatctctgtttctaatgcatttttctcatattcataacagggagatagagttattcttcttaaaagagttgatcaaaactggtatgaaggtaaaatcccaggaaccaacagacaaggcatcttccctgtttcctatgtggaggtcgtcaagaagaacacaaaaggtgctgaggactaccctgaccctccaataccccacagctattctagtgataggattcacagcttgagctcaaataaggtaagaacatactctatcatgttaatgtaatattggaagctccaagtaagataatcggtgtgtgactttaggatattagattagaatatcatatctattgcagagaaagagatttacatattatgtttctacatgtgtgagtgccacatcagtaaatataagtcagtgtttctcaaataggtgctggcataaagatttaatgattaattttgctcatttcattttcaagttaaaatatcgaaagagaaagagaaaacgagagtatcatgaagtctcgtatgatatatatctgtactcctgtgtacataaatgttttctgaaataattttttcctaaagcttcatttttatatatgtaaattttatgtatataatataatctttacatataaataaatataatcatatattcatacatgtatatacaattgtgatttataatttgaaatataaatatacacaacacaaaatactatgtatatctcaaaatagtatatcacaagaacaccgggttattaggttgacaaatctatacaagttttttatatggaaaatgagctagagcaaaaatttttaattagagtctataagtcaagatgtttattagtttaaatgaaaatgttgtcggttattataagtcctcaagtttgttttatcagttttaggacagttatatgccagttctactgtttcacttgagcgggctaaagatgattatctttctcaatacgtaatttaaaagaggctttgcttctttaattggtgaatgtaaaaaggctatttgtctgtactcacaatgtgaaattttttcttatttttctgatgaattatattctttttatgaaaggcatgtaagggtcttttttctcattaacttctaggaataaaactttaaattgccaatgacttccaaaatgttttaagtacttctcaacattcaaaaaatgtattaagttgcctaatttattaattattttaattgagatcaaggctaggacatgaaaagctaaaccatcgagagctggtaaaataaaatcaacatatcagatgttactaaagtgtgaagtcacttcatgttccgatgaaaaaactgtttcaagatagcatcccagtgacctaaactacttcttgaaaatgagcctgagaaggattttatatgaggaaatgatctaagaatctgccatcttaagagaggcatttttttttagaaggctgaagtcttggcattttatttattgtgatcctctttgaagactgagtttcagttgcaaataattaccctcaaccctgtattcatggataatatatggaagagtttggtactatccaattttgtttgcttgattggttatagttttccagaatcttcttaagtatatttacttcattaccagaccttagcatttacagatcagcatccttccttcagtattttctattgataaagagaaaagataagaatcttcatgcatatatttgtcttatccaccattcagtcatctttaaataactatcacagaaatttcaaagcaactgtaccttcaaataaaatgttgtaaggaagaaaagcatgtatgtacaaaagctcattaaacatctaacaaattcttccatatgtcctaatataatatttaatggcaatataatatttttgatcccaatgttttcatctttgatgtgaatacaatttaactgtaattgaatatattttcaagtttttaaagtaataccagattttaaacagaggcatgtacaaatttcactaataaccagttttttattgctcactgctggggaaaaaatatgttgagaagcttatgtccataattaggaagaaatacttaatggttttatcccaactggtaatccatgctgtgatgtcacaggcttaatgaagaaaacttcccggaagtgacaaccatttttagaaagataaatataatgtatttctaaatgataacatccaaaatatactaaacgctacagaacctattttctaactgatatttacaaacagagaactcattaataatttataaatcactctggtgacacatttaaatcacatttcttgacatactgtctttgtcttaggggagactaaaatgtatgttgattttatttctgatatttctgcttttagtgcattagaatccaattctgatgcttttggaaaacaaaataattgtatgggttttgtattataggtataggtttgtgatctagttataccaggatgcttcatttggctttcggtataagcaagtccatcataaagctaagcagtttaacctgctgacatgtatttcggtgactgtggtggtgacggcacagcgtagtcgcagcatcagatagcaatggtgatggtggcagtaatgacaagggaattcaagatctttctttctcatctacataatattcctggcataacagaaagtgaaagtggaaacctgatggtctgaaattattatatatttcacagactttccaaatctaactatgaaaacttctgtgttatgtaacaaggggtataaactagaactctagctagtaagggaacttctgtagactgctgaatgagacttgagtggtttatatcattgaaaactcagcatctacaggacttaacaggagtggctgtctacctaggcgcaaaccacacgtgcagtctcactgtgtgtcagcagctaagcagcccaggtcctgaatcctgtattaagatgctcacatgagttttgtgatatttatgtcatcccacgataagatgacttaaaaaaaaaaagctaaataaatctaattaataccccactcctactataggacacaggagtcaaaagttaagtaggaaatgcatcacccactcacacacactaagtccccaggagcaagagggctgcttccctgtgtaaagtgttatcctaaacaatcagctggaaagtgtatctccagaatctttttggagatgtttttctttccaaatcaaagacatctacctggagagacctaaagtgaaaggtcccttctcaaggcttttaggcacatagcaggtagcattttctctagtccggtaagggtagataaacgtattccaatgttagtaagtggcacttctggaactacattttttaatttctaatttttatgggtacatatggggtgtatatatttatcagaactacttttaatacctttgcataaaatttcaaatgtattgtttcatttactatatccaaaatacatcagtaatactacgtatgtagaagtaagtatattttacttcagaagattaagcttcataactcatacctcctctgatttacataaatgtcaagctttgaaagagaacgggagctgaagcagaagtcctccctcccgttagcatcaaatgagctttctatgtaaatatttactttggattttttaaaactttgaagccgtagttatgtaagctcagcttcattctgatcatgggttcctgtctttgagacatagttttcagaacttattcacttagaaatttgttaacatataatgatctaaaatactttattcatatgttgtaatcaccttgcaaacataagtgagaaaattgtcagcgtttaaaagattgggctatcctgcaggacaagagaacactacacacattcaggaaataaaatgacttcactattagttttcattctacattaacatttctctggagtcatttatactctactaagtcagtatctggaaacctgtaatatcttttcaacatagtttaaagtaagtaagcattaaatctcttaagggccaggcgcggtggctcacacctgtaaccccagcactttgggaggctgaggtgggtgggtcacgaggtcaggagttcaagaccagcctggccaacatggtgaaacccgtctctactaaaaatataaaaattagctgtactggtgacatgcgcctgtagtcccagctactcgggaggatgaagcaggaaaatcgtttgaacctgggaggcagaggttgcagtgagccgagatcacaccactgcactccagcctgggtgccacagcgagactccatctctaaaaaattttttaaaaaattaaaaataaataaaaataaatctctcaaggttttactgtcctggtaatctctatatcatctttatcttgtttgacatttaagaccccttccaaaactagtagagtttcatttgtgaagtaacttttctaattaacataaatgattttatgtatttaaatttcagcaaaataccttcaaatctagatatcttctaaatgtcttcaaatctatgttaaacataaaattattttcatattcaccaccgcatcttttctgcatttctccatcgctatgttttgatgcattattattattttcttagtttattttttcttaacttcataatccgtgctcatttccaagttggcttccagtgaaccagcccctcctcccacccacaaagtctcacctggctcagataaaggagctctccagggaactggccagggctggttgtccctgacagcctcatgtctaccagcaaaccctttggccccaacaccacctcgtttcctggacaacttcttgggtgaattggagaagcttggtgctttaaccttgtcagctgaccaagccaaaccaaccatcctagaggacgccatcctggaaattaaggaggaacctgctgtcctcctcccattgtccccagcgactgcacctgccgaatcaccttccactcacgcgggtgtggcctcggctgcagcccagccttaccatgcagagcctcttcaggatcccagaacgacaactcaaagcaactttgcagagttgagaaaaatgagaaggggcttctcagaccctaaaaaggcaccagaagtcctaggggataattttgtggcctctgcgtgcaccagcgtgggttccttgcctgtaccccttccggtcattggagaggaagatgagggcatctatgaggggattgtgtcaggcatccagagagggccgccagaacctcaggaaggagacgcctggtggtgtggccacgatgggtcagagggcaccccacacctgcacattgaagaggaggaggaggaggagaaacccaactgcctaaaacaccccatagccacccccacagatcctaggacccccaaggaggacagcaatgcagcaaaacccagtaatgaggtattttaattttgtctgattatggaagaactaaccggccttaccatgattagctattagagttaatcatattaataaatacctattttgactaacagatttttttaaacaaaaaacacaaatactatataagatgggggtggagtgggtatatgaaaacacaccatatttaattaaatgatgtaaatatgtgatataattccattatcccatttttcttcaggaccataaacttatattgtaaaagtctttgtaattgatatagtctttgtaatcttccaatattaacaatgatagctaatagtggagctcttactgagtatcagacactattctaaaaactccacatctttaatcgtcaaaacccagtgaggtgtgtgacattatcatccccactttagagaagaggaagttgatgcccagaaatttgtcctattccaggatgagaaactgtacaccatacctttgacataacggcactttgcaaaaataataatgctaataataaacaaagacaacagaaaagaaaaacagcacttctgtcccctttcgattttctaaagaggtcgttctctttgtgttgacttcacattgactacttaagaactgggtactgtatcttcatgttatgaagaatcttgaacagtggttttaatcaacaaaggcagaaaatatccagaaactttagcttgcaaacctctctcttaaaacaaaaaacgagcctgcaacgccagcacttccagaggccgaggcaggcagatcacctgaggtcaggaatttgagatcagcctggccaacatggtgaaaccccgtcactaccaaaaatacaaaaactagccaggcgtggtggtgggtgcctacaatcccagctactcgggaggctgaggcaggagaatcacttgaacccgggaggaggaggttgtaatgagctgagatcgtgccagtgcactccagcctgggtgacagagcgagactccatctcaaaaaaaaagagaaacttaaggccagctgcggtggcttacgcctgtaatccagcactttgggagcccaaggctggtggatcatctgaggtcaggagttcgaaaccaacctgtccaacatggtaaaacccccatctccactaaaaatacaaaaattagtcagacatggtgttgggtgcctgtaatcccagctactcgggaggctgaggcaggagaactgcttcaaaccgggaggcggaggttgcagtgaactgaagttgtgccactgcactccgttctgggcaaaaagagcaaaactccatttcaaaaataaaaagaaacttgatcccacaaatgtaccctgtgaattaagaagcaagtataattactggcaattatagaaattatgaaataacagaaaggatggttcctattacgctactatccaagtcaaattctttcatagttcctgtatttcaaaataacccggccaggcctgcatttgtgtaaaacaaacaccttatttaataacagatagataattcattgcaaggagccaaacgtgtctctacatcaattatttcagtaactaatattcctttcaattcaatcaatctgaaggtgtgattagatgtgtggctttgctgacacagacagtaccctaggccggctcatcccagcaccagctcacaccctgcacgcggggccacggcttccccagctttgtgacacgctgactatagttggcaacctactttacacgcaagttacagtcattgcagggttttaaatacttttttccttcacttttagaaggagccatcatataaatatatgagaaaatgatagaatataggtgttcctatctccagccacccccatgcgaaaaattaaactgatcataccattggggattttgaatcaaattcaaaagaggaagttagtggtttcaaagcaaaaaatttgtcataaatataacttcccaaggttattagtaactttaaaatgttggaagttgagaggaaattccgtaaagagcatgtaacctcattctgagacaagcataatcacctctcgtctttcctcgatatttaagcctccgtcattttcttcgggagagcaagcacccacaccctttcccagccacctgctttcctcccctccatttcattctctcttcgcctctgtttctgacctggactctacactttctcagccctgctcacctcctctcctccctaaatattcttatcaacaggagatcaatccaccaaaattaaaggtaactgcatcttgagtgtggtttattgcatgtcttcaatgagcttaattagtaagatgtatgcattcagatttgcgccctctcacaagacctacgaagttacataaatactgattgctaacttttaacatcatgggcgtggcctctatccaaacatttaaaagacatatttgcatagcagctatacccagattgaggagaaaaacaaattaaaatgtatatcataataagaagtaatgatgagattgttttcagttggccgtcagcatgagaagcatcacatttaaggtatcttagctcagtgcctgccattctccatcacctctcagtggactcattgtctcccgtcatttcccaccgatcggcaggttcagcagagcctggagacaggatgatctttggcattgactgtcttgagccttgttcttccacaaaagtgacgtaaattcatgaggatgtgggaaggatcatccttttgtagcacttcacaaagcatccatctctgagacttgcaggctgacagttccgctggtatttaacctaaagatactatttttaaaaaattattttaacaaaattaatgactggccttggaaagagatttaatgacaaccacagcatgaaattagtccatcactgaaatgttttccttctatgttcagaatgatcctaaaacattttcctttggaaaaaaggtgacagacttcaaacaatagctcaccctcacattcagtcttttgaatgtgaaatgagagcctctgcacataagtaaaaatttagggctctaatacagctaaggttctgtattaggaagtgccatttatacaatctcaaaaccactaccaccaaacccattcgctgacatagtctatctatgtgctcctgttaggcgtgaaaggaactttgtaaaaaatgaaacactttaattgcttttgctctttgaggttttttttcttagctggcagaaaataattaggaaatgttttaaataatgccactttatatgatgcctaaggctaagaatttctctttttttctcttctgtctgtggttttatttttaaggccaaggtatttatttcttgtctttttttttaacttgttcttcggtttttaagcttagtcaataagagggaaagtagccttagaatctgagttctctaatttggaaagacggaggacgcaccatcgtagcatcaggacaaagccaggatttaaaaaggtttactcttctgcaagaacaaaattcttctcgtatattctttaagtttccgttgtttgcagaatgacatgagagaatggaggtattcacaataactatgttttaaaagaatattttaatgaccacatgagatacttctgactaactccagcaaatcaaagtgattttctctgttttatctcctatttaggaggaaatctcaatttttgaatctcccactgagtttttttaaaccttataaatctattttgtagtcattgaaagaatatattcactgaagttatttgtgcttgtaaatttaagtacaaattgaatcaactcgtaattttaggccattatagtttaattctgcatctgacccagttacaaactctgccaatctgagtccgaagcctttttatttcttccatttcaagaatgctgatgctcattgtaaagaaaagaaataacccagcactgaaagcaaagagaaaataaactcttagtaatgttttaatgacatagtatagcacgcatgaaatcattgtaataacatttttatcaaccccatcaaccattgtttagttaactcatgttaagtcagtgcaatttcattctttaaagtgttttctaagacaatgacaatctccataaaagtaaatgcaatccagaatcttccataaacgtaaaagttcctaccactttatagattacagatgactgaaagatacataaattatgtttaatgtataaatctgaatccaatatttcccccagtcttctgagcatctgcttttaaaataatgattttttcataacaaaaaatagtataaattggctgggcacggtggctcatgcctgtaatcccagcactttgagaggccaaggtgggtggatcacaaggtcaggagttcaagaccagcctggccaagatggtgaaaccccgtctctaccaaaaatacaaaaattagccggacgtggtgacaggtgcctgtaatcccagctactcggaagggtgaggcagagaattgcttgaacccgggaggcagaggttgcagtgagccgagaccgtgccactgcactccagcctggcaacagagcgagactccatctcaaaaaaaatagtataaatctcagctcctctataagctgagcctccatttccatccgagagactattttgcaagagacttgccgcatgtggtctcaagttgcagcggaagctctgtgaggagagtgagaggctcttttttaggtttcttccaagtaactcagtggttgtggtcccaccaggaagtctcgtcaccctaaagcagtcccatcagaaggggatccccggcgcacggttttcaacatgaaatcaggccctgatttttcctaatatgttcacgtgctctttccagctgttatgatccacatcattctaaaagctaaatggggttattttttttctctaagagctctgatatgcattgaacccctgtattagtcaagactgggataagcacagtcccagaaaactcaaaataattatagcttaaacaacgtagaaatatattgctcttacacataaatgaagggtgtccgggactggtatggtggccccgcagtcatcagagaacccaggagtttccatctgatgtgggctcatcgccatcctcagagagaagcttccgctatgggtcccaggtggcagctcgagtagttcccttctcacacgaaccagcaggaaggagaaaagatgggagattacaccttctcccttgaaggccaagtcccagaattgcatatatcccctcggtctcagcttatgacatgagtacatccagctacaagtcaggaaatgtggtctttatccagaatggccatgtgcctacccaacagcctggccccattactgaggaccaagaagagaatggatgtggagagcatcaagcatcgtctgccacgacacttaagcaacggtgccaaacacatttcatcccgagaggctggggatttgaggtcaatcattactgagaattaggaaaacttttctaaatgagagttgagaaaaccacatgcttttatttaagcgtgttttattcctccggaagttctcttaagccagatcaaataccaggcagtacactgccagatcctgtccgctattggaaggaaaataaaacctacacaaaagaaggtcagcttactcactgtcatatgaaagatcttactctgaaaataaaaaaaaaacaccaaaacagtccagcccacaggttggcacttcagtagttcatcaaatttcaccatgtttccccccaaaaaggccttattttcttcttatgtgttagaaaattttgcctccaacaaatgtctgatacagtccatgaaatttgacaggcattaagccaaattctcctctatctcaccttgcatcccttcaataagatgaaaaagcagggcaggtttgagagcatcttgaacccaattgctaagcattctatgaaagacataacatttcttggccgggcgcagtggctgacacctgtaatcccagcactttgggagcccgaggcaggcagatcacttgaggtcaggagttcaagaccagcctgaccaacatggtgaaatcctgtctctactaaaaatacaaaaattagctgggcctggtggcgggtgcctgtgatcccagctactcgggaggctgagacaagagaatcgctcgaacccgggagatggaggttgcagtgagccgagactgtgccattgcactccagcctgggcgacagagccagactccgtctcaaaaaaataaaagacaaaaaaagatataacatttcttatatgttcttggcctcttccctatgccagctttcctctgtgaacctttttctgctgtgcctgtgggtgccatgttaagatggcagctggtgcctgtggtgtggaaactgtataagcagctggagaagctgtggaccctccctgccctgctgttgtgcaggagtttggcatgctgtgtgtgcatggaaaaagccagccaggaaagctcctcctgaagtctgtgtgacgaagatgagagctaactaacttcttgtacattttccaggctgacgtaaaaagcgagatatgtgtcctgggtaagcctcctcgtagcccagtgatgtctaggagattctgcggctcacctgtcagagggctcagcggttcccacagggtagggtcagcatgcccccactttgtggcaggcatcctggccacctcccccgcccccagggctggctcttccttagttgtctttgctgtgaactggccttaaagtgaggctggagacaccctgaagatgaagcgaccacctggtgatgtgcttcccttttaggtgtgtgtgaggtttccaaactccacaaagacatggtcagattctctactctacaaataagagtgtcgtgtgttttgtggtctacatctgtctcatggttctacactaaatcactgctttctagtcaccgtttctcctgcaaagaaaaaactgttgccaagcatctacagtgccgaactcacacacttccggtcatgtttgcttctgtgtcattcaatttggattttttttaaatccatgattcttgtctaacatcttctgtttctctggtgatgtgcactacatcctctcagtctgccttttgtccccatactgctgtctggattctatccacttcctatttcttgccagctctgattgaacttaaaggtcaaattactttcccttagctacttcgttccatagtatctacagtactttaaaatacatggactctaaatggtacttactatcaattctaaggaatgcagccaaggagtttggaaattttcatctggacataagtcaggattcctttcctcatttctgttttaatggacccggattcaaccttgactggcctatcgcatggccgtgcttctgcatttcaagaagttctcaagggcttgatttcacagaagtcttcattttttatttctaaagaaaagtcgatattattctgcattcatgccactttgtgctttttgcattgcataggaagacctcattttgttgctgaggcagagctttgtgttgccatagagacagaaatgccaatttgtagagactcttagactcccccgaatggccttccagagccaaagcaaaacataagcttcttttgcagtgaaaaggacccatctataaccctcctgtgggtccacgagatggtatgcttgtgttccccttaaggttttttttttattttttgcctgatttttacattatgtatttgtatgtcagattacacgtgtgtttgtgtgaaccataaatattctatttttttagatttatgcaaagttgtgttttaccttcataatttaagaaggaaaaataagcctctagaaacataaacgtggtattattaggagaatttcatcgaattctggtgggcaaatatgacaactaatattttataaaaaaagataaaaacactttagcactgcttatattgctttcagagatttttttgcattagtgtttaaagtaacagtcaatccttctttaagaattatttgatactaaatatagctaatcctccagagataactgcagaagctttgataaattagacggcttttcaacagactgtagctcactaagatcggaaagtatatattttactgatgttacagactccatgatgtttcaaaccagcttccttatgaacagcaacttgtgattggttctggctttggaaattagcatgtgtttaaaacttgtctcttttgtatccgtttttgacaacattaaaaaatagctacagaaaaatacttacatagtcagggctacagaaaaaaatacatatttaggatacgatgaaaaccgcagcatgcttcactggatttttctcttgttctactcttaagattcatcaaggaaatataagcataatataattcttgttcaaaatgcccagcacagtgattgtaatgtgtcagttgaaagccatctttctaggttcagctcatgtaagcctctctgaatgtcacaagtgtatattgttctatatttatcttaaaactgctaagaagttaggggaaatggaaatgcctgcacagatagtcaaaatagaaatggacacggaccaaaaatgctggtggctttacaagggatgctttctcaaaaatttaaaacgtggggagggaagaacatggttaggaaaacagatgactgtctattccacatcactctgcggcctttaaaataggcttttaaaatttttccagccttgggaacttggataaaaaggggcagataaagcagaaacaactctcagcttgttgctgccattgctcaccactaggtggcgacagagtgcagctgcattacaaatctctgcttaagcgacttgccatttgagttacatcaccaaggggaaagggcgaaagacagtctccccagataatctatttacatcaccttataggacatttgcacctacctcagcgtcaaaattaagatgctgattttagccaaggtaggccaagtagtccatcatagtaatctttcatgcaatagcgtgcacatcgaaattaccattttgtttctttttctgtttgttttttacctatttgtcgtattaagaaattatccagtatctttgggttttggtttaccattctgcaaaatggagttgaattgtaaccattatttttttttacgtgaccgagacacatgagaattaaccaatcaatgtcagtgtcccagctctctgtgtaaaactgatgacggacacctttacacagcagaggaaatacatctgtggaaatgtgtatccttcatggaatccctgaggggacccgattaaccctcatcttgtccaactcattgatttcagagatagggaagctgaggcatccccaaggttatatggtgcttaacgcccaaaacagaaagacgcagatgagccgtcttagataactgttcttgctactcattccctactagtcaaatgcctttaaaataaactatttcaagtactgtaattagtcagctttcctcaaaactgtctcctagttatccacattaacatggaggtgattcttgttaaaggtaagctttgaaaagttctaaaactcgccattataagacacacacaacttctctgctacgaaaagtcttgattgattctggcctcaggatgtgaacagtatagaaaactgatgatttgtgtgtaaaaagaggggcagggtttgaaagatatgaaggaagggaaaagagaaattgggaaacaggtaaaagcaaggacgggggccgggcgcagtgactcacgcctgtaatcccagcactttaggaggccaaggcgggaagatcacaaggtcaggagatcgagaccatcctggctaacatggtgaaaccctgtctctactaaaaatacaaaaattagctgggcacggtggtgcgtgcctgtagtcccagctactcgggaggctgaggcaggagaatcgcttgaacccgggaggcagaggttgcagtgagccaagatcacaccactgacctctagcctggtggcagagtgagactccatctcaaaaaaaaaaaaaaaaaaaaaaagcaaggacggtgctggctgccccacacaggaacatacgttctccagccatggacgtgggatccaggaagctgcaggtttgcagcaatcaccaaattttcataatggtcaatgggacagttcagttaaatgattgatgaggtgggttgagttaaaggaattaaactagtagaattataatgatgataactaaaaagggatatacggactttaaaagttgattgttttacattaatgaacaatttgatttttaaagtggtattcacattttaacaaaagagcaatgaaatgaaactaaccagttttacaaagcattggatgccatgatgtagaagttgaaacttttactcaattttaaaatattaaaatggtttaaatgtgtgaaaacagggatgccaattttagagcataatgaaatatattttacacaacattttctcttaagacaagaataaataatattttcttattcataactttattatgcactgcaaatggtgctatgattgttttggggaaagagtagtagctatcttggtatatgatatgcagtctggcatattagacattttcaagttacttttgagtacagtatttttcagtgactaacatgtacattctcaaaatcatatggctttaatgcatactctttggccagaagttttactcctgggaatatattctaaagaatagttcaaaagaagaaaatagctctttgcataaaaaatgtgtatagcattgctgtttatgatagcaaaaaaaaaaagactagaccaattctaacttcaaaactaaaaaaaaaagagaggaatggttaagaaaactatgatatgtagacacacgtgggagaacattattctgcagacatttgaaataagaaagaagactgagaaaaaaagactggaaagttattacaaaataatattaatggcaattgatgtatacaaatcttacttctgcatgaaagttttatacatatataaagttttattggactggaagagaacttgaaataggtaatatgatacaggcttatcaatgacttacaattaccatcttatatatttaaattgatttaataatatcttgaattaaatgacctttaagatggttggaaaactggttagtcataatttttcttaaaatatgaatatcttccaattttaataatagatacatcattagtagtcatattgatttacaggagtaaactatttcactcttaagtcataattgtgtgcagtaattcttacgcactctagttttaaatattctatccacagactgttgagtgaaatttctaagaacactgttaataaaggtttccagttaaccgagtcagagcttacagttttagtactgtgagtacctagtcttatgctagatagacaagtaggatagaaagggggtggataaagaatttaggaagtgggtgaatcattgactcgtagactgaaaggaacctcagaattatccatccaagcttggatcagtggggtttctatggacaattggcagcaagagatttcagcctatcagtaatccactcataactatggaaatctaagaactggtcccaaagtctaaggacatggatctaatagctatttcagtagtcatcaaacagtcacttatataattgccatgcaaattctgattttaccctgtagctatcatttagaagcaaatgcttttgaaatggattatgaatgatttgtttgcatttctcccctaaaaggtaaagtttaggtagtcaatataaattacactgagtttatatattcaacaaacatgttaactttcattcactgaaaatattaatgtgggtatatgggatgctaaggcttgtcatttccaatattataagtatctattacagatactggtcttgatgcttagtttaaaaagaaaagaaactcttttgagagttcagtgcactggaaatttctaccaatgtttctcttctaaggtaaaatgttacatgttacccggatattgttcgttgcattccaaagttctgttttctctttttaaaaatgcatgttttctctccacattgagaacagaaaatgttaattcaaatgtagcatgggatgtctgcctattgatattttcctctgtgctgtatgtgaaaatgttgtctgtgaaggaaagattgaaagaatgagtgtggatactttgctgttaaactaaatgtggtttattttctgcttgtttgagaaaacgctggagaataaggttgtatgaaggtgtctatatttcctattctagtggtttgccgtctatgttcttgccttattcctggcctttgaaaaatcaatgggaccaaaccctgacttttccttaaagcttgagcagactagattgtagacatgttcaaaacatttgaccttgcttattttgctttaatttaaagctccctttaaatattttaattattaatcctgcagaaagcttttatttggtttttttcttcctcttggttttttacaacaggaaatattaaatgtcaagaaaagtaccatgccattatccaaattatcttttaattagtaccagtttaaacattgattacattgaaaatcatttcatttcagccacagcgtcctgtgtttactcatgaaaatattcaaggtgggggggaaccgtaagtattcttcttatcttctaaatttgagactaaccttgacccacaaaatggacaactgtaccaaaatgtaagatgtatggctttgcacgtgaaagatcaaactaacatgaggcctcttaaattacgagaaattgtaatagtctctccatcttttatgacagtgaccagaaactaatttttaaaagaacccatagttctctgagaagattttaattgacacactaggaaaacttcccaatgcttcagtgattcctaagatggataactctgtctccctctctgctctgctggctgtgtaacgagtaactgcgagcttcaaagacatacagaacatgttctaaccttacttttacacccactgggagacggtaaaagtggacctcagtgtaaaaaagacctaaagcgatcattccatcattccaaagttacatgcttagaagggtcatttgaaaagggcagtattaaaacactcactgttattcagttacatgcgattacttccacagcaccaggaaaatgccttttcaaactttcctttcaaattccttctcctttctgatacatgagttaaatcagcctgaaggtgtcacacgttgtcttgaagattctctctgtgtgtttctttttcgggcccattttgtccctgagagacgttcaggagttatcagcttcctgttggcctctgcccacactgtgagtcgagagtgagacccctgggaaggcttattcatggacctaaccccttgtcccccatatctgagcacacactggggatcctgacccactgcccacactctgctcacctggagcagaacaggctaacaatagcctcctccttgcggcaggtcctggcatatgacctggtgcctttatcaccatcaagtccttccttgctcctcacagacctgaaacttagcaaaaagcagctccggatgagactggctctcacagagcacaggcagaaaagtgttcttgttgcgggaaagtctgtattttggaaagaacaggttagcagtgataatcatttgaaatctcactgaaggttaggtgcagtcactatgcctgaaatcccagcactttggaaggccaaaacccaggagttcaagaccagcctggacaacatagcaaaacaccatctctacaaaaataaaaataaaaaattagtcaggtgtgatggcatgcgcctgtagtcccagctgcttagtaggctgaggtgggaagatcacttgggccagggagatcaaggctacaataagccatgatgatggccctgcactccagcctgggcaacagagcaagaccctgtctcaaacaaacaaacaaacaaaaagatcgcttaactggaaaacactaaatacgacttgtcattctaaagcttttgtttgttctcttatttacccaaacgatgataagatcacatgataaaaaataaattccagggctgtttaggtttattgcattaccaacatgttatattaaacagctttcaaagtgtttatgaatgaaagatatgttacattttcaaagtcctgatttgtatattagaaaacattgtttattaaatttatatttgattatagcctgaattagtgggattttagggtgttgcttagttgctttcatttaaaaataagttttgagccaaagtaggaacataatgttatgtcactacaattcagagttttagtgaaatatgttctagaaaaagttgcaagttatcgagagggcttccagtctggctcagcatttcctgtttaaaagacacctttctttttgaggcatccttaccccaccaccatcactcacctcaccaacacatctttcacaacagcattttttaacattggatttgtcttcatttcccattgtgcaacactggctttgaaagccaggagaggcaggaggatttcctgaaggtgtgtttacgtttccataaaactccgtgggttttcttttgttttgtttttgtttctgtggtctaattaaaccagaatggtaaataaatttggacaaacatgctggctttcatcagacaaaaatgaagcaggagtctgtgccaattttgttgcgttagctctgagaccttgagattctttccagcagctgaggtttgcagccttaggtaaccggtctccatgagtgggtggagatgagcctgggcagggttcaagcctgagaagctcaataaaagaatcagttttcccaaagtgagaaatgccgtgtgtatccatcaaaacagcagcccaggaaccaccatctctctcaaatgtgaaactggaaaagggaccgtgaactttccccacagatacacaaaagataccaccccttcacctgagcagcctccaaatcaaattctttacacaagcaacaaaataaatggactacccctagcaaagctggccacatgcaaacatccaaatcaggtgacgtttctgtattccacacctgcctgtctttttggccactactctgggatgctagctgcctttctctgcccttccccataatcacaaacccctctctcaagaaaaggcctcagaagcccatgctcaaaaggatataagtggctgtaaggtctactggaaggatgaagttttaacaggagaagaagcctctaatgttgaaatttcaggctttggtgccaggccagggaaaacaatattttctaggggatgttgttaggcattctctgaagccaactctatccagctcccccagtccaaatgctggatgaacggggggaagccagtaggtcactgttgcttattaatgacataagatttgagtttaaatgatagaatagttttgttctaccaaaatattattttctgactcataaagtaattaaaaataaatcattcttgttccggagcggtagtcaagattatcaacttttttaagttggcatgaaaaaatctaaaataccctagaaagtggtaattattttctcacattagcagaatgacatgactgttacagaaagcagcagaaacaaattcccaatttttaaaaaccccctcacagtactggtaatattttagtactattatgaagaagttttcatgttaactgcctatcaaattcttcttgaccttctcagctacagtaatttcgccttcattttccaaaaacaccagcccatgttactatttattataatgtatggtgttttcttaccacaaattcagtgtctgaattcattattgatcaatttccaccacagtatatgctgtcaaagaattcaggccgggaaaggaaagtgatagcattctatcaataattcttttttatataaaattatttcaagagagagttttaaaatcaaatacaatttttctgggactcattttaaaaagagacttatgtccatagtctgcttgaaatggaatcagtaataactgcacatagaatacatctactcaacttcataggctaattacatcaaatcttccaattctacatcctcagaaaacactgatccaaaccataacattaaactgatctaaagaattcctcttagtaaaaaaaataattttcctttgtatagtaattcacacagagtgattaaaaagacatgtctgacacattttgtctatctccatttagaacctttgaaaattcaattctcaagcccccattatttgcttctgattatggctagctaaaattgtgattccttcttgtttttaaacagttaaataatacaaatatcacttattttatattttgtactattatttaatgtctaaatgatagacgttagatggctggacaactgaaatgcgggtctgacttatacatgttgacatattttaatccaatttatgaatgttacaattttcatggatattcctcgtgagtttcaaaatgttgttagagtgttctaatgcctgtgaagatctacatattgctatgtacctgcttaccaggcttgtaccatccaatagaatgctatttacatgcttaccaggcttgtaccacccaacagaatgttgttaagaataggaatgttaaaggaagaatgaatattgttctatcttctatatttcatgaaggtgtcaagatgtttttaaacacattcccttgtcctgtttaaggtttcaggctctgtataactatactcccaggaatgaagatgagctggagctcagagaaagtgatgtcattgatgtcatggaaaagtgtgatgacggctggtttgtgggtatgtgcgcttcttcctcaggcaccttcggctattttgtaatttgcttgagtttgctcactcccgtggtttgctgtgatggccgagcttcctttgaattcgtaatgcctttgatctttcagacattcatatgcacaatgtaatcccaaggctattgcatttttaatatagtttagtattcactgcttcagctatgtgtgattttctgcgagctttatttccaactcaactgagagaagacaatttctttaaatagcaaaaaccaggaaagattgagatctaagaacaacaacaacaaatggtccccagaagagaaatatcaacgctctgtgctgtggaaaatgttagttgtccacagtgagaatctaatttcagagggagtgagattaagtgaacagctctcccgtttcctaggtctgacgtagatgcccgaacattcagtgactcaccttaactttagtttgtggtggaagcagagagacgttccattcttcccacttaaaaggcaacttcatctttaccatcctaaaaaaaaagacgagaggtcttctgggaaaacatttgtagacaaaagtattttacactgggccacagaaagaggtgaaaaggaaacacaggctgcagggcagagaatggaagagaggaaaggtgagaggagaggagggctcactctagacatccatcggtggcaaaatcatgaaagaattgaggccctggtgcggccacaagcctctgattttatttccattaaaagaagaaaaaaaggccgggtgcggtggctcatgcctgtaattctagcactttgggaggccgaggcgggtggattacctgaggccaggagttcgaggccagcctggtcaacatggtgaaaccccgtatctaccaaaagtacaataatcagctgggcttggtggcaggtgcctgtaatcccagccactcaggaggctaaggcaggagaattgcttgaacccaagaggcagaggttgcagtgagccgagatcatgccactgcactccagcctgggcgacaagagcgaaactccatctcaaaaacaaggaggaggaggaggagggaggaggaggagggaggagaaacgtaaaatggcttgcctagccaaggaaaaagaaaaacagccatcaaaccaaggcagtaagtgccaggatataggagacagatgaagcttgagagacccttatccggtccatctgcgctgcctaaagaagaatttagcaatttagtgcaccaacttttacaagaagtgtccaaggaattacattatttgaaaccagaggcgaacataattatgatagccatttgtgcgtgtggttaaacacacaccatgttaaaaatcatgccactgatagaactcccacacacaaatagtgcttaatcctttttttcattaatgatttgtaaattgttgaaaaattgtatactcgatgaaggactctggcagtgctgtttttaaataaatgatgtggcactgaccatgatcttctgtaagatgataaaactgttggaacagcgacagcctgccacagatgatgtcttcatgtcgcacctgtgttgcgcgggttgctggtccctgagaagctttgctcttaggattttccactcaccctgtcacctgtcagcctcgccttgatccctcacccccgactctggtgtggcagcctcagtgactgagctcctccgcccccctcctcagcagggctgactttccctttagcttgggaggctcagcatttctgtttagcctgccgcgatggcagcgcagcatttatgccggaggggcagtgagagcgtcaggcaaccagctaacactgcttattttgtctgcctatgggcttcatgtgagttgcctgccttcttttccaaacccctcggggcttgctgtcttccgaggccttgtaaatgggaagtattcaagcccatgtgtatgaactgatatcgttgtcacccccctttcatgactcgcttctattttcagggacctcaagaagaaccaaattctttggtactttccccggaaactacgtcaagaggctgtgaattgcgctccctccttctgtagaggccgcctgccagccatgcacctgcgtcaacgcgcctgaaacaccccgcgggcctcccgttgtcatgccttacggtttccaatgcgccgtcaccatctccacctgccaccaaaccaccagcagagtagccgccgctgctgtgagcctggggacgacatggcaggctggtccccctccgtgaaagtgtggattcctacttcctgctctaagctttgacacgtcaaaatgtgggatcagaaagaaaaaaatcatgatatttaaaaatggtcaaatatttgaggcaaaaaaaaaaaaaaaaagtgtctccaggaggctgtccagcctcgtggctccatttcaacatctccccccaggcgatgttctcccccaagacgaccagaaaattgtttattggggaatgctgtggtttgcattttcatattcttcgcttggcagtgtgtattcttttcacaagtttgcctagtgtcttggtttacacaatatgacaactgtaactgtactttagctattgtttgcctgcacatacatgttgtaatatgcacagtgattacaacctttaaagcaagaggaggcgagttaatttggatgagtgtgatttt

SEQ ID NO: 36573 - DNA, 4696 bp, Homo sapiens
gcgtcccggaagcgcccgcggggccgggtgcgatggcggcggtggctgcgttgcagctggggctgcgggcggcggggctgggacgggtgagcgccgggtgcggggtgcggggtgcggggtgcggggtgcggggtgcggggcgcggggaggggtcccggagctcagcccgcccgtccgtgtccgcaggccccggccagcgccgcctggaggagcgtcctcagggtctccccgcgcccaggtgagggctgcaggccgggctgtgatccaggcgcctgggcagagccacctgctgtctgccctgcactttgaagggttgtcgtggggattgaaatgaaccaactgccggctgagcggaggctccctgggagtgacaagttccgtattaaaatgctttcagtggaattgtggtcgtgtgccgggcatgtagcgagcgctttgtcctcacaacgcgagaggtagctccttggtcgttcccctgttacagagaaggctcgagagttacttccgaacgtcccatccagctaatgggtggccagcccaggctgaaagcccagggctctgaaagtaaagcgtatctaaccaccgcggcttacgtgttcctctcagtgtgcagcacagggctgttttgccgtgtgtagagtgctgtgcaagcctgccccaggcctgcctttttataaaaaaaaaaaaaaaaatagtatccgcaaggcccctggtgcttttcagcggatggaactcatcctctgagagcttaaaggcactttctgtgtacattcttccctctttacatttacgatgagttgtaaaaatggaaagctgttaagagagctctgtgagccattactgaattgatatatttttctacataacacaataaccactagtgcctgactaagctacttagtaactgtagctgcttattttttattttttgagacagtttcgctcttgttgcccaggctggagtgcagtggcgcaatctcggcttacagcaaccacctcctcccaggttcaagcgattctcctgcctcagcctcccgagtagctgggattacagaagcaccatcgtgctcagctaatttttgcatttttttgtagagatggggtttctgcatgttggtcaggctggtctcgaactcctgatctcgtgatccgcccgccttggcctcccaaagtgctgggattacaggcgtgagccaccgtgcccggccaactgtagctgcttattaaatgcattttgaatggatgaatggtgcatcttagtgcagtggaatacatctagattcttgagtaaaaaggcatgagttactcagggtcgtggttggtggtcaaaccggcactgagccctagatcccacttactcacttggcagacgtactgtgtgtgccttgttctgggcaccgggttaggagctgggctggatacaggtgctgctagttggctctaggcagcaggttttgattggcagtactggagtctgtcttggaacgggctgctccaggtctgtgttcgagggcttctggctccatgtcagtgttgtgaaactctccaggggtggcctggaggccaagcagatgtggcagttctgcagcagaagcatctgccacaaaagcggaagatgactcctttcttcagtgggtcctgctcctcatccctgtgactgcctttggcttggggacatggcaggtaaagaccggcatctggtgtgcgtaactctgggcccttgaccttgctgccatctgcttggccttatgctctgtcactgtaggtccagcgtcggaagtggaagctgaacctgattgcagagttggagtccagagttctggctgagcctgtccctctgccagccgagtgagtgcatggctgcccccctagggcctgttttacttgagttcaacagcagagccctggcttctgctggccagcttgccccttttggtgggacttttagtcactgccttgacctcaggtgggagctctcattatcagtcatctgttgggcttgctgttgacacctgactgcccttgtgaagctacctgagaccgcctcctgacatatggaggaaagtcttattttgagtcctgggtgtcacccttttttcaggtatagtaaacttatcctccacagggcccaaggccctgtggctgagggcagataatgtaggtctcaccgtgagggtggtcgtttgaaaaagtgccctgaatgatttgtctgctctctccctagaatatgccctacagagataggtatattcagccacattttccattcagggtagcaaacagtatgccagatttggcttgcagatggggttttggcccacatattttttaaaatttcacataaaatattcattgaggagtccagatttttagcctctcttgtaaagttggactctggcagtgcagatccacattcccacatggcatcaaagttcccctttgaagagcacgccctttgcctttctccttcacttgtctggccctggtgggctgtgtagtctgccaccctcaggggattcgttttccagccaaaccttgctcggccactgttcttatctccatgcagcccaatggaactgaaaaatctggagtataggccagtgaaggtcagggggtgctttgaccattccaaggagctgtatatgatgccccggaccatggtggaccctgtccgggaggcccgggagggcggcctcatctcctcctcaactcagagtggggcctatgtggtcactcccttccactgcaccgacctggggtgagtaggacatgtgggagctggctgtcctggcagaggcagtcagggtatactaatttacatcactatttccttcacaatccccaaccttggtaggaccctggggaacccaagatacccaggagattcaattccttgcatagtttaagtccctaattgtgacattgacttaatcttctcagccagctcatttatgactggataatttctgtatgttgacctctgaagggaaaggagggattcgtgaaacaggggccctgcctctggagaactgtctagttgcccacacattagatgatggcaagctatgaggggccagcaagaggacttcaagagaaaggaccccagccctaccttgagggagtggaggcaggggtggctccctagagggctatttgggagttaagagatgggaagaacattccaggcaaagcaaatgacaggtacaggagcacctgtgtgattaactagggaactggaggattcacgtaaaaatgaaaatacctggggctcttgttaacccatgggttcctgttttagggctgggatggggcccaagtactcatctccagcaggctggggtgccagggctgctcctcacggctgccttggttaggaggagggattggagacagctcttgccatagttcaggggagaggtgtggggtctaaactctggcgtggcagcgttgctcaccagttgcacgttgtagtaggtagaccacaagaagcagagatagaaggggaaagccacactggtaaaaaggtagtgatggtggcagggagccttttaccaaccacgaaggtgcctcaagagaggaagactttgcctgtgtggcactgccagggctccactgagccagccctgttttaaaagccttccttggtgctctagttgttcctatgggtgcctgagtgaccatgagtgactgtctttagtcaaaaaccctccccacctgaagtagcactttcattaccctagagtcaccatcctggtaaatagagggttcgttcccaggaagaaagtgaatcctgaaacccggcagaaaggccaggtaagggacatggactcttcctactttagagaaggctctgggagtccaccaggctccatgcaatctcacacaccttcctttatagattgagggagaagtggacctcattgggatggtgaggctgacagaaaccaggcagccttttgtccctgagaacaatccagaaaggaaccactggcattatcgagacctggaagctatggccagaatcacaggcgcagagcccatcttcattgatgccaacttccgtacgttgtggaccagcccatctcggaacaagtagcttttgtgaatactgtccttcctcctaaccctcattgcccagtcactactgtggcttatgttctcacatgtgtatatggcgggtgggaggaggcagcaactcagcaaagaacctaggcaagtactgagcggacaagggcggggatggtcacccaacgtaaaggccatacaggacttccaactggccacgcaaaaatgacagccactaggaagtggtgcagaggctggcaggccagtagggggtggacttgagtctgctgtctccacagagagcacagtccctggaggacccattggagggcaaaccagagttactctgaggaacgagcatctgcagtacatcgtgacctggtgagtccccagcggccctctggcttcctccccttcagcctagcagcctgctaatgctggcttgctttcaacccctaggtatggactctctgcagctacatcctacctgtggtttaagaaattcctacgtgggacacctggtgtgtgacagatcagctgctgaagccctgtccctggataatgcagtatttcaagactgcctttatgctggatcatgtgctactggtataaagttctggccttctacctt

SEQ ID NO: 36574 - DNA, 11936 bp, Homo sapiens
agacactgcccgctctccgggactgccgcgccgctccccgttgccttccaggactgagaaaggggaaagggaagggtgccacgtccgagcagccgccttgactggggaagggtctgaatcccacccttggcattgcttggtggagactgagatacccgtgctccgctcgcctccttggttgaagatttctccttccctcacgtgatttgagccccgtttttattttctgtgagccacgtcctcctcgagcggggtcaatctggcaaaaggagtgatgcgcttcgcctggaccgtgctcctgctcgggcctttgcagctctgcgcgctagtgcactgcgcccctcccgccgccggccaacagcagcccccgcgcgagccgccggcggctccgggcgcctggcgccagcagatccaatgggagaacaacgggcaggtgttcagcttgctgagcctgggctcacagtaccagcctcagcgccgccgggacccgggcgccgccgtccctggtgcagccaacgcctccgcccagcagccccgcactccgatcctgctgatccgcgacaaccgcaccgccgcggcgcgaacgcggacggccggctcatctggagtcaccgctggccgccccaggcccaccgcccgtcactggttccaagctggctactcgacatctagagcccgcgaagctggcgcctcgcgcgcggagaaccagacagcgccgggagaagttcctgcgctcagtaacctgcggccgcccagccgcgtggacggcatggtgggcgacgacccttacaacccctacaagtactctgacgacaacccttattacaactactacgatacttatgaaaggcccagacctgggggcaggtaccggcccggatacggcactggctacttccagtacggtaagtacccccaagtccgctggaagcacccgtgcacctggtccccagctatgtggcttctcgacgtggctgcctgggcgcggcgggccccggtcctcgcagatccgatccctcccccacgcgcctgcagtggcagccctggaatccagtgcaaaccgcgcgtctggcccctcctgcttccttttcacattgctttgcagtcccgggcgtccccagttctcttgctgtcctccgctccactctgcagtcccggtgggcgaagggtgaggagtaagggacctagaggggtagggagttggagcggggggcgccgggttgtttcactgctgcgcccgtcgcctgctgacgtttaggtctcccagacctggtggccgacccctactacatccaggcgtccacgtacgtgcagaagatgtccatgtacaacctgagatgcgcggcggaggaaaactgtctggccaggtacgggctgatatgtctgaggccccgctccccggtctaccttcagggggcgctctggtgcctggttctgactgctactgcttcgcgcagacaagtgttaggaagtgggacaagagctgggaagtgggacgtgacctcctgggcatgctgacctggacggagagttaatatttttgaagatttctgtgggttctgtctcaaagtgcagcaggaatcacagaggtggaggaaacccttatcctggagactgaaagtctcatgctctttttccaagatacttaaacttgggagtcaattgttccaatcacttttcataaaacaactatacagtaattcaaaaaatttattgtaatggaagggtgtgttaatacccccttaaaagattcggggcaaatttgccatcgtagcctcattggtaaagactaagttttcctcttttgtttgagaccacgatgaacttggttgttttggtattacttcagccagaataagaccgtgagcaagagctttgtttttccactattctaaaataaaatagtaactctgggattggggttctctgggtttactgctgggaaacagcagagggagcaaaagatgttttaataaaaatttaaagtgtaaaataaggtcatcaataccacctgaacatatagacacactaaatatattagtaggaacacagtgatgtttatttgtacatttcttccactttgaccctttataattgtcaggctaaaggaagtgaagaaatccaagctcattttcattcctgagtcttgcatcactcacaccattgaactccctatgatgtttttacagtactgccattgttttgggatagtgaagttacaaaattattaatttaaatctgggtatgctcttttagagttatttcctcagtttgcagctcattaacttttttaaaagttttgttaagtttgaagtttgtaataaacatctatgaattattttttttattgggggattatttccacttcagtttcactcattcatatgatcaaacttgaattgattctaaagtttacttctgacatttagatttttaatgcttattatgtttttactgttaagatctgtggatttccataggtgttattcattcacttattcaccaaatattcattgagctctgactactccaagacggttctaggagctttggattcagcaatgaacaaaaagaaacaaaatgccttagactcttggaactgatagtctagttgggaaaggaggattgtcactactatataatggatgttttatttgtagttttgtctttagttaatattccatgaatataataatttttcttttttcaaaatcacagtacagcatacagggcagatgtcagagattatgatcacagggtgctgctcagatttccccaaagagtgaaaaaccaagggacatcagatttcttacccagccgaccaagatattcctgggaatggcacagttgtcatcagtaagtaaatgggcctcctgggtacttttgggttgcttttcatttctcaggtgatttttgatatcacaaatgcaagtcttatttcttacctgaagggagaaaattgctattacttatatttagaatttttctctatgtaatttcacataacccatctactacaagatcctgttatcttttgaaatggaaaatctgaagcccagcttattaaagctgttgataggatacagcaattgacttcaataaaatttactccaatgcattacagataggatttctttaaaagtccattacagccaagatcatctaaagttagttagcattaaatagcatttcataaagaccacacgttttttatcacaagcattcagaaaccattctcaaagaaagatgtagatgatacatcccatcagctcagaaggaccttcttccatcttttaaaagacctgtatcaagcccaaggtggttgccttttctatcctaaatttaaggatttttgcataaggtaattctatcatttgccttagtaacttgcctgggtgtttattttcaggaaatcctcatgtgtggccttaaacttacttcctgaaatccaagccagtcctcattgttttttccttatgtgggaagatgaacagctcagcaccttccatttaatgaaataacaaaagtagatataagtcccttaatttcctgataaaataggaatattttatttctaaataaaagtgtgtactatttaaataataatggtggataaaacatgccatgagttctcccttgcttttcactaatgattttaaatatgtgagaactcaattttttaaaatctcatagaaaccttgaaaaagtcatgtgctgcttttcggaatgaaacatcagcagtggcagccaaggggaatacactagagaacacagggcaagtttcacttaagcacagataatttattgtccatttctatttaatattcaaagacaaaatggggtacaataagaaagcaaaatactgaactaagtcttttgtcctagtagcaaagttaaaccttacaattttgatagacttatgtcctggggaaaaaaaaaccctagcatgaatctctcttttagaagataaatttggtctcaattttaatgtgaaaacaaatttgtgaagccatgggggaagtcatttaatatcttcattgctttctctgtatgtaactgaccaccatctttttgttttgtgggacatcagacattaccacagtatggatgagtttagccactatgacctgcttgatgccaacacccagaggagagtggctgaaggccacaaagcaagtttctgtcttgaagacacatcctgtgactatggctaccacaggcgatttgcatgtactgcacacacacaggtatgttggcaccctgaaatccagaacctcaagcctcagagagaaacgggtcatctaccgttagttagcattaaatagcatttcatgaagagcacacacatttttatcaaaaggatacagagactgttctcaaagaaaactgtagatgatataccccatgagtctagtattttctttcctctcacctctcttttataaagcattcaatttgaggtccatgttgttaagatgtaaaataattgggaaaaggcaaatgatggcttgatgatccaaattacttttgaagtatttccagttatgcatgtggcccctattcatgatcacaggtcagtgtgggtccttgttacagtccacaatgaagaacaaaaatttactctctgaaaaagtctgaatggttgacaacatatgcacccattctgtattccttaaccggcttagtaaataactgtaaaaaaagatatctctgttttttcacctgtgaaaccattccttccttctgttttatgctgaaaatagaatagtggttgcggttagcaaatggaggaaaaataagtttctttaaaagcactttaaaaagttgcctcttttaataatgcaaataagagcagaaggacaccatttctttctccacacatatatatttaaatctacagtataattgatgtcagatgttgtttggatggatttttttaaagtagtgctgaactaagcagtttgcatgttttatcattggaaaatgcgtgtcagttaaaatctatgtcagtatttccatatgaaaccctaatttgtaaaaggacattataatttgactcccgcccagatcttggcaaggggtagtgaatgtacataactgagggtatgaagggatcagcagttggcatcttgggaagcaaattccagggctgtggcaggaagctgtttggtgacctaaatgttaccattgcttttttctctgagcttagaacatcatagcaattggagggggaaaggttaacttctacatgccccaggacagtacttacttaagaaagaggagatgtaacttacccacacattattcatgtgtgcatatacagattcccttttcagtgatctgcaagtcctgtgcaagggacctagagtttatttgccccatttacaaaaagaggcactctggacagctcactctgaaatatttgaagctgggattgtagacattatagcacttctggttcccccccttctttggggtgaccccatttcattttatatggtagctttcttgttaatcatcttccatatatgttctttttaaccattattcaccaaatcttgcattgagcgatttatatatttgtttttttcattagatcaatgtctctttcacatggacttcatttaaaggaaaaaatagtctctcaatcacctaatgatgactcagattagtttattgtaatgctgcttaaatgtattcaagcataaaactaggtataacttctttagatttatacttttacatattaataactcttgtgttctgagacaaaaatttacatattaaatatatacgaaactaaaacagttgaattcaccttattaatttaatgtaacaaatagtatgtattgctaaaactcaaattgctgatttagagagcctcagctaacattcaacattgaatctgtttttatattttgactttgcctacatgaaatgcctatttgccttagtaactcgtttttgcttgcttgtgcaaataatcaaagcttatacttaagttctgccagcttatgaactcgagtgccaatttcagcatttttaaggctcttttgtctatttgaaggcaagataagcactgaagcattatgtaaacccatcttaaatgaatatctaatccagtgaatcctttacaatgtcatgaacattgtggtagtagtagaagtaataactagcacttattgagtatgtattatatgccagaatcagaattgtatgctggaatcagaccaaaaattcttcattttatatttactactcaacatactgttaagtgatgtatggatcaaggtaggaatctagataataacaacagaatatgagtctcactgctgtgacactgacccttctgagttgggcctgtctgtgctattgtgtgctctatgacagcacaattctcccctgctcttcccaaatcaagctacagctaaaccagcattggtagagcatgctaaggtgattttactgtctcttgggtgaccaaagtgatcttaaacagcaaagcaatattggttgctagaattgaatggcagtattgagttaaaatgaatctagcatgtactttgaatttaaattactattagaataaaaatacaagttaaaactttttgtgaagaactaatggaatcaagaatatacctacagactccaatctgaggaaacttctctagactataacattcttaaaagcaaggattgtatttgttatatttttctcctcccagcctgtagaaggcattcatttacttattgatgtgaatattttagcaagtggagtgatgtggcattcatcaatttagtcatgcatttaccccttcaacaaaatatgtcatatttcagtgactgtatgagagagagtatagtggggtagttaagaacagggactctggaccttgattacctaaactcaaaaccagcttagccacttactaggctggatacccttgggtaagttatttgatcttagtgtgccttagttttctcatctataaaatggagataatagcccctcatgtagttgtgaaaattgaatttttatacacacacacacacacacacacacacatataaatgtttacgattgttcctgccacatactatttaataaatgttagttattcaaagatacaacgtaaactctacccttagggaacttgcagcctctggttagctatattcttacatagcatgttataatgcagagcaaaaagggataaacactgtaaaagctatccacaataaaaagtatcatggacgttcaaagcacaagaaggtaatttccaaaaggggaaactggggaggatttcactgagaagaggacatttgagctaagataattattatgtggcctttattcctgaactgttaaaattctagaactttggtagaggcctattttgttccttcagattgcatttatctctggtgatatatgacacttttaagaagtgaggtgtactactacttatattagtcctgtatcttttttagctggaggtgctataaggctgagtaataaatacttctcaagggagatgaaatataagtatagttttatgtcagactcttgtaagtactaacttaaaatttaatttgcaaataatagcatattatttatcatagtctgaccacataccataattttaaattttttattttgtttatcttagggattgagtcctggctgttatgatacctatggtgcagacatagactgccagtggattgatattacagatgtaaaacctggaaactatatcctaaaggtaaagacctttgaaaatatatcatatattgatattgcagatcaataggccctcttctctggattcaaatgttaaataatcatggtattggaagcaattatacatcctcaaactatttataaacaatctaatctaatctaatctgtcttattttaaagaacttcaggggaaaatatgcagtctctttccataacgtctccagagtttaaccacttacttaagttaaaatcccttccctgcttgatttagctaagtcctcattaacaatttccttattgtagccctatggaaaaagaaatactgaggaactctttgtgttgcccaggtcagtgtaaaccccagctacctggttcctgaatctgactataccaacaatgttgtgcgctgtgacattcgctacacaggacatcatgcgtatgcctcaggctgcacaatttcaccgtaagtgttatttgcttagctaagtaattgttgtcacaaataatttttgttcatgccaaacattatacatagaatgtatctgtttctgctactacagcagctttcttgtaagcagaccaaaggcagaaaatggtatgcagtctgattttatttttttaaataatggaaggcaaaggagaatgtactaaggtttttagttttcaggagaagcttagttttcaggagaagacataaacagaccacagtgtttacccagaaggcatttgtgaaggcccaatatatcaaattgctcaatatgtagagtgggtgagcttgtagaagccccagtagttgcttcttggccccttcctcgcagtccctgaaagaattgctagggttcttcaaagtacattttgaaaaccactgccataaagtaagcaactgaagagttcagccccctctggtctgtacaaatcaagatgtcatatatttgagttctagaaccattgatactaggaaaatactctgcaaaagattgaggtgtgtggaggtttcttcataatattcctactcctgagactcttcttagaatgaaatactggaagatatctattcacagggaggtgctctgatgaaaataatgaaaaaaggttgggtaggtttgactgcatgcctgtctgtcctgccccatctccttaagcactacctccccaagtgttgctgggtgctagattataattacatatgccacttgagttatgccttcccaacaatgagaatactatttccattggaatgatactcaacactcatcagctttgctttgtcactggagaaccaccagtgccactggatcatacagacaggtatagcagagctatactagaatctcataattaatagaaatttctgcctgatacaaaaacccaggactttctacataaagaagcagagactgtgctttacaagtgttgtcacaacattagagatagatgaagcctgtgatagcaaaaggatagcactgaaaaaacagagtcacatacattcttctgaacatgcccacagcacagaaaacctggcaggttttatggcccatattgtgtggagttggttatagtagaaccaacccccgacccccaccgccagaacaccattataatttaagctaaaataatttgcacttaaataaacagattagttttttcttaatttttataattccttaatttattcatccattctccatttatttattcatttgcactctcatttttgtactgtttgttgatgccctgagctagatattactgaataatgcaaacataaataggactactaatctctatactgctgtagccttattacactattttcagttaattacttatgaatttctttgtttaatgtctgtctcctgctctactcagtgatggctgtgatttagtctcttgtccactgttgtatacccattgtcaggtacaggtctgccaccttgcagcctctcactcactgcttaatgaatttctttctcaaataatttgagtaaaggcattttgagtaggggaagtgagagaattacacatataactgtaatagagatacaatatgagaagtttcatgagggataaaataaaatgtggtgagatcagaaggacctttgctataagtttggtaactcccaactatgtcttactgacttcccactagaaataggtctggagaggtctgttgcatagaatgtctcttgcttttaatcagtagaatccattgaattgggtattgctagatatttagaagaaataaaaattgttgtattgctccagcaatatgactgtacaagagggattcctgatgtggtcactcatatagagttgaatttttttttttttttttttttttactagttattactgactgtaacaaacttcaagagtggttgaagctggaatgtttataactaatataaaccagatgaaaatatgaaaagtgaaattataattagtgatcataataaaatgtcatacttattctgagtggaaatattggggaaagtatagaatatttgagaaaaaaaccccacaccttcaggatagtaatacttgcttcttacattttgactttcacatcaggccttccttcctaggaatcagagttcagacagaggagaggtctctttgggctgagtttcaggagtgactttaggatacatttgaattgagccttgaagtctggggaatgcaccggggagcattaaggaaaggaagcccagggcaagtcaacgtcacaggcaacttgcatggcaggaggaaactgcagggcatgtttggaaaaacaagtcttctagtttggctaaagcatgaattttgtggagttacgagttggacaaaaaggatggaaaagtaagttgagccagatggaagacagccctgaagagcaggctaaaatttattctggaggcagtgggaggctgaagctttttgagcaggaagtgtaacttgcctaaggccatcaggtcagtctggtggctgtgtaagcagcagtgagtgtgactctgaagacatatcatgtatcagttcactgattgcttttcctgccagatatttaagagcattctgttgatgtgtaaaagccacccagtaaatagttgaataggtatgtgctgttaatgtaccctctctccttcattttcctcactgaaacaaaatgtacggaccaggtgactctgaggcttctttcagttataagatactatgtaagtttttttttttctcctcacagaatttactgtttggaaattggtagtttatgatttgaataagtgaattttcacttccttacatgaagatctatggtcacatttaaagacagtaatatttgattgattagctttggtccagtttctgcctattaatgtattattctacatccaaagccatgctggagaaggactaattcaagatggagcagaggccttgactctacttcttggtggacatgccacccttgttccatggaatgaattcccctggtcagggatgctggtcccagaagtcctgctgtactcttgagtgtttcagaagtggtttctttgcctctaaatgtgaagagtgtaggcatcaggcatctctgctgttgacatagtcactttcttcaaaccattattaaaatgatgtactactgcataatttcacaacatgattgctgcttaggtggagggaaactgttgcataaagtttttaaaaggttgactttaaatttgtctgttgtactcattcattatattatcaggttaataatttgtcttattttgtcttcttaatctaggtattagaaggcaaagcaaaactcccaatggataaatcagtgcctggtgttctgaagtgggaaaaaatagactaacttcagtaggatttatgtattttgaaaaagagaacagaaaacaacaaaagaatttttgtttggactgttttcaataacaaagcacataactggattttgaacgcttaagtcatcattacttgggaaatttttaatgtttattatttacatcactttgtgaattaacacagtgtttcaattctgtaattacatatttgactctttcaaagaaatccaaatttctcatgttccttttgaaattgtagtgcaaaatggtcagtattatctaaatgaatgagccaaaatgactttgaactgaaacttttctaaagtgctggaactttagtgaaacataataataatgggtttata

SEQ ID NO: 36575 - DNA, 139518 bp, Homo sapiens
cccccggcggagccagctgctgctcttcggtgctggccccggtgccggccccgttgcccagggaacaggctcccggcagcccccgcggcccggagtccatcccgcctcctccggcccggcggggccgacgagtccggaggggctgccgcgggaggtgagtccggcgacgccgcaagcggccccgacgcccccgacgcccccgacgcctggccccgagcccctcctcggcctcccccgggccactcttcccttgcctcagccccgcagggtctccatgcccgtccgccccgtctccctcgcccgcggtctcgcccgcgcggagtggcggacactaaatgccacaacacacggagcgcctggctcgccgcccgcagaatccggcggtccgcagcggggaacaggggccgcccgcccctcctcaggcctccgctgcgcgtcccgcgccctcggcccccggccccaccctgcatcccggctgccggtctggccgcgggctctgctccttcgccttaagattgacgtcgtgttctgtcccccactcgcagcccgcgtcccttacatccgcccaccggcgcctggccccaggccttgacactcatccagttggtgttcagtgttcgatgagtggataagtgaatgactcctttcccaatcctatttgaaggcatgggaggcagaataggtagtaagtgttaaaggatggggtgtcctggagtcagagccgggcaggtcccagcggccccttcctagctctgtgctggggcaagtgccctacctcactccgctccagtttcatcaccagtggaatggagatgagaatagtttctacctctggcttggtaagaggattaaatgggtcagtgcatgtaaagttaagcacggtgcctgccgctgtacatttcagtaaaggggagcccctgctgtcatctgtgctagcctgcgttctcgccctctagtcccttctgatatgtctctgacttctcatgactttagtttctccttctctacctccatttctcttccctgcacttttttcttcctctcttattgggattcaggaattttattctgttctgtgacttatgttccatgtgttggcagaatgtgggataccagcctgggtgcatccttttctcatctattggagtgaccagttgcacttgtggactgcctccttgcagccaaggtcttgtagacagagttctgggaaatctcaaaacgcaaatcccaggcataggtagaatctgggaatgaagccactgtagctccttgtgatcaccagcgattcctggtcttttaggctgcaggactttgtgttttctcacacccagctataatgtaccttgataaacctctgaccttatttttgttgttgttgttgttaacctgacttacgtcccatattggtggttatttggccatcgtgtgccagcactgtgccaggctggctctagggatgctgtggtgaaccagacagacccttcctgaggtcactgcctcagaaagatcatggtctggcccatgaactttaaaagggagaactaagtgcaggtgtaggggacacacaaattgaattttcaggactgccttggaaaaccagtggtggggaagatggaatgaggataaccctcttctgaaggagtgactaggaagtagcttttgttaggcatcagctatattatacccacgtgtctttttcaatagaagactggcatctactggatttttttttccaattttttcttaaagaagttacacttaagtttggggagaatttcatttcatattagccgctgtaggagttgaaaaaaatggctactggaacttagtgggaagaaaaggaaggaaacaggcatcaggcagaggcagttgattgaacttgggaagatgaggaatagatcaggaaagggttataatgaaaagctttggtgtcaagcacgaagagatttctagattcagtaatgcacagagagatcagtaaaattagaagggagtagttgatggctttgcgaattgctaaggtagaagggagctgttactcaagatgcatgttcaatttaaaatgaatgtattctttggacctggacataagagttctattgactttttgccactattttatatttagggctgtcatacttgggtgaatctagcacagtgctttgagagagagattcattcaacaaacgtgtattgagcattgattgtaccatactctttattggtcttttaaagcaccacaaagtatacagactagaagaacataggtgaagatgagaaagagtccattgaaggggagagaaaacagataatgatggtgctgtgcgataactgccatcatggagttctgtgaaagcagagaaagaccaaccaagtatctgagggaatttatgaaggcttcctggtggcggaggactagttcttacagggcacatgtgggggaatagggaagagtggaaagggactttgttctgcagagacatacaggttatggtgtgtgcagggactgtgatggaaagctgatggatgcacaaacaaaacgtggcctgtctacacaatggaaggctgttcagcaataaaaaggaacgaagtactgatttgtgctacaacatggaggaaccttgagaacattaggctaagtgaaagcaaccagacacaaaataccacatattatatgattcaattttgatgaaatctccagaataggcgaactgtagacagagaggagatcagtggttgcccagggctgagagaagaagcgtgtagaggggtgattgctaaagggtagggagtgcacagtgtgtggatggaagagtggcctgagatgaagttagatatagactgttttgtcatagtgtctaatttccatgcttgtgttaggctttagcttgtgaccattgggtagccaatggggatgggagcaaggaagtgacaaaattttgtctggaagataaatgactgcctcagtctcattacgttcctccttaataatttaatactcaaataattaatagatgtcgtagccagatttcaaacatagattctacaatagggatacaaattgttgcttcctagggattttggagagaatcctgaaaccattagtgtacccagagcactctgataacatggttattgtacagcgaagtggatgacttagactctatattagtcctagctccagtttgagaaatcatccatctgggtggcagttgggtgttagtagtcagcagtgaaggctagctgccaccttccagggttatgagattgacagggctagtggggaaaggaagcatcgtaacttgaaggatgccatagggtggtgttttgtatttttttaactgaaatagtcatgactaaggaagcattattcattatatttttatttatttatttatttttgagatgaaatatcactctgtcacccaggctggagtgcagtggcacgatcttggttcactgcagcctccacctcccaggttcaagtgattctcctgcctcagcctcccaagtagctgggattacaggtgtgcgccaccacacctggctaatttttgtattttttagtagagatgggtttcgccatgttggccagactggtctcgaactcctggcctcaagcaatcctcccacctcggcctcccaaagtgctgggattacaggcgtgagccatcatgcccagcccaattttaaaaattggattgagactattgttttgcagtaagacctgaagttaacaaatctttactgagcatctactctgtgccaaagctattattagatactaggatttaccttggtaagcaagagagaattcatgttgcttacattcttgtaggagagatgatttttaaatggtttagcaaataaagcaattagaggttgtaatgaggattatgaagcacatatgatagaggaaagaagggacagttgggtactcttgagtgatctggtcagagaaggcctttctgtggtggtgatatttaagctgagaccccacagttgagaagaagccagataaatggagtgagatcatttattctgcatagaggaaataattatgacacctgagtgggacagagtgggtcagtggagctagaacttggaggacaagtggagacgggtagagaggtgacaggggagctgcaaagggcttagaccacacggggcatttggtttttattcttagagcactgggcaaccagtgaggagttttgagtagaatgggtagtatggtctgatttctctttgaaggagctgatattttcctttgttttttggggggtaacagctttattgagatataatttacatgccacacagttcacccatttatatacaattcaatggtttttactgtattcacagctatgcaaccgtcactacgtcaattttagaactttctcatcaccctaaaaggaaactccgtacccttcagcaatacaccctaaccccttcttctcccagccctgggcaaccactgacctactctgcctacagcttgcctattctagacattttgtatacatggaatcatataatatatggtgttttgtgcctggttgctttcacttagcataatattctcaggattcctccgtgttgtagcatgaatcagtacttcattcctttttattgctgaacaggcttccattgtgtggatagatcacattttgtttgtccattcatcagttgatggacagttaggttgttttgacattttggctattatgagtggtgatattatgaacatttatctacaaattctttgtagatatgttatcatttctattgggcataaacctaggaatagaacttctgggtcacatggtaactctgtaaccttttgaagaactgcccactggtggctgcaccattttatttttcaccagcaatgtatacagttttttccacatccttgctaacacttgttcataccctagtgggtatgaagtggtatctccttgtggtttcgatttgcatttccctgatgagtaatggtgctgaacatctttttatgtgcttattggccttttttttttttttttttttttttttttttggaaataaagtctcgctctgttgcccaggctggagtgcagtggtgcgatcttggctcactacaacctccacctctcgggttcaggtgattcttgttccttcggcctcctgagtagctgggattacagatgtgcgccactatgcccacctaatttttgtgtttttggtagagacagggtttcaccatgttggccaggctggtcttgaactcccaacctcaggtgatccacctgcgttggcctcccaaagtgctgggattacagatgtgagccaccgtgcctggccttactgggcatttgtgtgtcttctttggagaaatgtttcttagactttgcccattgtaaaattgtcttttgttgttgttttgagatgaagtcttgctgtgttgatcaggctggtctcaaattcctgggttcaatcgatcttcccaccccagcctcccaagtagctgagactatagccacgtgccactgcacccagcttttaaaattgtctttttattattgagttataagagctctttatatattctgggtaaaatctctttatcagatatataaccaggagatattttcttccattttgtgggttttttttttttatttttgtcggtggtgtggattagatgtatttttactttcttgatggtgccctttggagcacaagcgtttttcatttcagtgaagtcaaagagctaattttgatggctgaatgagcctggcttctgggggcaggtgtggaagaccatggcagcagtgtaggcgagggatatgatagcttgtactgtggcatggccacagagttggtgaggaggcgccaggcttgagggaggcttggagatagggctgatggactgagttgagagattgttgtacgggtgagggaaacagaggaattgagggtgaatactaggatttcagcttgaacaacacttttgattcaaaatgtgattatgctgttacctgccggacaattgtgacagtttctaatacctgctggagcctagcaagggcagccctgcgctccctccctgggttctgaagttgcttttggtaggattatcactgagtgtgccaaggagatggtcagggattctgaccttttgtaatacccactaagacctcctaagccaccacaaataaacatattatctgagtagaatagtgcacttgctctgcaaatgcacttttgaggcaaatctcttgactcccttctagctagactgcagtctcaaagcccttcttgtgtagagcctgcgagctgtcagtggatagcatcaaatcaagcggatggattcttgaaagctaaatgtcatcatttgacagagctactatgaggaaaaatatttttatttttaaaaaagttttattgatcgattgatttgagatggggtcttgctctgtcacctaggctggagtgcagtggcttgatcatggctcactgcagcctcgaactcccgggctcaatggatcctccaggttcagtcgatcctccgggctcaattgattcttgtgcctcagcctcctgagtagatggtactacaggcacgcaccaccacacctggctacttttttgtattttttgtagagacagagttttgtcatgttgcccaggctgatgtcaaacccctgggctcggccaagtgcagtggctcacgcctgtaatcccagcactttgggaggccgaggcgggtggatcacaagatcaggagattgagaccatcctggctaacacggtgaaaccccgtctctactaaaaaaaacaaaaaaacaaaaaaacaaaaaattagccaggcgtggtggcaggtgcctgtagtcccagctactcaggaggctgaggcagaatggcatgaacccgggaggcggagcttgcagtgagccgagatcgcatcactgtactccagcctgggcgacagagtgagactctgtctcaaaaaaataaataaacaaacaagcaaacaaacaaacccttgggctcaagtgatctgcccacctcaacctcccaaagtactgggattacagatgtgagccactgtgcctggctgaggaataacttttttttttttgagacagagtttcgctcttgttgcccaggctggagtgcaatggcacaatcttggttcactggaacctctgcctcctgggttcaagcgattctcctgcctcagcctcctgagtagctgagattacgggcacctcccaccatgcccagctaatttttgtgttttaatagagatgaggtttcaccaagttggtcatgctggtctcaaactcctgacctcaggtgatccacccacctcaggctcccaaagtgctgggattacacgcgtgaaccaccacacccggccggtaataagatttttaaaggaggaaataacattaggcaatacttactggtgaagagctcagtacttccgcttgcttgctaggagatctcatgagctaaagcagatacgaaagtgcctgccagagatagggagtagaaggtgtgaaggccaggacgtgagaggccaggcctgttgtaattagaagcaattcagtgtggctggaggacaagtgagagatcctcgggtggcagaggccagatcaccaaggttcttgtaagccagcaacacttgggctttagcaggaggaagatggggaccactgcagagtgttaagcaagggagtgatgacatcagctttgcacatcaggaaaatccctctgtttgccacgtggatgacggggagggagaggcgggcagatgagctgggcaccagagagagctgcaggtgagaggtaatggtggcccgagctaggggtgacacactgaggtgtgtgggagatgtactgaatggagaatcggggacatggagaggagaggaggagggatcagggatgatgctccttttctggcttggtcagcatggcccaggcaactggtagaagatacaagataggtaagtgtctttgacattgttcatttactctgtgtttatagctaggatgtaagttttactaatcccatttcagatggtaattggagatctagagaggttgagcagttattccagggtgcctcaggtagttttaggagcattgggatttgaacttgggtctttttcacttcagtatcattagccactcattgtgcagttcttcctcggtggaaagagggtcagttctgtggctgtgggtctgagacctgggggttgggtgaggtggaacatggagttgggtgaacattgggtaaggaggaggagcagaaagtcttagcagaaatgtttgctgtgtctgcattgtttttcccaaacctagcgcaggacagtgagacagcggctctatgccttttcctcagcccgtcctagacactgtttctgccaggaggacagttttgctgggagttggcctcaacctgctcctcctatctgaatggtgggtgaaggacagacaagcctggtgctaagctcatccagaggcccccagatagggaaatagcatggattctcttctgcccgctggggacttcttgggcacctggcccccaggcatggctgtcctgactcatctgggtgctatggcttacgggcctctagatatcctttggaaaaacgtgtgaggcataaattgatatgaacattcttcaaggcagtttggcaatacatttttttttaattcaacatttccacctcttgcagtgtactccaagaatatacttggatatatttctgttgtttttgatggcaaaattaaaatcttttggttgagaaaattttggtttatccatacagtgtgttctctgcagtttttctgtatagtcactaaaaatcacattctaggggaatatttaatgacatggaaaatactcatgatttattaagtgaaaaagtctgtgtgtgtgcatatatgtttatatacatatatctgtagctatctgtgtacatggcatatctcagtatgatgagattgtgacttttctttacttctttgtccttttattttgagatagggtctcactctgtcacccaggctggagtacagtggtataatcagctcactgcagccttgatctcctgggctcaagcgattctctgtgtaccaccacacctggctaatttttgtattttttgcagagtcaggatcttgccatgtttcccaggctggtctcaaatttctggcctcaagtgatctacccaccttggcctcccaaagtgctaggattacaggtgtgacctactgcacccagctgcctttgtacttttcttttcttttttttttttgagattgagtttcactcttgttgcccaggctggagtgcaatggcacaatcttggctcaccacaacctctgccttctgggttcaagcgattctcctgcctcagcctcccaagtggctgggattacaggcatgcgccaccacgcccaggtaattttgtatttttagtagagatggggtttttccatgttggtcaggctggttttgaactcccaacctcaggtgatccgccctgactcagtctcctgaagtgctggggtttacaggtgtgagacaccgcgcccagccttctttgtgcttttctatattaacaaatttttgaggccgggcatggtggttcatacctgtaatcccagcaagtctgggcgtggtagctcaagcctgtaatcctagcactttgggaggccaaggtgggtggatcacctgagatcaggagttcaagaccagcatgatcaacatggtgaaaccccatctctattaaaaatacaaaaattagccaggcctggtggcaggcacctgtaatcccagctactcgggaggctgaggcacaagaatcacttgaacccaggaggcggaggttgcagtgagccaagatcatgccactgcactccagcatgggcgacggagcaagtctcaaaaaaaaaagcaactttttgatagtgagcatttataactgttataaaaagaaacctttatttttaaaaagttaaataaattatggcacatcaatgtgtgtatgagtatgtatgtatgcactctttaaggaaacaaagccttttactatttctgtgccttggaaagaagaataagaagtttctgcatccatgaagtggaggtaacattcatgtctaatgtttggggattgcaggaaaaaaaaatggaagtaactatgatgcctacttcatgtttgttttttttttctttctttttggtgaggatttaatgggtttgtgtgctaagaacagtttgtattaagtacagacggttttcaacttacagagtttcaacttactattttttgactttaagattgagcgaaaacgataccattcagtagaaactgtatttccagtaaccatacaaccattctgtttttcactttcaatatggtattaaataaattacatgagatatgcaacactttgtgataaaataggctttgattagatgattttgcccagctgtaggctaacataagtattctaagcacatttaagttaggctaggctaagctaagatgttcggcaggttaggtgtattaaatgtattgtgacttatcttttcagcttatgacggttttattgggacataaccccattgtaagttgaggagcatctgtaaaaacattagctattcccattattattactgcaaaagagggtggattgggttcttaagtatcacagaggaatgcaattattattattattgttatttacttacctttaagaaagttctcatacgtggatatgttctgcctgtattggctattgtgactgtcagatgaaatgggaatctaaggctgggcgcgatggctcacacctgtaatcccagcactttgggagactcagatgggcagatcatgaggtcaggagttcgagaccagcctggccaatatggggaaacccccatctctactaaaaaatataaaaattatccgggcttggtggcacacgcctgtagtcccacctactcgggaggctgaggcagaagaacccaggaggcgagtgttgcagtgagccgagatcgcaccaccgcactccagcttgggggacagagcgagattctgtctcaaaaaaaaaaaaaaaaaagaaaagaaatagaatctaaaaatgcttggaaaactggatatgctatacagatttagggaattattattccagcattgaattggggtcatattgaagaaaaaatgatactttgctgctcttccattccattttttagaattttatatttaatattttttcttttgctctacacattcagagaaacttctctagtaatgaactatagaaatgatcccagaaagcacagcctttgttcttctgttcttgtcactcattccttccttgcatattttccttttatttatttattcatttaagagacagtgtctcactctgtcactcgggctagagtgcagtgacacagtcatagctcactgcagcctcaaattcctaggctcaagtgatcttcctggctgagtgcagtggctcatacctgtaatcccagcacttggggaagctgaggaggaaggatcacttgagcccaggagttggagaccagcctaggcaacatagtgaaaccctctctattttttaaaatgaaatatttgttttaaaagcgtgatcttcccacctcagcctcatgagtagctaggactacaggcatgtagcaccatgcctgactaatttttaaaaatattttttgttgaggcgggagtcttgctatgttgcccaggctggttgtgaactcctggtctcaagcagttctcccaccttggcctcccaaagcactaggattacaggcataagccactgttcctgggccaaattttctgtttcatcattcattcatttatgcaacaaatacttgctgaatgcctctgatgtgcctagcccttttctccctgcggggggaagaggggtgagtgaggcagatatgggctctgctgttatgggccttacagactagtgtgtgtgtcagagtggcaggcaggcagataaccagtcagagaaaagaaaggagatgtgtggataggccggacacggtggctcacacctgtaatccaagcactttgggaggctgagatgggaggatctcttgagcccaggagcttgaggctgtagtaagccatgattgagaccagcctgggcaacacagcgagacctcatctctacaaaataatttaaaaattagccaggcatggtggcatattcctgtagtcccagctacgtgggaggtggaggcaggaggttcacttgagcccaggagtttgaggcgtcagtgagtcatgatcttgctactgctttccagcctgggtcacagagtgagactgtgtctcaaaaaaaaagaagaaaggggctgtgtagagaaagtaaaactgggagaggtgacagagagagaactcagtagggggaggagaaatcaagtacggcctcatgaaagagggcacaattgagaaggaggaagagctcagtagagaaagaacattccaagtggacggaacagccaatgcaagggccctggggtgagaacgagctggattaatttgatcagaagagggactggaagttggtcagtccactatgtagaaatagaaaacctacagttcaaagagaccataaatccatgatgcaagaagtttctgtgagaggagcttggaagtctccatagaacctgtagagctaaaatatccctccaggtgtaatcaggtacagagcatctacctggactgttacagcctgcctgtcagagctgtgactgtgctgttgtcaagagcctaggacttggagggaaaagacctagagtcaagtctcggctgtttgatcttgagtgagtctcatgaccctctggcccccagtcccttctaaaagttagggatgatgctacctgccttataaggtagggtcaggattaaatcagtgagtgagcactttgtgaaagatggcgtgcatggaagggttgcatatctttagtaagggaagctttgaagccaaagtgcaagtgggtgggtctccatgtggaacagagtaaggtgctgtgtggctggactcttgagcgctgaggaggctgtgggcatccaaccaggccagggcacctgttcttcaccatctcattaacacagccagcatatctgcatctgagattggcccactattctcctaatagagtgtctttcctgtttctcttttccatatcctgtccaacctggtgggcttcatagttcaggatgtgttcagtgaagccatgtctacactcactctaatccccactgatctctctctcctcatgaaaacccacaaattatcacctcattacttgtggatttgtgtcttttcactatttcatctgcctccctgtctagatcataagctacttgggagtaagaactgttttgttttttgtattctttccactcctccatggcattcactacaacataaatcatagaggtcagaacatactgaagtgcattttgagttaaaatgctcaaaagtgatcttagtgacacgtgtttactttccctgtttatttaagctccagctataatgtttacctgcctaaaagttccatgttgccagtattaaacatacttctttttgccatgactaggcattgaaaggattgtaatgctttgttctgtagcccccaggtttccctagatgacaaataaacattccttttcctgcgtgaagatagtctgtggaaaccttggccatggcatcgatatcagagcctgttacattcagagagttctgcccgttgtactatctcctcaatgccattccgacaaagatccagaagggtttccgctctatcgtggtctatctcacggccctcgacaccaacggggactacatcgcggtgggcagcagcatcggcatgctctatctgtactgccggcacctcaaccagatgaggaagtacaactttgaggtgagccttgctttgcttttcacctgagggggcacgagccatagctgacgcttaacatgcttgtgttctaggatgagataatttacttctgatttgccagaatatggccttaatacctcacccaaacaatactttaaaaccatctttagctgaagtggaatataactaaaaacattggtgtttttaactttttcctgcctccaaaaatctaacatcactttatttatttatttgagacagcgtctcgctctgttgtccagcctagagtgcagtgggacaatcatagctcattgtagcctcaaactcctggggtcaagtgatccttttgcttcaacttcctgagtagctaggaccacagggatgactgccacacccagctagtttttgttttgttttgtctgtagagacatggtttcactatgttgcccaggctggtcttgaactcctcggctcaagcagtcctcctgccttggcctcctaaagtactcggattacaggcatgagccaccacacctggcctaacatcactttaaaagagaatatcacctgaggtcaggagttcgagaccagccttgaccaatatggtgaaaccctgtctctactaaaaatacaaaaattagctgggcgtggtggcatgcacctgtactcccagctactcaggaggctgagacaggagaattgcttgaacctgggagatggaggttgcagtgagccaagatcacaccactgcactccagcctgggtgacagagtgagactccatcttaaaaaaaagaaagaaagaaaaaaagagaacattttagtatttaaaacttactacaacactttgaaagcagatatttttttcctaagtgtttacaggagcaggcacatgcctgtttttcaaagttttgaataatctctagttcttctcttgaaattatgatgaaaaaaggatgtatatgaatattggctcattgccagaatatgcacctcttagctgagctgaggtctcttctatagcattgggatcctgaccaatctgtttctgcagtgctgtggactcaggcatttctgtgtattgtagatattggtggagatgttatttgactgtgttgtggctggcaccaactattggtgaactgtaatgtaattcacccacttagtcaatatctgtagtttattgagtacgtcacttttgtgagagactcaaagttgactgagttgtggcttccaccacatgggactctattctgtctgtggttagggggcttttatggaccaagatacagcttttgtatctaagagaaatgtttacaaatacttgtgttttaatcagtattcaatatattaaagttttcatttaaaacgtaactaatttaagcctctgtgctcattttaaaataatcaaaatggttcatacacatacagccctttctatgtgtcagacattattctttaaaaatatattttttaaattttttaaaacattattttttccttctcactatgcttcttggacagacatatattaactcattttatcctcacaaaaactctctgaggcagatgttattatgatcttcctcatttactaaggagacagctggtgaagagagggtaggtgacttgcctgaggttggctggtagtaaatggcagcaccatcatgtgaacttgggcagactgtctctagggtctgtattaatatatatatatatttttgagacggagtttcactcttgtcgcccaggctggagtgcaatgacatgatctcggctcactgcaacctccacctcccaggttcaagcaattttcctgcctcagcctccagagcagctaggattacaggcacccgctatcacacccagctaatttttgtatttttagtagagacggtatttcaccatgttggccaggctggtcttgaactcctgacgtcaggtgatccatctgcctcagcctcccaaagtactgtgattacaggcgtgagccaccacacctgcccgtgtattaatattttttgtataaaaattagaactactgctatttcttctctttgagtaatagctcatggattcgactgatcaaattccccaaacatttaaaaccattacgtaatctttcaaactgtagttaggagtttaatagtctgaaatctctcaaatgcttcagacactttataaggaagactcgtgaatccaacgatgaaccccaacaagatctatcaaagaaatccatgcacagaggcaccctagtcacactgctaaagatcacaatcttaaaatccgtgcacagaggcgtcctagtcacactgctaaacatcacaatcttaaaatccatgcacagaggcgtcctagtcacactgctgaacatcacaatcttaaaatccatgcacagaggcgtcctagtcacactgctaaagatcgctgtcttaaaatccatgcacagaggcgtcctagtcacactgctaaagatcacagtcttaaaatccatgcacagaggcatcctagtcacactgctgaagatcaccatcttaaaatccatgcacagaggcgtcctggtcacactgctaaagatcaccatcttaaaatccatgcacagaggcgtcctggtcacactgctgaagatcacaatcttaaaatccatgcacagaggcaccctagtcacactgctgaagatcacagtcttaaaatccatgcacagaggcaccctagtcacactgctgaagatcaccatcttaaaatccatgcacagaggcatcttagtcacactgctgaagatcaccatcttaaaatccatgcacagaggcatcttagtcacactgctgaagatcaccatcttaaaatccatgcacagaggcgtcctagtcacactgctaaagatcaccatcttaaaatccatgcacagaggcgtcctagtcacactgctgaagatcacagtcttaaaatccatgcacagaggcgtcctagtcacactgctgaagatcaccatcttaaaatccatgcacagaggcaccctagtcacactgctgaagatcaccatcttaaaatccatgcacagaggcgtcctagtcacactgctgaagatcaccatcttaaaatccgtgcacagaggcgtcctagtcacactgctgaagatcacagtcttaaaatccatgcacagaggcaccctagtcacactgctgaagatcaccatcttaaaatccatgcacagaggcgtcctggtcacactgctgaagatcacagtcttaaaatccatgcacagaggcaccctagtcacactgctgaagatcaccatcttaaaatccatgcacagaggcgtcctagtcacactgctaaagatcacaatcttaaaaatagccagagaacaatgacgtattacctgtagaggaacaatgatttaaatgactgtggatttctcatcagaaactgtattagcccgttctcatgctgctatgaagaaatacccaagcctgtataatttataaaggaaagaggttttattgactcacagttacgcatggctgcggaggcctcaggaaacttacagtcatggtggaaggcacctcttcacagggctcactgtcacaagaacaggaggggggaaaccatgcccatgattcagttatctctacctggtccctcctacgacatgtggggattatgggaactacaattcaagatgaaatttgggtgaggacacagccaaaccatatcagaaacaatggaagctggaagacagtagcatttttttggttttttgtttttgttttgttttgagacggagtctcgctctgtcgcccaggctagagtgcagtggcgcgatctcggctcactgcaacctccgcctcccgggttcaagcgattctcatgcctcagcctcccaagtagctgggactacaggtgcccgccaccacaccggctaatttttttgtatttttagtagagacggggtttcaccatgttcaccaggatggtctcgatctcctgacctcgtgatctgcccgcctcggcctcccaaagtgctgggattacaggcgtgaaccactgcaccaagcttgtttttttttttttttggcagagtttcgctcttgttgcccaggctggagcgtagtgactgcaacctccacctcctgggttcaaacgattctcctgcctcagcctcccttgtagctaggattacaggcacacgccaccaagctcagctaatttttctatttttagtagagacggggtttcaccatgttgtccaggctggtgtcaaactcctgatgtcaggtgatccactcgcttcggcctcccaaaatgctgggattacagctgtgagccactgcgcctggccgatagtagcacatttttaaagtggctgagaggccgggcatggtggctcacacctgtaattccagaactttgggaggctgaggcaggtggatcacttgaggtcgggaattcgagaccaatctggccaacatggcgagagccccatctctactaaaaatacaaaaattagccgggaatagtggctcatgcctgtaatcccagctactgagaaagctgaggcatgagaatcgcttgaatctgggaggcagaggctgcagtaagctaagatcgtgccagtgcactccagcctaggcgacagagtgagactccatctgaaaaataaaatgaagttctgagagaattgtcaacccgaaattctttactcagtgaaaatacctatcaagaaaggtgaaatgaaagtattaccagatgaaggaaaacttaagagggttcgttgccaaccgacctgctctaaagtcattgctaaatgaagttctttagacagaagggaactttgtacatcaagaatgaagaatggtaaatacctgggtaataaatacaatagatgatttttcccctattgagttctttaaaatatatttgacagttgaaaacaaaaattataactgatcaagttttaacagatgtagatgtagtaatatctaagacgagtacaacataagtaagggagagtaaggtatcctatacatttgtacattcttcttgaagaggtacaatattgattctaagtagattttgaaaaattacgtataggccgggcacggtggctcacgcctgtaatcccagcactttgggaggccgaggcgggtggatcacgaggtcaggagatcgagaccatccaggctaacatggtgaaaccctgtctctactaaaaatacaaaaaatgagccaggtgtggtggcgggctcctgtaatcccagctactcaggagactgaagcaggagaattgcttgaacccaggaggcagaggttgcagtgagccaagatcgcgccattgcactccagcctgggcaatgagagtgaaactccgtcccaaaaaaaaaaaagaaagaaagttggagtggctgtattaatatcaaggttttcttctgtgcaaagaaataaccaggggtaaaaaagacattacataataacagattcgtatatgtcccttaacaacatagcttcacacaatacacgaagcagaaatggacaaatctgcaattacatgtggagacttcagtattcctctctcaataatagaagtagtagacagaaaaccaacaggatgtagaagaactgaacaacaccatcagccaacttggtctaattcacatttatagaacactcagctgaatatacattctttgcaagtgcacatggaacattcatcaatatagaccatgtcctgagttagaaaacatacctcaacacatttagagtagactaagctttccaggcccttgtgttttactttgttttttcacttttctttaaaatataatttacacaaagtttgcaaatctttttttttttcgagacggagttttgctcttgttgcccaggctggagtgcaatggtgcgatctcggctcactgcaacctccgtcccccgggttcaagtgattcttgcctcagcctcccaagtagctgggattacaggcgcctgccaccacgcccagctaattttttgtatttttagtagagatggggtttcaccacgttggccaggctggtctcgaacgccagacttcaggtgatccatccacctcggcctcccaaagtgctgggatgacaggcgtgagccactgtgcccagcctgcaaatcttaatagtaccatgtgatgaatttatatgtgtatgcctgtttaatcacccagttcaagatacagaacatttccagcaccccagaagattctcttgtgctacctcctaatcattacccctccccaaggtaactattctgacttctaacacagagtagttttgacttctacagagtagttttgctagctccttgggttttaattcactattaagtaacctctggcagtaaggtttatatgcgttagcggaatttggactccttactcaggttgcagttacaacccagttttcttttataaagcacatgtgtctcattgatcaccattgtattgtcttttttgttttttttgtttttttttttgaggcagagtctcactctgtctcccaggctggagtgcagtggagcgatctcagcccactgcaatctccgcctcctgggttcaagtgattctcctgcttcagcctcctgagtagctggaattacaggtgcccgccaccatgcctggctactttttgtatttttagtagagacagggttttaccatgttggccaggctggattcaaactcctgatcgcaagtgatccacttgcctcggcctcctaaagtgctgggattacaagcatgagccactgcgcccggtcccgtattgtcttttagaaaaactgtataactatttaaatattttcagtcaccaaactaaaaaacaaatactaaagttgaagtttattgctccccagaatgaaactacaaattacatctgatggccatttttacagtttaaccaataattagttctctatcatattatctttgtttcgttttcctttaacagaatacctaagactagtagttgttctttttttttttttttgagatggagtttcgctcttgttgcctagcctggagtgcagtggcgcaacctcggctcactgcaaactctgcctcccgattcaagcgattcttctgcctcaatctcctgagtagctgggattacaggcatgtgccaccccatctggctaattttgtatttttagtagagacagggtttctccgtgttggccaggctggtctcgaactcccgaccccaggtgatccacctgcctcggcctcccaaagtgctgggattacgggtgtgagccactgcatccggccggaagttgtttttatttttttactatttttaatttttttaaagaggtttatttggcccacaattctgtagctggaaagtccaagattgggcagctgcatctggtggggacctcatgctgcttccactcatggtgggaattggaaggggaccaggtgtgtatcaagagatcacatggtaggccgggcatggtggctcaggcctgtaatcccagcacttcaggaggccaagacaggcggatcacgaggtcaggagtttgagatcagcctggacaacatggtgaaaccccatctctactaaaaatagaaaaattagccaggcatggtggcccatgcctgtaatcccagctactcaggaggctaaggcaggagaatcacttgaacccgggaggcggagattgcagtgagccaagactgcaccactgcactccagcctgggtgatggagcaagacaccacctcaaaaaaaaatatatatatatatatgtgtgtgtgtgtgtatatatatatacacatatatatgtatatgtatgtgtgtgtatatatatatatctatatctcacatggtcacatggcaagagaggaagcaagacaggaaccaaggatgccagactcattttcttttcctttcctttttttttttttttttttttttttttgagacagagtttcactcttgttgccctggctggagtgcagtggtgcaatctcggctcactgcgacctctgcctcctaggttccagcaattctcctgcctcagccttccgagtggccaggactacaggtgtgcgccaccacatctggctaatttttgtatgtttagtagagacagggtttcaccatgttggccaggctggtctcaaactcctgacctcaggtgatccacatgcctcaccctcccaaagtgctggaattacaggcatgagccacggcacccggctctttttcttttagtatggagtgcttcacaaatttgtgtgccatcctcgtgcaaggaagccagactctttttaacaacctgctgtcttggaaactaatccagtccttggagagtgagcactcattcacccatgaggagggcattaatctattcatgagggatctacccccatggcccaaacacctcctactaggccccacctcccagcactgccactttggggatcagacttcaacataaattttggcaaagacaaaccacatctaaaccatagcagatatgataagtcacgtgagctttgaaggactgtgacatggtagaacagcatccacaggctctaccagagtttggtggaacagcatccacaggctctaccagagtttgagggagcagcatccacaggctgtaccagagattgagggaagctggtacaaattactggatccagcaccatagaaggggactctgggagaatcccatgtaaagattttagctagtccaggcatagtggcacacacctgtaatcccagcactttgggaggccgaggcggacagatagcttgagctcaggagttcgagactagccttggcaatacagcaagacccccatctctacgaaagaatacaaaaattattcaggcgtgatggcgtgtacctgtagtcccagctactcaggaggctcaggtgggaggatcatttgagcccaggaggtcgaggtcgtagtgagccgagatcgagccactgcaccctaacctgggcatcaaagtgagaccctgcctcaaaaaaaaaaaaaatttagctagttatcctttaaatgtatttcacccatacatgcatatgcctgctgtgtacctacaaaaactttttaaatctaaaatattaacatttggaaaaaaaatgtattttgctggggccaaaatccatacttggtagccctgagtatcaacagcattttttgagcgcccattatatataggatatcaaacttataattgtggagaatcacaagggaggtataaaataaatttcttgtccaggcacggtggctcacgcctataatcccagcactttggtaggccgaggcaggcagatcattttgagctcaggagtttgagagcagcctgagcaacatggcaaaaccccatctctactaaaaatataaaaattacccgggtgtggtggcgggcacctgtaatcccagctactcaggagactgaggctggagaattgcttgaacccaggaggtggaggttgcagtgagtagagattgcgccactgcactacagcctgggcgacagagcaagactctgtctcaaaaataaaataaagtgaaaattttttttttggcaagaatgtagaatttagaggtagaagatttagagcttggaaacaaagctgtatacctatatgtaaacacataggaaaaggtctgaaggaattttcacatgattacttaactctaggtagggattaagattgggatgggctgagggaggaagagtgaaagggaattacgtatttttttaactttactgaggaattactagaaatttttggtacatattacacgcataaacacagcaacacaaagatttgttttgagctttggctgccagttattagtggtttaaccccagagatgaattaaatatttatgttgttgttgttgtcattttcatcatgagagctggctgggtcttagaatcatttggtacaatccccactttttatagataaagaaattctaagattcctgcttcaaggcacgtatctctgattgcctaaccattgtgcttacttcttgtgagaggaggtaggccctctgtgcagtctgtggatttcaaggatatggaatacagatgcgtggtctctttggaatgtccaagtcgaaagttaaagatgcattaactagtttagggaaaatctaagattttatgggaagataaataaaaaagtttatgctcaaataaatccatgtatggcatgattgaaagattatgtttttaaatgaagttatgtttcctaaagaggaaagcagaccttttctgtggtaaatatagccttgcatgtgttttcaagaatggtgctttggaaaccatttttttctacagaagttagtgggagagggcagatggaaacacagattcttcctacctagtgccaaaagcactgagaaaatgttgcaaggagctaataacaagtacaaaaatgttagaaatgtgttaaatatataggtctgatatgtgtaagcatagaccaaaaagactacctgacctgagtttctaatgttctgttttgaagttaaacatatgatcccttttccttagcattcaacaagccaatgagatttcatggatttgccttcagagctgtctttttttttttttttgagacggagtcttgctctgtcccccaggctggagtgcagcggcgccatctcggctcactgcaagctctgcctcccggtttcacatcattctcctgcctcagactcccgagtagctgggaccacaggtgcctgccaccacgcctggctaattttttgtatttttaatagagacagggtttcactgtgttagccaggatggtcttgatctcctgacctcgtgatccactcgcctcagcctcccaaagtgctgggattacaggcgtgagccaccacacctggctgggtggttgcagttttaaatagcattccagggaaggtctgactgagaaggtgacagttgaacaaagacgtaaagagcatgaccaacacaccatactgacatgtctgtattccaagaaaacggaagggaaaggcactgagcctgaaacatgtcttggatatttcgcattgagaaaagtcatgcttcagaatgttacaagtatttcattggcttatactttatagacatattttaaagaggtgcagaaaggacagtttttgtctcaccatagcagccaaggtgcatttgcccagtgccttccattgtctttccctgtgggagtaacttttaggtccagtgatgaggagcctgtgatgtctgtgttctggtttgttgataacattaccatacagggcttcacgggtgtccttcttagcatggattgcttccattcattggttgctggaaaatttgctttcaaatgtttttaacagtgactcttagggaaaaaaaatacattttattagatgtccattctccctaaatttacctgagttcaactgaattccaataggtttttttttagtgttaatttaaaaaaacaagctggccaggtgtgatggctcatgcctgtaatcccagcactttgggaggccaaggtgggcggatcacttaaggtcaggagtttgagaccagcctggccagtatggtgaaaccccatctctactaaaaatacaaaaattggctgggcgcagtggctcacgcctgttaacccaacactttgggaggccgaggcaggaggatcacgaggtcaggagatcgagaccatcctggctaacatggtgaaaccctgtctctactaaaaatacaaaaaaaaggccgggtgcggtgcctcacacctgtaatcccagcactttgggaggctgaggcgggcggatcacgagatcaggagatggaggccattgggctaacatggtgaaatgctgtctctactaaaaatataaaaaattagccgggtgagatggcaggcacctgtagtcccagctactcgggaggctgaggcaggagaatggcgtgaatccaggaggcggagcttgcagtgagccgagattgcgccactgcactccagcctgggcgacagagcaagactccgtctcaaaaaaaaaaaaaaaaaaaattagctggatgtggtggcacgtgcctgtagtcccagctactcaggaggctgaggcaggagaattgcttgaacctgggaggtggaggttgcagtgagccgagattgtgccactgcactccagcctgggcaacaagagtgaaactccatctcaaaaaaataaaaataaataaataaataaataataaaaatacaaaaattagccaggtgtggtggcacacacctgtaatcccagctacttgggaggctgaggcaggagaatcatttgaacctgggaggcagaggttgcagtgagccgagattatggcactacactccagcctgggtgacagagcaagtctctgtcttaataaatacataaataaaaatgataagctgatttaaaaatgcatatgaaattgtagtgggtggaatagtcatactagtggaaaagaggaagcaaatgggagaagttgctattaggtaacaaaacttatagagctttagtaattaagggagtgtggtattagcacaagaaaagatacatagatcactggaacagattagagaagtcagaagaccaacatgtatatggatacttgagtaattgcaaaggtgatacgacaaagtctttttcagtaaatgatgtgggacagctggatatgaatgggaagaaaaatgaaactggatccctacctcacttcatatggtggttattttgagcactttaaagtattaatgccactgtctcttgactgctgagattctgctggcagtgtaattatttcctttaccgggaatttgccttgtctgtttctgctttagatcttctctaatgatagagtccctggctttaggcttcttccttcaactccagtggatattccctactttgttttgtcctatggagttaagaaaattattccagaaaagcagatatctttgtttaacttccagatcattaaaaagttgtgttagtattcaaacattaaacagatgttctttgttagtaaaaggaggaaaatagtgtaaccattcttaataattgaatgaattcatatttggtcttaaatatttcaaaatatttcagatcaattctttggtatgctagtggtttctactgaaggttaagctttgacctactaaaagcagctcataaagaaagctttgtcagacttcagttcccatgaacctgctcacaaagaacactttttcccaatgtagttttgtcttgtgtatgaaaggaaaactgcctgccaaggaggctaagaaggttagctgaatgctattgtaatggtgagatgtttgtccagaaaaccattcctgacacctttcaaatcaaaagccttttttttttccttaaactttttgattgctggatttctgtttgaggaagttatgttgctacaatgagggtagcaataaatgcctcctgggaagttggaaataaaggcaaaggagagttaaacacaatagatgagatcagaaatgggcaaagttatcttaaagagacagaatggctccctggctagaataagactgaattgtccctagatcaaaaaaagaagagaatgtgtgtggcagaaggaagaaagtggactctacactgtgttagttaggaaaaccagaaattgggccaaattgcctgtttagtgggagagatagcttttgagagctgtgatcccgctggtgtggctggctctgggcagatatttgtatctgaaatgactcatgctgtgggacccttcctgagatctaacacttacagtggtttgatcagaaattgcaccatgcttgccaagcaacttttggactaaaagttgctgcccacgtatatcaggggaagaatatatatatatatatatatagtacctatcttagcatctgatttgtatgaccattacttcaatgtaaaataataaattggctttccagcttaaacttcaatttcttgtatattatatgatcatgagacaacctccctgggctgatcaacagcaggacgctaaaaagattgagtatctgagtcaggaaggtagagggccagaccctacatgtagctaattcaccattgtgaatctgcatgttaggtaaaactatggatttgttttttgtcttttgagacagattctcaccctgttgcccaggctggagtgcagtggcatgatctcagctcactgcaacctttgcctctgggttcaagagattctcttgcctcagcctcccaaatagctgggattacaggtgtgcaccaccacgcccaaccaattttttgtatttttaatagagacgggagtttcaccatgttggcgaggctggtctcgaactcctgacctcaagtgatccgcccacctcggcctcccaaagtgctgggattacaggcatgagccactgtgccaggcctaaaactatggtttttaaagatatacacgcatgtggtaaagctatgaatcaaagcaagagaatatttcatctcaatgttaggagagtggttttggtggggtggggtatgtagtcaggcagaggcacacaagagcttcaaaggtgctgttaatggtccctttcccaagctagatggggattccatgggtgctcattttttagtaactctaatttaagctgtacatgttatatatagtcatggatatataatcattattttaaaaatgaaggcaaggaggataccataaaatgaggtacttcatatttaaccagctggcatcctaagcacctttcctgccctcccctctctgcacctggcagagttgatcacatcctccccattacccactatacatgggtgtcagtgccaatagtgctttgctcttgtattattgatgagtcttgctccttttcctaaattgtgaggcctcctgaaggcagcacccttgtcttatgaaaaagttgagcttctgaggatatgtctttggtgaattttggaaaacgtttagcctttatctctgaagataccacttttcattaccctctcttttcatttcctgctgaaacccctttttttgtttgttttttgttttgttttgttttgttttagacagagtttcactcttgttgcccaggctggagtgcaatggtgtgatcttggctcaccgcaacctctgcctcccacattcaagtgattctcctgcctcagcctcccaagtagcagggattacaggtgctcgccaccacacccagctgattttttttgtatttttagtagagacggggtttcactgtgttggccaggctggtcatgaactcctggacctcaggtgattcacctgcctcagcctcccaaagtgctgggattacaggcgtgagccactgcgcctggctgagaacccacttatgtgtagcttggacctttatgttctctcttctatgtctctaaacttctctttcatgttttgaatcttttcatctctttgttgcatggtaggtaatttcctcagatctgtcatctagttcaatacttttttttccagctgtgactaatttgctgttcattccacccagtgacattttaaattctcttggattttttcatttctatttccaatagtagttgttctttgcttacatttcagtttcctgttttatttttaaaacattttaatcatttttcttttatgttctgtgttcttcaatctaagtgaaatacttggggttgttcagtgctgttatggcttgttttacttgactcattcatgggcctgcttccctatcgtaatttctaattacgagcaatgtggctgatcctaatgtatgagaaccctgggggacctggatcgggactgctccacagatggggtttatgtttaccaatgccaggcaccttggagtgctaccaacatagaagcacttcagattaaccgtctgcatagagctttgcttggaaagagaataaattcaaactctgatgctgaatggggcaggcttatgatgacacattcttcggaaagattcttttttattcgttccaatcaatgcttgagataagacagatttccttgccagctccatttgccagcaaatcaatttttccctagcttactccttcacttagggttaggtccttgggattctggcttggcagagaatatcagctccagctccccatcatctactccgctctgaaaaccaaggctccagaggtgtgccagatagttacagggtagcctgtagcttcagggctagcttctgttttagtttgggggcattcttcttggttttggggtcctgtggattttccatactttcttgaaaattcagctgtgcatttgaaaggctttgttatatattgcactcagcattgccaggtgtttggagaggggtgttttgggatagctaggctattgtattgtgcaaaattaaagcctcatattctatttctatatgaactgtagttaagtgttaataatctgatgtctgggatgttttgattcttacatcaataactatgacatttattaataatcatattaaataacattaactcaagctcattggttacattacaaaggacactgatacattacaaagcacacatacaagcactgcacaccagtattgaggcttccagccccctctacatgatcatttatttatttatttatttttgagacggagtctcactctgttgcccagactggagtgcagtggcatgatcttggctcactgcaacctccgcctcccaggctcaagcgattctcctgcctcagcctcccaagtagctgagattacaggtgcgcaccactaccacctggctaatttttgtacttttagtagagatggggtttctccatgtgggccaggctggtatcgaactcctgacttcaaatgatccacccgcctcggcctcccaaagtgctgggattataggcatgagccaccgcgcctggtcatgatcatttttattttggaaccattcattcagaaaaatttcacagccattttgaacttgtgctatgacatggcaaaatctctagtaaatcattttaattcctgatgagttcatttttataatgataaatttctaaggaaaatattttgttttcaacttcttgccaccatgtcaagactgtacattttaaaacatattacatcacattttcccttcaaagcaatgccagtgaattctgttaatggtatcattcatctcatgttacccaactccagatcataaagtttccctcattctccttcctttccacaaacctaccaaatcctctatcgccaagtcctttgggttaattcacggagaaagtatcgagcacagaggcagaacagggcctctggagagtgtcacatttgtgtgtgaatcctgactcttgattttcactagctttgtaaccttagacaaattactaccaggcacggtggctcacacctgtaatcccagcactttgggaggctgaggcaggatcactggagtccaggagtttgagaccagcctaggcaacatagcaagatcctgtctctacaaaaaataaaaaattagctgggtgtggtggcacacacttgtattcccagctacttgtaggggctgaggtgggaggatcacttgagcctgagaggtcaaggctgcagtgagccatgatcgggccactgcactcagcctgggtgacagagcgagaccctgtctcaaaacaaaccaaaaaacaaattagttaacctgtctggagctcagtcccatatttgtaaaatgtggctaactacagcaccttcccttatagaaagctgtttgaggatccagttatgcatttaaagggcttaacacattacctggcacaggaaaacaaagacaagctgctgtcctgttttctttgttgctgccatccttctcacaaggtctcgacggagtctgtcttcatcacgatttcactgccctcatgcctgttctgtttaccccttttctagactgggcccttacttaccttagcctgagctattgtgaaacactcccagcggcttcctgacttgccccactccctccttccgccgtcctgtcctgctcctaatcgtgtttgtcagaaatgcctctgactgatacactggcaaaatcagaaatcttcaagggatccccctttttcttgctgtagcttaagatctaaatctcttaacctagatcacgatctgacactagatatatttatagtccatgaaaataccctgaaagctttcaagtaccagatgaaagtgagctccttcattaccacctcaactcactgtaggcggcttttcatgtgcaacagctaagctttaagagggctgggactgtgacctactttattttgtattgttatagcagctcacttggtacccagagcaaggaggtatatttgtttcttgcatatttggcaggttgattactatataaattactctattgaagattaaaatggtttactgaagatgtcgccatatatcttagcaaggtcaaaacagttgtgtaatttttctgaatgaatactttcaaaataaaaaagaccactcagaccagaagcctgaacatctgtgagcaatgcttatacatgtgctttttaataaaccaacatgttgggccgggcacggtggctcacgcctgtaatcccaacactttggaaggttgaggcaggtggatcacaaggtcaggagtttgagaccagcctgaccaacatggtgaaaccccgtctctactaaaaatacaaaaattagctgggcatggtggcgtctgcctgtaatcccatcgactcaggaggctgaggcaggagaattgcttgaacccgggaggcagaggttgcagtgagccgagatcacaccgtggcactccggcctgggcgacagagcgagactctgtctccaaaaaactaaactaaactaaactaaaataaaccaacatattaaactttaataggattattgatctgaaaaccaaaacatggtaggaattagtttataagtcatatttagacgcatcatcttataaccctctcagcaaaacctgtggggcaggtagattatggataacaagtgttcacttcatgaattgtccctgttgatcaggtgaagtagaacttggatctggggcagctcttgtgactccagattcttggtttttgagcaggtgttgggggaaatacctttcttgttgaagttctttagtactcttttttttttttttttgagatggagtcttgctctgttgcccaggctggagtgcagtggcgcgatctcagctcattgcaacctctgcctcatgggttcaagctgctctcctgcctcagcctcccgaacagctgggattacaggcacacaccaccacgccaggctagtttttgtatttttagtagagacggagtttcgccgtgttggccaggctggtcttgaactcctgacctcaggtgatctgcccaccttggcctcccaaaatgctgggattacaggcataagccactgcacccggcccatcttttaataagagctcagcatattcatacttgattgatcagcattttcgtcattagaaatgaggtggggtttttttgtttttgtttttttgtgttttcatttcaaagattaaaaacctagagaggaaggagagtatttggggaaaatggtggaagagggagcaccagtcatctgtctccacacctagacatcaattgtactggcaggatctgtctgatctaactattttggaactcggaagtctactgaggtttacacattcttgctgggatggcaaactgtggttaattttggtcagtttcaactcttagcacagtagcagctatgcactccccaaccccagttctgtggaaggcggctacgcgggtgttcctagagcttgcacacagcgtgggagccagaataggcaaaaagcatcttgtcctctaaatatttggggtctgtgctctgactgctgattgctgcttctgatcgtagaggtgcagacaaagagatgggtggccattgtcgttacacctcctcattattgcaagttcttccccctccaattaacaagacttccaggggatttaaagagctaatggtcctgctcccttgcttcacttttattttttcccatttgggagccagatgttagagaatatgacattgaaaagcaactgcatataagggggagaattaagaagtgactgtgcatgcctaggaaaaggtataggcacagtaaagacctgagaagaccctgagtttatacccaagactgatctttggcacagacggcctacagtaaacaaaaagaatcacacacacatccacacacagaataacaaaacccagtaaacttgaaaaggggaggatctgattttctgaattaccacagtattagattcaaatgttcagttttcaacaaaacaaatcacgaggcacacaaagaaacaggaaagtatgctcttccaaggaaaaaaaaaacaactgaaactgtgagaccacatagtagacctactagaaaaagattttaaaacaactgtcttaaagatatgcaaacaactaaagaagatgtggcgctgggggcggtagctcatgcctgtaaacccagcacttggggaggccaaggcaggtggatcacttgaggtcaggagtttgagaccagcctggccaacatggggataccctgtctctactaaaaatacaaaaactagctgggtgtggtggtgtgcactggtaatctcagctacttgggaggctgaggcaagagaatcgcttgaacctgggaggcagaggttgcagtgagccgagattgtgccattgcactccagcctgggtaacagagtgagactccttctctaaataaataaataaataagatgtggaaaaaggtaaaacagcgtatgaaggctgggtgtggtggcttacgcctgtaatcccagcattttgagaggcagatcagttgagtccaggagttcaagaccagcctggccaacatgttgaaacccgggtcatcgctagtaaataagacaaaaattagctgggcgtggtggcacaagcatgtagtctcagctactcaggaggctgaggcaggagaatcacttgtacccgggagatggaggttgcactgagccaagatcgtgccactgcactccagcctgggcaacagagacagattctgtctcaaaaaaaaaaaaaaaaaaagaaaaaagaaagaaaagaaaaaggaaaacagtgtacaaataaaatgtaaatataaataaagagatagaaaccctaaaaagaaactgaaaataattctggaactgaaaaatacaataactgaaatgagaaattcactggagggattcaaaggcagatttgagtaggcagatgaaagaatcagtgaatttgaagataagatattaaaattatcaagtctgacaaacagaaaaatgtttgaagaaacatgagcagagcctaagggtcatcatcaaagagactaacatgttttctgggagttatagaaagaaatgaaagggggagagagattatttgaagaaatagtatctggaagcttcccagatttgacgagagacatggatataaacatctaggaagttaaacgacctccaagtaagatgaactcaaggacacccacaccaagacacattacaatcaaactcccaaaagcgaaaaccaaagaacctttgggctggattcagtggctcacacctgtaatcccagcactttgggaggacaaggcaggaggatcacttgagttcaagctcagcctgggcaatatagtaagacctcatctctactaaaaatcaaaaaaattagccgggcgaggtggcatttgcctgtagtctcaggtcctcgggaggctaaggtgggaaaattgcttgagcctggaaggtcgaggctgcagtgagctatgattgaggcactgcactccagcctggcctaccgaatgagaccctgtctcaaaaaaggattcaacctgaggaagctgactaaaaaaacaaacttcagagaggagagaaatgcctcctcatatacaagggacccccaataagattataagcagatttctcatcaaaaactttggaggggtcaggtgcagtggctcacatccataatcccagcactttgggaggctgaggcaggtggatctcttgaggccaggagtttgagaccagcctggccaacatggcgaaactctgtctctaaaaatacaaaaattagccagggatggtggcgtatgtgcctgtaatcccagccatctgggtgcctgaggcacaagaatcgcttgaatctgggaggcagaggttgcagtgagctgagatcaggacactgcactccagcctggatgacagagtgagaatctgtctcaaaaaacaaaacaaaacaaaaaaacaaagtttggaggcaagaatacagtgggctgatatattcagagtgttaaaaagaaagaagacctgtcaactaaccatctaatacccagcaaaactgtccttcagaaatgaaaaagaaattaagatattcccaggtgaacaaaaatggagggagttcattagccacaagacctgccccgcaagaaatactcaagtgagtcctgcagagggaaattaaaggatattaaacagttactcaaagccatataaagaaatgaagatcttggccgggcacggtggctcatgcctgtaatcccatcactttgggaggccgaggtgggtggatcatgaggtcaagagatggagaccatcttggccaacatggtgaaaccccatctctactaaaaatacaagaattacctaagtgtggtggcttgtgcctgtagtccccagctactcaaggaggctgaggcaggagaatcgcttgaacccaggaggtggaggttgtagcgaactgagatctggccactgcgctccagcctggtgacagagcaagactccgtctcaaaaaaagaaatgaagaaaaaaaaaaaagaaaaagaaatgaagatctcaaaagtgaaggatatgtgcaattttaaaagctaatattactgtaacaatggtttataattgcatttttgtgttctacatgatttaagagactaaaatgcttttttaaaattagtctaaaagctagtagtattgtaatgttggtttgtgaatccacattttcttttcttttcttttttttttttttttagatggtgtcttgctctgtcacccaggctggagtacagtggtgtgatatgggctcactgcaacatctgcctcccgggttcaagtgattcttgtgcctcagcctcccaagtagctgggattacaggtgtgtgccaccacacccagctaatttttgtatttttagtagagacggggtttctccatgttggccgggctggtgttaaactccgacctcagttgatctgcccgccttggcctcccaaagtgctgggattataggcgtgagccaccgtgcccagcccacattttgttttctacataatttaaaataatttttttggtaaaataatttctaaagcatttaaaataattatttactttatggtttggggcacacagtttataaaggtataattttgtgatatcagtaagcaaaaaggttgaggacccagctgtaatggagtggagcttttctgtgttactgaaattaagctgatagaaatttaaattagtgttataactttaggatgttaaatgtaatcctcatggtaatgacagagaaaatcactgtagaatatacacaaaaggacatgagaaaggaatttaaatattttaatgtacccccaaaaatcaactaaacacaggagtagacagtaatgcaggaaactagggacaaaaaccttaaggcatatacaaaacaaaatgacaagccaggcgcggtggctcacgcctataaccccagcactttgggaggccgaggcgggtggatcacgaggtcaggagttcaagactagcctggccaagatggtgtaaccccgtctctactaaaaaaacagaaaaattagccaggcatggtggcggggacctgtaatcccagccacccgggaggctgaagcagagaattggttgaacccaggagacagaggttgcagtgagccaaggtcacaccattgcactccagcctgggcaacagagtgagactcgtcgcaaaaaaaaaggaacaaaatgatagaaataagtccctgtttattggttaattaccttaaatgtaaatggattaaactctccaatcaaaagacaaagattgtcaaaatggtttttaaaaccaatctgggctggacgcagtggctcacacctgtaatcccagcactttgggaggccaaggtgggtggatcacctgaggtcaggagttcgagaccagcctgggtaacatggtgaaacccaaactctactaaaaatacaaacattagctgggtgtagtggtgcatgcctgtaatcccagctacccaggaggctgaggcaggagaaatgcttgaacctgggtgacagaggttgtagtgagctgagattgcaccattgcactccagcctgggcaacaagagcaaaactccatctcaaaaaaaaaaaaaaaaacaaaaaacaatcctactatatgctatatataagagactcacggccaggtgcagtggctcaagcctgtaatcccagcagtttgggaggccgaggccagcagatgacaaggtcaggagatcgagaccatcctggttaatatgatggaaccctgtctctactgaaaagtggaaccctgtctctattaaaaaatacaaaaaaattagccatgcttggtggtgggtgcctgtagtcccagctactcaggaggctgaggcaggagaatggcgtgaacccgggaggcagagcttgcagtgagccgagatcgcaccactgtactccagcctgtgcaaaagagcgagactccgtctcaaaaaaaaaaaaaaaaaaaaaaagagagactcactttaaatccaaatgttgctggtgaaaggatagaaaaagatattccatgcaaatagtaatgaaaagggatcggggtggctattctactatcagacaaaaagagttacagaattgcaggaagaaatagacagttctacaataaaagttggaagctttaatatcccactatcaataatggatagaaaaataaagaaactttacatgataaaccaactagatttaacagacatttatagaacactctacccaataacaatagcatacattttctcaaatgtagatgggatgttttccaggatagactatatgttaagccacaaattagtgtcaatagattttaaaagatatacaaagtatgttcttattgcaaccacaacaggataaagttagaaatcagtaacagaaggaaaattggagaatccacaaatttgtgcaattaaccatatactcttagtcaaccaaagggtaaataaagaaattacaagagaaatttaaaaatacttaaagatgattgacaatgaaaacacacataccaaaatttatgggacagtgaaaacagtgctaaaggagaaatttatagctttaaatatatacattaaaaaataagaaaaatctcaaatcaacaacctaaactttaccatttaaggaactagaaaaggaagaaaaactaaactcaaaactagcagaaggaaggaaataataagattagaacagaggtaaaggaaatagagactagaaaacaatagagaaaatcagtgaaaccaaaagttgaatttttgtaaaggtaaacagaattgacaaacctttagccagatggatcaagaagaaatgagagaagacacaaatgattaaaaccagaaacaaagtagacccttactattgattcaacagaaacaaaaaggattatgacaggatggtgatctgttgaataccaacagattggataacctagatgaaatggacaaacccctagaaacacaaaacctactgagactaaaccgtgaaaaaatagaatacctgagtagatctataattagtaagaggatagaatcaataatcaaatatctccttgtaaagaaaagccctagacacgaagccttcaccagtgaatttaaccaagcatttaaagaagaactaacactatttcttctcaaatttttccaaacagttgaagaggagggaatacttctgaattcactctatgaggccagaattatgctgatatcaaaactagaaaagataaccacaagaaaaatacacatcagtatccctcatgaacattgatgcaaaaatcttcaagaaaatactagcaagtaaattcagcagcatattaaaaggattatacaccatgaccaaagtgggatatatttctggaatgcaaggatggttcaacatatgaaagtcagttacctaatatgctgttttaacaaaatgagggacaaaatcacatggtcactccactggtccataaaaagcacttgacaaaattcaacacccttttatggtaaaaacactcaacaaactgggaatagaaactaccccaacataataaaagccatatatgaaaaacagtgaacaattatacttaatggtaaaaaacggaaagcttttcctctaagatcagaaacaaggcaaaatgcctgcttttgtcacttcagttcaacacagtgctggaaattttagccagagtcattagccaagaaaaagaaattaagaggcatcaaaattgggaaggaagaagtaaaagtatctctgtttgcagatgacatgatcttgtatgtagaaaccctaaagattccacaaaaaattgtttgaactaatacatgaaactgacatagtagcagcatacaaagtcaatgcacaaaaatcagttgcatttctaaacaccaacaatgaataatatgaaaaagaaattaagaggaaaattccacttaaaatggcattaaaaagaataaggaggtgaaagactcatacaatgaaacatgaaacattgctgaaagaaattaaagacataggtaaatagaaacacattgtatgttgagaaattggaagacttaacattgtgtgtttggtttttggagacagggtcttgctctgtcacctaggctggagtgcagtggcacaatcacagctcactgcagcctcaatctcctaggctcaagtgatcctcccacctcagactcccaagtagctaggactacaggcatgcacaactatgcccggctttttttttttttttaattttttgtagagatggggtctcactatgttgctcaggctggtcttgaactcctgggctcaagtgatcctcctgccttggcctcccaaaattgtgggattacaggcatgaatcaccccgactagcctgacttaatattgttaagctgtccataccacccaaagtaatttataagttaattcaatacaatttctatcaaactcccaaggccattttttggcttgggagttttagaatataaaaatttattctaaaattcatatgggatctcaggagaacctgaaaagccccaacaaacctgaaaaagaacaaagctggagatctcaaacttcctgaacttaaaacttaactgcaaaaatgcagtcattgaaacagtgtattggacttggctgtggtatgaagaaataagaaaaagaagagaacagcatgatacataaaaatagacatagagaccgatgaaatcaatagcccagaaataaaccctcttatatagtcaagtgaaatttttttttttttttgagacagactgtcactctgttgcccaggctgcagtgcaatggcgtgatctcggctcactgcaacctccacctcctaggttcaaatgatgctcctgcctcagcctcccgagtagctgggactacaggcgtgtggcaccacacctggctaatttgtgtatttttagtagagacaggatttcgtgttagccaggctggtctggaactcttgacctcaagtgattcgcctgcatcagcctcccaaagtgctgggattacaggtgtgagccaccgtacctggcccagtcaagtgatttttgataaggacgtgaagattgttccacagggaaaggacagtcttttcaacaaatggtataggggaaactggatattcacatgcaaaagaatgaagttggacccttacctaatactacattcaaaaattaactcaaaatggccggggcctggtggctcacacctgtaatcccagcacttgggaggcccaggcaggcggatcacttgaggccaggagtttgagactagcggggccaacatggggaaactctgtctctactaaaaatataaaaaattagccaggtgtggtgatgcatgcctgtagtcccagctactctggaggctgaggcatgagaatcacttgaacccgggaggtggaggttgcagtgagccaaggttgcaccattgcactccagcctgggcaacagagcgaggctccatctcaaaaagaaacaaacagacaaaaaactcaacaatgaaaaaacccaattcaaaaatgggcaaaggacttgaatagatgtttccccagagaaggtaaacaaatgaccaataagcatatgaaaaatgaccatcactaattattagggcatgcatgtcaaaactataccccacacccattaggatggctactgtcaaaaaaaagaaaaaaaggaaataacaagggttggtaaggatgtgagaaatgggaaccctggtgcattgttcacaggaatgagatgatgcagccaatactagaaaacagtatggtggttgctcaaaaaaattaaaaatagaattaccatatgataccaaaattcagtcctgagtacagtatgtacccaagataattgaaagcagtatctcaaagagatgtttgtacactcatattcataggagccttattcacagtagttaaaatggggaagcaatccatgtgcgtctatcaacggatgaatggataaacaaaatgtagtatgtacatacaagagaatatgagtaagccttaaaaaggaaggagttctgatatgtgctataacacggatgaaccttgaagatactgtgttaaggagataagccagttagaaaaaaggcaaatactgtatggttccatttgtatgaggtatttagagtattcaaaatcacggtaaaaggaatctgaggagattaaaaaaaaaagagtagtcaaaatcataaagacggaaagtagaatggtagttgccaggggctggggggagggatgaatggggaattattgtttaatagagtttcagttttacaagattaaatattcgtggagatggataatggtgatgattgaagagcattatgaatgtattgaataccactgaaatgtatactttaaaaagggatactggtaattttacgttatgtgtattttaacattaaaaaattgggggatgagggctgggcatggtggcccacacctgtaatcccagcactttgggaggccaaggcgggcagatcacgaggtcaggagatcgagaccatcctgcctaacacggtgaaaccccgtctctactaaaaatacaaaaaaagcggggcgtggtggcgggcgcctgtggtcccagctactcagtaggctgaggcaggagaatcgcttgaacccaggaggtggaggttgcagtgagccaaggtggcgccactgcactccagcctggtgatagagtgagattccatctcaaaaaaaaattaaaattggggcatgagggcagggtgcagtggctcacatctgtaatcccagcactttgagaggcccaggcaggaagatcccttgtgcccaggagattgagaccagcctgggcaatatagtgagaccttgtctctacaaaaaaaaattaaaattacctgggtgtggggcacacgtctgtagtcccagctacttgggaggctgaggtgcgaggatcgcttgagcctgggaggttgaggctgcagtgaactgtgattgcaccactgccctcctacctaggtatatttgttttttggtttttttgttgttgttgtttcttgttttttgagacagagtcttgctctgtcgcccaggctggatgcaatggcacgatctcggctcactgcaacctccgcctcctgggttcaagtgattcttcctgcctcagcctcccaaatagctgggattacaggcatctgccaccacgcccagctaatttttgtgtttttagtagagacggggtttcgccatgttggccaggctggtctcgaactcctgacctcaggtgatctgcttgccttggcctcccaaagtgctgggattacaggcgtgatccaccacgcccagccctgtttttgtttttgttttttcaacagatgtaatttctgacttgtataccttttcaatcaagaatatgtatggactgcagcctgatgaagtttttcactcctttagtaatgtcctccttgttttacattttcaaagcctgcatagttacagattcatttgttttcaacgtttccccaggggaagacggaatctatcactgtggtgaagctgctgagctgctttgatgacctggtggcagcaggcacagcctctggcagggttgcagtttttcaacttgtatcttcattgccagggagaaataaacaggtgagtactcatgatcttaacacgtgttaacttcttggcacattcctcatggatttttaaaattagaaatcctcatctgcttagaaagtttatgctcagagaaagccgggcacgactttctctgcccaggctcatgcctgtaatcccagtactttggaaggccaaggcgggctgatcacgaggtcaagagatcaagaccatcctggccaacatggtgaaaccccatctctactaaaaatacaaaatttggccgggtgcagtggctcatgcctgtaatcccagcactttgggaggccgaggcaggcagatcacgaggtcaggagatcaagaccatcctgactaacacagtgaaactccatctctactaaaaaatacaaaaaattagccgggtgtggtggcgggtgcctgtagtcccagctactagggaggctgaggcaggagaatggcgtgaacccggaagacggagcttgcagtgagcggagatcacgccactgcactccagcctgggcgacagagggagactccatctaaaaaaagaaaaaaaatacaaaaattagctgggcgtggtggtgcgtgcctgtagtcccagctactcgggaggctgaggcaggagaatcacttgaacccgggaggcagaggtcacagtgagctgagattgtaccacgctactgcactccagcctgacggagcgagactctgtctcaaaaaaaaaaaaaatgctcagagaagcttaacactgtgctgtttataattggagaacatttttgtgctgggttggacacttggcataaagtacatgtgggtcatttcatttttgcttaatattctcaaggtatgctctctgtgggttttgaaggtgactagacagatggaactttgtgcagggttctgcttggaaaacgagattgggaaaaccagctcttccctaactaggagtgattgtataccttttccatgtagccccagctcacagcatttatcctttttttttcttgtgtatatttttatcccttgttcatagcttcggagatttgatgtcactggtattcacaaaaatagcattacagctctggcttggagccccaatggaatgaaattgttctctggagatgacaaaggcaaaattgtttattcttctctggatctagaccaggtaaaattattttcagaaatactgttggctcttaccttcttacatttggaaaaactatatttataacttgtatttttagtcaacttgtattcttgatcatcatccctttataatctcaattgttatttgtaacatttacttttatagacttatgttttataagcttccacttctatgactaaggagttggcctactggaacattcacttttttcattccactgttgtgtattacttttacttgaaaaagaagctattatcattcctacttccttgaaaggttagtaggagtgatgccaagcacttctgaatcctaactgtggacaagtcagtgatttcaatggatggaggactctgccagccacctggcctgtgtgagatgacctcatgtgacaggaagtggcagaggaggttaggtggcagtatggtgaagatgaagaaactggagtgccaagagatccaggaactagtccaggggtgcaggcttgcacctcacagagcttgctttcaaactgtgcttctgcttcgacgcccgtgccttttccactgcacgtatggcttgatgatctgctgggttttatttgttttgtcatgtgtctgcaaccaaactgaactccttggtggcacagtcctttctttttcttatttgtagccttcattcctagagcactataggaattcagcaattttttttttttttgagacagtctcgctcttgtcgcccaggctggagtgcagtggcccaatctcggcttgtgacaacctccatatcccgggttcaagcgattctgccacctcagcctcgcaagtagctgggattacagggacctgccatcatgcccgactaatttttgtatttttgtagagacggagttttaccatgttggtcaggctggtcttgaactcctgaccttagatgatctgcctgcctcggccttccaaagtgctgggattacaggcgtgagccaccacgcccagccaagaattcagcaattattagctgcatgactttcagtccctctgatccaagactgacctagtacaaatattctctagtagtagttctcaagctttgtagtcacaggatccctttacactcttagaaagaggaccccaaagcatttttgttcatatgggttatctctaccaagtacaccatgttagaagttacaactgagaaatttaaaaatatacatatttttttgagatggagtctcgctctgttgcccaggctggagtgcagtggcgcgatctcggctcactgcaacctccgcctcccgggttcaagggattctcatgcctcagcctcccgagtagctgggactacaggcacctgccaccacgtctgactacttttttgtattttttgtagagatagtgtttcaccgttttagccaggatggtttcaatctcctgaccctgtgattgaaatctcccacctcagcctcccaaagtgctgggattacaggcgtgagccactgcgcctggctgaaatttaaaaatattttactttgaaataataaatccataacatctgcacataagtgacatattttgtgaaaatatctctatagctctattttcaaaacaggtgagaagagtgagtggcattgatttatatttttacaaatttctttattatctggcttaatagaagatggctggattctccctaatctcaagtaatcagggacacaaacactgcggaaggccgcagggtcctctgcctaggaaaaccagagacctttgttcacttgtttatctgctgaccttccctccactattgtcccatgaccctgccaaatccccctctgtgagaaacacccaagaattatcaataaaaaaataaattaaaaaaaaaaataaaaaataaaaaataaaaaaataaaaacacacctcaccaagctcagccaccaacttaaaaaggactggacaatacttttaccactttcccttctcagaattcaggcctgtcctcggaatgctacagggtacagcccatttgagctcctgtatggatactcctttttgttaggccccagtctcattccggacactagaccaacttagactgtgccccccctcaaaaaaaaaaaacttgtcatccctactatcttctgtctagtcatattcctattcaccattctcaactaactcatacatgccctgctctggtttacactgccggtttacactgtttttccaagccatcgcagctgatatctcctggtgctatccccaaactgccactcttaactcttgaagtaaataaataatctttgctggcaggactgtgctgaatctccttaggcactctctaatcagatatcctgagtcgtcccaattcttagaccttttatacctgtttttctccttctgttattccatttagtttctcaattcatccaaaaccatatccaggccatcatcaatcattctatatgacaaatgtttcttctaacatccccacgatatcaccccttaccacaagacctcccttcagcttaatctctcccactctatgttcccacgccgcccctaatcctgcttgaagcagccctgagaaacatcgcccattctctctccataccaccccccaaaaatttttgccgccccaacatttcaacaccattttgttttatttttcttattaatataagaaggcaggaatgtcaggcctctgagcccaagccaagccatcacatcccctgtgacttccacgtacgtatacgcccagatggcctgaagtaactgaagaatcacaaaagaagtgaatatgccctgccccgccttaactgatgacattccaccacaaaagaagtgtaaatggcctgtccttgctttaagtgatgacattaccttgtgaaagtccttttcctggctcatcctggctcaaaaagcacccccactgagcaccttgcgacccctgcccctgtccaccagagaacaaccccctttgactgtaattttccattaccttcccaaatcctataaaacggccccacccctatctccctctgctgactctcttttcggactcagcctgcctgcacccaggtgaaataaacagccatgttgctcaaaaaaaaaaaaaaaaaaaaaaaaaaaaaaaagaagatggctggattctgcattcaatctgttgccatacattgttttgattgaagtgtataaagaaaaactggctttacacagacatgtagttggaaatgggaggagtattttgatagccttttcagatagttgtggacattctttaataatatcctcatatgactacctcataaagcaaatggtagttgctttaaaggttacggtgacaaatgacaaatggtagtttctttaaaggttagtaaaaatgtggaatctgaaaccacatggatgaatttttcctactctgttacattaaaatctactttacccatgttggattttgtaacattatgtattggtcacttagaaaatactattcacagagtgatgcagatcttccaaatgttgacactttttttttttttttttttttttttgagacatggtcttactcctctcacccaggctggtgcacagtggtgcaatcacggctcactgcagctttgacttcccaggttcaggtgattcccccaccttggcctcccgagtagctgggactatgggtgcacaccaccatgcccagctgatttttttgtatttttatagagacagggcttcgccatgttgcacaggctggtcttgaacatctgggctcaagcaatctgctcaccacagtcttccaaagttcttggattacaggtttgagccaccgtgccagctgataaattttctaatacaatatcaaaaaaataccttcattaacatcaacatcattgtaatcgggaaagtctagctataaggaatcatgtcaagttcacagggacagatacaagttttcagattgctaatctttgtgtgagagcaacaaataccattacttgttttccttgaagtgacaggcttttttttttttttgagaaaatgtctgctaaatacccaaatttgaataattacagcatttcaaataaaaatggtgttttgtgaaaaaagcagctggctcagctcatagctgcaacagttgcacaagtggtttccttgagagaaccactgagtgtatttcagtgtgcagcagaagggagaatacaaaagtacctatcctctggccaggtgtggtggctcacacccgtaatcccagcactttgggaggccaaggcaggatgatcacttgagcccaggaatttgagaccagtctgggcaacatggcaaaaccccatttctaccaaaaaacataaaaattagccaggtatggtgatgcacacctgtaatcccagctactctggaggctgaggttggaggatcagttgagccttggaggtggagattgcagtgagctgagattgcaccactacactccagcctaggccaagagccagaacctgtctcaaaaaaaaggtttgcaacattttcatgtaatggaaatttctttatcttgattttggtgttggttacatgactataaatttgtcaaaattcatagaattgtatacccaaaaagggacgaaatttactgtaagttttaccaacaaatctgatcactgccccctacttccctcacaaaatgtcagtgatgttacagcagtatttctgaaataattgatgaaacttttcatatatatattggatttcatatatatgaaatatacatatatttcatatatatataatgtatatatatatatattttttgagacagagtctcactgtgttgcccaggctggagtgcagtggtgcgatcttggctcactgcaacccttgcctctgggttcaagtgattctcctgccgcagcctcccaagtagctgggattacaggcatgtgccacctcgcccagctaaattttgtatttttagtagagacgaggtttcaccatgttggccaggctggtctcgatctcctgacctcaaacgatccacccacctcggcctaccaaaatatagggattacaagtgtgagccactgcacccggcctgatgacacttttctgtaaaagtaacttacagaatcagattttttatacaatgaaatatgctttgtgttagcagtcgtatgccttctagaattttattttgtgtttatatataaaatatggtttttttttcttttttaaagacagagtctcactctgctacctgggctagagtgcagtggtgtgatcacaactcactgtaacctgaactcctgggctcaaatgatccttctgtctcagcctcccaagtagcggggaccataggcacgtgccaacatgcctggctaataaaaaaaatttttttgtagagacatgatctcacaatgttgcccaggctggtcttgtaaagtatcattttatgttaatagcattttatatatttaatatcatttaatttcttctaaccttctgttttctattaccctttcagttggcaaggatataatgtcctcaaagctgctttgaaccctttgtgaggggagactataatatgaacttacagagctgattattgtcgcaataattttatagaatgttccattccattgttttataatagaataagcaatacacacagtgcaacagatttctgtttagatctttatggattcttctttgaactctctgcatgtttactgcatcatccctgagcctgctatggtgcacagtaaagaatgtatctactgaggacatgtttttaaaaattatgcagattttaaaatgtttcctgtcaaactggatgcagcatgagggagatgttagtatggactcttttcccatccgtcaaataatctcgctatggtgggttgagagtgaatctgcagagagtgaaagcatgcgttaagtaaggtgcaagctgacctaagcacagctagcgggaaggacactgacttgtcctaagggaggtccattctttagcctggcgctgatgtgaggtgtaaccagactttctctgccaggggctctgtaactcccagctggtgttggaggagccatcttccattgtgcagctggattatagccagaaagtgctgctggtctctactctgcaaagaagtctgctcttttacactgaagaaaagtctgtaaggcaaattggaacacaaccaaggaaaaggtaagtttcacaagtttgccagtttggcctaaatgctgggccttgttgtagaaggtgctttagggtttcttaggtctcctgtttgccggagacctcctgtttgcaaacccacagcgcctctaagcctggggttcctggtggggccctgtgcctgcttaggatttctcctcccagaggcagacaagaagagtgtgttcttcttgtcgcagagctgtaggagcctgcacacacagccactctgcctctcagggtgccacagtcagcgcagagaagcctcaggggtggcctggtctatctgttccttgtggagccacctcctccacacagccctggtgaggggtcagggttgtggggctcactcgttattcagcacgtgtttaccatgcacccctgtgcactgtggcaggctcagcagtgacatggtaaacacggcagatctgagccctccgttgtggaaatggaaacacagatagaacacttgttgaccactgtgtcagctgctgtggaccaaaatacacaggatgctgtgtgagtttagacacacttttgtccaggtgaagggtcagggaagacatcctgaaggcatgggttccaggttgagagatcattcctcctttgaccagtgatgtggaggaagggcatcgagaagtccaccagccataccagccgtgtgggaaaagacaactggaacacctggggaacctgtaattcatcatcccaccctagcctgtaaagcactcttgtaggactctgcagcgagtttgcgtggggatggggtgaggaggggtaggtagagcagtggagctgacccctcctatgccaaggaggaggtagactggggccaacgtgggggtgggaagcagagggcggcattagtacagatcatgcgttgatgagtctacagtcatggattgtcgattggccgatgggagctggaagagttcccgtcttgtgtctcccaggaaagggcactgtttgcctgcatagaatcaggggcagggcagctgatggtcacggcatgtggggagggcttgaggctggccctgtggagagtgacagcagggactgggaaacatggtgagattggcaggcgttgatgaggccctgcggctggtggtgccgttggggacaggccgtcctggagagtcgggtgaggcggagccagcccctgtggtcgtagtcactgcccgttattctgtgttctgggctttgcggcaacacacaagtttattctcttttctgcatggcagccctccggctgttaaaagacgctctcaaacctcccctttcttctattttcgatgctgaacaccttcttttttctttttctttttcttttttgtttgagacagagttttgctcttcttgcccaggctggagtgcagtggtgcgatcttggctcactgcaacatctgcctcctgggttcaagcgattctcctgcctcagcctcctgagtagctgagattacaggcatgtgccaccacacccggctaattttgtatttttagtagagacagggtttcaccatgttggtcaggctggtctcaaactcccgacctcaggtgatccgcctgccttggcctcccaaagtgctgggattacaggtgtgagccaccacatgcggcctgctgaacaccttcttaatcccatcaacaatctggcctttttatatctgcagtctccctttcggtccctggagaactcagtggaatttatggccctgcagatcttagttctgctgctctctctgccagtatcctactcctctggcattttatcctggttcgtctgtcaatgttttactgcactgtcttggaaggaaggcagagtgtaaagagaggcattgaaaaccaattactttacatgtgggtcctattcccaacaatctctcttaaaacctggcccttggccggacacagtggctcacgcctgtaatcccaacactttgggaggccaaggtgggcgggtcacttgaggtcaggagttcaagaacagcctggccaacatggtgaaacctcctctctactaaaaacacaaaagtttgccaggcagggtagcaggcgcctgtaatcccagctactcaggaggctgaggcaggagaatcgcttgaaccggggagacaaaggttgcagtgagctgagactgcaccaccgcactccagcctgggtgacagagcgagacttcatctcaaaaaaatcgaaaacaaaaaaacaaaaaacaaacctggccctttaacctcttgtgtggagacccaggcagtttctgtaaacctctcctagtgcgtctgtgcagtcaagtctttagggaacattgattgaaagcgtgctctgctccccaggaacgttttaggatgcagaaacaaataaatgtgtccccttctcagaaggagagagattttactgagccttggggaaatgagggctaacagaataagaggaaatgtttttaacatctgtgtcttaaagacttgctttctgctgtagactattgtgtgcgtctatccctggaagcagtgcttccctcacaactgtttagtgagcggagctaggcatgtacacgtggaggcgtgacagcaagtacggaggcatccaaggagacaaggcctctgccctcaaacacaatgagagagactgtcggtcagcaggaggagagtagaggctgtcagtgctgtaaaggagcgggctaggtgaagcattagggagtgctaggcatggggcaggaagttgcatttggataggatggtcaggaaaggcctctacaagggcagtgatctttgagctgaagcctgggaagagctgctggaagagcattccaggctcagggaacagcatatgccaagacctcaattgggcaagagcttagatgttcaagaagccagaagtgactagggcactggctatggctggagtccaggggagccgtggggaggctgacacgggagtccaggggagccgtggggaggctgccatgggagtccaggggagctgcgaggaggctggcacgggagtccaggggagcctggcatgggagtccaggggagccgtggggaggctgccacgggagtccaggggagccgtggggaggctggcacgggagtccaggggagccacggggaggctgctgcaggagtccaggggagccgcagggaggcaggggagccgcagggaggctgccttgggagtccagggaaaccattgactgagatggagactggagactggggaaggctgggccagaggtcaggacatcaggacctctgctgtggacataaggggtttgacgggcctgtcaggtggctgcgtgggagtcgcagaagagagttctgtggaccggtctggagcccagggaagaagtcttgaccagaggggaaaatgaggtcaccagatacaggtgacactgacaccctgacattggatgaatccacgcagggaatgtctgttcattcagcgctggagctttgcgccaagcctctgccctgctccagtactcctcatcgggggatatctgtgaacaaggcagaacagatctctaatctcagggagctgtgtgcagagtagtgaacagataaacatgtcagagggtgcagagccagagagggaggagcaggagacacaggtgtctctttaataggatgacagggaaggctcctctgaggaggtagcatgggctgattcctgaaacaaagaggcaactagtgcgagaagaccttagagagaggctctggaggcagagggccctgcgcaccgaggatctgagcagccaggctggctgtgtggagcacggtgtggggagccccctcccgtcggctttgtgggccctgcccatggggctctttcagtccagtgctgtggtcagtcacagagggctgtggccaagccagggaggtcactctggctgctgcttggaatatgctggagggggcaggtgtggcagctcagcagggccagcaaggattctgggtgatccgggtaggagaagacaggatggggcggggttggtggtcggactgcttccaaggcagagctggcagatttgctgccacgttggttctgaggtgtgagagggatgagttggagatgattcctaggtctgtggtctatgcagctgggtgagtggacatgctgtggattgacgcagagaatcctggaggcacggggagaaggaggagatggaacagcctgctgtggccccgccatgtcctctccctgcagtggagagctggcgtgggaggcgggtggcgggtgtacctctcggggagctgtgcgctggcagccactggcatgcagacaggagctcgcctagggagatttgggcaggcttgtgttctgaagaggaaagggcatcaggagagaacaggagttggggggtcagaggagtcggaggccatatggagggacatagcagctgctgcgagaccgggggctgaggcagcttcgacgggcctgagtctgtagcatggaggctgtgcacagccctcctcatcagcagggccaagggattggaagggctgaaagaggagttgacggcgagtatggagagcttttaggaggagtgtttttgtagaagagaacaaagaaagacaaataggtggtgcccaggggggaaccatgtggcctggtgggagttttgggagaggggccgtgtggcagcacattggtgtgtgacgcgggtgcctgtggagggaacacagtgctggtggggacagagtgcaggcggtggcctcagttgggccctctcatgggcagcagtgtagggttgaccagaaaccgggacagagactctcttccagagaaagggcagggcactgagcacagggcaggtgcaggcaggtcaggaggcccagaggtagaagacgaggggtcctcttcccgtcgagtccgtgaacctcttcagaccggatgatgtgtgttacatccagaaaacctcagaggccctagccatctgcaaccgtgggtttgctgtcctgtgtatttatgttgcattgtttcatgtgtcagagccctctgcagacctgttactgtgtcccctgtgagtctagtactcagggaagccctccctggcagtagcactttgccctggggaaggagaaggagacgcagcaatctgtaggtgtggcgcccgcatgtgggtaagagccagcagccggttctggaaccccgcgactagcacatctgtttggatggccagtgggtgttagctgttgagatctctggcagggcttctgtggatccttcttctcactcagcttagactttcaggctcccattttgggtgctgtcagctttcagcgtatcagctctgtggcaccatacattatgcacaaaatcataaaacaccattttatagctagaatttgttagccagaacacactccttacatatcaacgtggtctataaagggaattaaaatttttttaggtaatcaatgaggtttttggaaatcatctctaccgaaattaagaaattatattaatttgtttatgattttagaatcctgcaatacttagaccttaaaagttggagcttcagtgtcaaattcagaaagcaccagcaagtactgcagaatcgcactgcaagtggatggtggctgagtcgggggcttaggacaatttgtacctggctctagctggttcttcacaacttcactgcctttgaccaacccactcatcagacatttccgttctttttattttttagagacagggtcttgctgtgtcaccaaggctggggtgcagtggtgtgatcacagctcactgcagccttgaacagctgggttcaggcgatcctcctccctcagcctcccgagtaactaggactacaggcacgcaccaccatgcctggctaaattttttaatttgtagagatggtgtctctctaggtcacccaggctgttgtcaaactcctgggctcaagcagtcctccctccttggcctccaaaagtgctgggattacaggtgtgagccaccatgcccagctattcagcagttttagaggcagccactcccaggaccttgctcagcagggctcctttcccttcctccagggtaagagtccacctggtgttcaggacctcgccttctcatgcccactcagatgcaccaccttgatctgagctctttgagcagctctttgagcctcagatggcgcttccagatgctgatgtgattgttcacacaggtcagcacagtgttatgagacaggctgaggacctcatcttatttattttttattttacccagagcatcaaacacgatgtcttacagaatgtaggaatcactaaatgtttgttaacatgagtgctttagttacataagatgaaccagtcaaaatggaaatgacaagagatttttcagaggtcctacaaatagaaggaaaacatttaaaaattggatcgccaagagaaattgattgacaggaaaggcagaggaagagattatgggctcccttgctggaattcctctggttcgctctatttagaggacatctccagaacaaacccaccaaaggcagtaatcagatacgatgctgttgatagagttgtccataaaagatccacgatgtcaaaacacccttggttcgtcctaacgatcattgtttcaaagctgaatttgatatataatatcctccttggaccctatccaaagggatttagttactgaggtgccagagggacctagtgagattctggtgtgcgaagaaaccccgcaaataactatctgtttgcctatgtgggtgggccctgggggtggcctctagggttgggtgtgctgctgtgtgcagggagtgtgggaacaggcacagcacaagttggccgaggtctggtggggaagcagtggcacggaggcagctctcaactgtgacctgcctgtagcctcgttcaggacaattgagcacttatggggacttagtgtcacaagcattgcttttgtgctgcatgtaagtaatctcattaattcctcacttcagcctttgagatgggagttactctgcctggtttacagaatgggaaacgggtccagaaaagttcaataattgcacgtaccacatacccactaggtgtcagggctggacatcgagcccagggctagctctaaaaccagtgctgtttctgcttttcacaatctgagaagtatttgggagaaggaatcagccaggcatagggctgaactgaaatgcttacatgtgaactctgttagcatcctgagaaataacgagaactcagattgccagtgggagtgtagattgtataatcacgtttaaaaagcttgaagttgtcttctaaacttgaatatgctctcagcaacccagcgattaccccacagcccaccaactgcatcctgagtgtccgtgacagactctgacacctgtgggctaaggggtatgcacagaaatgctcatagcacaattgctcaaaatagctttaaaaaataataattgaaatatccatcaacaagaaaatgaataaatgaattgtggaatacattaagtcctcgtttaatgtcattgataggttcttggaaactgcgacattagcaaaacaacgtataacaaaaccagtgtttttccctcaccaatgttgttgaaggagatggtgttatctgaggacctgctctatgtcatttcgcttacagttgtagtttctaagaacctgtggacgctgagtaggacgtactgtaccattcagcagtagaaatgaattagtgcgacagcttctttttatcaagaaggataaatctgagaaacatagtgttaagtgagaaaaagcaaaagagtacaattagcatcatacattttaataaaaatgaaagataaacaatactaaattatattgtctttagagatacatagatatgtgattaaaccaacaaaaaagtgaggaaatgataaaggcaaaatgcagtccagtggttccatctggggcacaagggggcaggaagtgttaggagcacaggagaacattggttgggtgactgatgatttctttcctaagtttggggatgggttcccaggtgtacctttccttgctaggcttcataactgcatggatatatgtacatatacacagtggtgcactgcataacaacatttcagtcattgacggactgcatgtatgacagtggtcgcagaagattataatggagctgaaaaaattcctatcagctggtgtcttagcgccacacattacgtgttctgtttttagatagacaaacagtcatcattatgttacaggtgcctacagtgttaagtacagtcatatggagtacaggtttgcagtccaggggcaataggctagactaagcttgtccaacccacggcccaacacaaatttgtaaactttcttaaaatgagattttttggccaggcgcagtggctcatgcctgtaatcccagcactttgggaagccaaggcaggtggatcacttgaggtcaggagttcgagaccagcctggccaacatggtaaaaccccatctctactaaaaatacacagttagctgggcatggcggtgcacacctataatcccagctacatgggaggctgaggcaggagaatcacttgaacccaagagggagaggttccattgcattgagcccagattgcgccattgcactgcatcctggacaacaagagcaaaactctgtctcaaaaaaaaaaaaagaggttttttttgtgactattattattattattattatttttagctcatcagctattgttagtgtattttatgtgtggcccaagacaattcttcttcttccaatgtggcccagggaagccaaaagattggacagccctgggctagactatgtgggtgtgtcataggctgtgccatctaggtttgtgtaagtacgctctatgatgttcacacaacgaagacatcgcctaatgacatatttctcaaacatccctgtcactaagtgacctgtgactctatatatagcatattcttttgtttgtgtcagatatttcataatttcagaaagaaaaaatatcaagcttgggggcaggaagggacattggtgcctctgatgggtttagagaaattctgaaaaggcaacaatatagatgggttgctgtgaagctcattcattcaggatgtggactgagcacagcaatcagacgtcagaagcaacagaatcagagcagggaaaggatgagcagacctggattcttcaccttctgcctcagtttcctctcctccaaaacgggagttgtaatacagtcatgtgtcacctaacaactggaatatattctgagaaatgcattgttaggtgacatctttgttgtatgaacagcattgagtgtactgacaagcgtaggtggtaggtacagcctacttccacctgggctaaatggtacagcatattgctcctgggctacagacttgcaccacatgtgactgtactgaatactttaggcagctgtagcacaacggtaagtaattgtatgtctaaacatagaaaaggtaccataaaaatatggtattataatcttatgggaccactgttgtatttgcggtccatcattgactaaaatggtttgttgttgttgtttttgaagcagagtcttgctctgtcacccaggttggagtacagtagtggcactatctcagctcactgcaaactctgcctcccaggttcaagcgattctcctgcctcagcctcccgagtagctgggactacaggcatgcgccaccatgcctggctaatttttgtatttttagtagaggcatggtttcaccatgttggccaggctagtctcaaactcttgacctcagatgatctgccgtcttggcctcccaaagtgctgagattgcaggcatgatgcatccagcctgaatacaatgttatgtgatgcgtgactgtatctgccactcatggttgttgtaaggattagacacgagagtgggatcaagtgccaggcacagtgcaggctgtgtgagtactcagtgaatggttccctgtgtgctaatggggcacacacctgtgagggtgtggtcgggcctctgttggtacagggatgacagtgtggtttgacaaaaaacaaacagtagaaagggtgaaaaatcaattattgtcttagccaaaaaattcttgttgtacttaatattaagggttgacaactgcattactttaaatcagtccatgtctgttttttgttctttctttctttcttctaattttagtactgggaaatttggtgcttgttttataccaggactctgtaagcaaagtgatctaaccttgtatgcgtcacggcccgggctccggctatggaaggctgatgtccacgggactgttcaagccacgtttatcttaaaagatgcttttgccgggggagtcaagccttttgaactgcacccgcgtctggaatcccccaacagtggaagttgcagcttacctgagaggcacctggggcttgtttcatgtttctttcaagaaggctgggtgctgagttggaatgaatatagtatctatctcctagacacagtcaaccaggtaagtgaagggacgccaccatatcttctgtgtctataggcaagagaatgtatctctataaactgttctactcagggacctcagaatgctaccaggagcagtattgacttacactttactttttcctttgggccagtcaaggaaatcaaatgaaggtttggtaatttttatagatttgaaaaaaaaaatttggttttgacatttaggtccaattttctgccgagaaatgatgtatgttttttgtatgtaaacacaaaattaaacttgttctttttgttgttgttgttgttgttgttgttgttgagaaagagtctcgctctgtcacccaggctggagtgcagtggcatgatctcggcttactgcaacctccacctcccaggttcaagcgattctcctgcctcagcctcctgagtagctgggattacagacgcatgccaccacgcctggctaatttttgtatttttagtagagacagggtttcacaatgttggtcaggctggtcttgaactcctgacctcgtgatctgcccgccttggcctcccaaattgctgggattacaggcgtgagccaccatgcctggtttttttttttgttttttttttttgagatggagtcctagtatgtcacccaggctggagtgcagtgtgcagtggtgcaatctgggctcactgcaacctccacctcccgagttcaagcgattctcctgcctcagcctcccaagtagctgggattacaggtgcgcaccaccacgcctggctaatttttttgtatttttagtagagacagggtttcaccatgttggccaggctggtctcgaactcctgactcaggtgatccgccagcctcggcctcccaaagtgctggggttacaggcgtgaaccgccgcgcccggccgccacttggttttttttttgttttttgttttttattttcagttttctttacttagcaatatatcttgggcaaatttccaacatcattaaaatcatggtaggaaataatttctgcttaaaccaagatgataacagattatcatcagagacagatttagaaactttaaacaaagctgtttagtttcagtttctccttgtcttaagagcagagcttttgctctttttaaaataaactccctgccttaccctcccgactcctcacccccagactctagaccaggccctgtcctgttcacgttcttccattctgagctcagcgggcctctgacaggcacccctttcttttataagcagagcctcactgtagaaaataaacagttttcagccaggcgcagtggcttacgcctgtaatcccagcactttgggcactttggaaggccgaggtaggtggataacctgaggtcaggagttcaaggccagcctggccaacatggtgaaactccgtctctactaaaaatacaaaaattagccaggcatggtggtgggcgcctgtagtcctggctactcgggaggctgaggcaggagaattgcttgaacctgggaggcggaggttgcaatgagccaagatcacaccactgcactccagcctgggtgacagagcaagacttcatttgaaaaaaagaaaagaaagggttttcttctttggtgtgtgtcagcagaacatgaagttcatcttctcctcattgaagttttatgaattattatcagccgtacctggtaacactggtttggcagaaagaaaactggcccggggtggggggcagaactagactcgactcttctagcctggttctgcctttaaccaagagtctcttatcggccggagcctggtttgttttcctgtaaaatggggtgggggtggaagaagcatcgacttaggggaatcaccaaggtgccttgagtttgttcattttataagggatattctgaaaggtatttttgcaccctttcctcagttacagagaacttctttccctggataccttttgaacttatgtgcacttattaattagtagcatcaagatgctttgtaactgtgcattggttctttcatctgagcatttacccgatgctttacccagtaggtataattaacttcattttataggtagagaaatggagacaggggaccgtctgggacagatgtcacagtcaccctcagagactggaccacccagtggcagcatgactggcagctttcggaaacaaatgttatgtttgcagcagtccatcagttatttaaaattagccaaaaacatagactctccttctacaacagactagtctctttatttgcactgtctacagcaaagcaaggacttgctttaagtcagtgtgggctcaggatgtcctgtgttttgttgccacccactttcagataatgctggaggaacctcccctcccttcatgtattcattcaaaacccatgagttgcagtgcgcactggcctctcctgcaggaatgcacacagtagggggactagacgtgtctgcacgttatttcagcccaggagtggggcgtcaagcggaagtttggatgaggtgctgcaagccctgagagccctgggtgttgcagcagagggcaagcttgtcagaggctgcttctcacagaggtggcgtctggagagaactggaacttccccagcaaacatggataggaaaggaatttgagcagaaagagaagcacgtgcattcaccatggaggaacagggctgggactgggctggcagggccggtgcacctgcagcagggacgagggcagggtggtacgtgggtcggagatgaccgaggccccaccatgccaggggacccctcagatcctgcttaccaatctgtgagatgttacctaactttggattgaattggaattttcagaaagttaccatagtaaagtgcagttatcatttgactgatttggactctcacacatgcatttttatgctttgagctgttaccgttgtttagttttgtgttttttgttttttttttttttttttttttgacaggccacagttgctggtttggaaggatccggtgatattgtgtctgtttcgtgcacagaaaatgaaatatttttcttgaaaggagataggaacattataagaatttcaagcaggcctgaaggattaacatcaacaggtttgtatttattataaaatgtaccatgtatatgatgggaagtactatactctgttgtttgtaattgcagttaataattgatcaaacttaccattgggccaggcatggtggctcacgcctgtaatcccagcactttgggaggctgaggtgggtggatcgcttaagctcaggactttaagaccagcctgggcaacatggtaaaaccctgtctctaccaaaaatacaaaaaactagccaggcgtggtggcatgcgcctgtggtctcaagtactcgggaggctgaggtgggaggatcgcttgagcctgggaggcagaggttgctgtaagctaagattgcaccactgcactccagcctggatgacagagtgagacctcatctcaaaaacaaaaccaaaaacttaccattattttgctaaactattgcaactttatttgaacttggaggatttggagggtttcctctgattctttttttttttttttgagatggagtttcgctcttgttgcccaggctagagtgcaatgaggcgatctcagctcaccgcaacctctgcctcccaggttcaagctattctcctgcctcagcctcctgagtagctgggattacaggcatgcgccattatgccaggctaattttgtatttttagtagagacagggtttctccatgttggtcaggcaggtctcaaactcccgacctcaggcgatccgcctgcctccgcctcccaaagtgctgggattaaaggcgtgagccactgtgcccggccgctcctctgattgttaaaatagcatttacagtacatttcttgaaagtcacctactttaaggcttacatcagatagtctcacatttagtggagttgctttcatggttgtggaagatggggagattgagaaaggaggaaggaaaaatcagaaaccactttactgatccctgctctccgtctgagacagtatgtgggattaatgctccaaaagacatagatttgcatagagttttagaatatttaaatctgtcatctgggacataccgtttacccttaactcagttcttccttgtaggatttatttttctctgtgcttttgacattttttggtaattcatacaagcccaaattttaatgagcaaagaatcctaatatgtgtcctcttgcggacatccacatgctttatatatttgggttcctcggggaacttgttcctcatggtggcaacaacagccatgtggaccccatcaccctcctcctcactaccattacctctgatgtcagagagggcaaattggggtgaatattccaaaacataatttgtataagaagtgaataagctctgactcttgagtttatgagctgggggcccctcagacagtgtcatcaaagggttagaatggctttcaggaagggtggtgacttggagccaccaggctaagctctggacctctgctgcccatagagctttctgcagtgatgaagatgctcccatctgccctgtctggtaggcagtccctgtccatgtgtggctgctgagtacttgcaatatagcaagtgcagctgagagatgaattttacattttgtttaatttttattttattttattttattttttgagacagagtcttgctctgtatcccaggctagagtgcagtggtgcagtctctggtcactgcaacctccacctcctgggttcaaacgattctcctgccttagcctcccgaatagctgggattacaggtgtgcaccaccacaccaggctaatattttgtattttagtagaaagggggtttcaccatgcaccatgttacccaggctggtctcgaactcctgagctcaggcagtcctcccaccttagcctcccaaagtgatgggattacaggcatgagccaccgcgcccagcctaaattttgttcaattttgatcaatttgaatttcaatacttacaagtagctggtggctgcctattggacagggagctctaggcaagatctgccattaagttatgtaatcttcagcaagtcgcttcacagcagagtcctcccctccagtctccagtgtacacttcattgcctgcagtctgcccctaacacatgccctcaatagaatgtgggtgcttcaagggcaggaattcctgtgtcttatggactgccatgtcccagcagctagccctgtgtctggcacacggaggatccccgataaagagaggatggcgaatggatcaaagtgggctgtggtcttgtgttgagggtactgtagctggaactgctctggccttgtgccctgtggtgtcgtgttgcagaaaagatgagtccactgcagtgggaagctcactggcccttgggcttggggacaggagacaggtactcacatgcctgttctcactctgcggtctactggccttgatgctgtgtggtaatggacttctctgtcttgagtttgttctaatggaaaattacctttccctcttccaggaaacttaattacaggtacacatgtatttttcaaatgccctttgagtaatcttaaagtatattcaaggcagagtcttagtatgaagtataactaagctgttttgttatacacaggcatctctcatttgtaaataatttgtaaattgaagcgagaaatgctgtattcttagtatttttttacttttttttttttttttttgagacaggtttcactctgtcgtgcaggctggagtgcagtggcatgatctcagctcactgcaacctccacctcccaggctcaaatgattctcccacctcagcctcccaagtagctgggactatgggcgtgcaccaccacaccctgctaaattttgagactccgtctcaaaaataaataaataaataaatataaaaagaaagctatggcaaattattttactgattttaatatatgagcttcttgaagaacaaaaactgtttcttagagtcttttgtatgattcttttagttttggtggattttttttttttttttttttgagacggagtctcactgtgttgcccaggctggagtgcagtggcgcaatctcggctcactgcaagctttgcctcccaggttcacaccattctcctgcctcagcctcccaagtagctgggacccccggcgcccgccaccatgcccggctaattttttgtatttttagtagagacggggtttcactgtgttagccaggatggtcttgatctcctgaccttgtgatccgcccgccttggcctcccaaagtgctgggattacaggcgtgagtcaccgtgcccatcctagttttgctggtttctatgaatttagaatcattcagttctttagctggctggtgcctctgtgacaactggtatttagggctagcaaacgtggataagtgcacatcagctctctcttggatcaccagtggtaaaaccagactcttctttcttagtgagagatggtctggagatgtctggatgctcagagcgtgtccacgtgcagcaagcggagaagctgccaggggccacagtttctgagacgaggctcagaggctcttccatggccagctccgtggccagcgagccaaggagcaggagcagctcgctcaactccaccgacagcggctccgggctcctgccccctgggctccaggccacccctgagctgggcaagggcagccagcccctgtcacagagattcaacgccatcagctcagaggactttgaccaggagcttgtcgtgaagcctatcaaagtgaaaaggaagaagaagaagaagaagacaggtaccctctgtagctggcacacacccatctggggttacagtctttccagattctctgggagtgctgctgctcactgagtgagcaatgctccatacatccaaaagcagagaacacatacatttcttccccaaaggagttttactgcaaaatacttcacattaacggaaaatacacacacacacacacacacacactgtaaggtctaaatgatgacagaacacctgtgtgtactcaccaccctgcttaaagggtctcagttttgtacttttcaatatttatttatgtatttatattatttatttattttttgcgacagagtttcgctcgtcgcccaggctggagtgcaatggcacgatctcggctcactgcaacctcacctcctgagttcaagcaattctcctgcctcagcctcccgagtatgcatgcccagcgaattttgtatttttagtagatacagggtttctccatgttggtcaggctggtcttgaactcccaaactcaggtgatctgcccgcctcggcctcccaaagtgctgggattacagcgtgagccaccgcgcctggcatagtttttagtatttaaattaaaatgtcggggccgggcgcagtggctcatgcctgtaatcccaacactttgggaggccgaggcaggcggatcacgaggtcaagagattgagaccatcctggccaacatggtgaaaccccgtctctactaaaaacacataaattagctgggcttggtggcatgtgcctgtaatctcagtcactcgggaggctgaggcaggagaatcacttgaacctgggaggcagaggatgcagtgagccgaggtcacgccactgcactccagcctcgcaacagagcaagactccgtctcaaaaaaaaaaaaaaaaaaagtgttggtttatccatgtataccattgattaaatcagagattctgtgagcctgggtggaaagttgtggaaaccagaagatctatgctggtaaatacttgggacattttatgtttagtgttgaatatgctaccaaatatgggatttaacattgaatttttttctttttttttttcaacttttattttaaatacagggggtccatgcgcaggtttgttacatgggtatacagcacccaggtagtgagcacagtatgcagtaggtggcttttgacccatgccgcctcctctcccgctctggaggtccacagtgtctgtccttcccatgtttatgtccatgcgtgctcagtgtttggctcccacttacaagtcagaacatgctgttggttttctgttcctgttgcattaatttgcttaggattacggccagcggttccatccatgttgctgtaaaggacaagatttcattctttatttttatttatttatttatttatttatttattttttaatttattggagacagagtttcactgttgtcacccaggctagagtgcaatggtgcgatctcggctcactgcaacttccgcctcccaagttcaagcaattctcctgcctcagcctcccgagtagctgggattacaggtgcccactaccacgcccagctaagtttttgtatttttagtagaggcaggggtttaccatgttggacaggctggtcttgaactcctgacctaaggtggcccacccgcctcggcctcccaaagtgctaggatggcttatgagcgtgaaccaccgtgcacagcccagatttcattctttgttatggctgtgtaacactgaatttttcaaaccttttactccttggttcctgttaatcctctctagctaagatgactgcaacactgaaggaaatgttattagatttctaagcattttaataattataaggaattggtttgtgacccaggtgaacatctcagtttgtcccctggtttttcttagctgccctcaaacccatggatttgttcagtacttgcatgcatagaaagcatctctttgttgggattatttgtacttaagaggtttattcttcattcaccaaatatcctttatttaaaattttttttcttgagccaaaaatatgtgtgcaagttagtctcttactaatcatatagaaccgtgccttattttgaatgttcttattctgaattagaaggtggaagcaggagcacctgtcacagctccctggaatcgacaccctgctccgaatttcctggggacagtccccagtccttgaacacagacttgctgtcgatgacctcaagtgtcctgggcagtagcgtggatcagttaagtgcagagtctccagaccaggaaagcagcttcaatggtgaagtgaacggtgtcccacaggaaaatactgaccccgaaacgtttaatgtcctggaggtgtcaggatcaatgcctgattctctggctgaggaagatgacattagaactgaaatgccacactgtcaccatgcacatgggcgggagctgctcaatggagcgagggaagatgtgggaggcagtgatgtcacgggactcggagatgagccgtgtcctgcagatgatggaccaaatagcacacagttacccttccaagaacaggacagctctcctggggcgcatgatggggaagacatccaacccattggcccccaaagcactttttgtgaagtccccctcctgaactcactcactgtgccttccagcctcagctgggccccaagtgctgaacagtggctgcctgggaccagagctgatgaaggcagccccgtggagcccagccaagagcaggacatcctaaccagcatggaggcctctggccacctcagcacaaatctctggcatgctgtcactgatgatgacacaggtcagaaagaaatacccatttctgaacgtgtcttggggagtgtgggaggacagctgactccggtctctgccttggcagccagcactcacaagccctggcttgagcagcctccacgggatcagacattgacgtccagcgatgaggaggacatctatgcccacgggcttccttcttcatcctcagagacgagtgtgacagagctcggacctagttgctcccagcaggacctgagccggctgggtgcagaggacgccgggctgctcaagccagatcaggtatgtgggttcgggtggtgggaaaagtagctgaggcttctttcttaagggtaataattgtcaagactgattattttccttctcatggaaagaaattctattcctactgcaaaatccgtaggccaactctgttttcaagtctgggtttcaggggatttccagcacagggactatgaatggcttgaactacttctgacctgttctaccctgctcagtaacctgcctccccaaccaaggtagcgtcttgctgtttcctctgaccccacaagtgcaggctggtgtaggcacttactgttagccatcgtagggcagggctgaattggcctggggccatctcagaaaaccagtgggcagaggactgtccacctgtggagtagagaaagctctgagcagtttggaggcagggagtctcctgtccttctcctcacacccctccaaggaaccatctgcaagagcacgaggccatttccagaactgctgtctcctcaacctccgaacagtggctccaaggctcccctgcgagctgtacaggaaccagtttggagtaaccagtctttgtaggtccacccagcacatgtaactaggagatgacttttaactgtccttgagcattttatattaaaagtgatttttttaaaagtgcctacttcccttagcaagtaattattactagatatatttgtttcaaaactgtgtcttgccctgtctcctactaactgtcgatgtgaggtatgaattatggctgcgcacttacagccacgtgtgctttccacagtctacgctggcttctgtcagtgctagcagtgtgacgctttgtcagtgctcaccatgtgcaggtatcccacaaagcactttagaggtttaactcttttacttctctaaacacgaactataaaataggcactcttcttgtccccattttacagaggagaaaatggaagcacagaacagctagacagcttgcacaaggtcacatagcaaatgaagggcgggccccaggaccccctcactcaccctctgtgctgtcatgcctcagaagtgaaacatgctgcttacttgttttgagacaaaacgccataagtctggcttttttttcttctttctttcttttttttttttttttctgagacagggtctcactctgtcacccaggatggagcgcagtggcgcaatcatggctcattgctgcctcgacctccccaagctcaagtgatccacctgcctcagcttcctgagtcactgggactacaggcatgtgccaccatgcccagctaatttttgtattttttgtagagaaggggttttgccatattgcccaagctggtctcgaactcctgagctcaagcaatctgcctgcctcggcttcccaaagtgctgggattacaggtgtgagctgctgtgcctggccaagggtggccttttattcagtcatccggcatttatcttttcaacccagtggttcttgagtggccttgactgtcagcctctgtgattatgctggggaccacagtgcagatggcagctagttgtggattccatcttcctgagcctcagagtcttgagggggagccaggtacatgttcacatcctcgcagttgagtgggactcaggtgagggtactgagcaaagtacagggctgcaggaagcgcaagcagcatggccccctaatgtctgggcgttagccaggcagactgtcggtggggtggggtattggaattctaggccagaaatttaggaaagccctcacttaggtgacagggatcctggccctttgagcccctgactctctaacttcctcccttcctcatcccactccaggtagctgggaagccaagaaattttatggtgtgtttttatttggaggttcggtgtggaagtaagacttgccatggtgagcagggctggattgagaagagttgggcaccattttctttgaagtagttaacttctatgtgggtatctgtacaaatacatttatcttctttgcatttattgaaaagtattaaagtacaaagactttatttagctttgatttttaaaagaattctagcaaggtcgggcacagtggctcacgcctgtaatcccagcactttgggaggccaaggtgggcgaatcacctgaggtcaggagttcgagaccagcctggccaacatggcgaaaccccgtctctactaaaaatacaaaaaatagccgggtgtggtggcagatgcctgtaatcccaagtactcaggagcctgaggcaggagaattgcgacttgcttgaacccaggaggcggaggttgcagtgagccgagattgtgcccctgtactccagcctgggcgacagagcgagtctctgtctcaaaaaggaaaaaaaaaagaaaatatggtggaaaaaagaaagacagtggtagtgccatatatccagtgcctctgtaatgattagactacaaaaaattgacttgcatccaaatgttgaagaacctggctctttgtgtaaggtgaggtatgcctgcagaataatagcagctccttcgtaacgtgatgtgatgctctaagcgttacatttgcaaaggtgttagaacaggagaaaatgtcatccagggactccagggagtctttgtagggagacagcagcacgcgtctcagaaggtttgtagtagaggggtgtccacagatagcaggggttgggagaagggttgacttggcgtcttgctgacccgttttaccgtctcgtgttaatgatatcctctcacctttcttactgagaacagtaagccaaatgtggctgtgtcctctgccacagaactcactggctcttcccttgttagtttgcagaaagctggatgggctactcgggtcccggctatggcatcctcagcttggtggtctccgagaagtatatctggtgcctggactacaaaggcggcctgttctgcagcgcgttgccgggcgccgggctgcgctggcagaagtttgaagatgctgtccagcaggtggcagtctcgccctcaggttcgcctccccgctccctgctcccgctccctgctcccgctcgccgctcctgctccccgcccccggggtgcagacatcttagtacagggctcccctgcagcagctctgggctcacgctgccgtgcgttcaccaggtttgcctcttcaggaacgtttgaggggttgtctccaaagaacgtgaattgcttcattggatgtcaattcgtagtgtaaatgggtgttcagtttgagtttttgttttctttattaattgcaatggtaagctctgatcgtatttttgtaagctagacaaaaagtttgaaaattgagggacttttttagggatattaatatactaactcttcataaaaataatacgtgtttctctttctcattgttgctttaaagcaaccgaactaacgaagacgggcctatggatatgttagatatattccaattatttggcttcctctttaggaattctgttttaatgagctctctgctgtgggtgaacagtctactccctgactctaaaaggaaagtccattcattctttcatgctgctgttaggccattgttagtgaactggagctggtgtttcctgaacgatgttctcctgagctggaagacctcccatatctgcatggaatcatttgcttgctttttctttctttctttcttttttttttttttttgagacagagtcttgctgtgttgcccaggctggagtgcagtggtacaatctcagctcactgcgagctccacctcccaggttcgcactattctcctgcctcagcctccccagtagctgggactacaggcacccgccaccacgcccagctaatttttttgtatttttttagtggacacggggtttcactgtggtagccaggatggtcttgatctcctgacctcatgatccgcccgcctcagcctcccaaaatgctgggattacaggtgagagccactacgcccggctttgcttgttttttcttaaggttgtgttggccacgtcggcacctacgccagtggggacacttttgccttgaagcagcctggtttactgtcaggacattggaatagaagtcagacgaagccgaagctgagtctgtggcttgggacctgtctgttctctgtaacttcactgtgtttcgggatgaatttcccttaattctccctggtctctgtcactgtttaaaatattagtttgttcagcgttgtttttcttgcttgctttcactgtttgtttgaaaaatatttttctttagagactggctaacaacccactccacaagctgtcattacacagttgtgtgttttaattcatttctcgttggtatcatttaccttcaggtttgtctccttagccttttagaactttggttctattcctgactatattagttacttgtattcccaggccccttggtccctcactgtgctagcgggaactctgtatctccatgagattcacctgctcagttgaggcgtccttcagggcccagtcccatgtccttggtgggcagcagagcccttgtgccgggggcaccacaggcagagatgctcgacaggccctctagtccagcccagctgacactcggtgatcactggtggccccttgccttgcctgcgtcggcctgctccaggcctccagctgcagcgctatcctgccttccctttcctctctcctcctccatctcttcatcaaagtcctcttcacagtgaaaacaggccaactcagtgcaagtgtgttccttctgtgcaccttttccattcagctcatccagaactgatccttctctttgaatccctaaaggactttttcagcctctcctagggcactagttgtgcttaggatgtttatttggagacttatcaaacctaataatgtcatcagtgtttctcctcccgtgtgaggagcgcctgtcatgtgcccagctctgtggccatgtggttgatctgcttccgtctgcagtctttagagcagccctgtaaggtggagatgatccccacggcccaggaggaaagtgaagcttggagacgggcggtgacatggagcctgaagctgcatagccactgggtggtggccaagggcccaaacctgggtctggtggcctctttccccacttggggggacagaacaggatgtgttttagaaatctttctcccctcaatgcccagcatgaagacttttgtatagaaatatattctagtatttattggacagtgaatagaatttttatttccataggagcccttctctggaagattgaacagaaatctaaccgggcttttgcttgtgggaaagtcaccatcaaggggaagcggcactggtacgaagccctgccccaggcagtgtttgtggccctgagcgatgacacggcctggatcatcaggaccagtggggacctatacttgcagacaggtaaccgcgggccacgcttagaggcctgccagctctgccgtcactgcctctgctgcaccctgctttgctagtaacatgcttaccacaatcgctatgattaagaggctaaatccattcgaattaagacacttctgggaagagagtatttgccatttggcatgtattagcagtttcctgcattgacacaaactcaacccaggacaaatttagggcaaaaatgaataggattatttggtgagatacagaaacagaatcttattctcctatggccaaccaccgcatatcacgtatcctacaatgttagatcttaagaggtaagaatacagaggaaggacataaaattcatttccccctttaagctaaagtttaagtggctgcattttttttttcagccatatcaaagcccggctcctatatacttacttacccgtgggccaggaaaaaaaaagaaataatttgctcttttttattttgagacggagtctcgctctcttgcccaggctggcatgcagtggtgccatcttgactcactgcaacctctgcctcctgggttcaagtgatcctcctgcctcagcttcctgatcacaggctgggattacaggtgcccatcaccacgcccagccaatttttttgtatttttagtagagatggagtttcactatgtcggccaggctggtcttgaacttctgacctcaagtgatctgcccgcctcagcctcccaaagtgctgggattacaggtgtgagccaccacaccaggccataatttgctctaaatagcagttcaggccaggtgtggtggctcatgcctgtaatcccaacactttgggaggcctagacgagcagatcacctgaggtcaggagttcaagaccaacctggccaacatggtgaaactctgtctctactaaaaaaaaaaaaaaaaatacaaaaaattagctgggcgtggtggcgcttgcctgtaatcccagctacttgggagcctgaggcacaagaatcacttgaacctgggaggcagagcttgcagtgagctgagatcgcgccactgcactctccagcctggtgacagggcgagactccgtctcaaaacaaaacaaaacaaaaatagcagttcagcaagtcacaggaagctgccctcagggaagtttttagctgatggaagggcacagtgggacttgcttattaaaaataagctgtaatgacagtcagtgtttactgtcagcagaatggggaaggatcttccaccagcaatgtgatttatcagtatctggaaggactgtggggcaggagttatcgtcagttgtccagaggccacgttggatttatgtaaagatcagtcttccaggcgtttaatgttgttgattccaggagaatgttgttgttgttgttttgagacggaatctcgctctgttgcccaggctggagtgtagtggcacaatctcggctcactgcaacctccacttcctgggttcaagcgattctcctacctcagcctcccgagtagctgggactacaggcacatgccaccatgtccagctcacttttgtatttttagtagaggcagggtttcactatgttggccagtctggtcttgaactcctgaccttgtgatccgcccgcctcagcctcccaaaatgctggcattataggcgtgagccaccggcctcaggagcatgttttaatcactgctgtgagtcgtcagctggggatgagtcttcaggttgaagctcttgcacagctggctctctcctagctgtgtaagaacctctggcctgggtgcacagccatgctggcttcataggccatatgctggcccaggtctctccagcctagttcctgtgtctttctttaaatgaaagtagctctgtcaaggcacatgcacatctaagctgccaggacatttgagctttggtcatggggaagacaggaggtgcttctggcctgggggtgaggagcgagtgacctctaaaccagtagtgccagaggaatcaccaggacagtgatttcacatgaggtggccccacccagacctgttggattaggtccaatccctctggagactgctcaggagtgtgtcgtgtaagaagtcctgccggtgattcccacctagtttagtggaaggaaatatcacccaaggactgcaatactataggtgcgtctgtgattagtcacggagcatatttgagtactgagacctaattgcaggcctaaggtcaaggaatacagggttgtaggcgacagttggtctgtctgctcccctgggaatagcctttgagctcatttagacatactttattgacagaacacaaggaggcaaggggagagccctggacagggagccagggaccctgagctttggcctgccactgccttgcagtttgacagacctcagatttcatctgggaaattcggggtttcattttattagtggaacctcgcacccagtcagagcagagaggagccgccgtgctggagctctctgcaggaacgactgcaggcctcaggtccctgccaactccagcagcgctgcagccctctgcctggaagagctgctctgccctgcagcctttgggcctccatctggccactctcctgctcttggcttttgtgttcttctcttagaacttcttaagctacattgggacaccagataattctgaattgttcagttttcaaagagtgtctaaaactgttttcagatagatgttacatttaggcagaatttaaccactttatgttgattaaacttgacaacaaaaaagcggccggacagggcagctcctgcctgtaatcccagcactttgggaggctgaggtgggaggatctcttgagcccaggagtttgagatcagcctgggcaacgtagaaaggccccgtctatatttttaattaattaattaattaaagtttttttttaaagcactcatcataaaagaatatagcaaaataccaaaaaaggaaaaataagccaataaccaagtcaaaatgaggtgtggagttctgactgtgtgtctttggggcttcttcccatcttcctggcaggtctgagcgtggatcgcccttgtgccagagccgtaaaggtggactgtccctacccgctgtcccagatcacagcccggaacaatgtggtgtgggcgctgacagagcagagggccctcctgtaccgggagggcgtgagcagcttctgtccggaaggcgagcagtggaagtgtgacattgtcaggtactggcgggccagagactcctttcacatcgtgcttgtcctacccttcgttcttgtccacttgacaccacaaggcaccatgaggccgttcctgggaggcagcacctgcagcctccatggctataggctaagcttgaatctctgcctaattctgaccggcaaactggacgttgagtcagagctcgctttttaaaaatgctgccgccctctgcgcagccctgagcatcacagcgtcatgagtctgtcatgacggtctctattcagaattgcccaccgtcaggtagttctggtttagtgtctgtgacggcttaggtccaaatatttttctttattttcatgctaatcgaagttgatctctgaactgtagcttttttttttttttttgatacaggttctcactctgtcacccaggctggggtgcagtgccacgatcacggctcactgcagccttgacctccgggctcaggtgatcctcctgcctcagcctcctgagtagctgggactacagatgcatgccaccatgcccagctaatttttgtattttttgtagagatgagttttgggttttcatcatgttgcccagactcatctcgaactcttgggctcaagcaattctcctgccttggcctcccaaagtgctgggattacagacatgagccactatgcctggcccgatctctgaactgtaatttattaagctatttttttttttaccattcaagatgttagttatagaattgccatcagatcattttactagtatggaagtattaatagtcctttgaaaaactagattaggatattcttggtttgaatttagcaagccaataaactttcagtgaatacctattaagagccagaatggtccaggtgtggtggctcacgcctgtaatcccaacactttggaaggccaaggcaggcggatcacgaggtcaagagttcgagaccagactgaccaacatagtgaaatcccgtctctattaaaaatacaaaaattaaccgggcatctcaggaggctgaggcaggagaatcacttgaacctgggaggcggaagttgcagagagctgagatcgcaccattgcactccagcctgggtgacagagcaagactccatctcaaaaaacagacagacaaaaaaaagcaacaacaacaaaaagccagaatggtgctaggggctgggtgcgccaagagggctgagactggccctgctctcatcagttccaagtctcatgggggccccgtgcatggatggacacccattagcacagatggccctaaacaggagtgtggagcatgcagcactgagggaaccatggactccatgcagagatcaggaaggcagcatgcagagtggaccaacagctaagccttgaagctgacgaggacttccccatatggaaggagggggagggcgtctccagcaaagagggcagtgtctgcctaggtccagctgcacagaatagcctggcacatcgggggagtttacagtcattcccttggtgagggagggagtagagagatggaggcgctcaggggccttggattggcgggggaaggagtagagagatggaggcactcaggggccttggattggcgggggaaggagtagagagatggaggcactcaggggccttggattggtaggggaaggagtagagagatggaggcgctcaggggccttggattccttttgtgcctactcgcttttttcttaggttattttctctcttaagagtgttcccagccattctgggtcatcagtgtgtctttcaaaagctgccacccacttgaaccatatctcttgcacagtaatttaactcagacccaaacttccttccctggcacctgctgatccgctccagggccacgtctcttctcccagccacgcctgccgggagaccctggatgtccgcagtccagacacactgggcactctgcctatgggtgctgacccccctgttctcctccttattttcagcgaaaggcaagctttagaacccgtctgcataacgctcggggatcagcagactctctgggccctggacatccatgggaacctgtggttcagaactggcattatttccaagaagccccaaggagatgacgaccattggtggcaagtaggtgttcagctctgcgccacgtgccgaggtctcccgaccttttctgcttccccttttcttacttctctcttttccttaacgatactagattaaatttaaaatactcacttttttattatttgtttgtttgttttgaaacaagatctccttccgtcatccaggcggaagggcagtggtgcagtcacggctcactgcagtcttgacttcctgggctcaggtgattctcccacctcagcctcccaggtagctgggactacaggcgtgtgccaccatgcctggctagttttttgtatttgtttgtagagacagggttttggcatgttgtgcaggctggtctcaaactcctgagctcaagagatccacccagactgggcagagtggctcacacctgtaatcccagcaatttgagaggccaaggcaggcagatcactcgagtccaggagttcaaagccagcctgggcaacatggtgaaaccctgtctctaccaaaaatacaaaaattagttggacatggtggcacacgccgttggtcccaactactcggaaggctgaggtgggagaatagtttgagcccaggagacaaaggtttcagccaagatcacaccaccacactccaacctgggcaacagagctagaccctgtctcaaaataaataaaaataaaaaagagagagagagagaaatccaccctctccgcctcccaaagtgctgggattacaagtggagccaccactcccagccaatagtattccttttttctatttgatggattagactttgctgtgtttgagtgcattagaaacataaaggacttttcatcataggaaataatttgcaaactctttgtgtaaataatgcacttaatttatttattttgatattgtttatatatttattattataggctaaataaacccagtgacatccatttgaagacctaggtaataatgatgtttaattatgaacaaatgtgctgagaaaagagcccagataataggtttgaaagcccaacccagaattaaaattgagctgtctctgcttattcagaaggcctctaagtagatggtatttcagcaaagacaggagaattttcccacgtgcttccagaaaaggaaacactataagaaacaggatgagggtataatcaagctcactgtgtgtgatttggtcccagcaagagcgcctagaatgaatttctcttttctttttcttttctttttttctggggcagagtctcactcttttgcccacactggagtgtggtggcaggatcacgacccacctcagcctcccaagtagctgggaccacaggcacatgccaccatgcctggctaattattttggtagagacaaggtcttgctgttacccaggctggtctcgaactccttggctcaagcaatcctcccaccttgacctcccaaagcgctgggattacaggtgtgaaccaccaccctcggccctagaatggattttcaaaggagtgtctactttccccttctttggtatagtttagtgttagtgttgctcccacagtctcccactgtggtaggtaagatttcactgatagtcgatggtcgtgaaatatttgatgtttcttttttttgagacggagtcttgctctgtcacccagtctggagtacaatggcgcaatctcggctcactgcaacctccgcctcctgggttcaagcgattctcctgcctcagcctcctgggtagctgggactacaggcacgcaccaccaggcccagctaatttgtgtatttttggtagagacagggtttcaccatgttggccaggttggtctcaatgtcttgaccttgtgatctgcctgcctcagcctcccaaagtgctgggattataggcgtgaaccaccgcgcccggccagtatttgatgtttctgaagtatcttgccccattggtttatgttttattgtcacctcagacttgctttgttgaaggcttgtcttgcattgactgctctgaggtctttcagatgagaatgtagaaaaatgagttgtgtttactctttgataaaatatgtattctatataatatgtacattatatacagatgtatctaatttatatactaggtaatatttgatagtcatgcaaatgattttaaaataccttttgtgtacttgtaaccatatatatacatatacatgtaaaaatatacatatatgtatttttgtagagacagggtttcaccatgttggcaggctggtctggaactcctgacctcaagtaatccacctgccttggcctcccaaagtgctgggattacaggcgtgagccactgtgcccgaccaggagtagggcatttatgccagtgatgttttatgtaatcaaacccagcagggcagaaatgtgagtgaacatcatggagaatcagattttcactcataaagaatttgccttatatcaagctgcccaagaagagaagagcttcctgcagggaggggtggttggagaaatgtctgaggtatatgaatgcttttcaggaatgttatagaagcaagctacccttctgagctagggttagagtctagatacccaggatggtcctagttgatgctcttgccctggagtaattattagtagtcccaattcagatcataaattagttcatcacagccttgcatggtggctcacacctgtaatcccagcactttgggaggcctgggcgggcggatcacctgaggtcaggagttcaagaccagcctggccaacatggtgaaaccccatctttactaaaaatataaaaaattagccggctgttgtggcgtgcgcctgtagtcccagctactcgggaggctgaggcacgagaatctcttgaacccaggaggcagaggttgcggtgagccaaaattgcaccactgcactccagcctgggtggcagggcaagactatgtctcaaaaaaaaaaaagttcatcactctacttgtgatacctttttagatgcatattatgtttctaagtaccgtatactgttgtccattggaaatacctgatttaaaagcaaaattaaagctgggcatagtggttcatgccagtaatcccaacactttgggaggccaaggcagggagatcacttgagcccagaagttcaagaccagccctgggcaacacagggagacctgtctctacaaaaaatttaaaaattggctacatgtagtagcattcgcctgtatttgggaggctgaggtgggaggattgcttgatcctggaagtcaaggctgagtatgattgtgccactgcattccagcctggatgccagagcaagactgtctcagaaaagatggcaaaattattctttctcactctgattagaatgaaagtcttcttagaaggggtgtgagggggtgataatcacaaaagtaatacatgcttgtaacagatccatgttgtataaaagtatataaaatgtgaatatattcttccatacctttaaatccaaccctacgaaggagctggagttagcattagcagtttgatggcatcctgccacatttttttggtcctttcacaagcgcacacgtgcacatttgtgtttggatggtcatcttgttactagaaatgcagaggtgtggacctgagctagaaccttccctcaaggcagagagtctacacttgtaactgctctgacagcagggcttttgcttgtctcctccttccaggtgagcatcacggactatgtggtgtttgaccagtgcagcttatttcagacgataatccatgccactcactcggtggccacagcagcccaagcccccgtagaaaaggtggcagataagctgcgcatggcgttttggtcccagcagcttcagtgccagccaagccttctcggggtcaataacagcggtgtctggatctcctcgggcaagaatgaattccacgtcgctaagggaagtctcataggtgggtgaattgctgtaattttcacactggctttataggcagcctcactttaaagccaacatttaaagaaaagctttaagatctcaacttgaaaagataatttagtgccagtggtatgaagtgtctagtggaggcactctatgctttgtgatcagtttctctcctttttaaaaaatctgtcattcctaaaactcgtatccctgtgtctggatagtgtttcccctggaaaccttttatgacataagaaaagcaaatggaggtcatttttatgttaacaatttcacattttaaatgaaaaaatccacccaaacctagtgagagagaatggtccacttcctggagggaaggtgatcgccactgttggaaatgcaaggctctggccaggtctgtgaatgtagatgccagtctacacatcctggggtttgtttctgtgagtgaaccccttgcttttctccagccctctccctgctgcatggcctccacgaccctggactgggtgtggctctgcctggcagtattcagagggagatgaatgttaggctgtgattgctcatgtcgctttatttagggacactctagaattatctggagaaagggtttgaaggccagctgtcgtccagaactaagatctgaagtggttttgtctatgctttctttctttaacacattcttcctatttactctttccaggcacctactggaatcatgtggttccccgtgggacagcttctgctacaaaatgggcctttgtgttggcttctgcagctcccacgaaggaaggtgggtcagtcttagcctcactgaagaatctagagcacagcttggccattggaaaggttcaaaccacagtcggactgtggccttgttggttatggggcatgcctcggagactgaccacgtgagggtgtcagaggccagtagcccttgttagctgagccgagggccctgaatcgggataggcctgaccaggagagcctctgagagggaccgagcgtggtgaagatgagggaaagtgtccttctgaaggaggggctcacacagtgcagccaccggggctggcagctggtgacttccagtggcacatggcaggggccacagcttctttgggcaccttcccatctcccctcgagaatccttctgtcacctcccagcaacttccttccgtcttgttcacagcctccggataacctaagtccgacatttgcaccgcattaggcagacctgccctgcagcggggtgctcctgccaaccacattctgggcagaactcagtgtccctgcggagtacagggtttgtgagggagccagggcaccagagggtgagggagctggcatctgcggccgggaggggcacttcccccacccgcttagctgggagccccggcagtcaggcgacctctctgggaagtagctgtacctcctcccaggattgcctgaggatgaaatgcaaagatgctgtgaaatctgtggtgaagagggaatcgtttgcttagttcaaaccattagtcccactaggatgcaggtgactgggtcagtacaataacttcttactcaccagattgttcggaccacagttctggaacccagaaatctctgaaaacaatgttatttcttgagtctggcataaattaatttggcagcaaaacctgaccggatctcacatagctgcctccagccttggttgatctgttggctgtgaccgcatccatgttgcagggatgttaccgcacttcaccggggagcgcctggcccctccgtggttgttttgtaaacctctggcatacccattagcttaggttttcaaaaatccagaaaaagtttgaattccaaaacgtggccacaagttgtagataatacttcatataacgtactgtgaccaagattttaactgccctaaggattatttgcattttaaacagaatctgttaaacctaaaggacttttttaaaatgctgtagggaatgaaaggacatgattttgaggcaagggtgggaagagaagcacttccagcttcctaagccttctccagcagctgccccaccccccggccccatccccagaaggtccgggagagcaccatggcgccatccttcctaggaactgccaaccctccctccctccagggcaccgagttgatagtcttctcctcttggtaaaattaactttctacattaaaaatgctttggtgcctttgttcaagtgaaaaacttctcagcccatgaaaaatgggaggtcaaagccactaagccaacattatggccttcataaaatctcctaagccttgccttctttccatttctttccaacatctcaggcgtgtttcttgttagtcacggtgtttccctctgccttctaccttaaagtgctacaccgctcctgcccgtgtgggaatgggcaggtgagtgagctggcatctgtggccaggtggctagcgtctgctgaaaggcaaaggctgccttgtgcatttagggcaggcggcttggtgcagacaacacctcgatgacaaacatgacccctttctgcaggaagcttcctgtggctgtgccagagcagcaaggacctgtgcagcgtcagcgcccagagcgcacagtcgcggccctccacggtgcagctgcctcccgaagccgagatgcgcgcctatgccgcctgccaggatgcgctgtgggcgctggacagcctcggccaggtgttcatcaggacgctctccaagagctgccccacgggcatgcactggaccaggctggacctctcccagctaggtacggccacctcgtgagtacacctgccggtgccctgactgccctaaaccggcatcacaacgtgatgtcggacaaaactgcccggcctgtgtccaacctgtgagagttctgagggggtgtttataagctgctgaatttcaggagctcagttggccactctttcagactagacaggctctgggttttgtcccttcccctgccccttagagtttgcagggctgtcagaacccgaggagggtgtgcgtcctcaggtcaaggggccactcgctgcgagcggcttgaaggatactggtgatgcagctgccccgtcagtctttctgaatatggaacatagctttatgacctgaaaagctgaaaagatgggtgttccctatgacaggatcagtgccacgtttgtctatctcctcaggacagtacctggcggaggagagtggctcagcacacaggtgctagctctccttcagctcagccagatataggaggacctgcatccactagctcctgcttttctctgaatcttctatcaaaagccgtggagtaggctaagaaatgtagtgctatttgtaggccgggcgcagtggctcacacttgtcatcccagcactttaggaggctgaggtgggtggatcacctgagatcaagagttcgagaccagcctggccaacatggtgacaccctgtctctactaaaaatacaaaaaaaaattaggtgggcgtggcagtgcacgcctgtagtctcagctactcaggaggctgaggcaggagaattgcttgaacccgggaggcgggggttgcagtgagccgagatcatgccattgcactccagcccaggcaacagagcgagattctgtttcaaaaaaaaaaaaagaagaagaaagaaagaaatgtagtgctgctatttgtaaataattcattcatgttccaagaaataataacataagcccacaacattagatttctctctgagtagattcttggtggatcaggcagcataggtgtggtttgcctgaaggtggagttgtgcagatggcccccagggcccggatgagccctgcacttgcagcaggactgacttaggaacttcctggctgcaaggcttcccagtttttttaacttagaaccagcatttggttatgtggtagacttgaattgtataagcatttaatgtttgaaaactcaatcacatgtactcaccaaaaaaaaaaaaaaaaaaaggatggggagaaagaaagcaagaagagggctgggcacagtggctaatgcctataatcccagcactttgggaggccaaggagggcggatcacctgaggtcaggagttcaagaccaacctggccaacatggtgaaaccccgtctttactaaaaatacaaaaattacctgggtgtggtggcacatgcctgtaatcccagctacttggttgggaggctgaggcacgagaatcacttgaacttggtaggcagaggttgcagtgagctgagatccatgccattgcactccagcctgggtgacagagcaagactctgtctcaaaagaaaaaaaaaaaaaagaaagcaggaagagaagggcttgttccccttctccccaagcccctggctgcattgcagtctgtatgctaccagctgatgagagcctcttgccattccgtaaagcaagcatcgtcctaggctgcctggcagtggttggtgtgctcagccccgggggctcctacagggtgctgagtagacatcacccattcttttgcctgaaaaggcccctgaacactaactcagctgaagaagcaagttctgttccaaggcttggggactgaaggtttgtccagggcaacttttgttctttatgctttgggcctccccacctgccttttggacccaccagtcaccatctagctttttgagaacacccgcctctccacatcactgacagtgactgatagacaaggctgaggctgagagtggcctgaacattggtgctgactgacctgccgcctgccctggaaagcctttcatttgttcagagaccctactggtcctgagccattctccagcagctcctacccagactaactggaaaatgccgctagttccctctgagggtaaaaagtccagggcttggtgtgtattctccctgctcctgaatcttgagcactgtgggaggctgtgttcacctgcaccatttgggtgagaagcagaactgcttcccttgcacgtccccttcccagcccctccaggaaggctgctgcaccgtggtgggattcagagtgaatgggcatcatgccaggttctgcactgctggagccagccctgcctgggcctcctgcctccagcacagctcatgcctccctcctggctcgatccagtcctcccagcaccggctagctggccaaagtggtgcaggtctctaaggtgtgtatttgggcttcactgggaggtttctctcggggagaaacctggcttgagtgggattgagtctcaagagtgtgagggaaacaggaacaagtccatcctgagtccaagatggccttgggccatctggtgttcagcagatactcattgaggggttgggtgtgtgaacagagggatggcctggggatcctggtcgctgtggatgggcaggttttcactgacctcctgtgttccgcctgcaaaatcattagcaaatcaatgtcagtatccggctgaccccgaaatgaatcagacagcagtgggtgcaaggaggtcacaggcagaggtgtggggactcatggcagaggcaggacagagctgggccccaggcgggctctggactctgggcaagctgctgtcaccttgaaccgcaatttcctctcctttcttttttttccaggtggggtctcactctgtcatccaggctagagtgcagtggcacgatcttggctcactgcaacctctgccttcccaggcttaagcaatcctcgcacctcagcctcccaagtagctgggaccacagacatgtgccaccatgcccacctaatttttttgttttttgagacggagtttcgctctgtcgcccaggctggagtgcagtggcacgatctcggctcactgcagcctctgcctcccaggttcaagcaattctccctgtctcaacctcccgagtagctgagattacaggcacccaccaccacacctggctaattttttgtatttttagtagagacagggtttcaccatgttggccagtctggtcctgaactcctgacctcaggtggtccgcctgcctccgcctcccaaagtgctgggattacaggcgtgagccaccacgtacagtccctgctaacttttgtattttgggtagagatggggttttatcatgttggccaggctagtcttgaactcctgacctcaaatgatccacctgccttgtcctcccaacgtgctgggattacaagtgtgagccaccatgcccggccttggtttcctctcctttctaatgggagcagcaacccccaagcccaaccccctggaggatgcacggggcatcccgtctaaatgttggccatctccgggcggtgtggtcatcctaaggctgtgacacgtcttgcttgggggtgctctctagtctttgttagctgctggtggtggggcttttgcttgtgttgccccagtttgtgccacagggaggacaaatccagcatctcttgttaaagcaccacctcgcttagtccttatcctgccctgaactttagattttgtttatttgagttatctggttgatcttgaaatgtcagattaagactcctttcctgtttcctacacatcctgagagaatgcagcaagtccagggttggcagctttgtgttggggcaagggaggtgaacaggcaaccgggactcccaggctgttcctctgcacacgcacctatcccctcaacgagtatctgctgaacactggagggctcgaggccatcttggactcagggtggacttgttcctgtttccctctcgctctttttttttttttttttgagacagagtctcgctctgttgcccaggctggagtgcagtggcgcaatctcggctccctgcaagctctgcctcctgggttcacgtcattctcctgcctcagcctcccgagtagctgggactacaggctcccaacaccacgcctggctaattttttgtatttttagtagagatggggtttcaccgtgttagccaggatggtcttgatctcctgacctcgtgatctgctcgcctcagcctcccaaagtgctgggattacaggtgtgagctaccgcacccagcctccctgtcactcttaagttgagactcaatctcactgaagctgagtttctcccctagaaagaacagccacctccccagccttcactatgccagggtaggggcagtgagcatcaggccaggggcaccaggtgttcagttattaggctctctccaggtatggtctgtgtcctgcaggaaaagcaggtaggtcaagagacttctctttttgtttgtttgagacagagtcttactctgttgcctaggctggagtgcagtgacacaatcttggctgactgcgacctccgcctcctgggttcaagtgattctcctgcctcagcctcccgagtagctgggatgacaggcatccacagccatgcccggctaatgtttgtgtttttagtagagacggggtttcaccatgttggccaagctggtctcgagctcctgacctcaactgatgcacccgtcttggcctcccaaagtgctgggattacaggtgtgagccactgcgcctgacccaagagaccttttaataattacttatttaagtgaaaattttgaatgcaggtgtgctgtctgcccaggagcccgtgtatgactgtgcatggcggctgtcatcaggtggcatgcattgaatggggattattgactgtaaaggagagtcatcaagctgacatggctgctgcctgtgttacttatctggaattaattggggtgcttcatttattttttacaagtcagcagtgggccgggtgcagtggcttacacctgtaatcctagcactttgggaggactgcttgaggccaggaatttaaaaccaacctggccaacatagcaagaccccatctctaaaaatatttgttaaagtcaacagtagggggtgcacacagcaatgaatggaaacacagtgactgcatttgaggatgttgttcaatatcaaatttagcctcccccaattgtgctcttcttcctaacttcgctcctctgctcccactaaattccctttttttttttttttttttttgagatagtgtctcaccatgttgcccaggctggagtgcaatggtctgatttttgactcactgcaacctccgtctcctaggttcaagcgattctcctgcctcagtctcccaagtagctgggattacaggcctgtgccaccccgcccagctaatttttgtatgtttagtagagacggtgtttcactgtgttggccaggctggtctctaactcctgacctcaggtgatccacccgcctcagcctcccaaagtgctgggattataggtgtgagccactgagccctgctgctcccagtaaattctgctggaaagaccagagtgctcttttggccagtcgctcagcagtgtcctggccatctacccgaggatctccctgcttctggacctctgcttccctcccaccactgtcagggtggagccccctcgtcaccaagttgctgtactgcagtagctgcctcctggcaccaggtgtgcccacctcccaccacggctaccagagctgtcttcctcaaacccagctcagatggtgttgccctccacgttacatggctccacgctgccactagaatacagctccagtctttggtgtggcacccagggtctcgcagccagacccggcctgctgttccgaggcctcgtgcgttggggactccagccactcctggcctttgtgttggggccctggctaactttcatattttgggtagagatggggtttcaccatgttggccaggctggtcttgaactcctgcccttccctaatgtgtggtgcatgttcatgccacccatttgcttctcttcctggggcctagcattccttccgtgggctgctttccttcaactcttcttccttcaggactcagttgagatcgcacctccccaccagacattcttcattgactgtccccatcatagcactgtgcttctacctgtcatttcagagccaagcacggtggcgcacacctgttgtcctagctacttgggaggctgaggcaggaggattgcttgagcctgggaagctgagcctaatctaggcaacagagcaagctcctgtttcttaaaaaaaaaaaaaatacacacatatatatatatatatatatatatgtaattttagtttgactcacattatttttgttgaaagtttacacacggagtgtgtagggactttacaggcagagaccaattgcttggtgacagtacgtacccaacaggatttttgttttaatttgggatggggtctcactatgttgcctaggctggtctcaaactcctgggctccagtgatgctcccacatcagcctcccaaagtgcggggattacaactgcatgcagctgcaccagcaggatttaaaatgtcagggaaagtcagtactgtttgcagctccatttctgagtaactctgggatgtgagttttgatcctatatttggccatgttactggtagtcaaagataaaactgccttccatgcaagtacaggatgtcatcacacacagtagcctggtggatgatgtgactcccaccctcccaggaaaattctcatctcttgctctaagttgccatcagccttcccagggcatgaggcagaagatgttaggttataaaaacttgtcggccaggcatggtggctcacacctgtaatcccagcactttgagaggccaaggtgcgtagatcacgagatcaagactatcctggccaacatggtgaaaccccgtctctactaaaaatacaaaaattagctgggcatggtggcttgcctgtagtcccagttactctggaggctgaggcaagggaatcgcttgaacccgggaggtggaggttacaaagatcatgccattgtactccagcctgggaacagagcgagactccgtctcaaaaaagcaaaccaaaaaatcttgttagagatacatttacatgtgttctcccttcagccctggtgttttctttacaagtgtcttcctggttgtatgagtagcaagcagccttggacagcatgacctctgctccctcggggacagtgttgaccttgggcagcactaactcattgttaggtcaggaccatcatcagtcttctctaaaaggcaagcagaaattttaatttcagactgggtgtggtggctcacgcttgtaatcctagcactttgggaggttgaggcaggaggatcacttaaggccaggagtttgagaccagcctgaccaacatagcaaaaccctgtctctacttaaaatacaaaaattagctgggtgtggtggtgggcgctgtagtctcagctactcaggaggctgaggcacaagaatcgcttgaacccgagaggcagaggctccagtgagccaagattatgccactgctgagccaagatggtgccactgcactccagcctgggcgacagaatgagactctgtctcaaaaaatactactaataataatcaattaattaaaaaacaaggccaggtacagtggctcatgcctgtaatctcagcacgttgggaggccaaggcaggcagatcacctaaggtcgggagtttgagactagcctggccaacatggtgaagccccgtctctactaacaatacaaaaattagccaggtgtggtggcacatgtctgtaatcccagctacttgggagcctgaggcacaagaatcccttgaacctgggaggcagaggttgtagtgagccgagatcacgccactacactccagcctgggtgacagagcaagactctgtctcaaaaaaaaaaaattaaattttaatttcaaggatgaggatgactttagcgaagtatcaaataatgaacatgatttctacctttaatttttttttttttttgagacggagtctcgctctgtcgcccaggctggagtgcagtggcacgatctccgctcactgcaagctccacctcccagcttcacgccatcctcctgcctcagcctcctgagtagctgggactacaggcacccactgccatgcccagctaatttttttgtatttttagtagagatggggcttcaccgtgttagccaggatggtctcgatctcctgatcttgtgatccacccgcctcagcctcccaaagtgctgggattacaggtgtgagccactgcgcccagcctcaattttttttttttaaatacagcttccctcttctttctacccctatacaaattaccagagcaattactgctataggattaaattaaaggaattcttaaattaaatggttggctgctgaaccaagttgtagcagttgaatatggaattttgtagtgatttattataatcctagtttttggaagaaaatttgcatcacttagcagatatttaagatgcttgtaacatttcatttcccagtacacataaatatgcattatgtcaggcattggaatgtttagcaaactaatgaaatttgtaatttaatttatcaggtcacagcatttaatgaagaactattcagtgtcagtttatgccgttaggtaacaaacaggattgtgttacgcagtaatttatacagaaaagtattttataaataaaatgtcaaataaatgccactttttgttttaaaatgatatgtttaagaaataatcctaaagggaaaatgtctgctttgtcgaataaagtaattaaagcatttttttaaaacaagagaaaaaaataaggacaaagcagggacagacaggaaaatgtcagtgtgtttgcatcagccaggctgggctgtgcttcggtagcaagccccagatatcagcgacttcacacagtgaaccgtggcccccgctccacgaagctggccctgcatctgtcctcttctagggcagtggtcctccaggtggtggcttcctgatcctgcctgctttgctctgcggctccaccatctcggttccttctgctcagagcctgttgccagtactggtcgtgggtcctgcctaactctaagggaatgtgagggagccatggagtgcttggggagggctgtggtctctgccaccgcgttcaccacatcctgaccacttcttccatggaacaggttcacaaacctcattcatccaggcggcctgggtgacactctggggtaaaagtctgcaggaaagccctcagttcaactttgtcatctttcacctgtctcttcaattcggaataagctggtttatgcactggaagtacatcatctagtagtcttttatatgtgttctgaaaggttgttcactgtgtaatgtgaactccgtgttctgtgagcagtgttgttgctgccaactctgagatgctggcctggtgtgtttttgtcaccatgtgactctgttagcatgatcactgctgcctgtagtttctcttagaggcaggttgaagactctaatgtaaaattgtcttttaattagcatttgtttctcagctatttctagagttactgttgaaggtactttattttgactggtacagatctttgcatatgtaatgttagagttccagggaattctgtttaaactccccggtaaaacattctgtacaagatcaaggaaggagaaaatacagttaatttttggaatagagaaattgtcatctttagaaaatgcaaagaggaataatgataattttttgtgtagcagtgaatgaatagctttaagttgatgtcataactgaagacacatgagattttcacatggcagagtcatgcctctgtgttttgctacactccgtgggctgtcatctgataccagtgacaactgtgcaagggtggtacctcccgattctgcacccagtgtggggcgtcctccacctgcccctctccagcagcaccaccagctaatggagctgcacaccttttattccccggttgaaagtcaaaataacccatcaaaattaaaaacttctcatccaaaaacactattaagaaaatgaaaaagcaaaccacagactagatttacaatgcacgtatctgacaaaagactagtacctacaatgtgcagagaactcctctaactcagcagtcaggagaaagttcattttaaaatgagcaagacttgaacaggcacttcacaaaagaagatatacagatgtccataagcatattaaaagattcccagcatcattccttagcaggaaatacaaattaaagccacgacatgatacaacttcacctctcctagaatggctgccgtggaaaaggttcaggggtgcgggcagccagaacccgcagacacggctgtgggtgtggagcacaggatctccattggggaaactggcggtttctttaaaaatgaaacaggccgggcgcagtggctcacacctgtaatcccagcactttgggaggccgagacggatcacctgaggtcaggagttcaagaccagcttggccaacatggcaaaaccctgtctctactaaaaatacaaaaattagctggacgtggtggcaggtgcctgtaatcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaagaaaaaaacaaaaaaacaggaggcagaggttgcagtgagccaagatcacgccactgcactccagcctgggcaacagaacgagattctgtctcaaaaaaaataaaaaagcagtcagttcagcagttacctcagggtagagggcattggccagaagggagttgagggaactttttggggtgactaagttgtttaaaaccaattgggacaggcgtagtggctcacacctgtaatcccagcacttcgggaggctgaggtgggtggatcacttgaggtcaggagttcgagaccagcctggccgacatgattaaactccatctctactaaaaatacaaaaattagctgggcgtggtggcacgcgcctgtaatcccagctactcaggaggctgaggcacgagaatcacttgaacccaggaggcagaggttgcagtgagccaagattgcacccctgtacaccagcctggatgacagagcaagactccatctcaaaaacaaacagaacaaaaaacaaaaacaaacaattcaacttagccctgaagatctgtgcattgtgctgtaggtaaagtctcagaggtcagaggttgctgatgcagaggacccaggctgacccaggtccaaaccttagatcctcctttgcctcctggcctggccacctcctgccgtgtggccctcagcagatctctttctggctgagtcccgacggtctcatgggtgaagtgggatgatactaatcgtgtatcattgttgtgggtttgagatgagtatatgaagacctggctgacagcctgtccacagcagctgctcaggaactgttgactgctgttcttttagccagactattatcaaatgtaatttctatttttaaaaaactcttcccatttcctttcctcttgcaatcagtctcaatagcagtaagaaataaataaaaatgaagattctttgggagacttagttttgtttttttttgtttttttgagatggggcctcgctctgttgcccaggctggagtgcagtggcaccatcacaggtcactgcaacctcgacttcctgggcccaaccgatctcagcctcccgagtagctgggactacaggtgtgtgccaccacacccaactaatttctgtgtattttgtagagacaggatctcactatgctgcccaaactggtcttgaacttctgggctcaaccgatccacccgccatggcctctgaaagtgctaagattacaggtgtgtgccactgtgcccagtcagtttaattctaattaagatcaagattatctgtaaatacgagttccctctctccaaatctagaatttgctggcattagtcacatgtctgaggaagctgacgatgggacccacattgagatactaatcccagggctcggtggttcagggcactgtactgacagcatcttgactgctttgcctgttgcctggaaggggtgccgtgtggcgcctggcaggtggcagagtggccagaggccattattactctcttgagttacggtgttctcaagcccagctgagtccacacagccgatgtggatggactaggacagatccgatgacttagtgtccaagttcaattgcaaatgcagcctcatttctttctttgaagtagaaaatcaaagttcatagattagatgaaagaatagtcattgtacaaaagtaattatagtgtgtgtacttttctttatctacaggagctgtaaaattgacaagcttggcatgtggaaatcagcacatctgggcctgtgattccaggggtggagtttacttccgtgtagggactcagcctctcaatcccagtctcatgcttccagcctggataatgattgagccacctgtccaggtaagcagaagttagctggtggaactcactcttcagtaagacagaaactgtgaggatgctggtactgggaaaaaggatctgcacagcctctagaggcctcccagcaaatgcggggagccatgcccccagggtctacacactctcgttcatcaacatcacaactggaattcgggatttgtgaagtttagagctgaacagactgttacagattatgagtcaacacgtatattttctctttcaaaataataatatttcgtttttgactttttactaagtgaatattattttttaaatctgcctatatattggaacctctattttataataataatgataataaatcagtacccagaagtataaagaaggtaaaagttactttgaatcttgtcatggagaaaatgctgagtgcctctcctggtttgttgaagaaattccgtttcctgtccagcccactgctggccagctcctgccatgtttcagctgaccgtgcatcccaacacagagtctgtgttctcctgacctccagcactcagctcacaaggagaagtctgatttgaatgtactatctagttacccttaaagatcccacaggcttggttcctgtgctgaatagatttctgttgaagtttataactgggggctgtggttttttgagacttatttgcccagactcctgccagcccccatttggtgactctgttgggaaacaggtgaagttgccaattgtggaggcagcagtggggcaggggggatggttcgttgttgggcagagaaaccttcagtggagtcaggaaagaggtaaagagtagggtaaatgcctttgtgcataactgtctacattttggtcatggtgaggcctcagggatgaggacaccagtggtgtccaccagccctggggagtgtggtggtgggagaacctttactgaaatcagcattcggctccagagctctgtggaggccaccactagcggtcatggccacagggaggcttctcgtcctccttggtgggtcttcctcctccagagggtgatggggatgatattgtctatgacaacactttgtgaatgatacggcactgtcaaacatgaggttgtacataatgaattataacacatgctctgttttccctctgcacacggtgacgtactcatagtggcacagagggagagtccaccctgcagagaggagccttcctcactgccatgtttagcactgctggggcacagtgattatgaaaagcaagccgcctgtcgttagtttcattattgtccttaaattctctggttgcccgcacccaggtggactcctttgacacaccactgtcaatacgttcctttttttccttctaacaactttatatttttccttttaagttacaacccgcataacataaaatttcagccttctacagtgtgcagctcagtggctttagcatcagttagcagcagttagcaccatccaattccagagggttcccatcactccaaaacagagagaacacccttacccattagcagtcacttcctgttctcacagaaccagcccctccgcccatggcagccactcatctgctttctgtttctatggctttgcctattctggacattttatataaattggatcatataatatgtggccttttttatctgacatctttcactttgtatcatgtttcggagttcatccacgttgtaggtgtatcagttcttaattcctttttatgactacatcacagctctgttgtatggataggccacattggtttatcatttcaccagtggatggacatttggattgtttctgcttattggctactgtgaataatgctgctgtcaacatatgtgtgcaagtctttagggaggatgtatgttcccagttctattgggtatctgtctgtaagtggaattgcaggtcatgtggcgattctgtgttgaactttttaaggatgtcaaagtgtttttcacagtggctgcaccatttgtgttccaccagcaagatatgagagttctagtttttcccatcctcaccaattttttttttttttttttttttgagccagagtttcgctcttattgcctagtctggagtgcaatggcgccatcttggctcactacaacctccgcctaccgggttcaagcaattatcctgcctcagcctcctgagtagctgagattacaggcatgcaccaccatgcccaggtgatttttgtatttttaggagagacggggtttcaccatattggtcaggctggtctcgaactcctgacctcaggtaatccaccctcccccggcctcccaaagtgctgggattacaggcatgagccactgcgcctggcctttccaattttttgttgttattttatttttctggtctcagaaactgcctcatatgtctaattttttaatactagtcatcatagtagttggaaagtggtatctcattgtgggtttgatttgcattgacctaacaactaatgatattgaacatccctcttttcatgtgtttattggttatttgtgtatcttctttcaagaactgtgtgttccttttttcttttttttttttatgatggagtctcactctgttgcccaggctggagtgcagtggcgcaatctctgctcactgcaatctctgcctcctgggttcaagcgattctcttgcctcagcctgctgagtagctgggattacagacatgtgcctccacgcctggctatttttttttttccatatttttttagtagaggcagggtttcaccatgttggccaggctggtctcaaactcctggcctcaggtgatccgcccacctcggcctcccaaagtgcttggattacaggcgtgtgccaccacgcccagcctcaaatcttttgctcatttttaaattgtgttatcttttactgagtttgtttgtttgttttgagatggagtcttgctctgtcgcccaggctggagtgcagtggcatgatctcagctcactgcaacttctgcctcctggattcaagtgattctactgcctcagtctcctgagtagctaggattacaggcatgcaccgccatgcctggctaatttttgtatttttagtagagatgggggtttcaccatgttggccaggctggtcttgaactcctgaccttgtgatccgcctacctgggtctcccaaagtgctgagattacaggtgtgagccaccgtgcccagcctgttgagttttatatatgagttctttatgtattctgggtactagacctttatcagacacatgatttacaagtattttcttccattctgtgcattgtcttttacttttttatgatgttctttgatgcacaaatatttttattttgatgaagtccagtttattaattttttcttcatttgcttctgcttttagttgcctaatccaaggtcacaaagatttacctctatgttttcttctagcagttttgtagttttagctcttacattaagtgcttcatccattttgagttgatttttgaatatggtatgagataggtgtccaaatgcattcttttacatgtgggtatcgaattgtaccagcaccatttattgaaaagactattctgtccacattaaattatttcaacacccttgtcaaaatcaattgattgtaaatataaaggtttgctactggactcttagttatatcccagtgatctgtgtatctatccttaaactacactgtcctgattacttagctttgtcgtaaattttgaaatcaggaagtatgaatcctctaactttttctttttcaagattttttcagctacatggagcccctcctacatccatgtgaattttgggataagtatgtcaatttctgcaaaaaaaaatactaactggaattttgaaaggaattgtgtcgaatcagtagataaatttggaaaatcttccagtctgtgaacatgggatgtcttcccatttatttagatcttctttactttccttcaccaatgttttgtagttttcagagtatatgttttatactgcttttgttaggtttatttctaagttctgtattccctttgatactattgtaaatggagctgttttcttcattttcagattgcccattgctagtatagatttttgtatattgatcttgtgtctggcaaccttgctaaacttgtttattgggtctaacaggtttttgtagattcttttgcattttctatagatgagatcatggcttctgacatggtctgccaatagagataattttacttcttcctttctatctgtatgtcttttattttactgtcttgcctgattgccctggctggaacttctagtaaaatgttgagtagaagtggcgagaatgggcctcctagtcttgtttctgatcttaaggggaaggcattcagtcttttaccattaaatatgatgtgagctttgtgttttcttaggctccctttattaggttgaacttcccttctactcctagaaggaattctaggagttctttctgttcctagtttgttcagtgtttgttatgatgaaagggtgttgggttttgtcaaatgctttttctatgcctattgagatggtcatctggtttttttcctttattaatatgatatattatactgatggagttttatatgttgaaacacagtttcattcctgggttaaatcccagttggtcatgatgtgaaatcctttgtatgtatatgttgctggatttggtttgctaaagttttgttgaggatttttgtgtctatattcatgagagatattggtctttggttttcttgccatgtgtttgtctggatttggtatcaaggtaatgctgctggcctcatagaatgcactgggaagtgttttcttcttttctactttttggaagagtttttgaaagattggttttattttttacaccccatttgttagaattcgtcatcccatccatgaattcatgtagccatgtaggcctgaactttttttgtgggaagtttttttgactactggttcaatctctttattcattataggtctattcagaattttttttttttttttctgacatggagtctcgctctgtcacccaggctagaggatgttggcgcgatctcggcccactgcaacctccgtctcctgggttcttgcaattctcctgccttggcctccctagtagctgggactacaggcatgtaccaccacacgcagctaatttttctatttttagtagagacgaggtttcaccatgttggccaggcttgtcttgaactcctgacctcaaatgatccaccctccacagcctcccaaagtgctaggattacaggcatgagccactgcacccagcctattcagaattttctatttcttcttcttcttctttttttttttttttttgagatggagttttgctcttgttgcccagactggagggcaatggcacaatctcagctcactgaaacctccacctcccaggttcaagcaattctcctgcctcagcctcccaagtaactggggttacaggcgtgcaccaccatgcccggctaattttgtttcttgtgttttttttttttttttgagacggagtctcgctctgtcgcccaggctggagtgcagtggcacgatctcagctcactgcagcctccgcctcctgggttcaagcagttctcctgcctcagcctcacgagtagctgggattacaggcatgcaccgccacacccagctaatttttgtatttttagtagagatggggtttcactatgttgaataggatggttttgatctcctgacctcatgatccacctgcctcggcctcccaaagtgctgggattacagacgtgagtcactgtgcccagcctaattttatatttttagtagagatagggtttcactatgttggccaggctggtctcgaactcctgacctcaagtgatcttcccacctcggcctcccaaagtgctgggattacaggtgtgagccactgcaccctgcctctctttcttcttgagtcaatctaagtagtttattctttctaggaatttgttcatttcatctattttatctaatttgttggcatccaattgttcacagtattcttctgtaatactttttatttctgtgaaattggtagtaatgtctcctctttctgattttataatttgaattggctgggcacagtggctcatgtctgtaatcccactttggaaggttgaggcaggaagaccacttgagcctaggagttcaagaccagcctgggcaacatagcaagacatcatctctaccaaaaaaaaaaaaattacctggacctgatagtgcacctgtagtcccagctactcagaagactcaggtaggagaattgcttgagcccaggagttcaaggctgtagtgagctatgattgccagttttattgccaattgccactatactccagcctgggcaacagagcacaacgctaataataataataataataatttgaatcttctctcattttttcttagtctagctaaaggtttgtcaattttgttgctcttttcaaaacacctccttttggttttcttgctttttctgtgttgtttttctatcctctatttcttctatttccactctgttacttcctccacacattcttgtgcacagtgctttgcttgatagtgatattcctctggtagctccaaggaatatttgtcacaattatcacgtacatgtggaagacctgtggtaacattggactgtaaagtttgtaggatcccagtgcagaggcaggctgctgagtgcaagagcgagatttgcaggatgtgttgtagaaagaacgtccttgagtgggttgagcgcccatgtgccttgcctcctccttttcccagcaagccagaggccaggatgctggagagtagggcaagcaggaagctgccgatctcagtcctcagtggggctggagccacccttgcctctgctgtgtgcacctctctgcagccatggggccacacaggtacctggcaaaagggttacatggagaacggtgtgcaaccacaatttcctgttcctgtctccatgtagactctagaataacctctaggaagcaaagctaaaatggggaagagagctttgcttaaagtgctctattgactgtggtgatcaacagctttgccaggaaaatggccaaaatagaacaaattcacatgaaaggacctcaaagctctgctctgaataaagtagtgattgctaaatgggatgttaagcatgaactatttcaagtagttctgctgaatagagccacattttctcattgagttagcttttagcatgctatggaagacattcagtttgccatggattctgtagatacaaaatgcttttcaagttggtttctgtgggaaagaaatcaggcttcacatgtacacaggcctttctactgcactttgccaagcactgccttatccttaacccttttattgccccaggaaatagaaaagtccgtagttccccctactttacgaggaaatctgttacccagaacagttgagcaatttgcccaggatcccaactctggtgtgtgccaagcccaggcagggacccaggcccccagctcccaggtgctgcccctgccgaggctcccctgggctgaggaaggcgcttctcccgggctgctggcactgacgattgtttgctgagatcagaagtgaagacaagctctgctgccaggcgctcgccttgtgccaggctaatgcctgaagcacatctttccctcagtcctcacaacaacctgggaagtgactgcgtctttccccatttgacagaggagaaaaccctagctcagaggttcagaaagttgcctgaggcctcatagcgggcaggcggcaggggtgggacatagacccaggtgtgtgacacccgcctctgcctctcctgtggctctgaggtccaaggcctgggccaggaccaactgcaggatggcagcaagcaccaggttgtggcgacatgtcataggcttagtggcctcacacgtcgtattttaggacaaagcctacacatgcgaatctttaaatcgcagagggtcctgcaaatgagcccaggagtgaggggagatgggggttcactctgaggactggaacgtcagaagagttggttgaatctgaggattggagaacaagcggggtttatgtattttgattatgttctacatctttccactttgttttatttgttcttcgacttgagcttcttcatctgcgtagaggatgtatttgcagtggaaaaggaaatggaggcaggggatagatgctcaagggcacatgaagtgaagccacagaaatcttttaaaattagcatcagcttctctatttagttctgttgtcctattctcttctctgggaagatacccctcctgtagtagttttgcggtaaagttttaacaaagtactcaaaacaaatgactcagttttcagatttgctaacacttgcaagggtttggagaaaatatttatagttgtgtttagcatcttcatagtctggagtttgctgtttgagttagagaattttctgtctgtgttagaggtacctctaacgcaagcatagttggtgtgaagtttcacattctgtgtgccccatgtgcttgagtagaagaggtgtctgttcttactgtgcttacagtggactctgaaatggtgtctatggtgtggttccagttttgtaaaacaaaactataaaatcccactaggctgggtgcagtggctcatgcctataatcccagcactttgggaggccaaagtgggaggatcacttgaacccaggagttcaaaatcagcctaggcagcgtagtgagaccccgtctctacaggtaattttttaaattagccaggtgtgttggcgtgcacctgtggtcccagctactccagctactcaggaggctgaggtgggaggatcacttgagcccaggaggtcaaggctgcagtgagccatgtttgtaccactgcactccagactgggcaacagagcaagaccctgtcttaatcaattaataaaaataaaaaataatttctcactgaaaacctagaagaaactacaacaaaggtgactgttatggggccgggcacggtggctcatgcctgtaatgccagcactttgggaggcccatgtgggcagatcacctgaggtcgggagttcaagaccagcctgaccaatatggagaaaccccgtctctactaaaaatacaaaattagctgggtgtggtggtgcatgcctgtaatcccagctactcaggaggctgaggcaggagaattgcttaaacccgggaggcggaggttgtgatgagccgagatcgcgccattgcactctagcctggacaacaagagcgaaactccatctcaaaaaaaagactattttgatccagggattataagtgattaaaatttaccatgttttcccataatgggtaggaaaactttttcatgatcagggagaaaaataggtatattttacaagggacccatcttttgtgggtcagtgagcaacctttcttctccgaggcacgtctctgacctacccagcccatataaatctgaaccccagtaggttgtccccccttccccctgccccacacaaagattttagagctagaaggagactggaaaacacataaccttgccacttccttctgcagatgaggaaagcaaggcctggcaaaagcaaggttcctggtctcagggtagtcagtggttgtgccgggcctcctcagcccctcatcctcaaggcccacaacagagcagcggcaagaacagtcccatccagggacactcacaggctaccgtagagacacacgcaaaccactggcgcctgtgcttccagagctgtgggcagagtgccatggagccagctggagagggaagtgctgtcagggccttggagtggtcagaggatctcacaagaggtggcactggtacaagaaaggcaagtaggagtgtagcaggcaggcaggacagagggtgttctaagcagaggggacatgaagtataggcactgagcagaaggcacccttgcccagggtgcagaaaggggctgtattgggagactggcacaggccggggcagggagggctgggctaaggcattggcatcattcttgaagagtttgaagccaggcaggtggcctggtcagaccatgtttgaggaaggagcctgtgtcacaattccctgtgaccagtcagagggtcttctgctggacagatcacatgcacccataagtaggtcagatgcccaggagtgttttgcctcagatatggagcaaaattagcctgacagtaaatgcagctctggtcctacctactggagcttaaagcaagactccgaagaatcaaactgtttcagagtaacttaccagcatcttagaacaaagctcaagaatatttacagattgcaaaaatatccaacatcagcaagataaaattcacatgggcaaccaattaacatttacccaacaagcagagaagcaggaaaatacgacctgcaatgaaaggggaagaaatccgtcaataggagctgacccagaaatgatacagatggtaaaattcatagacaggacattaaaacagttgttacacctttatgtgttcaagaagctagtagagagattcagcctgttaagtagaaaatgagagatagaaaaactccaggctaggccaggcatgcaacggctcacacctgtaatcccagcacattgggaggctgaggtgggcagaccacctgaggtcaggagttgcctggccaacatggcaaaacctcatctctactaaaaatacaaaaattagccaagcgtggtggcacacacctgtaatcgtagctactcaggaggctgaggcaggagaatcacttgaacctgggaggtggaggttgcagtgagcaaagattgcaccactgcactccagcctgggcaacagagcgagactctgtctcaaaaaaaaaaaaaaaaaaaaaaaaacaatatcaaaaaactccaggctgggtgtggtggctcgtgcctgcaatcccagaactttgggacgctgagctgggagaattgcttaagctcgggagttcaagatgagcctgggcaagatggcaagaccctgcctctaaaaaaaaaaaaaaacaacaaaacaaaaaacaacaactcaaatcaaatttgtagggattaaaattgcaatgtctgagctgaaaaatatcactggatgagattaatggcagcatagaaattgcagaagaaaagactagtgagcttgaagacacagcagtgaaaaaccatccacactgaagcccagagggaaaacaggctggaaaatgttcagagaatcagtgagcacagaccccttcaagtggcctcacgtaaatgaaatccaagtcttaagagggaagaagggtgacaggaaaaaaagatgtgaagaagaaatacaactgaaagttgtccaaatttgatgaaataattatgctgagtcaagaagccaaagaatacatactgttatcatttcatttatataaaatttggccaggtacagtggctcatgcctgtaatcccaacactttgggaggctgaggcgagcagattgcctgagcccaggagttcaagaccagcctaagcaacatggcaaaaccccgtctgtacaaaaaatacaaaaattagctgggtgcctgtagtcccagctgctcaagaagctgaggtgggaggatcccttgagcccaggaggcagaggctgcagtgagccatgatggctgccacctcactccagcctgggtgatagagcatgaccctgtctcaaaaacaaacttatttatataaaatactagaaaatgctaacacaggccaggtgctgtggctcatgcctgtaatcccagcactttgggaggccagggcgggtggatgacctgaggtcagtagttcaagaccagcctggccaacgtggtgaaaccccgtctctattaaaactacaaaagtcagctgagtgtggtggtgcacacctgtaatcccagctacttgggaagctgaagcaggagaattgcttgaacctgagaggcagaggttgtggtgaaccgtgatgacgccattgcactccagcctgggcaacagagcgagactccgtctcaaaaaaaaaaaaaaggaaagaaaatgctaacacagatcagtgcttactcaaggcctggcagaaatttcaaaggggaggtgtggcagtggcttcaagagtgtatgcatatgtcaaagcttacccaattatgtactttaaatgtgtgcatttcattgtatgtcagcatacccctgtagagctggtttttttttttttttttgagacagaatcttgctctgtagcccagactggggtacagtggtgcgatctcggctcactgcaagctccgcctcctgggttcataccattctcctgcctcagcctcccaagtagctgggactacaggcgcccgccaccatgcccggcaaattttttttttttttttgtattttatgttgatacagggttttaccacgttagccaggacatacaaaaaattagccaggcgtggtggcgggcgcctgtagtcccagctactcaggaggccgaggcaggagaatggtgtgaacccaggaggcggaacttgcagtgagccgagatcgcaccactgcactccagcctgggtgacagagcgagactccgtctcaaaaaaaaaaaaaaaaaaaaaaagagttagccaggacggtctagatctcctggcctcgtgatctgcccacctcccaaagtgctgggattacaggcgtgagccaccgcacccggcctgtttttgttttttagagacagagtctcactccattgcccatgctggagtgcagtggagtgattgtggctcactgtaacctcaaactcctgggtcaagccatcctcccacctcagcctcccaactagctaggacactacaggcatgcaccaccgcacctagctaatttttaaaaaaatttgtagaggcatagtcttgctatgttgcccaggctggtcttggactcctggcctcaagcaagcctcccaccttagcctcccaaagtactgggattacagatgtgagccaccatgtctggcctctgtagagttgttttaaatattaaagtgtacaaaaaaaaaatttaaatgggccgggtgtggtggctcatgcctataatcccagcactttgggaggtcgaggcgggtagattgcttgagctcaggagttcaagaccagcctgggtattattgtgaaatcccatctctatgaaaaatacaaaagttagccaggtgtggtggcatgtgcctgtagttccagctactggggaggttgaggctgcagtgagctgtgatcatgtcagtgcgctccagcctgggtgacagaatgagaccctgtctcaaaaaaaaaaaaaagttttaaatgaagattatagggtaccctacattgtgtttggtttgcagagggaacagaaatgagtgaagctgcctaagcatggtggctcacacctgtaatcccagcactatgggaggccgaggcaggtggatcacctgagctcaggagttcaggaccagcctgagaaacatggtaaaaccccatctctaccaaaaatacaaaaaattagctgggcatggtggcacatgcctgtaatttcagctactcgggaggctgagatgggaggattgcttgagcccaggaggcggaggttgcagtgggctgagatcatgccactgcactccagcctgggcgaaagagtaaggccctgtctcaaaaaaaaaaaaaaaaaggaaaaaaaaaaggaaatgattgaagctgtttttggagttaactgaccaaaagttaaatgactaaaagaagagcgaggcaggaggttatagaagcaatcatgaaaaaaatacagatccccagggtcccaaacctggtttccgaggatgggtagtgtttgaacttggacttgagactcaatgggcattttcagtgaccagcaggtaaagaggcttggcctagtgtttctgagtagggaagagtgctcctccctgctgccttgggaggactgtctgctgctggaccaccctgaggactgtgagacattagctctgtgggcttctaggctcctggcagtgaacctctgggagtgaaggatgcacaaaggatgttgtgggaaagagaagatctgagatgtcctttgggtcatctttggaggatcttgactctgaggctggagggtttgtggctaattccatgggcagtgggggctgttggaggctcttgagcagggccggacaggacccaaatggagaaggtctgcagtgagctgtggaaattctttggcctgattcgctggatttgtggtgcacatctgtgagatgtgagattgggatggagtggacatggggactctgacatggattgttttggggcagaagaagccaatccatgctggcgtcccagcctgggtctgtaatctcattaatctccttttggtgactggaccagttgcctgtacaagtgcctcttggtctccttgatccaacctcactgagccagcgtcgcttgtatgcatgatactgcaagacttccttcccagctggcctgcacgcaggtgccttggagaggcattgggcagatggcatgtggccatttccagcagtggggcgcagtgctcagggagactgcagcatcctggagccctgccagccaggagggactgttcccattgcgggcagaatctgttacttgcaatcagaagaacttcaactaatacttgttttttgcctgtagattcaattgaccttgggaatgttgcttaaactcgcctttcactttcattttcctatcagtaaagtgaagggtcatatccacattagagccatcagaggagcttattaaaaatgtccaggcctcggccctccctggagatatgaattcagcaggtctggggtgaggcccaggcatcttggttggtttttttttttttttttttattgatttatttgagacggagtcttgctctgtcgcccaggctggagtgcagtggcatgatctcggctcactgcaagctccacctcccgggttcacgccattctcctgcctcagcctcccgagtagctgggactacaggcgcccaccaccacacctggctaatgttttgtgtttttagtagagatgggttttcactgtgttagccaggatggtctcgatctcctgaccttgtgatccgcctgccttggcctcccaaagtgctgggattacaggcgtgagccaccatgcccggcctattttttatttttgagacagagtctcagtctgtcattcaagctgaagtgcagtggtgcgatcatagctcactataaccacaaacccctgggctcaaacaatactcctgcctcagcctccaaaatggctaggggtatgcaccatcacacctggctcattttttaatttttattttgtagagatgaggtcttgctgtgttgtccaggctggtgtcaaactactggtctcaagtgatcctcccacccctcagcctcccaaagtgctgggattgcgggcgtgtgccactgtgcctggccagttttgttttttggttttgggtttttttttttttttttttttttgagatggagtcttgctctgtcgcccactggagttcagtggggtgatcttggctcactgcaacctccgcctcttgggttcaagtgattctcctgcctcagcctcctgagtagctgggagtacaggcacccgccaccacgcctggctaattttttttttttttttttgagacagggtctcactctgtcacccaggcgcgtagtgcagtggcacaatctcagctcactacaacctctgcctcctgggttcaagtggtcctcccacctcagcctcttgagtagctggggctacaggtgagtgccactatgtatttgtatttttagtagagacggggtttctccatgttggccaggctggtctcaaactcctgatctcaggtgatctgcccgcctcggcctcccaaagtgctgggattgcatgcgtgagccactgtgcccagccacacccagctaatttttgtatttttagtagagatggggtttcactgtgttggccaggctggtctggaactcctgacctcaagtgatccacctgtcttggcctcccaaagtgttgggattacagataggagccaccacaccgagcctggtttttatttttcatgaaagtcatacatgaaatgccaagtgtggtggtatgtgcctctagtcccacctactcaggaggctgggtgggaggatcactggagaccaggatcatccaccgcactccagcctgggcaacagagtgagcctccatctgtaaaagaaagaaaacagagtcacatgtgaaaatcagtaggttgacatgtcagtgggttctataagatgtgctataagaaacatgtctctcctgccaattttgccctctctggagagttcctttcagttcttttcgctgcctgtctctgaatgctgcttcgggagctgtgtttggtcccctgacttcaggtgtttctggttgactctctgcgggaagagaagcatgcagagctcttgcatcccccgtcccccattcccccagccacccacctcccttcctacttccaccctgccagagctgcagtgcttcctgggcacgggccttgctgtgaggacagaggagctcttcacagcggaggcaggggatgaatcacacctgcagttccttgtctgtgtgactctttgttttccctggacttgataatcatcttgtttgctcatctagttttttttctttttttttttgagacagagccttgctctgttgcccaggctggcgtgcaatggtgcgatcaatctctgctcactgcaacctccaactcctgggtccaagtgattcttctgcctcagcctcccgagtagctgggcttaacaggcgtgtgccaccacacccagctaattttttgtatttttaatagagacagggtttcaccacattggccagcctggtctcaaactcctgacctcaggtgagccacctgccttggcctcccaaagtgctgggattacaggcatgagccactacacccagcctgctcatctagttttctaagtgcagttccacacattcaatcccaaactctctgccagttgtctcacacattaggaatgtgtcctctccatttcttccccctgcagagatctctcctgcaccctcttggccagctccagtctggcctcgttcctctctctacccgggacccagctgttgtcctagcgtcacctttgacctcccctcatgttagagcccctttctcccggatcccgggtcttcctctctctgtgtctgtgtttgtttgggtggagtttatcttccagtcggttcccaaggaagggttcatggttggtgactttttggaggtattgcatgtctgaaaagtctttcatctgtgttcacccttgaccttgctggatatagcagtctaggttggaaaccattttcctttaggattttgagggtctttctccattgtctctcggcttccaggattgctactgagaagccagaagcctttctttttttttttttttttttttttgagacggagtctcgctctgtcgcccaggctggagtgcagtggcatgatctcggctcactgcaagctctgcctcccaggttcacgccattctcctgcctcagcctcccgagtagctgggactacaggcgcccgctaccacgcctggctaattttttttttttttgtatttttagtagagatggggtttcaccgtgttagccaggatggtctcgatctcctgaccttatgatctgcccgtctcggcctctcaaagtgctggaattacaggcgtgagccacctcgcccggcccagaagccgttctaacacctgatccttgatacttgacctgtttttctttctgaaagtttgtaaggtctctttgttcctagtgttataagaacagatacatagtggtatgccttggtgagggctgtgttcatccttgcagccaggtggttgcagcctatgtgctggtgggtgtctgggtcctctgctggggtcctcttctgccccgcctctcttgttttcctttttttgttgttatgtttttgtgtgttgttgttgttgttgtagggttttttgttgttgtggggttttgttttgttttgttttgtttttgagacggtctctcactctgtcacccaggctggagcacaatggcgcaatcacagctcattgtagctttaaacttctgggctcaagcaatcctcccaccacagcctcccaagtagctgggaccacaggcatatgcaccatgttcagctaatttttttattattttttgtagagatggagtctcactatattgcccaggctgcttttgaactcctgggctccagcaatcctgccaccttggcctcccaaagtgctggattccaggcatgagcaactgcacctggcacccctcctgttttctgtctgctctggctgaaggcctccttttccttttctttttttttttttttttttttgagttggtgtttttgcccttgttgcccaggctggagtgcagtggcgcaatctgggctcactacagcctctgccccccgggttcaagcgattctcctgcctcagcctcccacgtagctgggattataggcacctgccaccatgcctggctgattcttatattttcagtagagacaaggtttcaccatgtttgccaggctggtttcgaactcctgacctcaggtgatccacctgccttggcctcccaaagtgctgggattacaggcattagctactgtgcccagcctggaggcttccttttgtattgtggactttctaagctggcctccacttttcctttctctcctgtttctgtctttttatgcttttatcctgctttctagaagacattctcaaccttatttctccaaccctctgtcagattatttccatgatcacatgtttaatttctgaaagttcctgttgttgtttgatggctgtagagtcagtcttctctcatctccctaaggatgttttggaagtttcttctccctgcctggtctttgtatgtcccaagttgtgtgttttctgtctagttcgccttttacatggcagaggctttcttcagatgttggcagtcccctggttggaagagtgaggcccagcaaggctgactggaagccctgagcacatgcatggagcctgtgggccccgcgggtctctgacagcaatctggctgggctgctgggtggggagtcgttgcttttagccttccagggcccgctgagtccttgccatgcatcccccactttccagcttccagaattgtatggctgcttcctcccctcattctctctgtccttaggagatttgaaccttttttctttgagatggagtcttgctttgtcacccaggctggagtgcagtggcccgatctcagctcactgcagcctccccctcctgtgttcaagcaattctctgcctcagcctcccgagtagctgggattacaggcgcatgccaccatgcctggctaatttttgtatttttggtagagacagggtttcgccatgttagtcaggctggtctcgaactcctggcctcaggtgatccggtctgcctcggcttcccaaagtgctgggattacaggcgcgagccactgcgcccgccccgtttttctttgtttaacccattccctctcatggtagtggtgcttgagaagggagtgaaagagtaattgtgtgctcattatcatcactgcccagaagcttctggcttcttcagcgccctgcaggtgactcttgcacatacccagcgctgagcaccatggtgcagctcatccccttcacctccacggttctggtatcacagtcttcagagtatagccactattttcctctaagcctctgaacatctttgagtggtatttaggtgctggtggggctgcctgttacactgtaagttgttccgtcagcacaactatgctgcctgcaaatgaaggtatgaaacctccccaaactgctgtctaatggtgtgggatggaaccagctccctttgagagaaactaaattgttttttgccacttcctttaattttttccatgttgcctttttttcctatacctccatttaaacatctattgtttttgagctctcttcttcaaaacttgcttctaggaactattacccctcttcaccatattgaactctaagtcttttctctcattctggaaggccatgatacctagaagtagaccacagggttctaacggggtgccctgggtcctgcagcagtcccctcatcgtgctttaacaacttatgacccagtagtttaaacaacgacctagggaagcttgtcccagcctgccctgcgtgtgcccccagtaaaaccatgagcggcaggaaggggagcccctcgcgatgcttgccatgaccctagaggagcagagcccagagatcatctttagggacctctccctctgggctgcactcatccagaaggtgcttccccgagcctgtctgtagagtcagccacagagcagggcgatgagctatcagagaccagggtgtgtgccactgggtccagcttctgctcttcttgtctcacagcaatatttgagtcctggtgctagccatggcgcagtcgttgggctggtatcagtgacaaggtctggagggtagacaggaagagtggccagttggctccaccagcccctgctcaggaaggacagaatgtgacaggcacccaggaaacctgcttctgagcgttttctttagcgcaccccctacaattagcagatgcagcttcttgctggattctgaggtcacacctcagaccagatgtagaggcccagcagtaactggagtcagtgcagaaggacccaccacggagagggagaggcctctgacaggccagaagagagcagcagtggagcctgtttctgtctggagccctgctctgctgggccagaagtttccaaatgttttttagcagtgggacccattcttcaaattaaaaaaaaatttttttgagttaggctcttgttccgtcacccacgctggagtgcagtgacacaatctcagttcactgtaacctcaacctcctgggctcaagtgatcctcttacctcatcctcctgagtacctgggactacaggtgtgtgtacaaaatacaaaaaacactcccagctgtccagccttaaataaaatcttgtacataagccagatgtgttcaacaagtaacagcaaaactggtcccatgaaactgccccttccacaggggccctgaggcacctctgcaaggccagggccccacaggcgctgctggaaaactgctggtcttcgggccagtgaggacagagagagagctcagcacagcaggccccgggcagccatacccacctcgtaccacggtcagagtctcgaggagcctcagagatcatggtccccggctcctccagctaaggacacagaccacgaagaggaggtcctcctagtgtgtcagccctggctctgagaatttacctttaatttaattctagacctattaacatgggtatcgggtttttaagcccatctgaaattgggaagaatagaccagaagcaggaagagggtctgctacagggaaaaaagaactagaaagaccaaacagaagtcagaaagtacagctaccacggggccatgtgacaaatggcccaaccaacccacacgcctcagcgccccctgaggctgcacggatagacggacagacacacagcagcaccatgaatccttgagggaaagtaaagctcagcatgtgtcagtctttacggggattcaaggttaaaacagggagggagagagacttggagggaaaagaaaaggcagtgtggaaagcacaaatggccgcctggataaccgtggtttgtttgggttaggattatttccagaggcgtctttcctggggcatttgtgctgccgcttcaaaaaccctcggtccaccctggtattcctgaaacattcctgctgaatttcttccaagttctgataagtccatgccaaaatggtctgtctagatacatgtttcctttggctgtgaaatcttcagcatgtttttgtttttcagcctgggtttaccacattctgactgaggaacatgtgtgagtgtgtgtgtgcgtgcgcacacgtgtgttgataaaagctatgataaaagctcagctacaagaagtttgaagaactgtggtctgagccccagacacttgtgttttctttttcttttcttttctttttttttgagatggagtctcgctctctcccccaagctggagtgcagtggcgcaatctgggctcactgcaagctccgcctcccaggttcacaccattctcctgcctcagactcccgagtagctgggactacaggcgcccgccaccacgcctggctaattttttgtatttttagtagagacggggtttcactgtgttagccaggatggtctcaatctcctgacctcgtgatccgcccacctcggcctcccaaactgctgggattacaggcgtgagccaccacgcccggcctgtttgttttttttttttgatacggagtttcactcttgttgccgaggctggagtgcaatggcgcgatctcggctcaccacaacctctgcctcccgggttcaagcgattctcctgcctcagcctcctgagtagctgggattacaggcatgagccaccacacctggctaattttgtatattttttagtagagatggggtttctccatattggtcaggcttgtcttgaactccggacctcaggtgatacgcctgcctcagcctcccaaagggctgggattacaggcgtgagccaccacgcccagcctcttttgcatttttatgaagtttttaatatgaataagccaaaattttagatcacctactactttttttttgtttttttagtagagattaggtctcgagctactgggctcaggcaattctcctgcctcagtgtctcatagagctgggattataggtgtaagccactgtgctcggccttttttttttttttaattgaatttttttttatttttttgatacgtagtttcactctttttgcccaggctggagtgcaatggcgcaatcttgactcaccgcaacctctgcctcctgggttcaagcaattcttctgcctcagcctcctgagtaggtgggattacaggcgccccccaccacgtccggctaattttgtactttttttttagtagagacgaggtctctccatattggtcaggctggtctcaaactcccgacctcaggtggtccgcctgcctcagcctcccgaagtgctgggattacaggcatgagccactgcacccggcctaattgaaatttttattgagataatggtcactgcacttgtatttataagaaatcctgagtaccctttacccagttcacagcaatggtaactgcaaaactatagtacactgtcacaaccaaggcttgtctacttttttttttttctaaattgtgataaaatacacatgagatttaccgttagtgacagtacatttgcaatgttgtgcaaccattgtcactatatagttccagaacattcttttttttttcttttttgagatggagttttgctcttgttgtccaggctggaatgcagtggcacaatctgggctcactgcaacctctgcctccccaggttcaagtgattctcctgcctcagcctcccgagacactaggactacaggcatgcgccaccatgcctggctaattttgtatttttagtacagatggagtttcaccatgttggccaggctggtctcaaactcctaacctcaagtgatctgcccacctcggcctcccaaagtgctgggattacaggcatgagccactgtgcccaacctagttccagaacattcttatccctcaagaaagcccctagcaatgtgaagccactccccattcctcctccctcctctctcccagcctgtagcagctgctcacctgatttctacctgggattttcctcttctggatgtttcatagaaatggaatcctggctgggcgcggtggctcacacctgtaatcccagtactttgggaggctgaggtgggtgggtcacaaggtcaggagttcaaaaccagcctggccaaaatggtgaaaccctgtctctatcccagtactttgggaggctaaggtgggtggatcacaaggtcaggagttcaagaccagcctggccaagatggtgaaaccttgtctctactaaaaatacaaaaattagctgggcatggtggcaggcccctgtagtcccagctactcgggaggctgaggcaggagaatcacttgaacatgagaggcagaggttgcagtgagccaacatcacaccattgcactccagcccgggcgacaagagcaaaactgtgtcaaaaaaaaaaaaaaaaggaatcctacagtgtgtggccctgagtgatacgtgctctctctgacagcccctgagtgtgtctgggttttgtctgtttaaatgagggtttattcagccccagacttctggtacaaaccaggggacagctagccgctcttgcactcagcacagctaacaaaccagcagtgccaggctcagccgggagttcttttgcctccaaagaaaggcttgagaagaatctacactaactttagtggaggcacttacatcagtgcctccactaaaaataaagcaaaaacaagcaaatccaggtgacagttacaaaaaaaaaatacagtgagtttataaaataaatacagcaaaggtgtgttgagaccgccagtgaatcaggtcactgtgatgaaagccgcacagcaggtctgtgtgttaaccccacgcggcaccttccttggtcactgtgagcaaacagtggaattccctgctcccaagatcctgtgctgcttcccactggcaccactctcagaccgtaagaaatcggtttgctccagaggaagatgatgaagtcatttgctttgaggtccagtgattatcattgtttctgacctaatagaaaatcatccctcactgatgcccagccctgctggtctcgaagcccctcacaggcatcatgtcatgacacccagggtgtgcccagagccccagcaggcaggactgccaggcagggctaggaccaggcctctctgttactaacctagagagcagtcagcaaagcaacccccgagtttgccaacttttcaagcgttggttttttgtctgttgaaacctcggtgtattttagcagaggcgccttcccgagtcacccgacatctgtggctcggggtcatgattgccgcgaccacccggggtgctgagctccgccccggcctggcgtctgctctgaaaaggtccagactcaggcagagcagacaccccagggccactttgccagtccttcagcaggcgccatgggctcctcctccaaacctgttccatcggcctcttagggcctgcctgtaccaccagcccctggcttattgcaccagcgtccggaacggggttcttgttctacctgcccttccctgcagcttgtcctcactgcagccagaagggtcctcagacgacatgtgctagttcatatctctcctctttttttgtttttttgggttttttttgagacagagtctcactcttattgcccaggctggagtgcaatgtcacgatctcagctctctgcaacctctgcctcccgggttcaagtgattctcctgtctcagcctcccaagttggtggaattacaggcgcatgccaccatgcccgattaattttgtacttctagtagagatggggtttcatcatattggtcaggctggtctcaaactcctgacctcagatgatccacccgcctgggcctcccaaagtgctgggattacaggtgtgagccaccgcgctcagcccacatctctcctctttttttacttttattttgtttattattacagagggtcttgctctgttgcccaagctagagtgcaatggcacgaatatggcttactgcagcctcaaactcctgggctcaagttatcctcctgcctgagattcctaagtagctgggactataggcacatgccaccatgcccagataattttttaaattttggtagagacaaggtcttgctgttgcccaggctcgtctcaaactccttggctcaagcagtcctccctccttagtcttccaaagtgctggcattacaggtatgagacaccgtgcccagccctttcctcttttcacacccttctggcagcttcccacgtcactcagaatgaaatcatacttcttccctcagcctgaagcctgccatcagccctagcagccactctggcctcaccactgggctgcagcctcccagcctccttgctgcaaccctgagctaccctcagttctacacttgctggggctgctgggtaccttccctaggtgttggcaggatcactgcccctccactccaggcagagtcagggtgtccctctggcccttctctctgttacgcagtatggcattggtttgtccgggttgtgccccaccctccccagtaggatggcagttctgggtgggcagaaacaagtgttttgtttgcagttgaggtttccccaaaacccagcatgtgtgggtgctcatttgtcgaacaaatgatcacatgcctccaattagaggtgtccaggagacagctggtgtgaggccttgggccacatgagccctgccagtggtaggggtggtatggtgtaccatggaacccagtctgggaaatactgggtaaaggcatgaggcaagatgataaacctggaaagatgtgtccagaatgacttgctcttcctcttttaaagagcatttactggtgtccccatgtgcttttcgtcagactgtgctctcccaccctctgagacctggcctccatccctaccccttcctgaagccctcctgggctgtctgcaggctggcctctcacctagagtgagggccctgccagggagtgccagtcctcctttcggagagaagccactatgccatgagcttccgtcgtgtaaagtcagacccagacagcccaggccctggtgtcaggagtgtggcagcagccagggccggggctctccttctccttcttgggccagccactggtcacacaggtgcactcaaattgggaagctctgtcatgctgtgcacttaggatttgtgtagttttcaaatgtatattttcctccagtaatacaaaatagagtttctttttattggataaaagcgggtgaggggctggggacgcagaatgtttctgagggaagcaggtggtcagggtccatcctccacgcacctcctcagcatcgggctgggctggagctgggcagacgtggcctcctcctgcagggagctcccaggcagcacaggggcccttcccagaggcctggcaggcagcgtgagtggggttgtgaagggtgggcagcagcgtgccaggtgagcaacgcgtgagggggcgtgtgtgtccggaagggacgactggcaaggccagggtgaggctgggccccgcttgctcttcccaccatgttctgttctagcggcttctagtaaaggctgttaatgggcggaggctcacattaggaggcagagcccggaagcgagagagccaagggagacagggaagttttatgttccagagacgttgcgaggtgatggagagaagaggaaagggatgcggggtagccatcctctgcccgctcacgagcacttctccgcctgccaccgtgctgcttccagcgcccatctttctctatctggagacccctcagagactccactttggtccttgctgttcttgcccttctgctgaagcacagtcatctcctcctctctccatcattcccgttgtccttgacttactattcaaaagctagctgcttcaaaccacagcgcgtctcagctctgggccaggactacgggcagtgtgtgggggagtcctggctctgctccaccacgtcggggccctggccagtgggctgaatggcgaggcctgggccgcttttctgtcttctccacgcggccttccgagtggggaaggcgggagcctggcgggagcctctcctccacatagcctggtggcctcagcctcggcctcagctggcaggcctctcccctcccttccctggagcccctgcatcccctggaatgggggcttagcctagaacagcgcttccccaaatctgcacctctgaaccccaggtccatggaatggaaatggatgtgatgtatggaaagggggttccatagccaaacaagttaagctaagttcagagggaaggtggtgaatagaaatcccaaacatctgatcccagcacagctagcggtggggacttgccttgagtgcgctccaggtggtccctggggactcggtcctggcacccctgccctcctggattgcatcccacagccctgctggccgccccgccccagcctccctgctgtgacaggggcaggggctgcggtgaccctgcagcacaggcgcggctccctcggatcccttggatctcaccggtgcatctgaggttctgcgtggaaagtggctcgggcttccaatgccgctctgctttaagctgggaccgctgtccagggtggtgcccagccttctggcatctgccatccaacccttccctctctcccctcagtggccctgtgtcctccgggcatcaaccctaatgccacctcctcacctgaccacccactgccagttgctcattttatttcctggtggtgcctcccatatctgaacctagcctggtgcttacgtccaattgcctgctctggtgctacctgagagccccatccagcccactcacgaaggcttccagagcctgtgcctgtaacttgggcaaatgtgtggagtgagcgaccaaagggctgagggagcagcgaagggagcccctcgctaggactctaggactctgttctctctgtgtctcttaaaatagctcactcgtggctgggcgcagtggctcacacctgtaatcccagcaccttgggaagccgaggcaggcagatcgctggaggtcaggagttctagatcagcctggccaacatggtgaaaccccgtctctactaaaaatacaaaaattagctgggcttggaggtgggcacccataatcccagctacttgggaggctgaggcaggagaatcccttgaaaccggaaggcagaggttgcagtgagccaagatcacgccactgcactccagacacagtgagactcaaaaaaaaactagctcggacgggtgcggtggctcacgcctgtaatcccagcacttttgggaggccgaggtgggcggatcacctgaggtcaggagttcgagagcagcctcaacatggagaaaccccgtctctactaaaaatacaaaattagcctggcatggtggtgcatgcctgtaatctcagctactcgggaggctgaggcaggagaattgcttgaacctgggaggcggaggttgcggtgagccaagatcacaccattgcactccagcctgggtaacaagagcgaaactccgtctcaaaaaaaaaaaaaaaaaactaaactagctcattcacctcactggcaggctgagacctgcagtcactccagcggcaccctgagtgagctcacacaagagagaactttggccaggcacggtggctcacgcctgtaatctcagcactttgggaggccaaggggaatggctcacttgaacccacgagttcaagaccagcctgggcaacatggtgaaacccagtgtctacaacaaaatacaaaaattagcctggtgtggtggtgtgcacctgtagtcccagattcttgggaagctgaggtgggaggatcacttgagccagggagatggaggttgcagtgagccgggattgcgccagggcactccagcctgggtgacagcgagaccctgtcttaaaaaaaatttttttaaagagaactttctgacagccagaatcaggtgggggcaggagggagggggtggccctgtgcctgtcagtgttttggctgcggagctgcgaccaagtctggatgtgtttgggatttctattcaccaccttccctctgagcttagcttaacttgtttggctatggaaccccctttctatacatcacacctatttctattccatggacctgggattcagaggcgcagatttggggaagcgctgttctaggctaagcccccattccagggggatgcagggactccagggaagggaggggagaggcctgtgatcactctgcaaagcagggctgggtggggaggccgggcggctggggaagaaacctgccatgtctgggaagaccggttggtccttagaggacctagcagcagcaaaggcaaacactggctcaggcagtggtgactggtggtgatgtgccgacaagagcggccaccgccccgtcctccttgctgctctgtctctccatcctccatgtcctgatccactgggactggccctggggctgaggtgtgagacttggtgcccacgggaggcatttcatacatgcgttcatcagcccacagttaggggcccctgcccagagcagccggcgggtgaggatgcgggcagcctggagagggcacctcgatccgggaggtgcaggtggagggaggtcccactgcctgagggccctgagagtgtctggccccggcaagtgtgtgacacgggcactatgacaggagcactgtgcggccagagtgtggcacagggcatccagtgtgattgtattcacggcagccctgagcacaaagcaaggagcaggagatgtgtggcggcagcgagggatctgccagtttccactgggtggcccactcggtcccatggaggccgaccaggagggcagggacccaagaccacagatgtagcagggaagactgtgggttccagaaaagcaggcagtgccaggcagtgggggacagccagcccctcggggctcgggtcacccaccagcactgctggtgaccagaggcccagatcctccagacagtgctgtgctcgcgggcatggaggcctggtccaactgaggggtgggaagccctggggcaaactggagttgccggtggacagcaaacaggacactggagggacttcctcctgtcctgtgaagagcagacaaaggaccggagatgctgagcatggacagaggctgcccaaggaccagggcagggcggcagtcttgtgccgcggcctggtcaacgcagatgttgcctgcccggcagcacattcgggaggacagctgtgcctagaggagaggggcctcagctgagccaggatggtgagggcagcacaggcaggtggcaggggctcctgggctggcgtttttgtttctcacagtgcccaccatggtccttcacagccaggtccgccgcatctctcctctcattcctccactctctgttcacctgggccatccctgcccttcttggcctcctgctggagtccatgctggtatctgctgggctgtccctcagtctggcccacctgacattctggagacaagtgaccatctcccccgtgagactggcactaggggcaggacgtggcctctctgcctcctgcggggcccacactggctgctgcatgctgccactaacatgtccccagttccggaagtctcctgtcctttctcttgtcacccaactcctgccttccctgaaagtcccttcccgcttccagcccgccggggtcagcttggtcagcgtccattccagccccaacgaccagatgctgtgggtgcttgacagcaggtggaacgtgcacgtgcggaccgggatcaccgaggagatgcctgtggggaccgcctgggagcatgtgccaggtaggagcctgcagacagggcctgtggtgccggccagccggggctaccatcactgggggctgctgggcgctccctccaggccgctgtctgtgaggcagcctttgtgctggggctgtgctgtcgccgctgcttcctgggccaggggacaagcctcccatcatgttccttatcaggggaacccaggccgtcctgctggtgcttttgtgggagggcagtttgcacactgcccaggcccttctgtcctttgacttctggctttcggtggctttgctggccctgccaactggtcgtcctttccctcggctcctgccccaagcccagcccatcatgggcactccgtccccgcagggaccctggtggaggtgtgcagcgtcacaagagtcggcttgggaagcagcggcccatcccgtccatggcaggggctcaggagggaccctgtctgcccacagggttgcaggcctgccagctggcgctgagcaccaggaccgtgtgggcccgctgtccaaacggagacctcgcccggcggtacggcgtcacagacaagaaccccgccggggactactggaagaaaattcccggcagcgtgtcgtgtttcacaggcaggtgcccggggccagtgggcttaaggccccttggggttcccagggctcctgtggacgatgtcggggggctctcaaagaagccgaccccactgggctccaatctctcaaagcaagaactgagggcaaagccaggagtgtgtcccagggagggaaggggctggacacctgggctctgccagagtctcctgggcaaggacaaggtgctgttgacatccacttacagctgagggtacgaagttcacatggagatggtggcttgtccagtgtcccccacctagaatgtggcaagcccagacctgcgcccaagctcccagctccatctgtgcccaccccacaggctgtgtgattgacaagtatgtgattggctcttgtccctgcagtgactgcgtcagatgagctgtgggctgtgggcccgcccggctacctcctccaacggctgacaaagacgttcagccactcgcacggcacccagaagagcagccaggccgccatgccccaccctgaggacctggaggacgagtgggaggtcatctgaaggagccctggccgagtcacgcggaggggcccggcgtctgtggcgggcacaggggcttcagagtgactccctggtggacgcgctgcctcaacacttgtccagacacctctggccaggttggacccgcacacttactttcatctatgttggtttctgtctcgttccagaacccacagcctccacccgtggctggcgtgattgctgcagcagtggcgcctcctagctcaggacagtggcgactgcccggctgcatgcactccgattacccacgtgctgccgtcctggtctcatccacagatagctccagcttttgttggtgggagtggtctccggaggcctcccagaaccaagggtagccgggcagctggtttggcccagggcctccttccacattagtagccccagggccagatggagccaaaggtcagctctctgcagcgcgggatgtgctcggtgatggctttgtcccatcataggggggtgtccccccagagacaaagctgcagagcacattccatgccagacgctctggccaggaagctgaggccgggcttgagaggagagcgctggccatgccaggagagaacccacgcacatgcacaccacaacacacaacacacctcacctcacaccacagcacacctcaccacaccacaccgcactgcaccatacctcaccacatctcaccacaccacagcacacctcaccacacaacacaccacaccccacaccgcactgcaccgcaccgcaccgcaccgtacctcgccacatctcaccacaccacaccacaccacacctcactgcccacacacggcgcaggctgcccgcctcctggagagcacacttcagctgaaacagtaaagcctgatgggtgcaaatggaacctggatgtgtgcacgtgtgtcccaggtagggacggcacaggagggtgcatggggcgtgggggagctgagcaagggtcgctcacttagaaatgtctttggaatggtgtttaactaatgctgctggcggacatcctaaaaccagatgcatcctcagaggacgagtctactaattattgcctttgttgttgtattacaaatctgcataaaatacctcatttcaaatcaaatcttacaaatttagaagagagatatgttttccgaaaacagtggaagccctttgttccttcccgggtttgtcctgagcctgcactgtcctcgcctgcagcctcagaggggcaggcatccccgcacagacttgactggcagggcggtcacgggacctgcgggctggctccgagtggcagcccatgccttctgcggggtatgggttgacacttgacaggttgaaaccagtgcctctatggacggctgctgtggccccttcagacaatgggcagtgcccaccccgcccactggcatctgcgtgtgagggctaggccgccctgccacacatcccgccccctcccggaggcagcttcaggacaggacaccaggctggctgctttttttagcctgcccctggcccaggcccagtccttggtgtcagggagcccccaggccgcaggtggagggtgataaaatatgttctctgacaggacccagccagccacataggtggaggttttccatgtccaaatgaggtcaagatgccgaaatcccagatctgacttcacacttcccttttctagaaccttttgtaaaagttggtggcagcagaggcagccccaggccgggctgcatctctctgtgtctgttgtgccttgcccggcgcctcacggatggcaaagctctcctcacccatgggactgtagtgcaattaaacccgcgtctaggtgatgcttttaaagttgtagcttcgtgctttgtacagttttctttctggttttaatttttagttgtgctttgagtcagtgcaataaactagactttttccaaacctggccgagtgtggtgcctgagctgtgagaagtgtcctcagccgacactcacgagggcagtgcaagggagaacctgccagcccagccccaccacagggagagtgcgtcagcagacctgtcctggcctggctggtgttgaaatacacaccggtttgcccaagtggctgttatgggggaatggccgctccagagctggctgtaccccatggtagcctctgaggaggacgctgtggggtgaggtccagggctgcctcctcatggagctgtgtgtgagcaggcgttggaggggttcgagcccctggttctgtatcttcagccagcaaacgaaaccatatcgcaaaccagagctgctggaaaccagcacacgcaaaagatgacgcccagcacagcagcaggacacaccatgtgccaggaaatgacctcagcaagaaacctcaggccgtgtgaagagcagcaaagctttccagaaggcataaaaggaaacttgaataaaggaagatatgttccacattcctggatggaggactacacacattatggaaagacctcattctttccaaaggaatttataggtgtagcttgatttcagttcaaatccccactgggattgttttgttggggcaggcagggaggaataatgttagtacccacaaatgcccatgactgtgcccaatgtgcttctcaccagagccctgcaaggggaagtctcattagccccttgagactcagagaggttaggtaacttgctcaaggtcacacagcactgggactggaagccagctctgtagaactgcagacctgtgctgtttgatgcctcctcactgtcccgtcactcctgggaagaagaaacgggtgagaactgctaagtgatgacaggtggagccccagcaggggccactctattgaatggcatggcccagaccctcggagggccaggcaacaggctagcaaggcccacagggagggagcagaatggagagggcatctcagatgcgcttaaggagcggcgggggcggggcatggggggtgtcacaactaatgtggccactgcttcattctctgggcaaaataatattaaatggattaaagaatctaaaaccagtgggaaaactgtctgatttctggatggcaaaggctttctaaactcaaaagtgataggacaagctacagaggaaaataagtacatagatttgatttctccaaaatacagaaatgctgctgggcacagtgatgtgcagttatagtcccagctacttgggaggccaaggcaggaggattacttgagcccaggagtttgaggctgcaatgaactatgatcacaccactgcactccagcctcggcgacagagcaagaccttgtttctcaaaaataaataaatagaaggaaataaatgtaaaaatgctgcaaattaaaaacctcaaagaagggaaataattgcaacaaatgggaattgatgttgaatatttaccttaaaaacctatacaacaataagaggagtgcgcccttcagcagcatgtatacaaaaattgcaacgatacagagattagcatggcccctgcacaaggatgactcgcaaattcataaagctttccataaatatatttattaaaaaccaataggaggagcacttcgagtcgagtgtaagggcccttcacaaaagcagaaggaacactggcccaaacccccagcaccccggaagcagaggtgagatgggagcagcttgggagccccccattggcgccgccctactggggaagccggtccgtacgtaggccttgcatctcgccacctccacttctgtcctcaagaacaagtcctaggtcaagggaaacagcacagcctgtttataattaggaaacacttaaaacagcctggcatttgggaacagccatgttaacgtgagcaaattcctctcatgaaatagcctgcagctattaagaagcacgtgtgtgcaggaagcggaggcgcaggacctcaccgcgccagcgtgaagttcccgggcatggtcatgaaagcgtggttctgtaagaaatcagagggagaaagggagagaagggggagggagacaacccaaacgttggagggtatttgttgtaaacttcaaacttttggcaggtttgaaatttttcataactccggggaggagcaagaggggtgaaaagaaacaagttctctacttgtgatcagcagctggtcatagtggttgcctggagtatatgcctttttgtatcctttgaatttccagccatgtaaatgtattatttattccaaaaataaagcagatttacattttaaaaattc

SEQ ID NO: 36576 - DNA, 17579 bp, Homo sapiens
tccccctgccaccccgttctcagtcctcagtccttgccctaggctggtagcccactccttgcccgccccccgccttcctcccatctccccctcctctccccggcccccagcaccttctgcatcccagcctacctagcctactcctcctcttcctggccctcttccccaggctccaggctggggggtgctcgcgtctcccctgtaggccagagcagccccaagttctgggggcggtggggctgctgctttatccccatggcgctgccatcacttctgctgttggtggcagccctggcaggtggggtgcgtcctcccggggcgcggaacctgacgctggcggtggtgctgccagaacacaacctgagctatgcctgggcctggccacgggtgggacccgctgtggcactagctgtggaggctctgggccgggcactgcccgtggacctgcggtttgtcagctccgaactggaaggcgcctgctctgagtacctggcaccgctgagcgctgtggacctcaagctgtaccatgaccccgacctgctgttaggtcccggttgcgtgtaccctgctgcctctgtggcccgctttgcctcccactggcgccttcccctgctgactgcgggtgctgtggcctctggtttttcggctaagaatgaccattatcgtaccctggttcgcactggcccctctgctcccaagctgggtgagtttgtggtgacactacacgggcacttcaattggactgcccgtgctgccttgctgtacctggatgctcgcacagatgaccggcctcactacttcaccatcgagggcgtctttgaggccctgcagggcagcaacctcagtgtgcagcaccaggtgtatgcccgagagccagggggccccgagcaggccacccacttcatccgggccaacgggcgcagtgagtgtggcctgggctattttagggtcatgggaggagggtcgctgtgtccctaaagctcagcactggggaactgtagatggagataggcattgagcagctgtatgtggtggttgggatcaagaagcacacgtggacagagcacctgtgagagggccaaggcttcatcatgggagcttgtgaacaccctaggcagatgcaaacaaggaagaagagagcatgaggggtgaagccttgtatcaaggtggaatgtgaaaatgaggggatattaagtttcgggagcaatgtttgtgccctagagtagtgaatgtgattgatagccactctgaaatgtgccctgtctgtgatcagagctaccacccagactgggcgccaagaccccttggtggtgtaaaaataatgagggctccatgaacggactcagggctcagcagatttgggaaagacagataaagctcatactgagaaatctgtgctgtctgtgcctttgagcccagggaagggcagggaagagtcagggagcaggccggttgggtggggagcagcaagggaggctctgggaaagggaggggcttgagagtgacagctcccttcctctggggtctggacaggctctgacttctgccagatggtccatatggccccagggtacttatggtggactccaagaggggtgggctggggagcatctgctttggggttgataggttagggcactctctttcttgctgaagagggacatcccagtgattcagagagggggctgtgtgggggacctggataccttctcagggtgctcctctgtcatgtacctgctcccagttgtgtatatctgcggccctctggagatgctgcatgagatcctgcttcaggcccagagggagaatctgaccaatggggattatgtcttcttttacctggatgtctttggggagagtctccgtgcaggccccacacgtgctacaggccggccctggcaggacaatcgcacccgggaacaggcccaggccctcagagaggcctttcaggtatcatttgagccaaatctgaaggaggagggggaagaggtgcttcgctggaaattctctctcacaagaccctaaagaaaccctaggaaccaggcaggaattgtgagccacaggagtaaaatgaacagaggcattctgagtctagtgtcaccctttcttacttctctacttttgtgactcttagtgtgcttgctgccaagactgactttggctgcctccaaaatcctaaaacactgactttcctaagtgccagtagtaggctatattgtgggggagaaaagttcaggaagagatctgatcctagcccttgggtgggcttccaccctttatggagaggtgaggcatcgttctggtacagtcagacaaagtttgagaaaggatatgattatgtgtcctggaacagacactaagaactttagtggctcagaggaggaagagtcagtgtgggctgtgtttagggaaggcttttacacaggaagtgagaccgtattgtgactttaatgatagatgtcatattcatagtcagagtgggagaggagatccaagcatcctgagcaaagagaaaaagataggaatgggcgtgtttgagagaccaagaagatactgacccgacaagaatgaggggttcacttaaaggagatacaggaaataaagttgcaaaggtagaatcagattaaggagagctctaagtcttaaggcactaggacttgaatttggggtccttgactttttgtgtgtgtgtgtgtgtgtgtggagataattatacagtagtgacagaattcaggattagaagagggggagacctggggcagtgagaccaactgtaacagattagaagggggtgaggtgatatagcttgaactagtgtgatgatagcaggaatggaaagaaacgcatttcagatttcagaaaatttgtggggaatgttggcatgactctgttcatttcactcctgctcaaaactttcagtgacttgtgttctagagaataaaatcctgactccttattgtgacatttaagaccttctgcagtctgttctcaaaccactttttcagtcttacctcctggtaccctcatgctgagaactgcagcctaccaggcctctgagttcccccaaccccagggccttcctgcccctgtgcctttatgttctttttccttttgtctggaatgctcttccttccctcatcccaaatatctgcctctcaaaatcatacccatgaatcttcccgattcccccgccacttttttactaaccgtgcatataagtgtttcccgtgtatttatccatatccctccttttttccaagaaggattggaggtggcttatgggataaccttaaagtcctttaaactctgggattatttggttcgaagtagctgtgtataagggctggacctgggtggccattcttctccaataaggttttatgtggctgtgattatatatttggttgcgactgacgagtgtgtgtctgactgagaatgacatagctgtttgcatgcctgagaatgagtctgtgactgtcacacttgaatatgggcagtggcagggcaggttttgtttatgccataatgttttcctaaaacaatcttctcacctttgtctgggtaatgcttccatattctttaagactcataccagttattttcctttctaggaaatgatcccagaatccctaagtgggactgaatttcctactcttttgcttaactccatctaccatagaactaaccatattattcagtctgtgtttgatttatttgaaggctgactcatttcattagtatttactgagcacctatcatgtccagtcactgtgctaggtactggtatacaagggagagcataacagactttgttcctgcctttttggagtttacatttggtaggatgggcaggcaataaataagtaagcaaataaatacaaatgtaggaacatattgtgatgtgttactaaaacataaagaggaaaggaatagagtgttatgaaaagagaagaacaaggggattgtacttcagctggtgtggactgcagaagatctgtgaccctctcagatgggagcactccataaccttcctggttatatcctttttctttttgagacagctctgttgcccaagttggagagcagtggtgtgatcacagctgctcactgcagtcttgacctcccaggctgaagcaatcctcccacttcagcctcccgagttgctgggactacaggcatatgacaccatgcccagataattttttattttttatagagatggggtcttatcatgttgcccaggctggtctcgaactcctgggctcaaatgatcttcttgccttggcctctcaaagtgctgggattacaggcatgagccactgcgccttgctggctgtattctatttgtggaagaaaagcctcactttcttctgtgagcattattgcccagccaagagtccccagcattaagggtagctagaggagggatctagtcatccaataatcagttatatcaattaactctcagttctccccctcactgtgggcattattcagacagagaaataaagagggaatctttgctgcaacacaagagaagggaactaggcaccaggaatatgctgatgggaaggtcaaggctttgggtaggtggggctgaggggtgataaggtgccccgccccccaccttccaatggggaagcaggggagagtctgagggaagttgggcagttagctacagccaagcaaggatgaaagagcacagagcctttctcccagagacactggccctctgaggtcccagaccaggccagcctggaaaaggtggcaatagaggaaaggaggccttgacacagatgcccacagcttttccaggagggtatcatgctcaaggaaaggccttagctcatgccgtatcgatactggctactagggagagagctctgaaatcaagtatgttgatatgatttttctctcccatttagccactagctgctccagggcagggatcatgctcatcttcatattccatatgtctagcatgtagtaggtgtttaacacatatttgctgaattgaattaggggtgtgttggggagagggggataggatgaggaattcacctagacaggagtagagctggcaagtaatgtaaactaggtgatcaaccaggatagggaagaaaagattgagtggaactaaataagcaatgaccaggctctgaggatccagaagcccaggctggtcaatggaggactacagggttagaaacccaggcagaggtcacaacctacatgaccagcatgagattgggttacacacagggagcaccagcggcaagaatggaagaaagcactaaaccaagggcttggagatcacttgtctcattaggccactgttgaccactctccagttggccagggcaagtctcagtgggcgggtccacagatagaggcaggtgcctcctgagggtgcacatttcctaggtgtgctcctggcacccacccaccactgcacccatttgtggcggactttgcttgttttttccacctggggtccactgtgaaatgggacacaattatcctccttcactttctctcaaacccctgagcaagcacagaaactgtttgaggttgggtttttttttttggtttggtttttcatttttgttttttggtactacaactacaactagtaaccacagcaaaaacagttctagcatagcagtttagggggaccatggggtcaaaactatttaaaaataatacaaagatcttatctgctttgtcacgcttgttcttttgtgattgtgtagggaagttttccagaggttacatggcatgatgatgtcatcacttggacagctatggaaggtgtgcttgtgtgttcttgcgttttcaaaatttatcagttttaatttctaagatggtcaatattgatagatatagtccacataaacaaactttatttggggtccttaataatttttaagagtataaagcgattgtgagaccaaaagtttgataactgctagcctaacaaactagccaaacttagtgttgagaattagtgtttaaaatgtgttaaaaacctatcatcagcctttattgaaatataaattgtgttgaacctgatcttttctcgcccttttcctgactttttacattgcttgtcaacaatattctacctctttattttattcttggaacaggtgctactgaatgaactatttcaaccctttcctcaattcccttctctttttaaaaaaattttacctgagactgggagaatgttagaagtgtgtaatcaggcagctaaatgctctagtaagaataatgatatcttgaggcaagctgcagtctaatataatataatgaatgcatattagaaatcgactttattatttcctatctctaatgaattgatacataataggccatatgtgatgtgtctagtgcagcgtatctctatggtccacatgtactttctatgacaagaataaacaaaactgggagaaatgaccggattttaaattatcatttcacaaagtcatgtttcataaaatatattgaactgaagtctttccttgaagttgtgatgccagtttcctgttggagcagaagttggtctcagtgactatgtggcctgaggcagggcctgagactgggaggtccagcagctcaggaaggggaaatgtgtgagactaatgggagccaagcaggcactttggtgagagacagagatgctgactcatgcgccagtgagatgtgtgcatgtctgagatcacatgtgtcatttgcttacctgtgaaatgtgtgtgggcatgtgactgtgtgtttgtccctgtgacacatctattactcagtaagcaggacagtgctgtttgtggtaggtgttccacacattaaatggatgagcacacagcttttcacaggtggaatcactgtctcaaagtatttccctcagttgtcatagggcctgaaatctctctaattcactgggcggagacactgtgttcaagtggccgaaatgacaatgttagtattttactgatgacattaacagtgattaacatctcagagaggagctgttagtgggtgttgtccttgatcataagcagatacccagaaagcatgggacagaggagccgtgtgagctgtggtggcctggcaggaacctggatgctggaagggagctctggaagatgttgggctgggctttggggatggggttgactattatttgccagtttccaccttcccagaaccagtcctatctacctttcaggaggagtgccactccctcttcccagatgtatgcaacacaacacacacacacacacacacacacacacgcacacacacacgcagagagagagaggttagtagccctttcaaagccttcagactcacctgtgtatattttatatcatgtatattttaccaagtttccctgtcctgcatcttctcttcccataatgcctatcttgaatcctgttcactcttccccatatgctgctggtacagactgtattggtgatcacgtaccgagaacccccaaatcctgagtatcaggaattccagaatcgtctgctgataagagcccgggaagactttggtgtggagctgggcccttccctggtaagtagatctctcccttcctgagagtcaggtcaagctttggggaagggcttctctcccaaactcagcatcaagtcttggctgtggagcaagcccaactttggggggtctccgcttctgtccaggatttttccttctgccctatggagtagttaggaagggatggcactttaggaataagagggaagaaagcaaaccagaagagagaataggtagaagggagaccccagagagaggggaaggggccttgcaggacatttggagagtactgctgaagttgccacccccagatgaacctcatcgctggctgcttctatgatgggatcctgctatatgctgaagtcctgaatgagacaatacaggaaggaggcacccgggaggatggacttcgaattgtggaaaagatgcagggacgaagatatcacggtaatgaagaggggtcaatgggggtctgagggctgatgtcaggaatagagtgggctgaagaagaaacagatgtcaggatcaccacagctttagtgggggttagtgaatatggcagagttgcccacacctcaagatcggggaagggtagactctgagggagccgtaggcatgagtgagtgggagaggagcccagggtagacctcaaagaaaggacactcttttctgtcttaggtgtaactgggctggttgtcatggacaagaacaatgaccgagagactgactttgtcctctgggccatgggagacctggattctggggactttcaggtgatggaggaggaggcagggaagagagtgtggccctgcaaaatccagctttcaagggttcagtcggggcagaaccaaaactactagatgagggatttgttttctctgctggcactgcatcctggctgggtggtaggctggggagaaaagcagcgaaacagctggggtctggggaggaggctggtgggagcaggcctgtgggcccagctttttgcttccttacagcctgcagcccactactcgggagctgagaagcagatttggtggacgggacggcctattccctgggtgaagggggctcctccctcggacaatcccccctgtgcctttgacttggacgacccatcctgtgataaaagtgggtgtgtgcagggactgggagcagctttcctccctttgctttccattcatggcctccaccctcactgaccctccactcttaactgtgcttctgcctttacgtctgcatccctccctcctcatttcttcctactcccaaggagtctgtctatgcacctatgcaccccgttctccattctgccaagtccgcacacagtcttcctcagggtctctatttccccttcagctccactttcaaccctggcaattgtggctctgggcacaggaatcaccttcatcatgtttggtgtttccagcttcctaattttccggtgagttctgggtttcttgctgacctactccctgcccccattgccacacaacctctggctgaagccaggtggtccctataatgtgggatagggtagtaggtttcttaatttgctggttgtctcttagatccaacagcgtcttcctctctagcctttctctttagttgtcgcttagcctaggtgtttgttccacttttggtcctagactggatatactaactagtgtttttcagtggggttaagatcaaaggtgaattttccattggtcttcttttaggaaagaactttcacccccagtctctgtgtttgttagtgagcatagggcatgtgccagatatgccgagaatgcagccttatcttccagccctgtctctcaggtgtaacagttgcagcttcaggagctgcagggaagcccctgcaaccctgctgttggcttgggggtggcaggattcggcttgccagtcaactgaggtgtgcagtccttacagaaagctgatgctggagaaggagctggctagcatgttgtggcgtattcgctgggaagaactgcagtttggcaactcagagcgttatcacaaaggtgcaggcagtcgcctcacactgtcgctggtgagcccttgtctcagctgttcctctgcctccctctgagttcctgtcccttcttaccctggatctctcccagcacattggcttgtaatgatagcccctgcactaccaccatcatctaatgttcctttcatccttccgcctccatgttgcccttggccccagcggggatccagttacggctcgctcatgacagcccatgggaaataccagatctttgccaacaccggtcacttcaaggtgaacagtcatttgcttgttctggtccccaccatttcatcctgtctcatccccatctgccacctctgcccctgaacctctgtccctcatacccgactctctgtgcccagctgagctcctgggtgcttccactgctctctagcatttccttgtacccagaacttctgatattcactttcctttcccctttcactcccaccatcagggaaatgttgtcgccatcaaacatgtgaataagaagcgcattgagctgacccggcaggttctgtttgaactcaaacatgtatgtaacagaggatggactctaacatgtatgtaatggaggagtggggaaaactatgaaatagtaaaattggctagatgggcaaggggttgatttataaatgattttaaaatcgtagatacaactaagagaaaggtcctcttatgtagtggtaagtttctgtatctaatttttaactctttcaattttcttatccttcccattgtttttttctgccagatgagagatgttcagttcaaccatctcactcgcttcattggcgcctgcatagaccctcccaacatttgcattgtcactgaatactgtcctcgtgggagtttacaggtgagggataggtgtaggagattatggcaggggtgggaaggatagacccaaagttatactgactctatgctgggtgatagctggtgggaccaggacagacagtctattccatgtcacttaccaggatattctagaaaatgacagcatcaacttggactggatgtttcgttattcactcattaatgaccttgttaaggtgagtcttccccactccttaaaagttcatccactttaaatcacttccactgttctttgattgtggtttttctccttctagtcctctgaagtcctgttctctcatctccccttattcccatggtctggtaataatgggtaaacaaggagtctggggcttataactgggacagtgagttttacctgccacaaggagtcctgtgcctgtagagagtttctatctttctgtcttaaatatctcaggtctctttccatcatctcttttacctctaagaactcataaaatgagtggagtctctgaacatatttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaatttttttgtatttttagtagagacggggtttcaccgttttagccgggatggtctcgatctcttgacctcgtgatccgcccgcctcggcctcccaaagtgctgggattacaggcgtgagccaccgcgcccggcctgaacatatttatctcttgtttttcctctcattattttactctccgaacatatttatctcctgtttttcctctcattattttactctctgaccaatatttggcatgtctgcccttttgttcagaaaactgaaatttaaaaaaggaacatttactagtagaactaagagaaaccaaggaagattgtactaaaaacctttggtactcttctgttatactaggttttagctatgttcaaatgactcagaggcccatggatttgtggagcataaaatagaatcttgcatgagttggacaggttttctgaaataagtctcatagccaatgagcatcccagtggatcaccccacactgtatctgaaactagctttggttttctgctgaattctcatgaagttatttaaaaagtatttttttgtgtgtgaaaatttgctatcaaatgagagataaaaatattagtaaagccaatgtcatgctcaactagaggtgtgatgataaacataagacacgactcttgagagaacagtgatttggtggaaaagtgatttacaacaaagccagaagcctaatcctgtgattgttgaaggcatcctttgcacagtttccacacaagtaaattcacaacttcagagattcccaaaagttttgttgataccaaaataaataaaaaggaagaattcatagagattagagttatgaattaagtccagagctaaacatttagacagaaatgttttttgttagcatattgaaccttgtatcctctttctgtctcacctgaactgacttgggtggctcctagggtttcatttttggggagcatcattaagacttttttttttttttttctgagacagggtcttattctgtcacccaggctagagtgtagtggctaggtcactgctcactgcagcttcgacctcctgggctcaagtgattctcccatcttagcctcctgagtagctgggaccacagcgtgtgctgcagtgcccggctcatttttatatttttggtagaggtggggtttcgccatgttgctgaggctggtcttgaactgctgggctcaagcaatctgccagccttggcctcccaaagtgctgggattacaggcatgagccactgagcccggcctttaagactgtctttcagctcctcggaggcaaaggtttttccctctctggacccacagagccagcagttttaggcttctgcactggcttagcagattttgtccattttccaggtttatgatgttctgcactttctctctgatccagcattccctctagtagatcttgttcctcctctaccccgacttgcccacctccctctagtagatcttattcctcctctaccccgacctgcccacctccctctagtagatcttgttcttcctctaccccgacctgcccacctccctctagtagatcttgttcctcctctaccccgacctgcccacctccctctagtagatcttgttcctcctctaccccgacctgcccacctccctctagtagatcttgttcctcctctaccccgacctgcccacctccctctagtagatcttgttcctcctctaccccgacctgcccacctccctctagtagatcttgttcctcctctaccccgacttgcccacctacgcctggttatgcattaaagtttacaactggtcttccttggtatatccagctactcttgatacctgggtctcaagtcatgtcttcctaattagtagccaggtatctgaggccaccatgggtgttatatcattttggtcttcacccaagttctgttctcttcactaatcaagaagattgactgccctctccagggtagtcatttgtagctccacttatccctctttttaagcattttccctgtccctggtggctgggtgcctgtgtcctgcttatgataccaggaacagatgactcttctgttcttcctgcttccttgggtggaaactgcaaaggatgccttccaaaatcagcttattatttttgtggacccaagatctgtagacagctagccagtgcccatctcatggagagagggtattctaagccagatatgatccaatcccatgacttgatctgtaccctgcagggcatggcctttctccacaacagcattatttcatcgcatgggagtctcaagtcctccaactgtgtggtggatagtcgttttgtgctcaaaatcacagactatggcctggccagcttccgatcaactgctgaacctgatgacagccatgccctctatgccagtgaggcccacccccacaacccactttttatattgctcctctttccacctagggatggtgggagagggaggtggagtgacagtaatatagggatgagcccaggtgggcttgggggtgccccatttcgggggacctggccagccggtttcctcttttcagagaagctgtggactgccccagaactgctcagtgggaaccccttgccaaccacaggcatgcagaaggctgacgtctatagctttgggatcatcctgcaggagatagcacttcgcagtggtcctttctacttggagggcctggacctcagccccaaaggtaagagtcaatccactacccacagcctcttcttcctgggggaactctgttcttcatccaaacctttgatcaccctcagagattgtccagaaggtacgaaatggtcagcggccatatttccggccaagcattgaccggacccaactgaatgaagagctagttttgctgatggagcgatgttgggctcaggacccagctgagcggccagactttggacagattaagggcttcattcggcgctttaacaagtgagagggcattatggggcaggggcttcccagggatagaagactcattagtcctagtgcatgaagtggggcaggtgggaccagagggtgggttggataggaagtcctgggaatcttcagaatcttagagcaagtgccttatcctggcctccctctagggagggtggcaccagcatattggacaacctcctgctgcgcatggaacagtatgccaataacttggagaagctggtggaggaacgcacacaggcctatctggaggaaaaacgcaaggctgaagctctgctctaccaaatcctaccccagtgagactttgtcccccttcctgtattttcttttgggattctgctctgttgggctctgcctcatcaggcacctgagaactcgcctccccaccctcagaaccctgctggccacagggagcacccctgcttatagattatttgctgtcattctgtctccacatcagctatgctgccttcttactggctgcccatcccttcttcttaagaccctgctctaccacacccttgcttcagcaagtgtatgtaaaacagtcccaacttgagacagctcccatgcacagggattcccctcaaacccccccgccacttgtgtgccttaccttgcattagactgtaatgtcttcccagccactttcctccctcccacctgaaaagcctagctttcttgttacagctcatctctgctgcagccacatacactttccctctctcttccactcctgctctcttggagtttggctcatacggcacccttgcttcctagttcagtggcagagcagttaaaacggggagagactgtacaggctgaggcctttgacagtgttaccatctacttcagtgacattgttggcttcacagcattgtcagcagagagcacccccatgcaggtgagagccatgggtgagaggtggcgggtggggttgggtgggtagggacctggggaagcctcattgataataggaaagatgagtttgttctagagttcccacatcttttgatggcttgtgggttaagaattcttagaaaattgggcacaagtctcagggcctctgcttttctatcccttttaggtagtgacacttcttaatgacctgtatacctgctttgatgccataattgacaactttgatgtctacaaggtgagagctggggccgctgttcaatagaagaccctttaatagagacccgctttgaaactcagtctccctgaaccccacacaccttacccaccccatgatcagttttccctccagggtactcagcatcctggtgctggagtgtacttcgtagacagatgtagctccagcactataattgtacactccagtcgaatttcttgtgaatcctttgacttccctaatcagaaccatcatgagatttagctcctatcttcctggagtataaatacagcctatccaacatttctctccagtcctctccagacatggaagaatcatataggatgtgggtccagactgatttagtggggtgagggaaaatatattttaaaaagtaaaactttttgttgaagttattgagttggatttattgtccttgggagtaaaaatcatctggatttgaatattggcttgttgctaactgtgtggccttaggtaagtcacagaatctccctgagcctcagttgttttatctgtaagatgggaataatagattcgttgtatggaaagtacctaacattgtttggcatgtggcagactactatttagggataactactttatccctaaatacttagtgtgtatttcctaaaaacttcactgtgtatttccttaaaacaatggcatttattctcttacatagctttggcacaattaccaaaatcaaatgcctgctttcctcctctctgacagtttgggctgtcaggtccatttcactgggcctgctttacctcctcaccagcctctgtcctcttgagttaccgttttcttgcttcccatttcctgatggcagagcctatttgtccatgtcctgctgcagacagggtgttcattcattccgcaaatgtttactgagtattcaccaggtgctgggtggagaaagaagacttaaagattccctagacatctcctctcccctagactcaggaccatggcacttattttctagtcaatattctggtctccagcatgtcaggatgattaatgatggtgtcaagcttgtctccctctactttttcccatccccatggatataaatagaggtgaccttttaatccccctctcaatcaggtggagacgattggggatgcttacatggtggtatctggcctcccaggccgaaatggtcaacgccatgcaccagaaattgctcgtatggccctagcattactagatgcagtttcttcctttcgcatccgccaccgaccccatgaccagctgaggctacgcataggggtccatactggtaaggctgactctcactccagccctagtctccacctttcccagactctcccaacctgtttcttctcaaagggccagtctgtgctggggttgttggcctgaagatgccccgttattgtctttttggagacacagtgaacactgcttctcgaatggagtctaatggtcaaggtaagacattagccctcaaccccactgttggcctcaatttatcttgcccttttcttcttttcataatccctccaatttcttaatctgagagaccacagttccttagtgtcgcatcctcgggcatattttggttctaatagatatgcattgggaggttgggcatattttggtcctaatagatatgcattgggagcttcccagggatggttggtcgggcacggtgctatacagtatcaccaattatttgattgccttttctttgattcctcattccaccatcctccccattccacccaccccagcgctgaagatccatgtctcctctaccaccaaggatgccctagatgagctaggatgcttccagctagagcttcggggggatgtggaaatgaaggtgatggcaggccatggggaggggggcatggaaagggagggtgaaagtgattatgggaatcatagggaaagagagggagacaaagggactaacatcgaagcatctgaatcatgtccactctcccacttccagggaaaaggaaagatgcgaacatactggctcttaggagagcggaaaggacctcctggactcctgtaaacccccattctttccaagtcagatagtcttctgctgctggtacctgggtgggcaatggccaccatgtctgcacacaccagaaatggacattttcatatgcaatggaaaacagccacaaaaaaacctaccttatatggaagttgtagccctctgcagctcagccctgtacatatacctgtccctctctggcttggtccccttcctccctactttctgtaaatatctgtatctaaaccagaatattttggtcaaatataaaacaataataaaaaaagttctgatgtcat

SEQ ID NO: 36577 - DNA, 68883 bp, Homo sapiens
agtcggcggcggctgctgctgcctgtggcccgggcggctgggagaagcggagtgttggtgagtgacgcggcggaggtgtagtttgacgcggtgtgttacgtgggggagagaataaaactccagcgagatccgggccgtgaacgaaagcagtgacggaggagcttgtaccaccggtaagaggagcaggaggaggaggcaggagccagagagagccggggggacggaggggggacggggaggcgccggacacccgcgcttggggccttcccctcgcaggaggggccgcggtaaagatggagcctccgcccgagccccacaacatcgccgccgctcgcagcgaacaaagaataatggcggcggactggagccagcggcggccggggcggcagcgactctgcctgcagccagcggcggcgctcatggcggggggcggcgggcggcgggcggcgggcggggtgggagccggcggccgggggtgtgtgcgggcggccggccgcggcgagctggcgcccgcgttcccgccgccgccgccgggccgggcgcggagccgggaacccggagccgccccgggggaggccgcccgctcggcccggcgctgccccccgcgccgctcgctcgtccggcccccgccgcccgcctcgcccccggcccgacccggccgggcctccggggcagccgccgcctaggtgccggtgggggatggaggaggaagaaggcgacagttgagggcagaggaggtgaaggtgcctgctgccttcccggtggcttcggtgcctgccatgcccgcttcgcaaggggaagagctgcaacgtctgacctactcttctctccactctttgtgcaataaagttcgaaacccaaggtttcctctcgtgctgtattttattcgtgccctttcccccccgctcctacaccgttgaggaaatgctgctttctgccctgtgttgcttagttgagagatgagagcttgtgcttttggggggaatttttgactccctcacccctttgctttttttttttttttaaagtcagtcatggaaatgcatgctttttgggagaaagggtgctaagaaaaacatttataataactttttaaactgttgggatcttataaaagggaagctggtgtttgaaaacagtttcggttttaaccctttttaataaggtaatcatcacttgagatctatcattctgaaacacttcgttggaacgagtatcagccgatgtactcttgttttacatcatttcgcggggtgcaaccttgccaaccgcgtttgggtcatctggatctcccctcaccctccgtcccactccccctaccatatttcccacgaatttctgtgtgaactttaatgagagattgatttaatactactactaaaaatagacattaaagtatccattatttgtctcatgcagtaggtaacccccgtcttgagattgacaatttaagccacaagctgtattttttcttcgcctgttgggaaaagaggacagcagaaaagtcattgacacattaaaaattaaaagacagtttttgaaggacgtgcggtatgacctatttaagtttgtaataccatctcaagttataattctaacctcagctggcgtctaacttctgaaggtttagtagaagatacttttgattgctgcctattgaaatcttttacatttatggctcatttcgtgatttaaaagtaaagccccgaacagttattttaggtggtgcaaaagacgaacaagtttgttttaaaaatacttgtctgtcactgtatgattgcattgtgattgatacgtacaaaccttctggttaagaacaaatattgattggcagcagaagcactgtcttatttttctgtattctagtcacttttccaaaacgtgctttgctgtattgcttctctttaaaagaccacattggcaatttgtcatttccaagaaaattaagaagaggcaataaaggcaggttttctataaagattggggaaatgattttatttccgagcactgaaaaaattatagtattgataatggtagcttaccatttttcctttatgttgttccgcaagccactatcagtagagtagaattttttttcttgttaagaatataagtcgggcgcggtggctgaggcctgtaatcccagcacttggggggtcgaggcgggcggatcacttgaggtcaggagtgcaagaccagcctggccaacatgatgaaaccccatctctactaaaaatacaaaaattagccgggtgtggtggcacgcgcctgtaatcccagctactcggggggctggggttgcagtgaattgagatcgtgccatgcacttcagcctgggcgacacagcaagactccgtctcaaagaaaaaaaaaaaaaagaaagaatatatgactcttcatttgtgagatttttaaaaaattgttcactgatggccgagtgcggtggctcacatctgtaatcccagcactttgggaagccgaggcaggcggctcacgaggtcaagagatcgagaccatcctggctaacatggtgaaaccccgtctctactaaaaatacaaaaattagctgggtgtcgtggcgcgtgcttgtaatcccagctactagggtagctgaggcaggagaatctcttgagcccaggaggtggagattgcagtgagccgagatcgcgccactgccctccagcctggtgacagcgagaccccatctcaaaaaaaaaaaagtttactgataagttctttctttagtcttgcccgagagatattttaaattgtattttttatttttatttttatttatttgtttttttgagacggagtttggcccttattgcccaggctggagtgcagtgggctggtctcggctcactcactgcaagctccgcctcccgggttcaagcaattctcctgccccagccccccgagtagctgggattacaggtgtgagccaccgcgcccggcctgttttattatttatacattcataatttgtgattcttagcaattccaggtgaaacttcaaacttgtattcattaatacttgaacattcacctggaacatgttactaaattgtacttctgcactgttccagccatggataaaaattacagctggatctgcttgaatctttttttttttttcatgaacacctacatttagaaagctaataaattacttgacagagtttgcttgaagaatgttaaaagaacacttctttgggaatttaaaacttaagtgttacctgttttgaatgattttttttttgtttacataaagagcctgaagaaacttagacacctgatccataaaaatggcacctttttctactttctgaaactcatattcttgattaggtctcattattagaaattttgggttcttcatagagaagtagctttatttctctctcattctaagacatttggttttgtttgtttggatacagtatggttatggggttatagtaaaaccaagtatgtcttcctcacgtgtttttaaattctactttttataacagaaaattatttttaacctaatgcttacaatatattaccgaaatttataatttcatttattccataaatagcttatcagatatgagttacataaacttgtttacagccagcttgtgacatagttttgcaaatatcttgatatatggtgtaactttgatggcttctttattgaatagagctcaaatctaaatttaagaatgtaatgagatgtcaagatggaaaaatgcaggatttttttttttcttacccatgtgtaaactcatctgtactgcagtatcacttgagacagcagtttatggtaattcaaatatttatttggcactcactgtgacagagaatgtagttgaaagagcatgaggtttggaatcataggcctaggtctgaatccaagcattgccactgctatcctgtacccaccctaaaggaattttgtgtcctgaaggaagtttcttaatctttctcagcctcagtttccttatatgtaaaattagaatactactacttatttcataagattgcgagataaacataaagtaccttagggctacaactaatgatagctagtcccttaagctttattttaacttcctacctgtgggcccttaggcaagttatcttaacttcttaatacctcactttcctttctgatcagtgtagaacaactacctcagaattgtgggggttaactataaagtaatacatactaagtcccaggcattgtgcaagtgtcaagtgctcaagtgttgacaaggcttttttcttttgttttaatttttttttgagacggagtcttgctctgttgcccaggatggtgtgcagtgatgcagtctcagctcacggcaacctctgcttcctggattcaagtgattctcctgcctcagcctccctagtagctggaactacaggcatgcaccaccacgcccggctaatttttgtgtttttagtagagacagggtttcaccatgttggtcaggctggtcttgaatgcctgggattataggcgtgagccaccacgcccagctggtctgttactttttaaattatttattattactatatgtaatacagtgggtcagaagctacaacaaatccaaagatgaattacgctgtcttatctctaccctcaggaactgttggggacacagtgactaaggcaaaatatgtgtcaaaagaaagcagtcaaaggaaaaagggatcacctttggtgaagtgaggagtatattttttatatttctaatttggttttttgaataagtaattcattcacatgatctataattcaaaacataataacagcaaaatgccctacattctcttgccctattacctaagtgttagcaattttttatttgtcctttaagaggtgttttatgcaaacacgagcaaatatgtatgtacagtctccccctttttgtacaaatggtagcatactaggtatacgctctcctatatcatgctttacccccaccacttaatatggcttagcaattttgtatcagcacataaagagcttcttcattttttaacatacaattggaagcattttattatgtaagtagactgtattaaccagttagtgagctgcttttattcttaggtcttatattaccttttaaactaagggaaactgccatcttgcctttatttctttaaatgaaaaactttctatttgaatgaaaaataaatagtttgtgacaggaaattgttatttaaagtccctcatttcctgtttaactccagtttttaaaagttttagtaaaatgatcaaaatgtacatgaggaggcaagcaagccaggttaagagttaactcacaaggtgaatttaactcttttgttgaggttcttacagttctgaacagactacttctttcaattattattttggcccaaaaggtttttatagctttctttcttaatgagaaagaacatttcatatagtccggtgtttttttgggttttttttaacagacagctcatgggatattattacccagtaaggctgattactatactagatttctccctgcattcatttattttttacatacttgttaacttaccttgacgattttctagtatttcttaatgtaattatgtgagttttatattttgtacctaaatttaaaaatagtgagattcacctatatgattgctgagatgataaactttactgcatagatgatttttttacccccgtggggaaacctttggtcaaccagttggaccaagtaatacgtatttcagccaaagcacaaaatgcgtttcactaccttttttttttcctctagcttttcgaaacagcattgagctacaatacttttttatttatttatttatttatttatttttatttatttatttttttgaggcaaggtttggctctatcacccaggctggagtgcagtggcacacacttggctcactgcaacctctgtttcctggctcaagccatcctcccatttcagcttcctgagtgagtgggacaacaggcgcgcaccaccaggcccggctaattttttgtagagacagagtttcgccatgttgcccaggctggtctcaaactcatgagctcaagccatccacctgcctcagcctcccaaagagttgggattacaagcgtgagccaccatgcccgaatgctgtagtacattttaaatatacatgctgtttgtatttatctttaaaatgtacacactatgacttttttgagttgattaaactcagaaagtgattaataatatagcagcaagggcacaaatctctttccagaaaacatcattaagtaaagctgtcatgggccagtcgcggtggctgacgcctgtgtgatcccagcactttgggaggctgaggtaggtggatcacctgaggtcaggagttcgagaccagcctggccaacatggtgaaaccccgtctctactaaaaatacaaaaattagctgggcatgggggcaggcgcctgcaatcccagctactcaggaggctgaggcaggataatcacttggacctggaaggcagaggttgcagtgagctgagattgcaccattgcacgccaggctgggcgacaagagcgaaactctgtcttaagaaaaaaacaaaagctgtcatggtatatttcgttttttgtattcccaagttggtgtttatgcgttgatcatatatacaaagtttttaatgtaagaatattgttttgaggttttactaatatttgatttaaaatattactatgtgctatttggccaggcgtggtggctcacgtctgtaatcccggcactttgggaggtcgaggcgggcggatcacttgaggccaggagtttgagaccagcctggccaagatggtgaaaccccatctctactaaaaatagaagaattatctgggtatagttgtatacgcctgtagtcccagctgcttgggaggctgaggcaggagaattgcttgagccctggaagtggaggttgcagtgagccagtatcaccccactgaactccactctgggtgacagagcaagatgccatctcataaataaaatattactgtgtgctatttgtacctgctaaatgattaaaatgtttacaaagtgctttgttgttgttgttgttgttgagacggagtctttctctgttgccaggctggagtgcagtggtgcgatctcagctcactgcaacctccgcctcctgggttaaagcgattcccctgcctcagcctcccaagtagctgggattacaggcgcctgccaccatgcccagctaaagagacagggtttcaccatgttggccaggatggtctcgatctccttgacctcgtgatccacccacctctgcctcccaaagtggtgggattacaggcgtgagccactgcgcctggcctacaaagtgcttgtctttacatatttggggatgggggtggggtagatcattgaaatctgtaaaggcagaacgttttttatctggaacatatctgtagactaacagagttaaatgatttcccacagtgtcatggaatcatcagtggattgcctcttggggtggaggcaaagatcattaaagcagcaaactgataatgtgaacgtggttgttttttctctgccaattaaatatatgctagtttagtcattatagaagagccagatgctggtcagcttgttgaagttgtaagtagaaggtgtggttttatcacatctgtaaatgtaggtttttgagacaaaacttaaataagaatagacgttagtttttattcacattcagaatgtctgactccccttaatatatacacactcttgtcttatctactgggtttttttgttgttgttttttgttttgccttttctctctctctttttaagctctgccagacaaggccctatgaagataggttttacaggttgagaatcttttatctgaaattcttgggaccagaagtatttccagttttgggttttttcagattttagaatatttgcatatacatacataatgagctatcttggggatgggacccaagtctaaacatgaaatttgtttcatatacacattatacacatagcctgaaggtaattttatacaaaatttttaataattttgtgcatgaaacagttttgactgtgaactgttacatgaggtcaggtgtgggaatttttcatggcatcatgtcagtgctcaaaaagtttgagattttggatgttttattagggatgcttaccctgtattatattttgcccagatgtttcctcatttgtcttctaggctaccagaaagatgttagcttagaaaaacgtattctggcgtttattccaacagatgagaaggcagtttctccagtgatgaataattacctataatttaatacgtgcattatacatctccagtgatgaaaaatcactgtgtattaaaaaattcttgaagctaggtacataatctcaactcctaaaaaagaaaataaacagtagtactccttgatgaacttacagatgctaagttgccttttcttagagttgaaataaggtgataaaggagtttaccgtgagactagctgtgtgaacaaagatgaaaaacaccctttcagttttcttcctcttggatgattctaggatctctaaaaaataatcttaaaaggggcgaggttttgagaggatgaggtctaaggaattgatggtgagttttttctgaaagaagagaagtgacatttgattagataagaaagggttaaaagggaagttattaataaaatagtttaggagtagagtggatctgaaagttgacttataccaatgatgatagaatgtgtcttttcccaaaggttagtgcatcttctctgaaatgaagacgtttctttcatcaattttaagtgaatttctaaggatctggttatctacttgtgagtttttggttgtaactgtatgacagtacagatgtaactaaaaatgtttgtaatttacccaaggttaaataaccattatttttgagggctgttatccctgttggtataagtaagtagttggcagtaggggacacagaaataccttgtttttcaccactgaagtgaaaattacagattattctgaattatttgtactctttttttttttttttgagaggaatctcgctctgtctcccagcctggaatgcagtggtgtgatctcggctcactgcaacctccgcctcctgggttccagcgattctgctgccccagcctcccaagtagctgggattacaagcatgtgccaccatacctggctaattttttttttttttttttgtatttttagtagagacaggatttcaccatgttggccaagctggtctcgaactcctgaccttatgtgatctgcctgcctcagcctccgattacaggcatgaaccaccgcccccagccctatttgtactcttaaaggggagtcattttcttataataagtatcagtagtagctctattgtttgctgtgatcaatggtgacaccttgactttatgtattgccatttatcaatcatttattcagtgaagatttattgaccattgactttattatggttggtgaaataatcgcaagaaaatttattcagttaggtatttataaaaatacctaggtattaaatgaagattgttctagttgatataagcaataaagcctgactatatggctcctaccctcaagaatcttacggtatagtagggatgatgaaatagtgtaagaatgatttatatgtgccagagtacatgacagagtttttactgtcttgaagagctacagagttcagaagagaaggggcttagtgaggaaaagttttgtgggagaagtagaattcaagttgaatactaaagaacttcagtaagtacagataaaatggagtgtattctaggcagtggaatggacaaaaaaatgaaaacatggacatataatgaacttgacatactcataaattggtgaagaaagtattagattatagatctacattttgaggaatgctgagtatgaggcagggagctttgagtttcatgtaagagaaggtaagatataaacaggaatacaatgataaattgggctgaaatgtagatttcctgactcccaattcttctccttagtgtagacagagatatacagtcatgcactgtataagaacgttttggtgaatgacagattgcatatacaacagtggtcctgtgctagtgtaagcaaacctattaagaacttcagataggtccttcaggaggtattccagaagaaggcattgttaccataggagatgacagctccatgcatgtgattgccccttgaagacattccagtgggacacgttgtggaggtggaaggctgtgatgttgacaatcttgaccctgtgtaggcctaggctaacgtgtgaatgtctttttaacaaaaaattttaaaaagtggccgggaatggtggctcacgcctgtaatcctagcacttggggaggctgagtcaggcgggttgcttgagcccaggagtttcaagcagcctgggcaaaatggcgaaatcctgtctctacagagaatacaaaaattaattaactgggcttggtggtgcatgcctgtaatccctgctactcacgaggccaaggcaggagaacccaagaggcagagattgcagtgagctgatactgtgccactgcactccagcctgggtgacatagtgagaccctgtgtcaaaaaaataaagtttaacaaaaaagtttaaaaagtaaaaaaaaaaaaaaaaaaaaaaaaaaaaggaaaaaaccttagattcttttattgctttactttattactaaatttgctttcacttaaaaaccctttagagaaaaaatatttttatacagctgtacaatttatttgtgttttaagctatgtgttattacaaaagagttgacaagttaaaaaaactaaaaagcatatgaagttacagtaagctacggttaatgtattactgatgaaagaaaattttgtttatataaatttagtgtagcctggatgggcacagtggctcacacctgtaatcccagcactttgggaggccaaggcaggtggattacctgaggttagaagttcgagaccagcctggccaacatggtgaaaccctgttcctactaaaagtgcaaaaattagccaggtgtggtggcaggcgcccgtaatcccagctactcaggaggctgaggcaggagaatagcttgaacccacaggtggagcatgcagtgagccgagatcgtgccactgcactccagcctgggtgacaagagcaagactccatctcaaaaaaaaaaaaattagcctaagtatacagtgcctttgaagtctacaatagtgtacagtaatgttgtaggccttcacatttctcacactgattcacccagaccaacttctagtcctgcaagctccgtttgtgataagcaccctgtacagatgtaccattttttatcttttatattttatatcttttatttttactgtaccttttctatgtttggatatgtttcgataacaaatacttaccgttgtgttacatttccccacagtgttcagtacaataccatgctgtatgggtttgtagcctatactatgtagccttggtacatagtaggctataccatctaggttttgttttctaacctaattaactaatgatgcatttctcagaacatattaccatcaagtgacacatgactgtatatgtattacagttaaaaattggacatcatagattcttttttaaacagctttattgaaatataattcacatactctacaatacacccatttggtgtgtacagttcagtggttttcagtatattcacaaagttgtgcatctattaccaccatcagtttaggacattttcattatccctaaaagaaatctacacatctcctctcagccatcacctcttaatctccccatacctgcagccctaggcaaccacctatcacctttgtgtctctataggtttgcttattctgggacattgtgtataagtggaatcatatagcataatgtccattgtgatgagctgcctttagcataatgttttcaaggtttattcatgttgtagtatgtatcagtattcatttttattgccataatagtccattttatggatatagaacattttatttgtgagttcacggacattggactttttgattattatgaaaatgctgccataaacattcatttatgttgacttgccttcatttctctgagtatatactcaggaatggaattttatggtaactgtgtttaaccatttaaggaactgccgggctgttttccaatctgctgcaccaccagcagtgtattagggttcaaattttcccccatcttcactaacacttgttatcatctgttttttggggttttgggtttttgtttttgtttttttgtttatttcaattatagccattctactgagtgcaaagaggtagctcagtttggttttgatttgtatttccctcacgactaatgatatcaagctgcttttcatgtgctgatttggccatttgtatatcttctttgggaaaatttctgttcagatcttttgcacattttaaaattcggttggctttttgttgtaatagttgtttattattctagatacaaatctcttgtcagatacatgatttacaaaaattttctcctgtgggttgtcttcactttcttgatggtgtctcttgaagcacaaaagtttttaatttttatgatttccggttcatctaatttttcttttcttgtttgtgttttggtgttatattgtgtatatcataaattcttgtttattataaacatttaaaaaatatctctgatctctgtgaaggcccaggcaaacaagataccattatttaatgaaaaataactgaagctactaatgtgtatttggagttataatccacctacctcaggccttccctttattctgtgtccatatccttcagtttgtagtgacagatgaaagaagcaaagatgaaaatcgagaaataattttgagtgaaacattttaatttgaagcacagttgtcccttggtatcgatggggaattggttccaggaccccttcaggtaccaaatccacggatgcttgagtcccttatataaagtggtatagtatttgcatgtaatcgacaaatatcctcccatatactttaaatcatctctagattacttataataccttatacagtgcctgcccatcacttgactcttatgggttcagcataggagtcagcatgcagcaaattcaagctttacttctgggacttggggatttttttcccccaaatatctttgatctgcagttggttgaatccacagatgctgaatctttggatacagaggcccagttgtaactatgatccaagaatttgttatttattatgagagaatttattataatgactgcgatggtagtttataacttataaactctaccatatttgggaaattcacagttacaaacatttacctatgaagggggagtgagtagtcattccttcattttttacaaataagctgagtcgtggagaatttaagtgatgtgtgtagaaactcacagtaagtaaggcgtagtcttcatcactcttgtagtactgcattatctctttgtaaagttttcagggtttctgttttattaatggttattaattttatttatttatttatttatttatttttgagatggagtctgtcaccaggctgaagtgcagtggtgctatcttggctcactgcagcctctgcctcctgggttcaagtgattctcctgcctcagcctaccgagtaactgggactacaggtgcatgccaccacacccagctaatttttttgtatttttagtagagacagggtttcaccatgttggtcaggatggtatcgatttcttgaccttgtgatctgcccacctcagcctcccagagtgctggggattacaggcgtgagccacggcgcccagccaaaatttgtttttttgtttgtttgtttgttttttgagacgaggtctcgctgtgttgtgcaggctggagtgcagtggcaccatctcagctcactgcaagctctgcctcctgggttcatgccattctcctgcttcagcctcctgagtagctgggactacaggggcccgccaccacgcctggctaattttttgtatttttagtagagacagagtttcactgtggtctcgatcttctgacctcatgatctgcccgccttggcctcccaaagtgctgggattacaggcgtgagccactgcccggccaaaatttttctttttaagcaatattagtttaggcttgtaagtagctcacttagggtaaatattctagccaagatcatgaaaaaatacattgatttcattatgttcttaatcagatctgcatcagattaccataaataggcagctattctttctttttttccacagttcattgtattcctaccatttccaaatagaagtttatggttttaaattactgatgttaagtacttgtttggaaggaatttatagttaaactagttataataatttatacctgtcaagctctttcatatatagtacatattttatctctcattagtttctgtaagctcttgagagaaaggttcttttttatttccaccttttaagttcaggggtacatgtgcaggatgtgcaggtttgttacataggtaatcgtgtgccatggtggtttgctgcacacatcatcccatcacccaggtattaagcccagcattcaccagctgttcttcctgatgctcttcctcctcccacccccaaccctctgacaggccccagtgtgtgttgtccccccaaccaccgatgtgtccatgtgttctcatcatgtacctcccacttacaaatgagaacatgcggtatttggttttctgttcctgtattagtttgctgaggataaaggcctccagctccatctatgttcatgcaaaggacatgatcttgttctttatggctgcatagtatttcatggtgtgtatgtaccacattttctttagtctgtcattgatgggcatttaggttgattgcatgtcttcgctattgtgaatagtgctgcagttaacatatgcgtgcatgtattgttataatagaatgatttatattcctttgggtatatatccagtaaggggattgctgggtcaaatggtatttctgcctctaggtttttgaggtattgccacactgtcttccacaatggttgaactaacaccaccaacaatgtagaagcattccagagaaaggttcttttatttttgttttgttttgttcgagacagtctcactctgttgcccagactggagtgcagtggcatgatctcggctcactgcaacctctgtctcctgggttcaagtgattctcctgcctcagcctcctgagtagctgggactccagtcatgtgccaccatgcccggctaatttttgtatttttagtagagatgaggtttcactatgttggccagctggtcacgaacttctcacctcaagtgatccacccgccttggcctcccaaagtgctgggattacagacgtgagccactccgcctggcctaattccagagaaaggttcttatatgttttatgctatagtcccatagtatgggactactactatgtagtaattttcagttctgctgaaaatgctgtagtcgttactacgtagtaggcgcagaatatttgtttaatgagtgattctctattaaagggtcataaatttgaaaggtaaaggttaagaacaatttctctttagagttgtacagattaaaggaagtgaactttttttttttttttttgtgagatggagtttcgctctttctgcccaggctagagtgcaatggcgcaatctcggctcactgcaacctctgcctcctaggttcaagcgattctcctgcctcagcctcccgagtagctgggattacaggcgtgcgccaccacgcctggctaattttgtatttttttagtagagacaaggtttctccatgttggccaggctggtcttgaactcccgacctcaggtgatctgcccgccttggcctcccaaagtcttgggattacaggcatgagccaccgcacctggccaaacatatttttctttaactgaggaaattagattcattgtccaaagcttaaaaggaagattttctactttgagtttttattaactctgatactttactatgacagtacttccagcctctgagacatgagaaatagcgtgagattgtagtaatcaaaatgaccttaccagaaatcaccaccaggttggtgaaaaacagtacatctacacagaaggatggacttgatgttgattctttcaagattaaagatgaagatgcccgaacttgaagcaagtcttttatcaaaaccgtacataaagcaaaacacactgtatgatactgtaatggtggacacatatcattacgcatttatctgtagaatgtgcaacaccaagagtgaaccgtaagattaaaaaagaaacaacaacaataggctgggcgcagtggctcatgctggtaatcccaacactttgagaggctgaggtgggcggatcacctgaggtcaggagtttgagaccagcctggccaacgttgtgaaaccccatctctactaaaaataaaaaaattagctggctgtggtggcgggtgcctgtaatcccagctacttgggagactgaggcaagagaaccgcttgaacctgggaagcggaggttgcagtgagctgagatcatgccactcactgcattccagcttgggggacagtgagaccctatatcaaaaaaaaaacaaaaaacaacaaaaacaaatcaaagcctgtacataaagtatgtactgttgcctgcatgccatttgtcagttttaaagattaaccatggtcagtttttaaatgtagtccagtatatccttggtacctttgagttcttgggctttttcctttgctgtttgactagtaagcaaaatgtaataaaagtaattagcatattgcataatagtccacatagttccattcccaaatattacagagaactcctcattttttgtaatattggaggctgttataaccctgaagtcttgaacattccttacaaatctcttgacatcttttgttctccatctgtgaagttagctaacaccagaattcctgtattatgactcctcccataacatgtgctgtctcacctcaagaaaactgaattttcactcttccatgtccaatttgtaaataattcaccaagaataacatttcaaaatttagttcaaaataacagatgttacttcataaacttatttaaaaaacacttggacattcatctcccatttggatgtagtgattttgacgtaatcactttgattttcttaagtaaatgtaagtaggctatacatatttaacttcggggcatagtaacttttgggtacttacagtttcagcattgagctagtttacgaagcagaactaacatttgaagacagcttcattctttagtcaacataaaaattgtttttgtcaaagtaactgtatgtaggaagtatgtgatcctttttttcttaaaaaaatgagctccaaatagccatttagtaacacttcatgtatagaggtttctgtgagatcaattcttccaagtgttcaaagtgtaaaaagctgtgaaacacccattaagtgggtgtttggaatgaaaggggaatggaaagagatgagataaaaatattatctaaaatattgcatagtcgtggctgctgctttgctaagcaacactgtctcttggtggtcacatacatgaagacttgtttcaaattcatgagtatagtcttacctgaaggaaaacaaggcaagtaaactttgcaaatacttaatttcaaacaaacaaacaaaaaactttaagaaagcactacagctttcttgttgaaaggcgctatagagttagtcacatattctgagatggctgtcaaaccatgcaatatgtttctatatatcagatgatttttttttttttaaattgagatggagtctcattcaccgtgtcacccaggaaggagtgcagtggtgcaatctcgactcactacaacccccacctcccgggtacagcattcttgtgcttcagcctcctgagtagctgggattacaggtgcacaccaccacgcccagctaatttttgtatttttagtagagacggggtttcacaatgttggccaggcagatcgcaaactgcctcaagtaatctgcccgcctaggcctcccaaagcgcagggattacaggtgtgagccactgcatctggctggcattatttctaacacacttctgttaaatacttccttcaagaacaatatctttgtcatagaatatgctacattttttaaaaacaaatttatttatcaaggatggcattcaaataccctggtaattacaaaactgcaatgataaaatacaaaatattgaacttaaacagtttctctgagctaaatccaataaataaatcagggaatttgttttcttaaataatattgaaaagattcctggggccaggcccggtggctcacacctgtaatcccagcactttgggaggctgatgcgggtagatcacctaaggtcaggagtttgagaccagcgtggccaacatggtgaaaccctgtctctactaaaaatacaaaaattagccaggtgtggtggtgcacatctgtaatcccagctacttgagaggctgaggcaggagaatcacttgaaccggggaggcagatgttgcagtgagccgagatcactccattgcactccagcctgggcaatgagcaaaactctgtccccgcctgcctcccccgctcccccccaaaaagattcctttttgctatttattgccctgtttttgatgactatggtggtggttgggttattttggtatttactattaatacagtttataaaagtaaacaaattttcaagcttgcttttatttttgtcatataagtaatttaaatcttatcaaattcagatcacagagttaacttcatgtataacttttcttgctttgtaatatctagattggaggctgaaataaggatttgttctctgttaaaagcagaaagaccttggtaggagcacagggaaaactcagcttgataaagataccaatttattttcatttatcacattgtctgctctgacttgttcccttaaaatatttataacctttgttacagtgtgatcagtctaatctaaagtttattcagttgaggttgatctatgttgaggagtgtgtgtacatatatacatacatgtatatgcatatgacatttgaatatgcttttttgcctgtctggtttcaatgaaagtgtgctatatttaacaccaatagactattattagcatcagaaacctggagcattgctaagtttccagtattgattagataacagctcagttctgccaggttggacatatggtaaagataaatgacaagtattttaaggttaaccctcccccgcttaaaaaaaaaaggtgcaggaaaaaaagtaggggaaaacagtagacagtgcaccctagttattgattcttggaaagctaaaatctatcgtgtagcacctgaacattataacactttagaaaattaagacatttgaaggatgtaagaatgtatcagcaaggctttggctggggtgcagtggctcacgcctgtagtcccaacactttaggagcccaaagcaggcagatcacaaggtcaggaaatcgagaccgtcctggctaacacgatgaaacacaaaaaaattagacgagctcacacctgtagtcccaacactttgggagccgaggtgggcagatcacaaggtcaggagatcgagaccatcctggctaacatggtgaaaccccatctctactaaaaatacaaaaaaattggcacacacctgtagtcccagctactcgggaggctgaggcaggagaactgcttgaacccaaggggcgggggttgcagtgagctgagattgtgccaccacactccagcctgggcgaaagagcgagactccatctcaaaaaaaaaaaaaagagagaaaagaatgtattagcaaggctttcaaacagttaccctaaaaactaaatacaggcacaacataactgtgtagacataattatgtatcacatgtaggtacttatagatatatttatgcagagtatttttagttaacatatctgactgtgacaacaaaatagtcatttagtttgaaaatcatgtgcccaaatatgtgttttgctgtggttaccctggagactttggagttctgccatgtgatttccttaaatccctggaatttttgattgctgagaattcaggaggagttgcccacttgttagtgtgcagggaaatgtgtttttctcatttctagttgaggtcattctttttttttttttttttttaaaccatagcatgtgttccattagttatgaatgtattatttctttagagtcaaaattcacaactcatttctttgaatattatctctgatcctagatgggatcaaaattgccctagatttaggagttttaaaagtttactaggttgtggggaagatgggtttatttttcataaacttgaactagaatgttgacgattataaggactgggacacttcctaaaggtcaaaatattttaaggcgaaagtatgtattctttccttttgcctaatgattgaaagaaaaagtggtaatatgcgcttgctttctattatgagctttaatttgtaatttgatgaagatttttgttaacttgctataggtagtcaggtaaggaaacagtggtgccagaatttgtccctgattcagtatagttctgtgcaggtcttgagtagatgaatttaaatgctactttattagtaagagttagatggtcagccttgtactgagaacctccaaccttcttcccagctttatttttctacacgcttcccatcatctgacttacgtgttttacttgtttactagaatgtaagctacatacaagcagagtttttaaaatttttattctgttcattgctttattctgagtggctattatcgtttaccttttttccttgttttctatgcaaagtctcttatcagccactacttgctcatttccatacagggctatagttcaaccctttgctgataccatttttcttatagaaaaagttcttccaaaacttatcaatactgtattcatcattaatgcctctttggaattctctcattctcctgactattgctgaacatagtctcttcttttaaatgctgaggaagcactcatttgacactttgctgagatgtttacctaaactacattttaaactttttaattactactgtttttactgtggaaaggggtgtgaaagtgttacagccctttactattgggaaatctaatcagataaatttcgtgaggctaggatggaaaggaaaaactttacaagttaagcaaagggactgttaattaactgtttaataactctaacgacagttatgaccagagcaacataatagataaaagacaatctccactaagagccttcattgggtaatagtatgacttgtagtttttttaaaaaatgctaataatctcaggttgtattacagtctcatggttatacagatggatgggaatatctctatttgcctaggatcaagaggctaggtgacctcttactcaatgggtcgttctttgttatatgtattagtatatagtaaaaggaaatacttcctttaccataaatgttattttattacgtggccatgtaattatggtctcagctcctaggatcagaggatttaaacttagaagacatttttcggctgggcacagtgactcaacacctgcaatcccagcactttgggaggctgaggtgggcggatcaggaggtcaggagatcgagaccatcctggctgacacagtgaagccccatctctactaaaaatataaaaaattagctggcatggtggcgggtgcctgtagtcccagctactcaggaggctgaggcaagaggattgcttgaacctgggaggcggaggttgcagtgagccgagatcgagccattgcactccagcctgggcaacaagagcgaaactccgtctcaaaaaaaaaaaaaaaaaaaaaaaaattaagaaggctatcctctaccctaaaaaggattggtaggctgcttgaatgaaatgataataaaacaccagttgtttaaatggggctcctatacacactttgttttaaaaagaaatatcgagttgtggagggaagaggatgaaaaacattttgagtatgtctttgtaactaaaatttacttggattcactaatggctttgttcctttattgtaatggagtaatattttctaaaacaaaaagttgtaatggtgttctataccttaaatgtcaaaaaagattaagtagtctcaatgtgttgtaaataaaaatgaaagaaatggtcaatctgtgcattagattgtgtttaatcaaatggtagggtaaaactacgcataccagatgacagcatagctttaaaaatgtggcttggaataaagtctttcaaaaatggttgtgtataccctgtctacaaaggaggtatgatacatttgtatttatctttattctagataaaatgatggtttacagggggagaaaatgaagaaaaaattgtgaatgtcttttttttttttttttggtaagacagtcttgctctgtcacccaggctgcagtgcagtggcgcgatctcggcttactacaacctccgcctcccgggttcaagcaattctcctgcctcagcctcccaaatatcccaagtagctgggattacaggcacctgccaccacgcccagctaattttttgtatttttagtagagaccgggtttcaccgtgttggccaagctgatctcgaactcctgatctcaggtgatccacccgcctcggcctccccaagtgctgggattacaggcatgagccaccgcgcccggctgtgaatgtctgctcttaatactttgactcattactgtcattgagtgtattcatttgtttattttattttattgttattgaaactagttttttgtttttatatgccattttcttcaagatgaaaattacggataacttacaggtagacttttttttttttttttttttttttgagatggagtgtcactctgacaccgaggctggagtgcagtggcaccatgttggctcactgcaacttctgtctcctgggttcaagcaattctcctgcctcagcctcccgagtatctgggattacaggtgcccactgccacacccggctagtttttatgtttttagtagagatgaggtttcaccatgttgaccaggctggtcttgaactcctgacctcaggcgatccacccgctttggcctcctaaagtgctgggattacaggcgtgagccatcgcgccgggcccaggtaaacttttgttgttgttgtttgttacatttgatgtctttcttattttgagtttaaaagaccacagtttgcaaaatataactcagtgaattaatcagttattatttgataatttgattatttgataataaccagagttatttgataatttttaagttttcttataatttagaaatacagggtgaataggcaaaatgtaaacaaaaatggtaatttcatataaaaaagtatctggtgtttaaaaaactttgtatgcatctcaaaatcatgattaaagtatagttttggcttattaaagtgttatatatgtcttctgatattaaaatttgttttaattatccaagtaatcctgaatccattctcatgggaagaaagatacttaagtcaatattaaaatactgaaatatgtgaagagttaaaggtgaaagtcattctgtacagttctacaaaattctgtttctctgttcagagctactgcttatagtttagtgtttaatcttgcacaccttttgcatgcataaacctttacaacaatttgttttacttttttaaaaaaataaatggggctctattttacaatgtgtcaatatattaattttttttcatggttacaattttgtaatggttctcttaatgatggataattgttttcaggggtttttttgctatgatttaaaaaattttacagtgaatactgttgagctacatctctggatattactatcgattatatggtcagtgcacttgtggctttatgaatattttaaataatgtagtcaagtctgttgatctttttccttgtcatctgtgttttgtggattttggtatttccaaactatattcatttctacagagttattttcatttccattttttgaactgtcacttgtaaaacactttctttttatagaaccttatgagtgatagcaagatgtattagtatgtaatacattgtgatggagtgtaatgatcacaaggatcagtgacagttttgatgaccaatttcagagttataaaataaatgaaatatattctggaaaagtcatgggctttttgtgttgtttgtggaatcactaaaggtagtccctcactattaacaaatttgttttgacacataatatgtgaggcactgaattataataggcactagaaacattgcctattttcctgaatcctttagacaggattgcttccccagttaccagagatttctctaaccttgatttacagtagctactgctggtaggaattgctctccactccacttttgctgccatccagtgttacattaccctacaaatatactaagtgcttagcaaagcagagtccaaatgtaagatcaatttttgtcttacccagaattttacaattaaaatatataaataaaagatttctctgtgtgtggatgtatgtgtacagtatagtgttgcatgctatacatggggtgaggtatcagaatgctttttcagtgtttggcacctctaatttggctctgtggccatttattccacctttctaccttgaaattccacaacttgggctcttgaaattacctggtatggtgcaatgcacgtgtattctcagctactccagaggctgaggcgggaggatcacttgagcccaggagtttgaggttgagattgagatgaactgtgagaacatgctactgcactccagtctgggcaacagagcaagacctcatctctaaaaaattttgggcttgaaacgggctgattttgtcctaccactagtaatcacttttagaagtagcttacaattgctgtttcttccttcttatggggggaaatacccttataggaggtattatgaagccaatatctaataaactctgtcatcattagctcacttccactcttctgccatctctctgtacctgattagtatagttttgaaaaattataattttgctaccactgcacctctccttgttagtaggggagatttatgtaagagaagaatcttttatttctagacaaggtaatatcccattgggaagaaacagccaagggagaagaaatgtttttttcttctttgaagggactagaacttttatagctcagcaaatttgaataagtttgatggtaattcagctacattatattttagctagatttctgagttcatttggtaacctaaccaccacatatatacctatttataacttgaaatttgcctttaaagtcacgaaagcacaaagcactgtggtgcttgtaacactcttccatattattataggtaactaaatgaccatggaatctggagccgagaaccagcagagtggagatgcagctgtaacagaagctgaaaaccaacaaatgacagttcaagcccagccacagattgccacattagcccaggtataaaatacatggagagattccagtttgtgtctcttcctagaggaatacgtttccaagagaatttagttgttattacatagatatacatagaatgagcagagatactcttacaatatcaaaattcctatttacttagtattagagtatatttagaaatgatagtattaattcaataacagtaaaatgtattattaaacaataatacagtatttttagtgaaatgatccagaaataattacattttaaacttatgggtaaatggtgctctcagataagggaagaaaaccttggctatgtatgacaactgctttttttatttttttaatatgacacagatttattttttaacagtgggaatgcagataatatgaaagcctaagtttatataactaaactaaaaattaggataagcaaataaattgacatgtaaggaaattttaaggatgatagcagtttttgtttcctgtatattttaaatataatttctgattctttcatttcatctttctctttaacatcctatctttaagaatattttctctcattcttatgtttttgtttgcatgcattctcctcaactattttattaacagctgtttacatagataggaatgagaaaggtggttaacttaaaaaacaaatagcagatacagacctgctaggtaatagtgtgataccgtctctttcagatgaaggttcccaggagaatataatcctagcagaagctctgatatatgtagcttcagtttctccaagagtttaaaagttcctagagaagtcacctagcaagaatgaatcatgggaaatagaggactcaccacacttgggtgtctggctgaggtagtgtgagccagatactggatttccagcaagaatatagtcagaaggagtgagctgttctgtgttttctcctaagaccaccagggtttacctccagccttcaggaataagacaaagccaaatacatctaatgtactcatacgaggcaggctgcaggattgaaggggagagagccaggacttccatcaatatagggtcaacagataagaatctgggctcatctgtatattttgccctttagaaagaggaagacacaatgctaggccgggcgctgtggctcacgcctataatccaaacactttaggaggctgaggcgagcgaatcacttgaggtcaggagttcaagacgagcctggccaacatggtgaaaccccatctctactaaaaatacaaaaattaaccaggcgtggtagcacacacctgtaaatccagcgaccttagaaggctgagggaggagaattgcttaagtccgggaggcagaggttgcagtgaactgagattgcgccactgcattccagccggggtgacagaacaagattccctctcaaaaaaaaaaagaagatgcaatgccagcaggcttctttatgatgatagcccttaacacatcttatctctggagtcacactattttgtccagtctggttgtccccagagtaggctgtattgtgtcatcctgggaattcctttctccctacttccattttctcacagtttgtgtttttgatatggtaaagcatgtttttcagtggttttatgagaaagaaaggttggctgagtaaagatagcatgttataaaaattgaatgtatgggccgggtgtgatggctcacacctataatccccacactttgggaggccgaggcaggcggatcacgaggttaggagattgagaccatcctggctaacacagtgaagcccgtctctactaaaaatacaaaaaaattagctgggtgtggttatgggctcctgtagtcccagctactcgggaggctgaggcaggagaatgtcatgaacccgagaccgcaccactgcactccagcctgggtgacagagcgagactccatctcaaaaagtaaataaatacaaataaaaattgaatgtacatgtgccttaacatctagaagatgtacaacaaaaatattaaaagtgattagctatgggtgataggaatataaagggtttttattttattttttatatctgtattttataaatttataatgagaggagccattatataaaattattagtgtagaaaagggattattcattgagttagctaggtatattttccctagagaagactcaggaaagagaacatagtaattgcttcaaatattacaagagcatttatatggaattgagatgagatactctgaataaggttatggttctcaaacttcagtgtacgggaaagtatgattgggttcctgttagagttgactttacagagtatcctgtgtgactctaatgaagctattccatggaccacattttgagaatcaaataaaactaagcaagatttatagtggccagagagaaagtgattaataagtaaggactttattactatccagagatggaagcttctggttttaccctatatgccaaagacactgtctttatagggatcttccccccaggcttcacagtcacatatttcgctgcctgctaaaataaacatctctacaaattcagatgtcagagtagtttcatcatcttccattacaaccccagtcacccaaaagcctatccttacttcttgcattctctttttcaattaaggacagtctgccaattctctttcagacatgaaacattgggtcatctgcagttcctctctcacctcttttaactattcataaagccctttctggactgcttccaaattttcataaaatcacttccctcgttcccatctctactactactaactgccctctttttggccttcatcatctttccttaactacttcatgggctttcttcgttggtctccccaccaccagttttccccctgaaatatatatctttcacactgccactaaagtgattttttttttttttttttgagatggagttttgttcttattgcccaggctggagtgcaatggcgcgatctcggctcactgcaacctctgccccctgggtttaagcagttctgcttcagcctcccaagtagctgggattacaggcacctgccaccatacctggctaattttttgtatttttagtagagatggggtttcaccatgttggccaggctggtctcgaactctagacctcagatgatccacccgcctcggcctcccaaagtgctgggattacaggcgtgagccacattgcccggcctaaagtgatctatctaaaagcaaacatcaccatggtattcaggagttcaaaagcccttcagtggcttctgcaataccctcaggataaaatgcagtttctctgaggtgacataatacaggctttttgtgactagcacatctagccccacctgcctctgttgttttctctctccctacttcatacatcatacagtaacacacttatgtgcaccattggtgctgagctgctggttatcccactctgccatgtgtgctgtttctctttgcttttgccactactccactctgtgcttgaaattctgtgactcttccctgtaagtaataataacaagtctaacttttttcttttgttttaaattcacattcttccctgatagcctccccttctcttaggttgggtagagtaattctcagtgtgtccatttttcttttagcaaacctcattactaaactgaattgtattgtgtctcttttccccattccttcgcatacatacccccaataatttatttgaggtcagagacccctatctttctcacttttgtagtttcagttctaacattattcctggaacataggtccccaataactgtttcctgatttagcaaataaaattcctatccttgaatgtgttcaagcataggagcaataaataacatctgatagacatgtatgatttaaggacccttttaacctgggtattgactcattaaaactgccttagttctagacttagtaggtcaggtttgcttatgcttgagagcagttagattttagaacgtgacttatttaacatgatattctttagaattttatgtttcttcaaggatagtatatctgttgaccttgggtgaacacttaatctcattgagcagttatttgtgtttttaaaaatggagatccttatcacccagtcttcagtttcttcaaatagcaaaatcagaaattggaaatgaaagcaggtgggaaaatgtaaagtgccatacaaataaagtgatatctcatgttcagagagtctgtattacatatttggtataacatgggaatagtttttaattttttgtcacttgggaagagctgaaaaggataggggtatagtttttggtgttttttatagtgttttttcttaaagaatattaaatttagtcattactttcatatcagtgaaatacatatctagcaaaaaggtcacgtttttgcttctaaaaagttatttcatattgaacatgagtactgccaaagagtgtctgggatgataattcttttctgtgttcaacaccataggtatctatgccagcagctcatgcaacatcatctgctcccaccgtaactctagtacagctgcccaatgggcagacagttcaagtccatggagtcattcaggcggcccagccatcagttattcagtctccacaagtccaaacagttcaggtatgtgtataaaaagttctgcatctattttaataacttttgtttatagccatatctctctcctttcactagttatgaaaataaggacacatctagttcagtttattttattcacagtataggaatatgctgcatctgtatagtcaccttatgtataggaacatatatacagaagaacaaacataaaagaaaatgactaatttcttaagctgcagaggaaaaagaattgattggggaaaataatgaagtacatgagataaagtggaagtgtttgggagaaactgtaggactgaagtacctcagtcgaggaaaattgagatgcaaaaatagtaactaattttctaaatctgcaattggagaaaaatatacccttgatcaaaaattaataaccttacctaagatattatttgaccttagagattacataaagcatttgtaaaatcagctgtgcttagggttttcagttacagtgtgtaactttgaaataatatattcagaggttacatcttaagggtcaggaattatactatgcatgttatctaattctttggagagatctttcctttgggtttgatccacaggtaataaaggcactgtagacctttgaaggtgactactctgtttaactgtagggaaccgagagcagtatagatcattgcaattgagcttattgaaaaaaaagacttgaacgttcattcaagtaggccataaccccagcctcccatttcatattttttgcttcacagtcttcctgtaaggacttaaaaagacttttctccggaacacaggtgagtcctaggtcctagatttggagagaactattattagaaaggaaggtgagaaattattctttatgtctttgtccttttcctctataaacatggaatttcaacacttgaacaaaaacctcagagatcttctgggtctaggccatacttgttacctccccagcccttagtctgttgcttaattctgtttaacatttctcccctcttcctaatggtagtccagcatttacttgaacactttcagagaaaggaagctcaatctcctgaggtaacctgtttacaattaggagtgattgctaaaatattcttctctgtgatgatccaaaatatatcttcctaaaacttttacctagtgatcccgggtaaacacaggttctattctcggaaactagattagcaagtctaattcctgttctattggactgcttcctcttccccatcccccgcacccttcctatttttaagaaaatttccagactaaacaaactatttttctttagccatttattagatggtataactctgtttcctcttcaccatcctggttgttttcttctgggtgagcgctgttatgttttctttacatatagtaaccagaactgattaatatttgtagaggggagaagtgctgtctttgtcctggaagcattctattaatgtcctcagtagaatttgtcagccattttatactattgagtcatcgaacttctattaaccacctctacttcattctgtctttgtgcttttggttcactttgacacttaagtgggagcgtgggggaggagaagtaatgtttttgtgtgaaatcatcagttggatcaatttccataagacactgggaatggcatttgttaacaagtaaaagatagtgttgtgcatgtaaagatctaagaacttgatatttctatgaaatcacaatgactgagcaatagtcctttgccttagtttttattccattgagtgctaccttaccattgtccatactgtgccattactaattccctaaccatatgctcctcttagtaatagtgagaaaacttgatttgctagtgaggagacctagattccagacccagtttggacattaataagtcaaatggccttgggcacatctacctttctctttttcacttatagaagatctttctataaagaacacaaaaattacttaagttacagccacaaaatttgctaagattactgttttttattgtaatatgtgttattgttgattgtattcttgattttaatctttattctggggcaacataatttggacatgaagattttatggccattaagtatagaaatattctcttttttttatttgcttgtattcatctttaaggaacacatttgtccattaaggtccattaaggtgagctgtacttctaatttaagagtgtgtatttataaaagaaaagttggacttattgaaccctggattctacaaatagagatacaaatataatatttttttctttaaaaggcctaaactatagaatatctattttaatagttatcttagccagttaatggtgattagtgttaacaactaggaaatagtttttatcaaaagagatgatcaaacaaggagaggatcttctagatgggagacctcattaatattccagaataaagtttccaaaatatacaaggtacagttctcttgttgtgagaatagattattactttaaattatcattcattcctacaacaaatgtttattggtgacatgctatgtcactgttctgcttgctataaaagacagcaatgagcaaataatacttctctgttctcaagaagatcacattttaatgaaaagagacagactatgaaaaaataaattgtgtcaggttaggagaattaacgagagagatgaataaagccaggggaaagggatggagaatgatgtggagggaagggtgttctactttatgtaatgtgctcagggaacacagcacagaccagaaggcaatgaaggaggctaaggcatgcagatcgaaaggtttggaagtgagggtatacttgggatatcaaggaataacagaaaggtatggctggaatagagtaagtgaggagggaagtgattggagatgcaatttacaacgtaagtttgtctcctttaaaatgtcaaatctacgtattttaaaaccctaggaatagaactttgtaaattgttcaggagtcttccggagtttcagcaggtattgaacttatttcttaaaaatacaaaattgtaaccccttcctattaacatggaataaactgacttagagccagggagatgaaaataataaactagataaatctcattgaaagcttgcataattggtagatgcaaatgaaaatgattatttagtaagcatacctcaaatgcacctagttttgttatctacatgaagttttctttttcaatgccagcagttgttaaatcacatttcagaaaacccaagcttagaatctgacttctaaatgactgttataaagtgttaaatgaggtcagactccgtggctcattcctgtaatcccagcactttgggaggctgaggcgggcggatcacttgagctcaggagttcgagatcagcctggccaacatggcaaaacgccatctctactaaaaatgcaaaaattagccaggcgtggtggtaggcacctatagtcccagctactcgggaggctaaggcacgagaatcacttgaaccctggagacggaggttgcggtgaaccaaaatcatgctgctgtactccagcctgagtgacagagtgagactctgtctcaaaaaataaaagtgttaaatgatttttaatgaagcatattatgtcattctcactatcctgaaaaataatattatttatctttaagaaatatataaatttttaatatttatgcttatcatatctctttaagaactcttgttttataatacgaatacttaaaatttagaaataagaaaaatgtatgcctgtgtaaaatttttcttatttataagagatacatgcagatcaaaagagttggaagatcattgatctagactttcagtaagcttcttgatccaatgagtaaaacactgtatctaaggccaggtgcagtggcctataatcccagcccaggcaggaggattgcttaaagccaggagttcaagaccagcctgggcaacatagcaagaccctgtctctacaaaaaaattaaaaattagctgggagtggtagtgcatgcctgcaatcccagctaactcaggaggttgagtctggaggatcccttgagcccatgagtttgaggctgcagtgggctgtgatcgcaccactgcactccagcctcggtgagtgagtgagatcctgtctcttaaaaaaaaaaaatcttaaaaaaaaaatatatatccaaaccatgagtctcaactctaccgagggatagtacttaagtttccaaaggaccatatataggtttaggaaacatcgaatattaccattgttttgattggttctagttactttatagtttattttaaaatttcaaataatcgaaacggggtcctccacctttccaatataaacaggtagtatgggttttaaataaaccaaagttgagaaatacagacctaaaactttatatctacaagtggtagtttagctttttgaaaatttcttgacttacaagtggccaaaattaaagacctatttaaggaattcagaaagaagttaataagtgataggagatgagaataaaaggaaggggttccatcattggaatgtgatgatgatacgtgatgtttataattgggatataatttttcatatgatgtttttattctgttatttataaaaatagatttttgacatgatttttattgatctcagttatgtgggtccagtatgtttttttttttttaacatcagttttaggttcacagcaaaattgagaggaagctacagagattacctgtatactccctccccaactccatggatagcttcccctgttcttaacatcctcccccagaacggtacatttatgttataatttgatgaccctacattaacacatcataattacccagagtccatagtttacattaaacttcattcttggcttggtatattctgtggcagtatttttattattgattaagtgatagatcagggactccataggaattagcttcatggcttacttctcttcagatggtattcccaaagaggaagtgttgtgtttatttcagtggtctgaattctctttacatttacaaagttgcaagcactaaatagtgataagttaattccttctgtgtgaattgacaaaatcttacaggtcagagaaaggcaaccttttttttttttttcattaagggccatagatccagagttagaaaaaaaaaggacacagattaaaaaacaacattaatttgtttcatttcaaaactatcctgtgggtagtttatatggcatgttttaatgttgttgttttagtgagttccaacttggaaggggggtgttccctaatcactatatgtccttaagagaagcatgtaaggatggggcatatgagagtcaagcagtggacacagaaagagccacagaggagctaagtgaattctgagtggcgtattaatgaagggaaacaacacttgtcacagtactatcaactttgagttcagtcttgttattccttgaatttctgatcctttcctcaggccttttcatagctcctgatcttctgtatgtgagaaagtttgtgcagagactcttgtgtgtgggctagttacagcagctactgattaacgtgaaacttttctgtgtgcttctttggcagtaattacagcattattattctgctgagaatcacagactaaattcagcattactcatctttttatctgtcatttgtgaattcattatatgttgcctattgatttttaggtctttcagattgtacttagactttaaagtgtttggatggggcaaattacttcattataaatatattttactacaagttactaactttacctggtttcattttaaatgagcatgcatatcacaaagccctgtaaaatgaatgcccacttgggagaactgttaggctcagaccacacatagagtacgcttggaatttctcaagtacttctgaatatgttttcttactgccattgccatacgttttgacgtggagctgacctacatagacccttttgtcttggttaagtataattcttactctgaccgcataatgtgcccctagttcaggaaagagcataacgtttctgctgattagagaaacttgggcagtgtaaatttgacaatcaagcatacttaggtaagtgaactcttctagtctagaaaaggtgtgaaaatgccactggttgctgcttctgacaaacctggtttgagactataacagtctggtttgagactggaaccaccaggattttgatgctggtaaggatgtctaaaatggaggttaatgacagtggctccactacttcctagctttgtgactcgggtgagttacttctttgtgccttagttcttccatctatggaatggatataatagtatagtacccatctggcgcctacattactgtgagtattaagtaatgtagtatatgtaaatgcattagcataacacctggcacataggcatctgtaaattctagtttctatcattaatatcccatgtaaattttttattcacttatcttcattacttttcagtctaggtattcttatcagaaaagcatagttctttaccttgaatttttacttaaaagtgattatagaatgctaactttgaaacatgttaggagtttttcctaacttgctaggaacaactgtcagggatgtcatgatggatcgccagtcttactgtacaactgtaaatatattcataagtgtttatacagttaaataataatatttgtatagtcactatatagacttaggaccaaatatttagccatccattttatcctttatatcagaaaccttattttagttggtagttttgttccaacagatgtaagaaaaaactgataagtaatactgatgcattcaggattgattacatggagtcctgaaaaaaaaattaaactgcagctattttaggttctctaacttcatcgtagtttatagggtaagtaaagggaaggggaaagtgattggtgtggttgtctcccataagaactgatttttttctactgaagcatgtataaagtttatatatgactttttatatttgtttaataaaaattttacaggaactaaatttgattatcaatatgaagtttttctttaatttcagatttcaactattgcagaaagtgaagattcacaggagtcagtggatagtgtaactgattcccaaaagcgaagggaaattctttcaaggaggccttcctacaggtatggaatttaatagttagaatcaaagatgtggaggaagtcttaggtagttgcagataaagagatgtcagaagaccagttagttgttcacgtcagttccttatagattacttttcttcatcttgagttatttgtctcaaataaagtggaagcttatcctacagaataagaagagcacttgttactctcaccagtcctaattttttttttttctgtttctgtttctgtagactgtgctggctgtctttctgttaaaagtttggaatacagttgataaggttatagcattttttagttataagccaactctgaggctctgttatttatctacttagtaacacattgcaaaccattttttatgccatggtacttaacagatagctattaatttaataattgtctcagggagatgctttactaacatcccctaattttagcagtagcttactgtaatttttgtgttcagttatagatgttgcctagtccatgccttgcctccaaggtgaaccaaaaccattttttaatgtaaaaattagctccacattaaatatcttcaggaagggcagttccataaatcttgataagtttacttcagcattgaagaaacttcagactcataattatcttccttgttagtgtaaattattttttatatattcctatttttcaaagggatggttttttccccccgcttggctattaaactaacccttttctctgtccttacaattaaattaagaatcctaagtgactagcaataaatagattttgaggtctaagaaattttatattaccagtttatgttatatgtatttatattcataatttattttaagtatagctagtgttagattttaactttgaagtatatctcctgttagtatataacacatttgatcctgaagcaaatccaaccaaatactactagtaaagtaattacacaggtaaatataaaagccaggattattatagttttggtttgtaactcctttttttcctatgtgattggaaagacaaaggcatagaacaataactataaatttatgtgactaagcacatgatatatgaagatgtcatttttgacaatagcataaagggacagagtttataactagtttgttacaaatttaagatatcaaaaattacttgggttagggtttttaggggttttttcccacctttcagtgtgattatgttattcatttgaaatatggtatggttcctttgtttttgggttccattttagagtttctccacccatccttgttgatctttatttttttttctagtaagtgaaacatttaacactgtaccaaaagtcagaattgcacaaaaaaagtatactcagtagtgcctccccattccttctgtcgttttcatttctttcctacccatccccagtaaatagctaaaaccattactctctcgtttatccatcctgatttttttccttgaacaaatgagcagatacatgtctgttttcatatttcccttttttccttacacaaaagatatgctgtatccattatttggatgtaccatagttgattcaaccacttgcctttatatgggcatatagattgtttccagtattttttttcctttttatttgtttttctattttagaccttggatatatggctccagtattttgcagttacaaacagtgccaatgggaataatcttaagcgagtttattttaatattgttggaattggggtgaattcctggaaatgggattgaggcacgaacacccatatttccttaaatatcaacaattccttatatcgggattgtgccagttttatactcccagcagcaatgtatgagagtgtggtgttttttgtttttgtttttgttttttttgtagctttgctaacagattttgttaacacttttttgtttcccaatctgagaagtgagaatttaaaaatcaggttttgatcttttttccctttagttgattgttgactttttactttccgactttgtgtatgtgttctttgagatgcaaaagattttttttaatgtagtcagtcttattattacccttaattgcacccttccttacattgaggttaaagataatacatctttttttttgtttttgtacatatttgggttccttttgacatctagatcaatccctgacccatgaagagtttattcatgtaatttatatattttaaacttctgctggctgggtgcagtggctcacacctgtaatcccagcacttcgggaggccaaggcgggtggatcacatgaggtcaggagttcgagaccatcctggccaacatggtgaaaccccatctactaaaaataccaaaaaaattagccaggcgtggtggcaggcgcccgtagtcccacctactctggaggctgttgcagaattgcttgaacccgggaggcggaggttgcagtgaaccaagatcgcgccactgcactccagcctggcgacagagcaagactccatctcaaaaaaaaaaaaaaaaaaaaaaccttctgtcctaagcactagcagctttctgtgagttttctcatctttaactatatttgtatttagccagtaaattgtacttatatttttaattattctagttttctaattttgtaggaaaattttgaatgacttatcttctgatgcaccaggagtgccaaggattgaagaagagaagtctgaagaggagacttcagcacctgccatcaccactgtaacggtgccaactccaatttaccaaactagcagtggacagtatagtgagtaatagacaatttctgtttctattgtgaggagaaaaaagtgaggagaaaaagctaatagttgcattctcttcagagaaaccaatacaagtgccaagtcttctcagttttgctgccattattatatttcctttactcttcactatgcaaaggtctgtaatggtagtattttcttttcttcagagagttttagttaggattagtcaagtgtataaaccttttagatgtccttttgtttttgtgcagatgcatggaaagtctgaagtttttgaaccactaattgagaccctaggtttgaggcctcatgtgttgagagaacataagttttttagattaaaaaaaatcattccttgaatatatctcggtattcattttaatagtttgtcttgccttctgaaagtagcattttaatgtcttcgtatttaataatgtttcaagtggggataagcatggcttggttgagtcagcacattcaattattccttttcatatgaaagatagtaatatactttttggcccacataaagcaaaaattgctcttacaaaattatttaaaagttttcatttctatgatgtctctgtctggcacttaggtctgtcttcttatctttcaccaaaatctgttataagacacttttgaattttattttgtttgatcaaaagcatttgtgtgaatggtacttttttctctttttcccttttttttttttgcctctcaaagtgctttattcattcagtgatttttttcatttgtatttgtttattaaacctggtgctgcccatttatacccttttccccacccaccttagtttcaaattaaatgtacacattgaaacttctttactgagatagtttcctaatccctgagggaatctgtatcagaaatatgcataaaagtttgaggccaggcacagtggctcatgcctgtattcccagcactttgggaagccaaagtggaaggatcacttgagccatccaggagtttaagaccccatccctatttataaaaataatttaaaaattaagaaatatgcatgaaagtttgacccccatgttattttttagttccagttcaactttgttttgcgtaactctaatttgcattcccatctgtattaaagacaagttctcaagtagcaaactttttaactctgccaaggctgaaacttttgagactaagtagaaggaaggcatttttgactaaggtttttatccactgtgctcaattagcttagtcatcttttttcttcttaagatctttgtggcagatataaagtacaactctttacctacaattctgtacgtgtatgtgtattatcagttgaagcctcataccagatgcttttagttattcaagatatgtgttcgaagacattgatacatgatgtttatttttcttctacttcagcatacctgagggatacaacatactcctgtcagtaacagattcactgttacagagattctcacttgaactaggaagcatgctctttaggaaagaggcctatcagaatctaaaaaggggaaatgaaggttagaaaagtaccagcacccccatagatgtttaatttggtacactcgtctcctccagcagctgaaaattgctagttttaagagattgagccaggcgccgtggctctcgcctgtaatcccagcacgctgggaggccaaggtggtggatcatgaggtcaggagttcaagaccagcctgcccaacatggtgaaaccctgcctccactaaaaatacaaaaattagccgggcatagtggcggacgcctgtaatcccagctactcgggaggctgagacaggagaattgcttgaacccaggaggcggagctggcagtgagctgagatcacaccactgcactccagcctgggtggcagagcaagattccgtctcaaaaaaaaaaaaaaaaaagagagattaatactttgaaatttttaaagctttgttcattatttttatcctgtgtcctctctgtatatgtacacatggctttggctttgatggaactgatttaacattatattcttgattttcattaagagcaatataataaatacatatacagcaacatttatatttcttaacttataaaatgaacatatggttgtcagaattcaccatagatatataaacacacatagttatatattttgtttaatagctgcattgtgtttcactgtgtaaatacagcacttatttaaacattctcctgctgatgaacatttaggacatttctattgtttcaaacagtgctacataaatatcctaagagtggaattatcgaccatcctggctaacacggtgaaaacccgtctctactaaaaatacaaaaaattagccgagcgaggtggcgggcacctgtagtcccagctactcgggaggctgaggcaggagaatggtgtgaacccagagggcggagcctgcagtgagccgagatagcgccactgcattccagcctgggcaacagcgagactccatctcaaaaaaaaaaaaaagagtggaattatcaaattaaagcatatcctccgcaagtacccttccaggtggaggcatgaatttccactccttccttaaattggttattttattaaattcatgctgttactagatttatctgttacttattagttcagtgtcccagatagtaaaatcttattagtgattctgctcttagatagaaaatgtgtatctgtcattttgaacttgaatttttttgtttcagtaaataaaactatgactcatgatgtttccctctttattctggcaactcagattcttagctaactttctgtttaattgtattcttttcttagtctagattttcttctacaattgttttatataactaaggatacatccgttacttgacttctgtctttttatttttgttttaatgaattgtgttttattgaaagctatctcaaatctttttggaataataaagtgtatacataaacattatagagaaaaactgtgttcagtaggattagacttcagtttccaaagtattttcatatacatgacctcatttgatatttacaacaattgtacttagtggctagaacccagatgcttttgtttttagagaagagagaacagaatcaaataacagtttagtgatggctgggcacagtggctcacgtctgtgatcccaacacttggggaggccaaagtgggaggactgcttgaggccaggagttcaagatcagcctgggcaacatagcaaaaccctgtctctacaaaaaaatgtctttagaaaattagtagggcctgatgtcctgtgctagctacttgggaggctgaggcaggaggatcacttgagcccaccagttggaggctacagtgagctgtgatcttgccactgcactccagcctggaagacagaacaagaccctgtctcaaaagaaaaaaattaaaacaaaaaactgttcagtgatggaactcaaactacaacccagtcttgtcatatatggtttactatttctttcttcttcccaccttgaattcactgctctgtagccaagaagaaagtggtatgttaaatacagtaggattcactcattaactctaaatgagaaattgtgatttgtttctgttaaccttctgattctttcaagtaatcatgcaaaattaatcttagaatagttcttactcatttttctccctgcctaagataagtaaaacttctgggattagctaaactagatccagtgtatatgccagcattttaattttcacaagtgtcattttgctaaactaatcacactgtagccattaactcttcttacttcttgatgaggcagtaatcaattttccatgtacagatgtctcaggatgttatttcccatagctggtggataactgatcccaaactaattcccttctaatggacagtaacatgcttaatcagacatgttgactttcctgcattgtttacttttttcttactcagttaaaatcagttttgtagttttatatgtgatattgtgatttttggtccttctctttctgaaaagcttgacccctacagggagaattgtctagagaggatattgccacctatctaaaaatgcttcttccaaataaatcatctaatttttaaattaaatttttctatgtactgtagcataaaggtgatttagtttttcataaagtgaaatatctactagtatgagcaaaagttgactgatttattgtttaacaaatgaatgacaggtgtggctaattagggcataaacaacaaagggttctatatgagaatgcttggatatgtattaaataatttagaaatgacagttaaagttttttttctaaatgatgatcttgagctctgattttaaaattccatgagagactgttgataattaagttccataggatatttcagttgtttcattgagtggattagataccattaaagaatttctacaagagttagggaatacaatgcactgatgaactgctttattagttatatgttaaaacaaccatttattgggtgcctatttcatggctgccactgtgctaagtgtatgaaagtatataagaaaattcctactctccagaaatttatttactagtgggacaagtattaatacattatgcagttaatgctaaaataaaagaaaggatcacagagtggaacctcttcagaaccaaataacttcagaaggaatttaacatttttccacttaaaaaaattgttaacaggcattattattataaattagaatgcagttcatagagtgcatttctattgtagaagttgaatatgggtttcctgaggagcaagttacttgaatatattagacccttcttggtgatgttatttgctgtaacttctcctagattattttacaaattattctacattggatgtaatgttttaaaagtcttatatggtattaaacttgtaacaataaaatccattggcttttagttgccattacccagggaggagcaatacagctggctaacaatggtaccgatggggtacagggcctgcaaacattaaccatgaccaatgcagcagccactcagccgggtactaccattctacagtatgcacagaccactgatggacagcagatcttagtgcccagcaaccaagttgttgttcaaggtaagggaattcagaattcacaggtgtggtaaattcttcaaaatactaaaattttataaactcacagaaaaagtaagtatcatattgcaaaccaccattcaaatgtagttaacatttcttcaatattgatagtatttttcatgaactcttccattattccaattggaccaaaatgtcatggcataaaaacaactattttcagtttttaaaatattgcatctacctttaacatcttttggggtagaagaaacaggataggttagaaggaaagaccaggaaatcaggagttagaaaagatggattctgtatctaactgcatggatctgctatgaggccttgagtaaaagtcagctgctctgagcctcaggaaagtgttttgttttttgttgttgttgtttttgttttttcatctgtaaaataagagttgcactgaatctctggaaacaatcttcagaagttcaggattctgtttctctgcttccccccccccccccaaaagaaatttaaatcttctgagatcatcagtttttattattattattattatttttttctagagacatggtctcactgtgttgcccaggctagtcttgaactccgggcctcaagcaatcctcctttctcaggctcccaaagtgttgggatgcctctgcacttgactcagtttttgtttcaaatgaaaacattatattccacaggatcttataccaatatgcaaatctgctgctctttagagaaaaagtagttgttaaattctcgacaaattatagaagttgctttttttggcttttttttttttttttttagttttttttttctgtttatttcaggaatctttatggatagcagttaaccatttttctttggatttgtttgaatatttcaagaatatagttaatgccaggttagaaatttgctgattgaggaaataataataaatttgtttctgaaaatatttttataaataataatgcattttgcctgtgttaggtaatgacagttgtatcctttcaccatggataattgaataatcctgaaacaccaactggagagagtcataacttatttaaagagccctaatgtttacagaatatattctgttattaaacgagtatttgaaaaagatactattttgcttattgatgagagtaaaacaccttttcactttacatgcaggtactcaaaaattgtaaagcaggatgtcagtgaatttgaattctgaacgtcagtttgaagatggtaacatgtttagtatataaatcttttccactcaaaccatacattttaattgatattaataattaatatgaataattttataaagaccttcaaatttttttaagtaacattaggttccttattaggagagcatattattacgctgtttttagaagcagtttgacaaatagtgattgtgtttgtttttacaaatggtgaatcagttagaaaaataaaacttcagtttatttagccattatcatttacattaaaacaatatgtttttcaaataatataattggcatcaagtgatacactttttcatacttttagttttgttttaattcaaaatttataatagttgaccataatgctttatcttctttttcattttgctattttatgaaaaatcatggtcgtttttatgtcgtggcaagagtctacttgaaattttttaatatgaatttaccaatatcaaaggaagacactgaggactatactctatctaggaagatcatccaagctgtgccccacttaccttttagacttaaggttggtaagcatgttaacaacagaatagaactgcattcaaatgaaaaataaaatgtaagatccagcggacataggttactgtaataaatacattacattgggaattatttcttagtagtggcgcgaagagtgctgattctttcaacgctttagccagaatcatcttttcttttttgtttcccttttagtccaaaatacatgcttagattgatgattgatacacataattgaatcaagttgcaatgtttctgtcttacaccatgctcactgtttttttcagctgcctctggagacgtacaaacataccagattcgcacagcacccactagcactattgcccctggagttgttatggcatcctccccagcacttcctacacagcctgctgaagaagcagcacgaaagagagaggtccgtctaatgaagaacaggtacaaatactgcatttacttagattgttatgtgttaagtgtgtcttcacattctgctggatgtgtatctttacatctactggtaataggatctttgcattgaattttttttttccagcagaattaatggatcttgctaaattttctttatttaataagctgcacttataagatagctgtatgattatgggtcaatctttgatcgtggagtagttttctttcatgcagtttccccacaggagatttaatgcacaacttccctatgtctgcactccaaccagttagccaggttatttaaaaatggtttcttttcatgtatagtattgttcaagaagatcaagagtttcatatatgtatattaactgtgtgttaaattttatctatattaaatttacttgatataaagtaaatgtatggtggccagttcatgttttaatgaataatatctttactcaaaataataacattttaacacctaaagattcttcaaaaatatgttaattctaagaataccatgttacggacaaaaatcttaaaatatagtcttcaaaaaaatactacattcaaaatctgtgaaatgttggtaaagcaattctcagaaagtaactttattgctgtaaatgattttgccgtcaaaaacaataaaaataagttactaaatattggtttagaactttcatatagaagtgaccgagacaaacaaaagaaaatgaaaataaggttatgtaaaggtttaaaaagtttgaaattagtgaaagtatctcactgttcatcccaggatacttcaaacactgataaagtgaaagaagcagggcttccaagtcctagccctatccctccattttgggagaaggtattaaccttctgtacctcagttttgtaaaatgggattccagcacacacccaaagtattgttgtaagagtcaagtaagagaatcctttgaaagcactttgtaactgtagtgctctgttgaaatgggtttgtgtgtgtgtgtgcaatttcacagctcagatcagcttttttgttcctaaaatattcttagctgtcacaatgttagtaaattatatctaaactctgagaaatggcagagatttttctgggatattagaaaaagagttggaaacaagccaagtgactttttttttttctcccgagatgaagtcttgctctgtcacccaggcaggagtgcaatggtgcaatctcagctcactgcagcctccacctcctgggttcaagcaattctcctgcctcaacctcccgagtagctgggattacaggtgcccaccaccacgcctggctaatttttgtattagtagagacatgatttcactattttggccaggctggtctcgaactcttgaccttgtgatccaccctcctcggacttccaaagtgctgggattacaggtatgagccatggtgcccagccctcaagtgacttttatttgtgctccatccatctgtgattttgagtatttaagttttactaaagagaagcataaaagctgcattcataattcaaatatattttaaaatataaattaaaatctgtaaataaaaattaaaatattttcagtttttaaaaatgtttataaggaaacctttaacttaaaattagaagcaagtctgatcaagaagtctcaagcacaggctgagtagtaatatttaagacaacactgcttactaaagaaaagagttcaaagcaaacataggagcagaatcaaaaaataaatccttttgattataaaaaacaacagaaggacttctgtttatgtctatgtagtttggctgtgtggaacaaaatgtttacccccgttgactggcagaccaaatttcctttttgttctatttatttttctttcagatttatgaccactgccaccaacaagttaggaacagggcacacataactacagttcctaccaggctttgcttgcctgagatcttcagggaaactacccgacttaccatggactctttcataacattactttgcttagatatagttaccctactctttaaaaaggaaacttctcattgattctgccatagttccttttcccctttgttaccagattactgctgcttttactttttcagcctccattcactggaatctggcttctatgactagcataccgctcatatgtctataaaaaggtacaaattccctcccacttggcaaatctagtattttctttcatttaattttaactctatggagtatttgacactttcgacttctcattactctaaactcttccttggcttacttcacctggttttctggctacttttcaaatttttcctttgaaccttcatccatacccatgtatttcaggcattactttatatgctgatacttcttaattctgtatattctggctttgacctttctgccgagtgctatttattaagctccagtatatattattttattaattctacctacagtgaggtagaagcttatccccactttagaggaggagaaggtaaatatcagaaaattcaaatattttgccaaaggtcacacactttatgagattagtagaactgaaatttgaacccatatctggcaccaaaacctgtaaacatgctacttcactgattccagtatgcagccatcttctgctgtgcctctcaaaccagagcacatggcagtatgctagggatgtgtagcctaaggaggtgaacgtggagtgctttccttgaatgttcattttgctaaaatatttgagagaaataaaccttatttttaaggtaaaataagagttttaaaagaaatttataccagcagtggttttgctgcacccccagagtctccatatttggtttcctcttctagtgtggctatttcagtggaaaagttaagagaagcacactcctaagcatgctcactaggatgaatttcccttatgcacatcaaacacagcctatcttaaagtttgataggaaaagattgtaatccaaaaaattcatcactatccaaattgccatttatttcaagatgaaggtaagtggtaaacattctaaaagaaagtgtagacagctcttctgttaatttgtgttgctacagtaacaaccacgaatctcagtgtcttaaaatttcttcctcacttctgttacattttggcagctgcaggtcagttgctgtggctctccttcatgtgcccatctgggtctaggatcctgggctagatagagcagcacgtctttgagaaaagggcaatgcttttgaaagcatttgcttgattttggtgaacgttacatctactcgtgatctgttagccacagcacaggcaaggacaagcccaaagtcagtggagtgggaatgaactcttcctacaggaagtggagagtgaaaaattgtgaaagtaatacaatctatcacctttgcctttatgtaactttacattgtagggggattttaaaagcagattccctaaaggcagaagtaacaaaggaaaaggttaaatggatttgaccatataaaactataaaccccctatttaggaaagtaaaagataaagtagcaaacattttaacaaataatgtcagaagactaatgagttgagggatataaataggcagattcttagaaaatggatagggtaaaaaatttgaaaaattctaaaaaaattaaaatgtatttgatatgaattaaaatatatccattcaactatatacaactagccattaagagtaaataaaggtgtatttttattaagatgggaagatgttctcggacaaaagcaggttaccaaagagtatttacattactatcaggttttttaaatttattattacacaagtaaaacatgttcattataagtaaattaagaaacattacctaaaaattgaattacttctaatttcaccatctaaaatgttaacattctaaagtcagtttttttactcaaaccagtacaaaggtaaatatacatttttaatatatttttaagtaattttaaacttacaaaggagttttaaaaatacagagttccggatacccttcatccagctttctctaatcttagtatattacataaccagggtacatttatcaaaaataaaagtacattggtataataccattaactgaattatacattttatttccccagtttttttacttacataatccagtttgggtaccatatcgcatttaattatagtctccttcagtctgtgaaagtttgtttccttgtctttgatggccttgtaacttttgaagagtagtgatctgttttcttttagaatatccctcagtttgcatttgtccagtgttttctatggatagattgagataataggttttggggaggaattccacagaggtatagtgtgcctttctcataacatcacatccgggagcacatacataattggcgatattaactttgatcacttggttaaagtgctgtccaggtgtctccactgttgagctaccatttttctctttgtccagcccatattcaaggggaggagaattaaattccacctcctaaaagggagaatatgaaagaaatttgtggtcatatgttaaaaccaccacagtaattaggtgtattttagaagaagtacttggaggctatgcagatatattcttttctctttaaagttttgcccaccagttttagaattcatcagtaaatcttgtctacagtaattattactatttgctattctaatgggaattttgtatatctccatcccttctaatatatttaacaactgaattctataaacaagatttgtttcttctccacattatttattttatcaatacagacacatactttgggagttataatccaatactattgttatttattatgttgttcatattgttctagctttggctactgggatcttttataagtgtcttctgtgtccttttgacatgccccatttttttctttttaagcacatctttactttctgagactacaagattgtccaggttctcatcttgtgttttcccttccctagccttggaatgagctgtttttccaatgatctctagttcctttattagaaaatggtggccaatatggtgaaaccctctctctactaaaaagagaaaatttagccggggtggtggtgcacgcttgtaatcccagctactcaggcggctgaggcagaagaattgtgcgaacctgggaggtggaagttgcagtgagctgagatggcactactactccagcctgagtgacagagtgagactctgtctcaaaaaaacaaacaaacaaacaaaaaaaaatatatatatatacatacacacacacatacaccttcatatatgcacacattcttatttctgtatctttatatatagttggctctgttttccatagcccacattcaagaaaaaaagtaacaatataacaattttttaaataatacaaataaaaaagtaacctagtataacaactatttacatagtatttacattgtattaaatattataagtaatctagaggtgattttaagtatatagggggattcatataggttatatgcaaatataatgccattttatataagggacttgagcatctgtggattttgatactcatgagagttcctgggaccaatcccccacagatactgagggacaactatatacttaaataggaatacacactaacatatctgactctaagctttaaccacgtggctcattttagacttctctttgcctgtttgtaacttctttctccgacagaaacttggcttatatgtttgtttaaatctactatacatacagaaaacttgtaagaattgataatatgtaccattgtgagaaacaggattaccagttacagtgcagtatttatatacacttctttttgtttttggcctaatagtatttagcaaaagtgctgttttctaaagttacttcactctgctcctttctccacccctttcaatgaggttatatcatatgattgtagtacagttagatttgtcacaatcttcagtctgggattttctgacatccctaagtttttatccttaaatttgcatatacataagttcactctttgtgctgtatagttttatgggttttgatagatgcagtgtcatgtatctgtcaccacaatgccatatggaacaattatactagttaactaacagttatataatactaagtattctcttatatccctttgaagtcagcttcccccacgccctgaaaaccaatgaactgttttctacccttatagttctgcctattccataatctcttataaatggtatcttaaattataatttgtagccttttagatctggttccttcatctagcaaaatgcatttaagatttattgattttgttgcatgaatcagtagttgggacttatcccagataattccattttatagatatactgtgctttgtttattcactttgaatttcatcccagttatttccagttttagagaaataaagttactatcaacacataaaggtttttatatgaactttccattaacatgagtaaatatctaggagtaggctggttgcatgaaatgtaactaactgtatatttaactttttaaataaactgtccaattgttttccaaaatggctgtaccattttatattcccaccaggaatgtatgagagttcagttgctttgtatccttgccaaaacttgacattgtcaggtttattgtttgtcccccagctctagaactggtataatggatatcttatggttttaacttgcacttcactagtgactttttttttttgagacggagtctccctctgtcatgtcacccaggctggagtgcagtggcaccatgtcggctcactgtaacctctgcctcctgggttcaagagattctcgtgcctcagcctccctgagtagtcaggattacaggcacctgccaccacgtctgattttttgtatttttagtagagacagggtttcgccatgttggccaggctggttttgaactcctgacctcagatgatccacccacctcggcctcccaaaatgctgggattacaggtgtgagctactgtgcccagccttcattagtgacttttatgtgatttgctatctatatgttttctttgatgaaatgtctatttagatcttttagtcatttctattgtttgttttcttttgttttcagagaccttttttccaaatcctttgtcagagcaagtattttctttcagtctgcagctttttctttaattttcttaacattatctatcttttgcagagcaaaaggttgccattttgatgaggcccattttatcagttgtgtccttttgtacatcatgcttgtggtatttatgaattttctgcctggataggcccagcccacttacacacgtctaggagcctatggacaggcccattggtgtccacatacatcatctagggtgcctgaggattggttggtcctgcccaccagcacccactgtctggaatcatgaaggccagctcgctctcactatcacattggccacccagaggcctgcagataggcctgcctggcctgctgccaccgtaaaggcctttgtgtccacataccagccaacctgatgtccccatcctcagcaaagctttatcacagcctccactgacaaccgaagcctaagccactgaagaaatcatagatgccatgagagaatcatagataccaccattgatgacagtaaaagaaatcatacagagacaacacatctgaacccacctagaatcaaatccagagcaccctacccagctaacactacagctacatctacagtaaaagtctttctctacaaaagccagtccataaaattggataaagcagcagttgcacagatatcaagataaggacacaagaaacataaaatactgaggaaacacgatacctccaaaggaacacaataattttccactaacagatctcaaagaaccaggtaatcaataaaatgcctgaaaaggaattgaaaataatgatcttaagaaaactcagcaagaaacaacagaacacagatagacaatacaaataaatcaggaaaacaattcatgatctgaatgagaaattaaagaggtaaatagttaaagaaacaaattctggaactgaagaatttaataaataaaaaacagtcgagcagaaagaatttctgaactttaagagagaggtcttttaaaataacccagtcaaacacacactaaaaaggatgaagaaagcctacataggacatcataaagcaaacaaatatttcaattttgggagtgccacaaggagaaaatataggaaaaggcatagaaaacctatttaacaaaataatcactgaagacctcccatgtcttgagagagagatatatatccagatacaggaaggtcatatgtactaaaacagtttatccaaaaaggcctttctaagacacactattttcaaactcaaaagtcaaaaacaaagaaaaaattcttatggaaccaaaaacagcccaaatagccaaagcattcctgaactaaaagaacaacatggaaggcatcacactacctgacttcaaaatatactacaaagctatagtaaccaaaacatagtattgatataaaaacacatagaccagtggaacagaataaagaacacagaataaatctacttatttacagcaaatgtgccaagaacatacattggggaaaggacactctcttcaatcaatggtattgggaaacctggatatctgtgtgcagagaatgaaactagatacctatcaccatacccaaaaatccactccaagtggattaaatacttaaacataagaccccaaactcttagactactagaagaaaacatgggggaaatgcttcctgacattagacttggcaaaaacttcatggctaagactccaaaagcacaagcaacaaaaagaaaaatagttaagtggaaatattaaactaaaaagcttctgaacagcaaaggaaacagagtgaagagacaacctgcagaatgggaggaatatttacaaactgttcatctgacaagggactgataaccaggatatataaggaactcaaccgaacaggaaaacaaacaaaaatcctattaaaaagtggacaaaaggtctgaatagacatttctcaaaagaagacatacaaatggccaagaaatatatttgaaaagctcaacattactaattgtcagattaaaaccacaatgaagtatcattagatagaatggttattatcaaaaagacaagaagtaacaaactgatgaggatgcagagaaaggtgaactcttcctctttgtgttaggaagtatcattagttagaatggctataatcaaaaagacaagaagtaaacactgatgatgcagagaaaggtgaactctttctaactctttgtgttagaattgtctcagtgttgatgagaatgtacattaatgcagccattacggaaaacggtgtggaggtttctcaaaaaaactaaaagggccaggcgtggtggctcacgcctgtaatcccagcactttgggaggccaaggcgggtggatcacaaggtcaggagatcgagaccatcctggctaacacggtgaaactccttctttactaaaaatccaaaaattcagccaggcatggtggcgggtgcctgtagtcccagctactcgggaggctgaggcaggagaatggcgtgaacccggaaggcagagcttgcagtgagccgagatcgcaccaccgcactacagcctgggtgacggaacgagactccatctcaaaaaaaaaaaaaaggaaaaagaaaaaaacacacaaaaaataaaagaaccactatatgatctagcaatcctactactgggtatctattcaaaagaaaggaaaccagtattgcatcacttcacagtagctaagatagggaatcaacctaaatatccatcaacatatgaatggataaagaaaattgcagtatatatacacagtggtatactgtcaagccactaaaaagaatgaaaatacatcatttgtggccatgtggatgaacttgggggacattatgggttatgcaaaataactcaaacatggaaagataaataccacatgttctcactcatgtgggagctaaaaattttttgagcttatggaagtagagagtaaaattgtgggtattagagcctgggaagggaaggtgagatagggagcatggggagaggttggttaatggacacaaacttacatctaggttggtagaatgatttctggtgttctgtagcaccatagggtgaatatggttaaatacaacttgtgtattttcacaaagctagaagtgaggattttgaatgttcacaacccaacaaaatgataagtttgaggtgatggatatgctagttaccataatttgatcattacatactgtatacacatattagaatattactgcatctcataaatgtctacagttattttatgtcaactaaaaataaaaaggaaaaaagaattctttgcctaaatcaatatcacacagacttcgttttcctctaaaagtgttatgttttatgttagagttttatatttagatctataattccctcctgagtttacttttgtataaggtgtgaggatgtgtcgagatccatttttttatataggaacatccatttgttccagaccatttgttgaaaagactattctttctctattgaattgcccttgctctttttttcaaaaattaattgaccatatttgtgtgagtctgtttcttggatatctttccattgatctttgtgtctgtcctttagccaataccatgttgccttgagttctgtataataagtcttgaatttgataatgtgagtcctccaactttgttcttaaaattgtttggctattctggttcctttgcactttaatgtatattttataatccgcttgttgatgtctacggaaagtgtgctagaattttagttaggattgtgttgtgtctatagatcaaattgtgaagaagtcacatcttagcaatacttagtttttgattccatgaacacaatataatctaatcagcacatagatcctgtacatatcttactggatttatacccaagtatgaactgttttctggttttttttttttttgtgtgtgggggtggggggacatgtgctatttgaaatggtatattcaattgttcattgctggtatatggaaataaaattggcttctgtatatttaccttttatcctatgaccattctaaatttacttattagttctaggagctttgtcggggggggtgtagattctttgggattctctacacaaattatcatgtcacctacaaatatggacagttttaattatttctaatctgcatgccttttaattttttttccttattgcaatgtctaggacttgtgctatgatgttgaataggagtggtgagagaggacatctttgccctattcttgatcttagggggtgtattagttttctattgctgcatgtcacaaactgccacaaacttactggcttaaacaacacaaatgtattgttttccagttctataagatcagaggccttcattggatctcactgggctaaaatgaaggtgtcagcaggactgcattccttcctggaggttctaggtgaaaatgtgtttctttgccatttctagcttctagaggccacccacattttttgcctcatggccccctttctccatcttcaacatagtgttatctctgttccccttctgcagtcacattttcttctgctttcctgttctacttttaagaatgcttgtggtttaactgggcccactcaagtaacccaagataattttcctattttaaggtcagctaattaacaaccttaattccatctgcaacctaattcccctttgccatataaggtaacatactcacacactgcagagattagtacatggacacctttgggggaccttaagtaatgtaatagctgtagggtctctgtaaaaagctcttcattacatttttttaaaaactctctttgatttttagtttctgagagttttcatcataaattgttgtttaatcttgtcaaatgcttttccagaatctactgaggtgatcgtgttgtttctcttatttggtctgttattagagtgaattacattcatactccaattttgagatatgcatgcattcctgggatgaacccccaattggtcatgaagtatcatttatacattgctggattcaatttgctaatattttgttgaggatttttatgtctacgtttatggctaatatgggattttagtttctttgccgtgagtttgttattagggtaatgctgaccttataaatgaggtggaagtcttcccttcccttctctttttctggaagagattataatatttgtattatttaagccttatatggttggtagaatttgccagtgaacccacataggcctggagttttctattttgagaagttttttttttttttttttttttttaatagatacgggatcattcagactatttcttcttcagtgagttttggaagtttgtgtttttaagacattggtccatttcttcaaagttatcaaattcatgaccatagagttgtttgtagtgttagtttattattcttttactgtatgggatgtcagtagggatgtccccccgcttcattcctaatattgttaatttttgtctttcctctctctctgtattcgccacccctaccccagccaccctcctttttttttaagtctggctaaaggtttatcaattttgttgattgtttttaagcaaccaaaattcttagtttcattagttttctccttagaattgtattgatttgtactctgatctttgttattttctcctgcttgctttggtttttttagttgttctctttctagtttcttttttcattaactgtaaattttttcctattaatatatacctttgtcttatttcagtttctaagaaaacttctgcaggtatctagtttcttaagacaatagttggatcagtttggcaaatcttttgtaaagggccagatagtaaatatttcaggctttgcagaccaaatgatctgtcacaactactcaactctgccgttgtaataccaaagcagcgatggataatactgactgtgttccagtaaaactttatttacaaaaacaagcagggaagcaaagtttggcaacccttgatataaataattgatttaagccctttttttctaacataagtatttaaggctgtaaatttccattttagcattggtttagctgtgtcccacaaattttgggttgtcatttttatttgcattcagtttaaaaatttttttatttcctttgagacttcttttttgacctatagacttagaaatgtttaatattcaatttccaaataatcgaggatcttcccaggtgttttatggcccaagaacatactttgtattatttttattctcttaaattatcaagtatcatatcaatgtcagataggtgtagttgattatgtcattcaggtgtactgtatcatttttaattttctacttattctgtcatctctgagactctacttagtctatcatcactgacaggagagtgtattaaggcattcatccctttgttcatttctcctttcagttctattagcttttgcctcatacaggagaattacatcttccatttagaattatgtcttcttagaggatagacctctttattattatataatgtctttctttatccctgacaatattccttcttcagaagaatgctttgtctgatactaataaaactaccccagttggtttgttttgtttttgtttgttgagacagaatcttgctctgttgcccaggctggagtgcaatggcagtggcacaatcttggctcactgcaacctccacctccctgattcaagtgattctcgtgcctcagcttccaaaatagctaggattacaggtgtgcgccaccacacccagctaatttttgtatttttagtagagacggggtttcgccatgttggccaggctggtctcaaactcctgacctcaagttatccgctcacctcagcctcccaaagtgctgggattacaggcgtgaaccaccattcccagcctccttttgattagtatttgcataatatatatccttctccatcctttttcttctctgtttatatttgaagtgggattcttgtagatggcatatacttaggtcttccttttttactgagctacatgccttttaaatggtttagatcagggattggcaaactatggcacaagtagaaatttttaattttacatttatatatttaattttcaattgtcttcatttccttatataaatccatgttttaatctattatatttctgcctcaaaaactcttttttacatttcttagaaaatagatcttctggcaatgaattccctctagttttgtttgaaaaagtttatttcatcatcatatttgaaagatatttttgctgggtatagaattctgggtttatcatttttttctttgaagtgacagactttaaagatgtcacttaaggctgaggtaggcggatcacaaggtctggagtttgagaccatcctggccaacatggtgaaaccctctctctactaaaaatacaaaaaatgagctgggcgtggtggcacacgcctgtagtcccagctactcgggaggctgaggcaggaaaatcacttaaacccgggaggcagaggttgcagtagcccagatcacgccactgcactccagcctggcaacagagcaagactccatctcaaaaaataaaaaaagatgtcactttttttcttatgatttaaatggtttctgacaagaaatctgtgtgtatataatgctccttttcttcctctgcctctgatttgcagcaattcaaatataatatgcctagggattttccctctcttccctccttcctcccccatccccaccatatttatcttattcttcttgtgtctgtggcttggtgtctgtcattaattttagaaaattcttggccaggtgcagtggctcacgcatgtaatcccagcactttgggagaccaaggcaggcggatcacgaggtcaggagattgagaacatcctggccaacatggtgaaaccccgtctctactaaaatacaaaaaattagctggccatggtggcgcatgcctgtagtcccagctgaggctgaggcaagggaattgcttgaacctgggaggtggaggttgcagtgagtccagattgcaccactgcactccagcctggcgacagagcaagactccatctcaaaaaagaaaagaaaattctcagatatactttcttcaaatatttttccgtcctgtcctccctcttcttctgagattacagttataaatatgttaggatgttggagacggtcacacagctttttgttgttctgtcttcaagttcactgattgtttcctcagctgtgtcagttttacttaccagaacatcaaacatattctttatctccatttccatttgattccttttcataatttccatgccactgctgaaataacccatctgatcttacatgttatccaccattcctattagagcctttaacatgttagtcatacttaaaatttgtatcaaggctgggtgcggtggctcatgcctgtaatcccagcactttgggaggctgaggcaggaggatagcttgagcccaggaattcaagacctgtttggaaaacataggaagacactgtctctacaaaaaataataaaataaattagctgggcatggtggtgcatgcctatggtcccagctgctggggaggttgaggcaggaagatcacttgagcctgggaggtcaaggctgcagtgagccctcattgtgccactgcactccagcctgggcagcagagcaagaccccatctcaaaaatgaaaaatagaagcaaatgctacttttttctgaattgatagttacatgaggatgaagacatcaatggaattacaatgtactgccatttggagttacctaaaaataataatagctaacacatcttcaacatgctaggcactatattgtgtgctttacatatattaactcatttgatcctcacaaacttttttttttttttttttttgagacggaaacacctatcacccaggctggagtgcagtggcgctatcttggctcactgcaatctctgcctcctgggttcaagcgattttcctacctcagcctcccaagtagctgggattacaggcacctgccaccatccccagctaatttttgtatttttagtagagacagagtttcgccatgttggccaggctggtctcaaactcctggcctcaagtgatctgcctgcctcagcctcccaaagcgctgggacctgggattacaggggtgagccaccacaccagccctcacaaaccttttgaggtagaaaatattaccatgtccttttttacagtcaggaaattaaggttaagtaataagattgtggcccttgaccacacagagctaaaaaagaatttactggtttagattgagcagcttgctaaagaataatttttaattatttttaatctgtgttagatttttttaaataatttcatttttaattgtggtaaaaaatataacaaaattgaccatcttaatgagttttaagtattcagttcagtcatgttaagtacattcatattgtggtgcagtagatttccagaacttgttcatcttgcaaaattgaaactctgtacccggtaaacaacaactccccatttcctcgttcccccagcccctggcagccactaatgtaagtcctgtttctatgaatttgattgactttagatgcctcataagagaaattacacaatatttgtctttttgagactagcttgtgtcagcataatgccctcaaggttcatctacgttttggcatgcagagggccttcctaaggctgaataatattaatattacattgtatgtatataccacattttgcttaccactcatctgctgatggacatttgggctgcttccacctcttggctattgtgaataatgctgcaatgaacatgagtgttcagatatctcttcaataccctgatttcagttcttttggatctgtagcaaaaagtgggattgctggatcatatggtaaattttgttcttaattttttgaggaacctccattccattttccatagcagctgcaccattttacattcctaccaacagtacacaagagttccagtttcctcacatcctcatcaacaatgggtattttctgctggtggtggttttttgatagtagccatcctaatggttgtgaggtgatacctagtggttttgatttgcatttccctagtgattagtgatgttgagcatctttttttttttttttttttttctgagatggaggctcgctctgttgcctaggtagagtgccgtggtgcaatctcggcttactgcaacctctgcctcccgggtttaagtgattctcctgcctcagcctcctgagtagctgggactacaggcacccaccaccatacctggctaatttttgtatttttaatagagatggagtttcaccatgttggccaggctggtcttgaactcctgacctcatgatccacccgcctctgcctcccaaagtgctgggattacaggcatgagccaccgcacccagcctatattgagcatctttttataggccatttatatatctctggagaaatctctgttcaagtccctatgcccattttttaaattgggttattttgctgttgagttcaaaagttctttatatattctagattttttttttccctttcttttgagacagcatcttgctgtctcccaagctgtggtatagtggcatgatcatggctcactgcagcctcgacctcccggcctccaacctcagcttcctgagtagctgagactacacgcacacaccacctaactaatttttaattgagacaggttcttggtttgtcacccaggttggaatgcaggtggcaggatcacggctcactgcaacctaagacctcctgggcttaagcagtcctcccacctcagcttcctgagcagctgggactacaggcatgtgccaccacacttggctaaatttttaaaaatttttttttagagacagggtcttaatatattgcccaggctgttcttgaacacatgggttcaagagattctcccacctcagcctcccaaagtgctgggattataggcgtgagccatacaccttgcctattctagatcttaaccccttagcagatatatgatttgcagatatttcttctcattctgtaggttgccttttcactatttattgtctttcgatgtgcagaagttttttagttggatatagtcctatttgtctatttttgcttttgttacctctgcttttggtgttgtatttaagatattactgccaaatccaatgtcagagagtgttttcttctagaagttttatagttttaggtcttacggttaggtctttgatctattttgagttaatatttgtgtacaacataaggtgcggcccaacctcactcttttgcatgtggatatccaggtttcccagcaccatttgttgaagagactgttagatttttttaaatgccctgaaatgattagtttgtaagattttctatttaaaggattgttacacattgaaatttagctttaatgttttcttagttattgatatggatagaatttcaagttttgcaggaattatgcagaatattttaattaatagtaagatgtaatttttaagtggtcatttaggtcttgtttgtttatggagttgtttttttgtttgtttctttgagacggagtctcactcttgtcactcaggctggagtgcagtggcgcaatctcagcttactgcagcctctgcctcccaggttcaagcgatgcccatggctcagccttccaagtagctgggactacaggcatgtgccgccacaccccgctaatttttgtgtttatagtagagaggggtttcatcatgttggccaggctgatcttggactcctgacctcaggtgatctccctgccttggcccccgaaagtgctgggattacaggcgtgagccgccacgcctggccagattaaaattttaatataaggtaatttccaagtaattctgtatatcttttccaatgcttaatatatactaaaatgttggttgctgtgagctatttctttaaaaaagaaaaaaaaaaggtaatccaaaataaatatgtggaaatcatttgcataatttttcccgtcctcttttgcttgtagggaagcagctcgagagtgtcgtagaaagaagaaagaatatgtgaaatgtttagaaaacagagtggcagtgcttgaaaatcaaaacaagacattgattgaggagctaaaagcacttaaggacctttactgccacaaatcagattaatttgggatttaaattttcacctgttaaggtggaaaatggactggcttggccacaacctgaaagacaaaataaacattttattttctaaacatttctttttttctatgcgcaaaactgcctgaaagcaactacagaatttcattcatttgtgcttttgcattaaactgtgaatgttccaacacctgcctccacttctcccctcaagaaattttcaacgccaggaatcatgaagagacttctgcttttcaacccccaccctcctcaagaagtaataatttgtttacttgtaaattgatgggagaaatgaggaaaagaaaatctttttaaaaatgatttcaaggtttgtgctgagctccttgattgccttagggacagaattaccccagcctcttgagctgaagtaatgtgtgggccgcatgcataaagtaagtaaggtgcaatgaagaagtgttgattgccaaattgacatgttgtcacattctcattgtgaattatgtaaagttgttaagagacataccctctaaaaaagaactttagcatggtattgaaggaattagaaatgaatttggagtgctttttatgtatgttgtcttcttcaatactgaaaatttgtccttggttcttaaaagcattctgtactaatacagctcttccatagggcagttgttgcttcttaattcagttctgtatgtgttcaacatttttgaatacattaaaagaagtaaccaactgaacgacaaagcatggtatttgaattttaaattaaagcaaagtaaataaaagtacaaagcatattttagttagtactaaattcttagtaaaatgctgatcagtaaaccaatcccttgagttatataacaagatttttaaataaatgttattgtcctcaccttcaaaaatatttatattgtcactcatttacgtaaaaagatatttctaatttactgttgcccattgcacttacataccaccaccaagaaagccttcaagatgtcaaataaagcaaagtgatatatatttgtttatgaaatgttacatgtagaaaaatactgattttaaatattttccatattaacaatttaacagagaatctctagtgaattttttaaatgaaagaagttgtaaggatataaaaagtacagtgttagatgtgcacaaggaaagttattttcagacatatttgaatgactgctgtactgcaatatttggattgtcattcttacaaaacatttttttgttctcttgtaaaaagagtagttattagttctgctttagctttccaatatgctgtatagcctttgtcattttataattttaattcctgattaaaacagtctgtatttgtgtatatcatacattgttttcaataccacttttaattgttactcattttattcactaagctcgataaatctaacagttactcttaaaaaaaaaaaaaaaagactaaggtggattttaaaaattggaaactgacataatgttaggttataatttctcatttggagccgggcgcagtggctcacgcctgtaatcccagcactttgggaggccaaggtgggtggatcacctgtggtcaagagttcaagaccagcctggccatcatggtgaaaccccatctctactaaaaatacaaaaattagccaggcgtggtggctggcgcctgtaatcccagctactcaggaggttgaggcagcagaattgcttgaacccaggaggcagagggttgcagtgagccgagatagcaccattgcactccagcctgggcgactccatctcaaaaaat

SEQ ID NO: 36578 - DNA, 42883 bp, Homo sapiens
ctcctcgccttcctccggctcagccgccgcgccgccgggctgctccttcttcctcctcgggcgcccgcggcgatgttcaaccgcgccgtgagccggctgagcaggaagcggccgccgtcaggtaagcggcttcgggggcccgcgggctcggggtcggggcgccgtttcgcccgcccggcctcctgccctccctcttgtgctcgggcgcggctcggtggtacctcccagactggagccccggccgaccgcaccacctctccccgctgggtaccgcaccttcgcggtcccagccgcgacgggagcgcagagctcctccgggagccccggggaggaagtttggctgaaagaggaacagccgcagttttctttttagtgatggtctgggagaaaaaggagcgccccaaatctccaaactttggaggtgacatggggctccagattccgaaagcggaacggcgcgcgggcttctccctccgtgacgctctccgcctccgctgcgggcgtgggtggaaggatgccgagcgcccgggggagcacggctggacccgggcatccgactgggcccctgggcctggggcgtcgggggccttcgcttctgccgcgaggagccaaaaggtgggatcgcgagggtggcggaaccccaggatggagaagggcacttctgcggtccgagccagcgaagttctgacgttacgaaggattcgccttggccgtcactttgggccagcctgagccacgatctcgggcaacttgataggccaaagaccccacggtgaaggtggagccgtgcccttgattccggtccttccacccttttgctcatcacaatagctacgacctgtgcaggcctttgggtgcgccaagggctttgtccaccgcgttgggtgaactctcccttcacccctaggacaacccggtgagtgaggagggagcggaagccaggcgctgttaggtaacttgccccagtcacactccgcaggtgatggggaggctttcaaacccaggttcccctgactctgaagttcgggggctttgccgggcttcccacgccaagattcacttctgcttggcgctcagagtcccaacgcgttggtgcatttcctttctgctcctggtattttatgagggacattgtggtttagagactgggaccagactggctggatccgaatctcaccttcgccatattcaccagccgtgggacctttctgcagaatgaggttctgcacagtgggaataacagtagctactcgccttttaaagtacttaattggaacctgtcttccatccatcaggttttgcaaattattgtatttaatatgtaggatttcatagggttgttgtaatgatcttacattgttgcccggcaagtactaagtgctccgttagcgttagtggtcatgtaaacctttttgtgttgcatgtgagtcaaagaattcccttgtgggtgttaatgttaaccagtctctatggttggcacaggcctgtggagcgctgctcagagcctggactcgaattaaactcttggttctaaccttgactctgtcattcagcaacactgggcaaattacttgatctctctgtgcctccgtttcagtgatgtgctggagctggctcaaactggcttgcaagagccagttgccaaatattcaaaaagtttggaaactggttgtaaaccataggtagcttgaaagtagttatgatgggatatttacatcatgaaaatcaacaaagctaaaaatgaaggcttcattttgactcaggagagctgatgttccagcacctttctccacctgcaaagtgggtttcatagggttatgggattaaatactcaaaaccatatgaagcccctagtacaatgtgtggcacataataaaagtgtaataattagtagcttttctcccttttgcctgttataaatagagctgctatgaatagccctgtacgcgttacttattactttagattgcttttgggttgaagactgacagatagaaccattgtatcctgggagatacatggatttggggtgattttgcgtgtagccaggttgcaccccaaaaaggctgaaggcagttttagggaacaaattatttcagggcaacaaattttaaacctcataaaatgtggttacatcactgacagaaaggtcggtctcaggccgggctcagtggctcacacctgtgatcccagcactttgggaggctgaggcaggaggattgcttgagcccaggagttccagataagcctgggaaacatggcaaaaccccgtctctacaaaaaaattaaaaaattagccaggcatggtgatgcgtgcctgtagtcccagctccttagacggctgaagtgagaggatggcttgagcctgggaggttgaggctacagtgagcttagatcgtgccactgcacttcaccctgggtgacagagtgagatccaaagaaaaggaaagaaggaaggaagggaggaaggaagaaaaaaggaaggaaggaaggaagatcagccactaaacatcatggattggtactggatgcctccactccaatagcctgattttctttggaattgtaggtgtagggtctttccccattatggaaaataacataagttcttgcctgactggtcatcaccacccagccgtgtgaaaagaagaagcctagtgagaaaggggtcatttgggcctgtgggccgaggtactgagaagacagccaagtgatttttgggaccctgtacttaattttttttttttttttgtaattttgaattatttttcttaaagaggatcctcaaattgtataaacttcaggctccacaaaagccagagctgctcctgcaggacccctgatttggacctggctgtggtcctgcctcccccagtaccttctattttacacttttcctacctttcagcaaaatctcactggagacactgtctttccgcggaggattttgagttcctaacccctccttccaaggttcagagtgggatttccttattcttcctgaggtttctcaaagtgtgttccacccgtcctgtgggttcaggagggctttgataaagtgcagcttctcaggccttgcccagactgattcagtgttggggactgtaggtggggcttgtctttgacaagcaccccagagaattctcaggccagtgaaatgtgagggtcccccaacgggattctgtccactcaccctgcccagttatcaaccttgcattgttgatagctgaaatatgcccatctgagatgccaagctgaagccacccgactccctacccctgcagctgcacccaggggtgacctctcaggggaattcccaccctgccgggcaggtttcggccgtcccctcgggcctgtcatacaggatccgattaaacccttgggaacagttttaagtttatggctgggcttgttttatttaaagatgacagtttgcacagcaatttaatgtctttgttttaacaactcggcagcagggtagccttggcagctgggacaactttctctgcagaatatcactggcccaggcctggggggacagaggggccagccgaagggccttgttttctataggtgtggtcagcttatgagccagttgagcctctgggacctgctctgggcaccacctagtgcagcccgtagcctggtgggtgtgaggtgctcacggtgttttatctctgttggctgatttgtatttgatgtgatgtctcctttcttcatggttagaaaatgtagatgcctggcatggccatttcctagggcttcctgggtgaactgagtcacttccctccctgggtggagtgagtccccagatgctgggctctgggaacctgttgcttaaactgcactaaatttatgcccccaagtttcttctgcttcccccagatagttctttgctgcagcagcctgcgggtggcagcaggagcggagggggccccagcaggcagcagcagtggccccttgataagagctgtcaggcggcatccgctggagtgagacagtcccttgcagacttgtggggacaaatttcccttccaagcaagttcccatctgtcaagagccctgctaagctccctcaggtccaccttgctgccccactgcctggtgggggaccccttatctgactgagtccttcccagccccatttttcctgctccctactctacccctggagggactggacaatactccctctgtgcctttgctcccccagctgtcctttgtcctgtcccaaagcctgggtccccctgctccaacagacccacccttctaggcctcgctgcctcccaccctccatgcttgacagagcagcttgtctgagcaggagggaaccatttcatttctccctcaagggctgcagaggccactaaggggcagggacttgtccggaggcacccatttctgaaggggcagagaactcaagtcttggacccaagtccacggccacctaaacacaacaaccatttagcgactttgctaaaatatatttagagaatgaatgtggagctgacaactttcctcccttcctccatccctctctcctccactccctccctcccttccttcttccctccctccttccctcccttccttcttttctgtagtcaggacattagaaacaaacaaagccatcatcaaacacctttatcatttcacacagaaaaggacattttaacacccccaatagtaggaaagatataatctcaggtaaagagctgtcctgatccacagaatcttgtagaggttgtcgctcctggggagagacactgggcacctgagggacagaggtgtgaggaagactattacaccacactcccttttgtatgtcctgcactgtgccccacgtaaagaaacatagtgatctatttcaaagcaaaagcaaaacaagcaacccaagactgtccttcctctaccagcacagttcacttggtaaatatttcctagtcttccttctcgtttatttgtggactagtgaagaaaaccgcctaccagcccgtggcactgtgggcaggcggccacctgggaacccctggcctcctctcctcaattcattttaagttctgtgagaaaatagcccccacctttcatttctggcatctttctctgtgtttttctctccagccagacaacctggggttgcatcccagctcatccacttccttgcttgcttctttgtagcaaattatttatcgtctctgtgcctcagtttcctgatctgtaaaatggggcccttgaggaaactagcttgcaaggattgttgcaaagtttcgatgggatatagtaagtgctcagtaaatgtcaacttttctttttcttttttttttttttgagacggagtttcactcttgttgcccacgctggagtgcaatggcgcaatctcggctcacggcaacctctacctccggggttcaagccattctcctgcctcagcctcctgagtagctgggattacacgcatgcaccaccacgcctggctaattttgtatttttaggtttctccacattggtcgggctggtctcaaactcccgacctcaggtgatctgcccgcctcggcctcccaaagtgctgggattacaggcgtgagccaccacgcctggcctcaactatttttaatagctatccgtcctcctttctgtgccctctacccttagcctggtgcctggcttggctcattccttagaaaatgtttatcactataaaatatatacttgagtgccagacatcatgctgaccctgaggaagactcagcccttgctttcaagaaatgcaccatccacctgactgaccctggaggaaaaagtcatttactttgcctcgagggagggtgcgggacagattgaggcagagtaggagggtgagggcagctttacgcagaaatgtcaggccccagaggacacacaggggcttctggaagtggagaaaatcgatgacagggtctttgttttcgggctagggctgctgggccattttcttttttctggactttgcctagaaagtggagagtctagggaggctacaaataacagtttggcgttcttatttccttccctctagtagaaactggaaaccagtggccatctgttgtttagtccacttaaaagaggatgttgaggcttgttttttcttcggacccaagggtgctcgggagccctccagtctctgcctttctcacacaaggcgtctctgggaaggcagtggattgttggtctgcgtggaacttctcaggtggacaccagagcatggaacgtaaggaatcgcccccacccctttccatgtccgcagtttgcctgtcgccttggccctgggcggggcaggggctgggaagagtgtgctgtgaggacacagaggtgcacaggtgactgtggaagggccagtaggagcacttggctttctgtgagtcccgaaccctcgtgtgaaaacgccacgatgccctttctgagtggagccaaccctctgccaccagctttcctgctcctgacttggatgctggctattactatgattattgaaaaacttttttcacttttgatgttatttcctgctaactgcagttcaatcagatctctctggcaagggaattgcatgcaggtggggtagttattctcagcagctagatactggagccgataaacacttaagtaatatttagataccatgtttccatgacccagtttctctggagccttacacagatcaccagttgtaacaaaatgactctctgattctaaattgggaggactttttaaaaaatgtactacacttgatgtggtataggtgacaagaggttttaaataagttttgtggggtgtgtactttctttgaaacttcattacaaagtagagtattttaaaggagtacagtgtgtgtgtgcacgcctgtgcatgtgagttgtaccaaaccactttggaatttagggttaatatctctgccttttcctggactcgaatgtttaatagtctgtgagtttgggggagtacttaggacaaaccttctgaggatgtaagttgactctgctgttgaggaaactggatagtgagatattactaaaatattatttgacttggagaaattgtctatgcaggatgattacacagaccttcctgcaaattaacagcagaaatccatgctgtgagcattcatctccgatgagtgttacagatgccttttgagtatggatttccaaggaattaatgtctggagaaggtctctgttagatatgacatcatagcatctataaataatgcatcataaaataagctgcaagcaaccagccccagccatctgcactgtgatgcttcacccatccttgaaataatggcttttactgacgccagaagccacataggacagcataatcataaatggaaaacgcatatacattgtgtttgtgtgctggatgattccacctggtcttatgtgactttttttttttttttttctgcatggattggactcttaacagttttctgttttttccccaaagtgtgattgttcttggtctcttaaaggctgttgtgttctggcctctgtgagtataaagatcagcagatataaaagctaaaaatggcagtagagcccttggtaaagagcgtgtactctggagcaggagtacctgggtttgggccgtgatttcccattttctagctgggacgcttgtaagttaccgtgcctcagtttcttcgtctgcaaagtggaaataatactaaccacgtcagtaggttattgtgagaactgaatcatttaattcaggtaaaagcttggaacggtacccagcacactgtaaatcatttgcaagtttttcttttttctttttatttttttgagacagagtcttgctctgtcaccaggctggagtgcagtggcttgatctcggctcactgcaacctccgcctcccaggttcaagcaatcctcctgcttcagcctcccgagtagctggaactacaggcgtgcaccaccacacctggctaattttttgtatttttagtatagatggggtttcagcacattggctaggatggtttcgatctcttgacctcgtgatctgcctgcctcagcctcccaaagtgctgggattacaggcgtgagccaccgcgccaacctttttttttttttttttttgagacagagtctcgctctgtcacccaggctggagtgtagtggcacgatctcggctgactgcaacctccgcctcctgggttcaagcaattcttctgcctcagcctcccgagtagctgagactataggcacgtgctaccatgcctggctaatttttgtaattttagtagagacagggtttcatcgtattgttcaggctggtcttgaactcctgacctcgtgatccgcctgcctcggcctcccaaagtgctgggattacagacatgagccacagtgcctggccttttttatttatttatttatttatttatttatttatttatttatttatttattttaagacaggttcttgttttgttgctcaggctggagtgcagtggtatgatctcagctcactgcaacctccgcctcccgggttcaagtgattctcctgtctcagcctcccgtgtagctggggattacaggagtgcaccaccatacccggctaatttttgtattttttgtagagacgtggttttgccatgttgcccaggctggtcttgaatgcctggcctcaagtgatccacccacctcggcctcccaaagtgctgggattacaggtgtgagccaccatgcctggcccatctgaagtattaaccattattattagctaatgacagagtagtctgaaaataaatttgctgaaaaatacgtattttgcatgcaaaaaatttgaagatctaaaatgacgtaaagagcccaggagctaagaaaacaaaatgaaacaccaaaaacttttattcattgcaaaaatgttttacagctgaagtaaacaatgacaacaaaaataaaacagcatgataaaattgaaacaaacaaatatcacaagcaggtcttccctagctggagagatcgtaaagctgctggagaacatgcctgacattttttccacctattcatgtcagtcctgctttcttgtgtaatctgtctgaaatggaaacttttatcaatgaaaagggatagaagaatattgcaactttgtggatccaggtaccagaagttgggcagctgggaaatcttggttttgctttattcttaagttcagaggtaaacctgctttgctattgagaaagagtatttatttcttctaatattactggactggttgtaacatttatttatgtatgtatatatgtatttatttacttacttactttaacctgcttccccttccaccttggttgttaacatttttttctttttttttttaaacttttttccctaagacggagtctctctctgtcacccaggctggagtgcagtggcgcaatctcagctcactgcaacttccgcctcccgggttcaaacaattctcctgcctcagcctcctgagtagctaggattacaggtgcgtgccaccatgcccggctaatttttgtattccatgttggccaggcaggttttgaactgacctcgtgatctggctgcctcagcctcctaaagtgctgggattataggcgtgagccactgtgcccggcctcttttctttttttatgattttttttttttttttttgagacagcgtctggctctgtcacccaggctggagtgcagtggcgcaatatcggctcactgtagtttctgcttcctgggctcgagtgatccttccacctcagcctcctgaatagctgggcctacaggcccataccaccatgaccagctaatttttgtggtttttttggtttgtttgtttttgttttattttgttttgtttgagacagagtcttgccctgtcacccaggctggagtgcaatggtgccatctcggctcactgcaacctccacctcctgggttcaagtaattctcctgcctcagcctcccgagtagctgggattacaggtgcgcaccaccactccaggctaattgtttgtatctttagtagagacagggtttcaccatgttggccaggctgatctcgaactcctgactttgtgatctgcccatctcgtcctcccaaagtgctggtgtgagttgccacgcctggcctaatttttgtattttttgtggagacgggatttcaccatgttgcccaggctggtcttgaactcctgagctcaagcaatctgcctgccttggcctcccaaagtgctggtattacaggcatgagccaccgcgcccacgggtcgtaactgagctgagatggcttaggaattcattacttagtgtgtcccctgagcaggggaccctgagttgcagaagtgccctcagcctaagggctatccctgtctgctcagtcatattggaggctggggatagtgacttggaaaagagagatgccactgggtgagtggagtttgcaaatgctgtctcatcaagatctgtctatactgatatcagtcaagatggatttgaaaagggtggggtgccatagccaaaagccttaaacttgaaagacagtcaggaagtcttagaaaaattcaaaccaacatttttggggaaaataaaaacttatgacagatagagagcaggtatctcagatagaaggatcttctattccacttatggggacagaaggtgagcaaaaaggcaagaaggaattgctctttatctagagcaccatagccagaaaaccaatacccatggctataaaaagcagctccatcttggcatactttctgacccgtccctgaaaactccatgctcttctgtaatagtgtcaattgttaacgtatttcatggcatatgatataagggagatcttagcccaggagaccatggaatggaagggcccatcggttttctaactatgttcccaggagccctgggattctgcagacatggccctggtgaggacagctgacctcccatacaggtcccagtattgggtccatccagtgattcattagctgcatcaccttggataggtcattctatcttctggatttttgcttcccagtctataaaatgaggtggtgggggaggtgggcctggaccacattagtgtgttttgagttgtaaaattttttgttcaaatgaaaacacatttgaacacataaacctaatatgcaaaaatgattagagtatgaaataaagggtgggggttggcaattgtctaacagtgaggtcagttcttttaactctcagacattttgttggctaaatggtaatctactgtgtgtatttatttgcaagacagcgtggcagtgaaaacccaaacatggtctggtttattatggaaaagaatgtcaagagttttggaatcctttcagaccaaggttgaaaacttatggccaaagtggttctgccatggcaagagaaatttgcagctgcctagattgttcctggaacagtgaacttgtgtctctagatttatttacttaagagaagatctgctggggaaatggagtaaactgtcaaactgtattctctgggcaaagagcagaagagtaaattagtggaatgcttggcagaatgaaccctgctgcagaaatttcttgtaataatgatcttttaattggatttatactttgttggaaagaaactcagtgttcaggaacttgccactgcagcatttacaaagagaacagggaactaatttaatatccacgaactggagggtcactttagaaaagcatcagctccatttggtgatgtgtttaagtgagtttccttcatggttagaggaaaggatttgtcccaaataattctcttacgtactctattgccaatgagcattgaagcatggtccctgctgggtttctgggtttctgctttattgatgattgattgattgagacagggtcttgctgtcatccaggctggagtacagtggcccaatcatggatcactgcagccttgaactcctgggctcaagctatcctcctgcctcagtctgtcaaatagctgggactaaaggcacatgccactatgcccagctaagttttgtattttttgtacacacaggatttcactatgttgcccaggctggtctcgaacacctgagcttgagtgatctgcccacctgggcctcccaaagtgctggggttataggtgtgaaccaccgtgcccagcctagtttttaaatattttatagagatggggtcccagtatgttgctcaggctggtcttgaactcctgagatcaagccatcctcctgtctcagcctcccaaggtgtttggattacaggcatgagccactgtgcccagctggcctggttctaatttagctcatgtcatctggtgaatgtctaaaatcctggtagtttccccaggtgcttggatttggagtcccaggggatcaagaagtcaacatgtattttgaccccccatagaacatcagagatcacaggagctgttactattaagtaagtccagtgtgctctgatacagattttctccaaaaccatttttagctgtgtggccccctagctgtttgcagcaattaatatttatgagactttatttaaaaaaatatatcatttagaggtggtttgctgtgctgatttatttatgtatttatttaatcagatggagtctcgctctgtcaccaggctggagtgcagtggtgcaatctcagctcactgcaacctccgcctcccgggttcaagcagttcgcctgccttagcctccctggtagctgggattacagacatccaccaccatgcccagcaaatttttgtatttttagtagagacagggtttcaccatgttggccatgatggtctcgatctcttgaccttgcaatctgcctgcctcggcctcccaaagtgctgggattacaggagtgagccacctcgcccggccttgctgatttcttaattaaaagtttattttctcctagatttgaacttttttttatagaaacatgtctctagctttggaaagaaaaaaagtcaatggggaaaaaagtgttagttatagaagtagtttgcttgatagatggttattttagagatgggaagaaaggagctcacatttgttgagcatctactgtgtcccaagtgtgctgctaggtgcctgatgtgcttccatttttgaatccttatgataacccaagagatgggggatgattttcaaatatacacaagaattttgcccaagatcctatagttttgaattggggaaactgggttttttgttttgttttgttttgtttcgtttgagtcagagtttcgctcttgtcacccagactagagtgcagtggcacgatcttggctcactgcaacctccgcctcccaggttcaaatgattcccctgcctcagcctcccaagtagctgggactacaggcacccaccaccacacccagctacttttttttatttttagtacagacggggtttcaccatgttggccaagctggtcttgaactcctgacctcaagtgatccacccgcctcagccccctaaagtgctaggattacaggcgtgagccaccgtgcccggccagaaactgggttttgaacctggccccatctgaagtgacattccatggttcttccttgactccaggaagggatcacatgccatagaatgaagcatgctttaattgttccctcctcctacaggcaagtggccaaagtgtgttatttggagattccctgttcctcccaggagacttctcagtgtcgtgagtcagagagtacagtggaagatgtgcagatgcaaagagttttcatccattttctctgtgcaccaaaatgtaagagggttgccaaaaacctcaggcatcaggataatgatatttatttatttatttatttatttatttattatcattatttttagatggaatcttgctctgtcgcccaggctggagtgcagtggtgtgatcttggctcactgcaacctccgcttcctgggttcaagcgtttctcctgcctcagcctctcaaggagctgggattacaggtgcatgccaccacacccaactaatttttatatttttagtagagatgaggtttcactcctgacctctggtgatctgcctgccttggcctcccaaagtgctgggattacaagtgtgagccactgcacccagcctataaatgatatttaatgcagtgttttaaaagatcaaaattaatgcagaaacatccgtaatgaacaaatatccgaagtttaaataaagtcaggaaaaataacagtgtgatgctgagccatattggactctgaagcaaaaggaaaaatcagcataaccgatcctgtctttatttaaaatttgggtattttgttcatcatggattttttagcataaattttgattttttgaaaaagtattgcctgaggaactgggcgcggtggctcatgcatgtaatcccagcactttgggaggccgaggtgggtggatcacctgaggtcaagagttcgagaccagcctggccaacatggtaaaaccccgtctctattaagaatacaaaaattagctgggtgcggtgggaatcacctataatctcagctacttgggaggctgaggcaggagaatcgcttgaatctaggaggcagaggttgcagtgagccgagactgtgctactgcactccagactgggaaacagagtgactctgtcaaaaacaaacaaacaaacaaaaagagctattgcctgaaatgacatttatcttgatgcctgggtattctggcaaccctctgacattttgcgccatcacgtgggtcccgtcctgcaatgagttttttaatctctgtgccagataatgagctaggtgctggagatacaagatgaggacacataggagccttcagactagtgggagtcagtcatgtaaatagtcacaacacagcaccataattctaagtctgtgcacaaagcgccatggggaagcagttgctgttgaatcaaggttctcttggaggagggtttgagtgtgacttgagggctgcctctgaattggccagtggacacaagagtaggggaaggatttggtgggaaacagcaggtcccttcatccctccgagcctcagtttacccccatctgtaaaatggaggaaatagtagtgcctgccttacagggttgtgtgacaagaatgagtccatcatgttaagcacctagaacagagcctgacgcataagtcggtgtatgtcagccgtgatggtgacggcagtgctgaccattgcatgcagatttcttaaaatgacagtgtctgttggccacatatgcagtctgaactttgctttgcagacatccacgacagcgatggcagttccagcagcagccaccagagcctcaagagcacagccaaatgggcggcatccctggagaatctgctggaagacccagaaggcgtgaaaagatttagggtttgtctttttcattgttaatcgggatggatgcagtgtgtgcagaagttcagatgcacacaggggagaaataggccagttcaacattgtctgtcagcgtagcactctctatgccagcttgagagttcagtactgtctatcccagcttgagggtgagactttctcatctgtcatgactgtgttggcaacgctgtcacagatgggtagcctgtttctggtttttgtgtagtgaggtgggaggggtacagggtgggaggagagagaagataccgtgcctattggtggagtctgtatgaggaattcccagctctgggtctctctgacgtgaaggcttgttctctcgtgcttgggggattctcagaatgcattgttgacagagtaagagaggctggcaatgagaacttggcgaagggacctccgagagcagggctgatggatggggaactgttgatcccatctagaaatagcttttctgaccagcagaagcccccggtgccagatggaggaccatatgtgaatttcaagaatgagtcctggttacttctgtctttaagtcttgggtcaggaataggatgagtcctcatgcagttggtgcctgttggagctcccagggagggagtggcaggtggtactaggcttctagttcctggtcgccaggccactgtgagcagtgtttgcaactcaggaggtctctgcacagcagagtagctggctgtgccatggactgcccaagatcggccataagaaaacacacatacctccaacttaaaatagtttgtatcatggtgtctttagacatacttaatgtgctttcttttcttttgtttaaaaaacagcctgattttagaggaatgtactttgtttaaacactgtctggaaggaaccaatatatcttccactttaatttactttttggtaatttattgtcagcttagaaatatgagtacattcctgcttcatttgtactcttctttacaatgtcaaaaccattaaggtcaaatgcatatgaaattatagctttaacattaaacatactcatttgtttttcagagtggggttttcgaagagtaactgaaccatgctcctctgttgaattttgccaaatcagtctttgaagggaaatgccatttgttttattttttttttaaagtagaatactgtgtgactctttttctttgtatccacaggaatttttaaaaaaggaattcagtgaagaaaatgttttgttttggctagcatgtgaagattttaagaaaatgcaagataagacgcaggtatttcctccactctgataatttttttcccttataaagttacaactgcctttccaatagattctgaagttgcctaaagaaacctgattcatattagttttgggggaagatttaagcttcagattaggtatcttgtgttgatcaaatattaatcatttttaaaagggtgagttaatccatttttaaatggagctgttcaaatggaccaatatttaaaataaaaataacaatttatgtcacttagagttcctcattgcatagaatttttttcttcatgaataagttatgaggatgttttccccacattttgacatgttagcattttggacgtggtaaaacgatacgcagatgtgtaatgataaaagcacaaggtgcatcagagggattgtcaattattcagtgtatcgtactgagcgtcccatagttggcgagcatcctgcagagaaagcctctgattgttctcctgggtagatgtgtcctctttgccttcattcccagtgtcagctggttgggtatgagggagggtagatgagattatggggaaggaggcctgtgccctgggtgggtttatgaggcctggccctgtatctttctaagaggctgctggctaaatgcctgcaggagccagtaagtcatgtgaatgaaggaggctcctggtgtgaggctggagggagtgttggggactggggccagctaaggacgttctgtctgcctgcacaggctgcagctggtggttcagggcctgtggctgtctgggcttcccctgcttcaggttccgtctccgccagcttactgatggtgatctcctagatctttgcttgccctgcgaccctggtggactttcttcccaaggcatgtcttatattccacctagtaccgcctgtttttctaaagaagctggacatttggatccttacgtgaaaccagatgatttttaaatgttggaactaattaaaaaaaaatttaaaaccttgcctaccaaacaaaacatacccatgggcagatgcggcttgcgcgttgccagtttttgaggcctcgtctccaaaagctggaatctatgggccagaagccgtgaagcgtttgcagacaactgcttggaaaatgtatatcatgggtttattcaaaggcctttccgggcgcagacacccatcctcctggatggcgcagcgcggccttttctccaccaccttcctctctggaggtggcaagggagtattctaagatggattctctttggcttgaacttcccaggcccacctcgaaagctgttactgggcgggacccttggattttgctttctggctttttctctcctctggatgacgttggccggagcctcctgggcagagaggggccccaggggaaagtgagaagcaggtggtgggggatgctttgggatgctaggattcaggctgagggccttcagaacaagagcctcattgttgtcctttgtctccagcaccgaggacagggcctggggaccaccatcgataaatgctagactgtgccaccgctgcgaccagcctcaccataaaatcctagctcagagtcaagcaagccaacagatgtccattcccctgccttattcttttgagtgttagaggtaggaggggcctgtgggtgggccggtccgcccctgcagtgtagacaaggaagtgaggtccccgcaccgtggcagagctaggacttgaactagctccctgaagtcacccgttgttgtctgcaccaccatgctgctctgtgcctccgttcagttgaattccccaaatctttgtgaagtgcctgcttggtgcccagcactgaacaggaaggcagcccagggacaggacaggtgagcggctccagggaacgggcacctcaaggggagcaagcctgtgcaagtgcaatgagtgtagagatgggaagcacatgtgtcgtgggagcaaggcgtgggcaacggggagggatccaggggaagtggctttttagctgagacttggcattgagattgggagggggttcccgggagcagggacagtgtgtgggcaggcagggctggcgacaagagctgagggaagaccagaagggctgaatggcatgtttgagggggaggccactgtgctgtgcttcaggctggcagggcagccacacctgggaatctgggtgccaaggtgagcagggctgggaaagcccctgtaggactttaatggagtggttggaaggagggggtcaaactttcaatgtgcctcttccagcctttcaggtcaggcaggtctggtgttgggttgccctgccctgtccacatcctacagagagagcttccgaatgggcagcccctttccatgcctgtacccctgacatccagcataggacttcttttccttttttgagacaaggtctgactctgttgcccaggctggagtgcagtggtgaggtcttggctcactgcagcctccgcctcctgggttcaggtgatcctcctgcctcagcctcccgagtagctgggattacaagtgtgtgctaccatgcttggctaatttttgtattttgaatagagacagggtttcaccatgtttgccaggctggtctagaacttctgacctcaagtgatccgcctgtcttggccttccaaagtgctgggattacaggtgtgagccactgtactcggcccagcataggacttcttgaaagtctgtgtccttaagcctggaatgcacccggcaattgctttagagcaatgaatgccaccctcctgtcactgcctgagaatgcagattgggtggaggcattggtgacacctggggtgtttggcctggagtgtttgggccccagtgtgagtcactgttcccattcgaagatgcagggatatgacttgagtggttaagcggcagctcgcccgaggctgggcacagtggctcacgcctgcaattataacactttgggaggtcaaggtgggtggatcacttgagcccaggagttcaagaccagtctgagcaacatggtgagaccttgtctctacaaaaaataccaaaaaaaaaaaaaaaattagctagacatgatggagtgcgcctgtagttgcccagggaggtcaaggctgcagtgaggtatgattgcgccactgcactccagcctggatgacaaagtgacaccctgtctcaacaaaaaaaaaaagaattcagagccacatttctgactccaggcattccctagtgagtcccgctgcctaggaagtaaaaccagggagtaagctctaaattactacaaaaagtgtggaggaacataggcactgggagaagtcgcctaactgaatgtctttgtttttttttttttttttgagacggagtttcgctcttctcgcccaggctagagtgcagtggcacgatctctgctcactgcaatctccgcctcccgggttcaagtgattcttctgcctcagcctactgagtagctgggattacaggcatgtgccaccatgcccagctaatttttgtatttttagtagagatgggtttcaccatgttggcgaggttggtctcaaactcctgacctcagatgatccacccgcctcggcctttcaaagtgctgggactacagacgtgagccaccgcgcccggccagttctttttaatcctctgttgtgcacgtaacctaactggatttcacagtcaaacttatcacatctgttccagcagggagaccatgggaggatttttctctctccatcaactaaggctgttgaggagtcgatacaaatcccactctcgcctctgttgttttaataggacctgtgttggttcattccttgacgtggattatccagcattcaacaacttcacatatccatgtcatttacttgtccgtcttctgtgtggtttgtcttctggaatctgggagtggggggcctcttcttccccactgtctccgagggtctagacccatgcctgacacatggtgaacttccttcctctttgtaggatgaaggcattccatttcctggatccaagtcctcttctctcctgagtcattccctcattttgggaacagcacacgagaatgacttcttccctccagaatgactcatgagagaagagcccaaaacacagctggcaatagcttcctgagaaggggggtctggcaggtaggtatgtaaagaccttgttgagtggaaatgttatttttttccctactctcctacttcactgataatctgacagagcatagaattctggggtgaaacacactcagaagtttgaagacattattccttagtcttctacttttgttgagaatcagtaatttatatgtaaactgttctgtttttttttttttttctttttttccctctctgggatagtataggatctattttcttttctatttttcccctttcctcctttccttccttccttccttccttccttcctttctttccttccttcctttctttctttccttccttccttcctttctttctttttttttttaatggggtttcgctcttgttgcccaggctggagtgcaatggcatgatctcggctcactgcaacctctgtcttccaggttcaagcgattctcctacctcagcctcccaagtagctgggattacaggcaccctccaacacacccagctaattttgtatttttagtagagatggggtttcgccatgttggtcaggctgatctcaaactcctgacctcaggtgatccacctgccctggcctccctaagtgttgggattacaggtgtgaaccaccacgcccagcaattttcttttcttttctttttgagacagggtctcactctgtcacccaggctggaatatagtgaggtcacggctctttgcagcctggacctcctgggtttaagcagtctcaccatgttgcttaggctggtcccaaaagaaatcctctcgcctcagcctcccaaagtgctgggattacaggtgtgagccactccacctggtcaggatcttttcatcactagtattctaaaactgttcagtcaggggctttggaggcagaggcggagttcattcattgtgtgaattctttgtggagccatataatctggaaatttgtagttctgggaaatggtcttatgttgttattgttatcatcattttagtaactttttttccttccattgtctctggtctcttttccaatgatgacctttcacgccctgcattgagcccttaatttcatgttttattcttcctattttttaattttttttttttttttgcttttggagattttgactacatcttcagatcctcctattgagttttttctgcttttttatttttccagacaagggccctctagtctcttcctggggggccataagcctgatatgttcctgaactaaacatatttctaattaactgtgtcaggagaattttgctggcgcggggggtctatatttggaatttccctgaatccctttattcggttcggcgtctcattcttgccgtcctctgtgcctctctgttccggagcctccctgggtctgtttctttagataagaaaactcaactcttctgttgaaggtggcgggggagccacctgactgctcaagtttggagcaggacctggggtggaggacctgggggtctgatggcttctttctgccgccctcatcaattccgtctgggctacctgatgccctcgagctcctgccgtctccggacgcgcttctcgttggcaccccctccccacctgttcaggggcttggcttcattcttctgggtctctgcagagtcatctgctgtgtctccgactgcttctcatttcctgagccagttcttgaaaatattctcatatcatttattggatattttctttgcctcattctctttctgaaattgatgttagtaaagttagtgtcttgatcctttcattgtcctaggaattgtctcccacattccatctctggaagaagacggggtggagaggagccggaggccagcagacgggatgggggtggggagtggctacaggggatcgaagtttccagcttcccagagtaggggctacagggcctgccagccagaaggggaccactctgttcctttgtgttaattcaaggtgtcagtgggatgtccatgcccacattgctagaaaccaactggctacatgggtcagtagcttgggggagggttggtctgaaatctgggggggacatggagttagagttgtcaccaaggacagaagtctgggaaaccccagaattcacggaggggacagggagacaggagctgggggacagacagggagacagaagctgggagacagacacagggagacaggagctgggggacagacagggagacaggagctgggggacagacacagggagacaggagctggggggcagacagggagacaggagctgggagacagacagggagacaggagctgggagacagatacagggagacaggagctgggggacagatagggagacagaagctgggagacagacacagggagacaggagctgggggacagacagggagacaggagctgggggacagacagggagacaggagctgggagacagggagacaggagctgggggacagatacagggagacaggagctgggggacagacagggagacagaagctgggagacagacacagggagacaggagctgggggacagatacagggagacaggagctgggggacagatacagggagacaggagctggggacagacagggagacaggagctgggggacagacacagggagacaggagctgggggacagacacagggaggtgttggggatcctgagaggacagggctcttacaaggtgagggaagcgggaagagaagaaagtcgcaatgctgagcagggctggggccagctcactccagaggaaggtctgagaggcctcgctgcctgggcagcgtcagccggctggtggagcagcgctggctgggcggaagcctgtgtgtagcgtgaggaatgaatgggagggacaatggaggcaggggtgcatgcttttcttttaagagatttcaaaaaggaattggagactaggcacggtggctcacgcctgtaatcctagcactttgggaggctgaggcaggtggatcacttgaggctgggagttcgagagcagcctggccaacatggtgaaaccccgtctctactaaaaatacaaaaaattagccgggcgtggtggcggactcctgtaatcccagctacttgggaggttgaagcaggagaattgcttgaacccgggaggcagagcttgcagtgagccgagatcgcgccactgcactccagcctgggcgacagtgagactccatcttgaaaaaaaaaaagagggattgggggtggtgaggccattaacccccatgtagagagctgtggggtcaagggggatcttttattttccagtgggaaggttcgattggggagggcggggccagtgtgggaagcagcgctcttctgagctttgggcccctggtgactttgctgttcgtctgcatagaggtgcacttctggggctgataggaaagtgaatttgcttctcctgatcgtgcacctgcagggagccgggttcgagagctgacgtctggctgagcattgtcacagttgagccactgctgggcctcgaagaagggcctcagccttgtggggtgcctggaaggtgctcactggggtgcaggtgcttcctgggcagtccccgagttgatgggccaaggtggggccctctccagcacctgccaggacagcctcagatgctggacacttcaggtctccccagggagaaaggggctctctggtccaggctgtggccagccacatgtgtcagggccgtggaagagaagtcggccatccttccaggccacagacacagaatcaactccaccagctctgttcctacccggacagtagctagaatagggttaacaaagctctggaaaaatctatcaaaatagctccacagactgtttcttcttttctgctcatgttctcggcctagacaccaggccttcccgtgactggcttgtggtcgccgtctcagggtttcccttttcagtcatacttcctagctccgccgagataagctgagccctgcagctgctcacagtgggcatctggtcagccagggccttgaaccccacattgttctcacgcagactcaggagggacagccggtggaagagggcagggctgagaccctcaaagcttatatacctgcagtcactggaacctacttcctctcccccggcctcttctgccccacctcaaagactcaagccattcattgcacttctctatttcagaatcactcaagatatcctggattcatgtgtgtatgtgtgtgcgtgtgtgcacgtgtgtgcgtgtgtgtgtgcgtgtgaatgtcaaggggaggaggggaggtctaaagtgatttctgcccccagacctctgcatggagtttgctcatctgcctggccgaaattctcctttcatgaagtggctttaaaacaggaagtggttttccaaaagggttgcttcctgacggaatgggggtggtggagggaggctgtggcttcatggagctggtgggtcttggagaggacagcagggccagctcctaagtgccacccccttgggtctcgaggatggcccccagacctgtcccttagatagccacgcttgtctggagagactcctgtgtcactgagtctggcatcgattcattgctcctattgacagtgaagacagggtggacagcatggctttcggtgttcacccaacctgggccgtctccctgcaagtgctggtgaggcttgctttctcgcagaacaggacatggccaggccgtggcttctcaggatcttttgtccccagtgccctgaactaaaaaagggctacccttccttcctttcatgccccagctatcaaaaccttctggtggtttccttaagggcagaaggtttgcagagcttgggatttcccaaaccaagccccacagcacatgcggagccccagttgggctcttggagagaaaggcagttttccaggccccccacacacatgtcatagctgtgtggctgcattttagaggcatttgttgtctgccttgctctgtagggtaaggtcatgctttagactctaacgttcagagaaacagccccgcttttgctgttggcgaggtatgagcacaggaagtctcctttctctaaaagaaaatcgagccctcaggggaagttctggaggagagggctcctgcgcctgcagccccgccctgaggcgcctgtcctgaagacacagttctcactgtgaagtcatctccttaccatcagtgagtgctcctgagccagcctcggttagtttcgggtgaaacaggaagccggtacctactcacggctcctgcttcccagcaggactgcactcgggacttgagggcgggcagcgagtgttttctccactgctgtgctcagtatctcgttagctaaaaggaaatgcaccctgcctgggaaggccgcataccgcacaacctggaggggccaatgtgtcttgcggaagtggaactgagcagaattcagaggccttggagccaaacagtcctaaggctcccggaagctctcagataagccatgccacctctcctgacctctgtgtcctcatggggaaagtggggctaacaggaaaatgccctttgctgcatgtccaggggattaaggaaatgggatccctccaagcaggtgcctgcagcccagtgggcgcttaataactggtagggatagtaggtgtgcatactttaacttgatttttttttttttttttgagagacagtctcactctgtcacccaggctggagttcagtggtgcaatctcagctcactgcaacctctctttcctgggttcaagcaattctcctgcctcagcctcctgagtagctgagattacaggtttgcaccaccacgcctggctaatttttgtctttttactagagatggggtttcaccatgttggccaggctgctctcgaactcctgacctcaggtgatcaatctgcctcggcttcccaaagtgctgggattacaggcatgagccactgtgcccggccacaggatggctgtaaatggtactgagtgctctctgcgggccaggattctttctgtcatcacttctgaatggttaatgcagcaattttgttccaggagaagtggctgcaggcgcatgaaggggcgggggtaggggcttggcagtgcaggctctcccatatagaaattctctctggagtggcctgagagcccctgggctgtggggggtgcctttctcttgccacagcagctcctgtgggcctggctggaggggagagcagggctcaggccgggaaggctgtgtgtgcagatagcacaaggccccatctgtctcctccagatgcaggaaaaggcaaaggagatctacatgacctttctgtccagcaaggcctcatcacaggtcaacgtggaggggcagtctcggctcaacgagaagatcctggaagaaccgcaccctctgatgttccagaaactccaggaccaggtaacccgacttccctgcctgcaccttgatttgaaaacctacattaattccaggcctggaagaatttactgaaacacccgatgttagactccctggaaaccatctcatacggccgggcagaccgaggtacactgaggggccatggttggggagagtggggaccagaattctaagcttgagatttgccccacaggagtccccccaggcctgtttaatcttggtctacacacagtttagaccagtttatctgccttctcagtccagattagaggggaggctggagctatttgaggagcctgtactgagaaagcaacctataattgctgaaggtaagaatagacggaaaactccagaaagcaagcaggagaactcaaagtggcaggctgtttctgtgcaaatatccagacacctccacatacttctggtggcctaatgctgtaagctattaatagttcatcatgtagcccctgaggcataatgaaaaggttagcattgggcagcatattccatgtgaattctgattcacatttggctattgaaggagacttgcggagggcctcctggaagtggtgaatttgagccagtcggaaggacgcatgggcattgatttgcgctgggaaagggagtggaatgtatggtgaaaaggcagtttttgtgactgtagccatatgaggatatcgaccccaccctggacctcagaatcttgtcagagctccctagggcacttgaaagtgcagccagggttgcgaacctgtactgacctctgtgctctaggtattctcagtaatgacaacactaactaccatttcgcttttggttctgtgtttttgttcttttttttttttttttttaataccgagtcttactctgtctcccaggatggagtgcagtggcttgatcttggttcactgcaacctccgcctcccaggttcaagcgattctcatgcctcagcctcctgagtagctggaattacaggcgcccaccaccacacacagttaatttttgtatttttagtagagacagggtttcaccatgttgactaggctagtctcgaactcctgacctcaagtgatccaccctccttggcctcccaaagtactgtgattacaggcgtgagccactgcacctggccttttcaggtttttttctttgaaacgaagtctcactctgttgcccaggctggagtgcagtggctcgatctcggctcactgccacctctgcctcctgagttaaagcgattctcctgcctcagcctccctaccagctgggattacaggcctacaccaccacgcccggctaattttttgtatttttagtagagacggggttttaccatgttgactaggctggtcccgaactcctggcctcaactgatccgcccgcgtcggcctcccagagtgctgggattacaggcgtgagccaccacgcctggccctaactaccatttaggactgcccgtttgagcctgatgtcacacttggtgtgtattgtctcattttatctccaatgagtgttattattcccattttgctgatgagaaaagcaaggttcagagagattaagtgttttttttagcattaagtcatgcagggagcaaaagtgctggaagccagattccctcttgtccatctgccttcaaagaccatgctccccccatgaccatcatggcctgtgttgctctgccaggctcctgggcagcctcttgctgtttctcaaagctcggtgaggcccctggagcagagggattggaaaggctttgtgaatgcaggtcatcccacttcccaggactgcgggagccaaggtaggatgaggaatgggagagttctgactccatgcggtagcactgcaggctctgagagatccagcccgcctgcccaacagctcagaacggagctggaccttatgagtaggcgtgccccttagactcattcagtgggaggcttagccagcacagaaaggaagaaacacaggggacagaggctgattgttttttttttcttttttaatgacaaagaattttatttatttatttattttattttatttttgcgacaggatgtccctctgttgccctggttggagcacagtggcatgaacccggctcagtgcagccttggcctcccgggctcaagtgatcctcccacctcaacctcccaagtagctgagactacaggtgtgtgccaccatgcccagctaatttttgtattttttttgtagagatgaactttcgctatgttgcccaggctattcttgaactcctgagctcaggcaattctccagccttggactcccaaagtgttgggattacaggcaagagccaccaggcccagcctcagaaaaattttttaaaatagtttttatccaactgtaagcatcacacatgctcagcaaaagaaacttgggaaacaaaaatataaagaagaaatcatttctttattgcataattgcacacttggagataaccaccaaatagtattttatctgtagactttccatctttttttctataaatacacatatgcacatgcccctaacagatgtggcctaataagtgtaataataatgtatatgtttatgcacaccaaacagatgtgcagtccaaactgctgaatgtaaagcaagtactgttatactctgttgttaaaaatctattattggaaggctgggctcagtcgctcacgcctgtaaacccagcactttgggaggccaaggcgtgtggatcacctgaggtcaggagttccagagcagcctggccaagatagcgaaaccccatctctgctaaaaatacaaaaattagccaggcgtggtggtgggcgcctataatcccagttactcgggaggctgaggcaggagaactgcttaagcctgggaggctgaggctgcactgagccgagatagtgccactgcactccagcctgagcgacagagtgagactccacctcaaaaaaaaaaattttttttaattgcatagagagaaagatccacgaactttcttcctaaggcataattgggtgaaaacaaggtatttggaatcagagccgatttcacagtgagtctccatgtgaagggcccctgtgttccgttttgctttgaaaactctgtctctccggggccttgctgtaactgtcaaaatgcgtgctcagcattagccccggtttttttcttgcaaaggctccctcgagagctctgttttcctaagtgaaggagattgaagctgaggggaacatgtttggagccacaagatttcacggaactttcaaaagcctctcccgcggctttggctttgctgagcactgctgggcttcatggtggagccgcagagcagccgctttcctgtgttcagcaccgccgcccccgaacttagcccctcatcaccacgtgcggctccgctgctctctgagcttctagtagggcagctctgactttgtagggcaccgctggaacctagaagaacgggaaaatcttccctgagccccaggctagatgagccaactcccatgcaccctgtttaaaggagagcttcaagagttttcagtcaggtcctgtttattcttggtttgcacacagttctaacaggtttttccattcatagcagatttgaagttgtggtagagactatggagtgatgagcagcaagaggtgatcactgacagctagggaggacacagaaatgacactgagtacaagcacagcaccgaggcctgagcctgggcgtggggacctccattgccacacgccgcaccatgggcatccctgtgctgtgggacagtgacatgataagtgagcctggtgaccccaaaccatcaagtagaagtgaaattgaggtcggcgtattatgtgaagagtgcattattcattttaatgagcacttcatcaaaaacattttttttggagacagtcctgttctgtcacccaggctggagtacaatggtgccatctctgctcactgcagcctctgcctcctggattcaagcgattctcctacctcagcctcctgagtagctgggattacaggcgtatgtcaccaggctaggctaatttttgtatttttagtagagatggcatttctccatgttgtccaggttggtctcaaactcctggcctcaagtgatccacccacctcggcctcccaaagtactgggattacaggtgtgagctactactgtgtccagccaaaggcatcctaagagaagcttgaggggcttaaagctttgctacctgggaaattcatgtaagtggcgagatggttctctgatttaattcagttctgcaagcttggtgtgcccagccctttggaggcaaagccaggagaggcgaaaggtggtgctgtgggcatttccctagtacgttagcctagagtcaaaggctgccgttggacaaatttaagttggaggaagcaggaaggaagggggttaccttacaaagaggtggtttcttcagggaattgcagttccttacagtgtcttttcttctttaaaaacatgtattacggccgggcgtggtggctcacacctgtaatcccagcactttgggaggccgaggcgggcagatcacaaggtcaggagatcgagaccatcctagctaacacggtgaaactccgtctctactaaaaatacaaaaaattagccaagtgtggtggtgggcgcctgtagtcccagctactcgggaggctgaggcaggagaatggcgtgaacccaggaggcagaggttgcagtgagccgagattgcaccattcaactctagcctgggtaacagagcgagactccatctcaaaaaacaaataaacaaaaatatctattcctaggagttttgattcagtccttgttggtctgctggtttgtggatttgttgttttattcattcctttatgctgcaattatgaactgaggccctactctgtaccagggactgtgctaggaactgtgtgtacaacagggaaatcagcatctgcccccacacggagggcagagaaagatcaatgctaagaaggaaatgcaacaggggatgagctgagaggtactggaagaggcctgctagggtctgtgctcaaggagggctccctggagaggtgactgggatctgaatggcaagcgggatctggatgagaggacctgggagccgggaccttccaaggagaggtgagcgcaaaggccccgaggcaggggcagcaggtgcgttagggggtcagcattgtaggaatgtagcacatgagggggtggtgaaagttcagttgggagggactggctgggtcaggccccgaggctgtggtagacagtttaattgcagggatgtgaacagtggctgtttatagaatgtgctggttgggctggtaaggcttggacctcttacagcctgagccccttggctcaggtccctagttcagggctgtgcccgtcccataccagttgggcaagagaaggcggatggcttggtgcagagccagctccgttattagaaagtcagccgtgaaaccctgacctcctgactgtggctcaccatttgtatggtgagtgggagtggcctgagctctgcccctcccctctccccccttccccctctccccctgcccatcactccctggatatggagatgccagattcatcactgttatcacagtgcatgcatgagcttggccctgagcaccagaggcagaagtgggggattctagtccagccctgccgctgtctgaccccaggagggttctgtttcttactgtggcttctgagtccccatctgtaacatggggctttgggcaaatactctgctacctctctgagctgcgctgccaagcagtctatgagcgttcaatgccctggtgttaaaaagtcactgataactacagccttatttccttagatctgactccccctgctgcccctaccccaacttctttgactttatttatatatatatttttgaggcagggtctcactctgtcacccaggctggagtacagtggtgtgatcttggctcactgtagccttgacctcctgggctcaagcaatcctcccacctcagcctcccaagtagctgatactacaggcgagcgtcaacatgctcagatttttttttttaattttttgtaaagatggggtctcactatgttgcccaggctggtctcaaactcctggcctcaagcaatcctcccatcttgacctcccaaagtgttgggattggaggcataagccactgtgcccggccttctttcactttagaatttagttactgtgagattgtggacaagacttgctccctctccgtgcctagcttttctcatttgtgaagtggaggttataataataaggtatttatgaactcctgacctcaagtgatctgcccacctcagcctcccaaagtgctgggattacaggcatgaaccactgcgccctgcctattttaattttttttatactgggtctccctctgtcatcgaggctggaatacagtggcaccatcatggctcactgtagccttgacctcccaggctcgatccatcctctaaccttagactgctgagtagctgggactataggcatgtgccaccacacttggctaatttttaaaatatatttttctagggatggggtcttactatgttgcccaggccggtcttgaactcctgggctcaagcaatcctccagccttggcttcctaaagtgctgctgtgattacaggtgtgagccacagtgtctggcctaaaattatcttaagttattgaattagtacatgcttattgttaagataaagaaaagaaaattcatgtgtccaggtgggtatgaagtgaaaagttaagatcccccagtcctgccgctccttctctcttcttagcaggaaatcgatgacgttattggtcctttcaggctgtactcaaacattgaagaatggaacacattgaagtctgctcagtgacttaaagttgttccatatgaaagatttaaaacaaaattctcctctggcacatttcttagccccagtttacacacctttcttgctcagaagcctttggtttaagttctatatacagcgcagcatggtctggaacagccatgagcttgatgaagatagaaaggtccagatcattgcacatggcagcttcgtggctttctcagtccatggaagagaagggcatgggtttggggttgtggggtgctcattcttcttccatgaatatcaggggtccccatgcctacacttaaaagcagattttgggccgggcacagtggctcatgcctataatcccagcactttgggaggccgaggcgggtggattagctgagttcaggagttcgagactagcctggccaacatggtgaaacttcgtctctacgaataatacaaaaaaattagccggacatggtggtgcacgcctgtattctcagctactcaggaggctgaggcaggaaaatcgcttgaacccgggaggtggaggttgcagtgagccgagatcgtgccattgcactccagcctaggtgacaagagcgaaactctgtctcaaaataaataaatacacaagcagagtttgcgtctgctagggtgccttcccgaggctttggatctggtgctaaactctagcctggaaaagcagagatgaggtggccttctccactcaaaaagaagtcctcagcctctggtgcttacaaaaaaaatggaaaaccagcagtttgggaggctgaggtgggcggatcacctgaggtcaggagtttgagaccagcctggccaacgtggtgaaaccccgtctctactaaaaatacaaaaagtagccggacatggttgcatgtgcctataatcccagctacttgggagtctgggtcgggagaatcaattgaacctggaagggagaggttgcactgagctgagatcatgccacagcactccagcctgggcaacagagtgagactctgtctcaaaaaaaaaaaaaaaaaaaaaaagccttgggtgagatgctagtgctcccagccacatccttgacagagaaaggagccatgaatggggtccctttttagcaatgcagtttctttgagttttcccagaacgtaagaggggaaaaatgcttcctttttcaacgtaagtaagaggggtgggccagctattgagggcctcggagggtgagagaggggctgtccggcctgtggcagtcatttgggggcccattctctcccttgccccattatttctccaaacaggaccttggcctgagtgcccctgcatgaccatggtcccctctcctgggtggtggcagaggctgtggtggtggccagagccagggacttaggatgtgtcagtcttatgggtgccaggtgacatttgctccaaaagatcaaatgcagggaagaaatgggtattttccagcatgctccgctagaaagggcaggtgtggttttttgttcaaacagaagggaggttggctgtctgtgtacaccgtagccatctgcctcacgagggtcaggatgggaagggcagtattcgagatactttgagatgtttcttgcaactttaaaatggtatttggtgctgggcatggtggctcacgcctgtaatcccagcactttgggtggctgaggcgggaggatgacaaagtcaagagattgagaccagcctggctaacatggtgaaaccccgtctctactaaaaatacaaaaattagctgggtgtggtggcacgtgcctgtaattccagctacttgggaggctgaggcaggagagttgcttgaatcagggagttggaggttgcggtgagctgagatcgcgccgctgcactccagcctggcgacagagtgagactccgtctcaaaaaaaataaataaataaaagtatttgggggaagaggaggggagagtggcactcagaggagcattcaactccccttccgatggcaaaaggcaaaattaaaatgccttcacccccagcagaaagtgagtcatgtcatttgggcctggaatttgaatcgtgtggacggtagaaaaaagcggacaatccgctccacacgtgtgaccgccacacgcgtgaacccgtgagcttgggaggggatatcgtccaagcgaggtctctctgatcccgctggtgtccagactccttctggagttccaatcccacccctggcacactgtccatctctggctggtctgtcgtgaagctggagagccgtgcaaggcgacagagccttctgtgtggcccgtcctggcgctctggggcaagggctgacttgagctgcttcgtctgctcatctgctgtctgccagctgccctcagacctcctcctgggtgcagcccgttcccacttgagagggaggtggtcttcactttagggggtaggcacatccctgtttgcgccttgccccgacagcctcgtcaatgcccagccacttctgagggctggagggacaggagcttcctttcttccccctttctgtctcctcgcgtgggtacaaaagcacgtctgtagtccatgtgtgtgaagagaggacgcattctagagccgcaattcagagacggcggtgcttccaccttctttcagcgattttcatatacaagcgaaaccaagttcttaaagcagatatgatatcccgctaattaaactttcattgccttaaggaatgatttttttcctcctgtgctggattaaaataaaatggcagagggttttgaagagaagagaggatgcatgttttgtttaggtcttctgtacttgtcttctgagaagtgttaaaatatttattaggcttgaaacgcaatgaatggagacagtgacgcaatattcacagaggggccttcaaggctggttgaggtcctcgtttctgcacagatgagtatgcgtcagggggacgtcctttcctggagcggcacatttggaacagtctgaagttggggcactgcatggatatttttctttcaggaaggcaaatcctgctcagccatggcaatgtctgggatctggagaggaggtggcttggtgatataaagaccttgttctgcaggacggttgtgcagagttgcacatctgcaggaagcctccctcctcatttttgtccgagtctcacttccagcagcctgtaggattggatcccaaggcaacgatgctaaacagtttacagtccaggcgtgcagcttgcagatgtggggctgccaaaaccccaaagcttgctaagccgcagctgtcttggccaaaaaaaaaaaaaaaaaaaaaaaaagatgcagaatgcagctcagccgccaacttgagttttccgcttcaccagcagccgtttgttggacggatggtggcctcagctctgttcccgtgtcttccactcacctgcggcctcctgcttagcccagatagctccattttcttctttctctgccttgtggacccttaaggagtctgaccgtgttgttcaggtgcccatcacagtccaaacctggtgaggtcatgtctccccctcagggatccctgcttgttggaactgtctgggacccctaggcccatctcattttctgtgtttgagccggggtgaggtgaaatcaacaagccaactggatgagcctccttggactgtcataagcaatgaccccaagtcaagtggcttcaaacagcagaaacgtattcgctcagcagaaacggattgaaaatatgacatcaaggtgttggcagggccctgttctccacaagactctggtgggtggtggcgagagggtgtggggggtgcttacttgccccttcagcttacagactgctggtggctgccggcactccttagcgctccttggcacgtggctgcatcaccgatgtctccctctgccttcacacgccttcttccctcagtgtgtcccctcctcttctgataaggacacccagtccctggatttagggcctaccctaaatgcagtatgattttattttgagacccttatgcaaccctcttttcaaatgaggtccattctgagattcgaggtgaatgtaagtttgggggaacaccattcaccccactactgacctttggggacatattgtttctcacttagacacatggatacactcttaaagaatgtatttggagccgggcgtggtggctcatgcctgtaatcccggcactttgggaggcctaggagggtggatcacctgaggtcaggagtttgagaccagcctggtcaatgtggtgaaaccccgtctctacttagctgggtgtggtggcgcacacctgtaatcacagctactcaggaggcagaagcaggagaatcgcttgaacccaggaggcggagtttgcagtgagccaagatcgtgccactgcactccagcctgggtgacagagtgggactccatctcaaaaaagcaaacaacaacaacaaaaaagaacgtatttgggatcattgtttttagatagggtgtgtttttaaaatttagtatcagtcatttaacattcacgggcagttttccatgttactctctttgcagccctcgtttttattgtcctgccatgcgagtggcagatggcctcatggttgggagtgggggctgcagagcctgccagggctggccttccgcccttctcttttgctcactgttatgggctgaactgtgctcccctccctaatccatatgttgaagtcctaatccccagaatgtgactttatttggagatagggctttaaaggggtaattaacattaaacaaggacattgaggtgagctctaacccaatctgactagtgtccttgtgagaagaggaggtaaggacacacgtgcaccggggagaccctgtgaagacgcagggagaaggtgtggtctacgagccgaggacagcggcctcaggagaaaccaaccctgatggcaccttgacttggacttctagcctccagaactgtgaggaacccctaagcccctcgtttcttcctctgtcaaatgggggtcttcagagcgctggagggagaactgaatgaaagaatgcccacacgctgcccagcgcagggctggagggcactgcagccgcgttggtactagccgggttcatttccccagcctctgctgctgcacagcgcacgatttctcttcagccactggtaaacacttactgggccccagtcacagctcttttccctgtgatagatgaggctctggccagtagctgggcacacgatctctggccactttcttggaagaaagttttaggtgcattctcttttttttttttttttgagacagggtctggctctatcacccaggatggagtgcagtggcgtgatcttagctcactgcagcctcaacctccgcgggcttaggtgatcctcccacctcagcctccttagtagctgggactacaggtgggtgccaccaagccctgctaatttttatatttttagtagagacaggattttgctatccgcccgcctcagcctcccaaagtgctggagtttcaggcatgagccaccgcacccggccttagttgcattctccatcctctaagtcacctttgctgagccccgtcccaggagcaccctgttgctgtgtgctcctgagccaggcccagggggtcgttggccggtggcagtcagaagtctgcccgtgcaccccatgtaaagcaatcaggcttcccacagcccaggcgcacgagggctttgggggcgacatcctctcctttctccagcctgtctgggtccaacagccacagctgcctcccagtcactgcagcagcacgggagatgggcaagggctctcagaggaggaaacctctgcctgagggacttctgcactcgtggggcatttcacacctgccccagtagggagtggcccttatgctcttaataaatagttcgcagccccctcccctcaggcttgctggcagccttgggatctcgggatctcggggtcgagtcctgccagcccggtgcagcccctgagcttcctcccagccgaagcagcctccttccctccccctcctcctctgccctgggtgcccccagcaccggccttttttcttctctactttgaagtctgagcctcagagccactacaggcaaacaggatgttcctctcccacatgcagacttcacacgagacgcttgggtcgcaccgcatcctgcttagagtggtgggtcccatctgcgtggacctggggtgggagtgggtacaggactgaggctgggtgccaggtgggaccttcgtgcaactggtttcattagtcacatttgagcgttcattgcagactttgaactaggtgagcctctgaaagtttccccttggggactcttgtgcctggaagggctgaataaggcagatggtgacgcttgcttagcacgtcggtgggaggccatgaaggagtaatggcgtttctcatcccccacctcagccctggctatgatttttgtattttctgggattaaaaaaaagtttgttttttttttctgtaaacctcagcaaattacaatcacacctggaattacaggatggctacaagatagatgactgctctagtgtggcacaggacaggggcttaaggaggcagggtcttgctgagcagctggaggactcgggcaagactagaagggcaccaggggatgggcaggcgctagtttaacagtttaaagaaaacctaaagtcccaggtctttctctgggttgtggactctgtttatagcacagtgactcaggcagttctgctgtggttgaagccatcttgggaagatgaaggtgtaaaatttgagggttccagttccctcctgaagcacctcccatcctccaagcagatgttctgagtcctttgagtccctcagatgtttgttttatttttaatttttattttatttctttttttttgagacagagtctcactctgttgcccaggctggagtgcagtggtgtgatctcagctcactgcagcctttgcctcctgggttcaagtgattctttggcctcagcctcctgaatagctgggactacaggtgtgtgccaccacgctcggctaatttttgtatttttagtagagacggggtttcaccatattggccaggctggtcttgaactcctgacctcaagtgatccacctgcctccacctcccaaagtgctgggattacaggtgtgagccaccgcccccagcaccctcagatgtttaatttacaaaatagtgtatgtgtgttgggagagggcagccttaaaagatgtcagggttttaccatccacttgacaaccccgcctggcagtcagtgacattctagacatctctggaactttccacttggttgttccgtgtaccagggtgaaccatgtggatttttagttgcagagtgtactgcgagttaagtggaaaggtctgagagagagagaaatgaggggtgggaaagagatcatagcccttgacagctggaaaaggctttgtgcttctctttctctgcccctttcctggggcaagggaggagggcagatggcacaggattgggtagcagtgggggagaatgaatgctggtcacaaggactgtggcccagaaaagaggttcagtggcggccagaggaagctactgtgcctggggacagccctctgagcacctgccatgccggcgggggcagccgtctaatctggggcacttcagctctgtcgggtgtcctcttcgctcacctgacataccttagagttgtttcattctagggatgtgctccccagcctgtctgatggcacagatgttggcattctgcagctggctgctctattctttatttgggacctgttcccttgctaagattatagttttgctgccctgccctgcagtgagcacgcctcattttgactcctggtacaataataggtttgtttgagatctcggatgccagacttactgggagtcttaacaatgctggcatcatatgatatgtcagtgatctttttaacaccactgtctctacagaaatggtttctattcggctgtctcaagctcttggagaaatacatccttgtcttatctaggcaaataaagtggagagtcttgaaggacttcttggtacaagggtctgaatcagtgctgtgtgaatctatatttccgtggaaaataaaggcatatttgttcatgtgactgtctatatattccattgagattattgcataatgaccaaaaatctccaggaaatctgccttgtctagcagatgacttatttgagctttcttagtgtgttctttgcacatgttagtattctttggcacatggtaggtattaatacatatctgatgggatgatttatggcctggattagcctcagccttcagactcttttttcttttcctccttagatctttaatctcatgaagtacgacagctacagccgcttcttaaagtctgacttgtttttaaaacacaagcgaaccgaggaagaggaagaagatttgcctgatgctcaaactgcagctaaaagagcttccagaatttataacacatgagcccccaaaaagccgggactggcagctttaagaagcaaaggaatttcctctcaggaccgtgccgggtttatcattgctttgttatttgtaaggactgaaatgtacaaaacccttcaatgggatgtgtgttttattaactgcttcaccagtaaattttgcatgatggctaagctaacataaaaaaagaataataataacttggaagttttagtttacaaaacagagattccttcaacactggacacgtcgagcattttgtagcttaattaaacctcatgtaaggcc

SEQ ID NO: 36579 - DNA, 2470 bp, Homo sapiens
gaaccgctctatgtccagctgagggagtgcgctgtagccctcgcgcgcatactcgtacaggaggttccggtttcgtttctctgtagtgaaacttctccttggactatcgttggagatgcagcctccccggggccggaacccccgacgagtcagcaaaggccacaagcgccgcgccatggacgcagccatcttggaccgggaacaaggcggcacttcgtcccgcccactccgcgtttagaccaattgcaaggcagcgaacctgaccgtgacgagccaatcagatcctgaggaaagttgaccgcgatagagtccttcgtcgcccaatcgtcgtctgtgtcccgcctcttcagtgacgcgaggcagaaccagccaatccctgcacggatagcgcccggaagaggctagaagctggattcagcgtgtccgcgacctcacctttaggtcctgtgaggtcggtggaatcctggggtcctccaaatctaccaggccatctccccagtttcccagttcttcctgcgtgcgggcgagagtggttgggccctcgggaacccactcagagcgaggctaaatttacggagggactttctgttagcagcatgagggcctgtggttagacctatagaggtatttcctttgatttaagccagaaagtcctgagagcggatcggggagcatttgcggatcggtcactttttcctcctttctgagtctcttatcccctaccacagggacggcccaggtggcaggatgtcctggtctggccttctccatggcctcaacacgtccctaacttgtggtaagtgggggacttgggcttcagggacgaggctagagggggagggttattcgctcttggacttgtgtgcctccgtcggagccccgagggaaacgggggtggaaaaacacggtggggttttggcagagctagggctgctagagcaagaggtgggaagcagctgcatggagggctactgcgtgtcaagcggcgtttgggtcagttttattatttatttatttaagatctccctctgtcgcccaggctgaagtgcagcggtgtgatcacagctcactgcagtctcgacctcctgggctcaagtgatcctcccgcctcagcctcccaagtagctgggaccacaggcctgcagaaccacaaccagctaactttttgattctttgtagagagggaggtctccctgtgtcgcccagtctggccttaactcctgagctcaagtgaccctccacagcctccaaaagtgctaggattacatgcatgagccactgagcctactattattttaaacagcattaaaaataatgcttcctggccagccgtggtggctcacgcctgtaatcccagcactttgagaggccgaggtcaggagttcgagaccagcctgaccaacatggtgaaaccccgtctctacttaaaaatacgaagattagccgagcgtggtggtgggtgcctgtagtcccagctgctcaggaggctgagacaggagaattgcttgaacccaggaggcagaggttgcagtgggccaagattgaggtactgcactccagcctgggcgacagagtgagactttgtctcaaaaaaaaaaaagaaaaaaaaaaaaaaggtaatgcttccttgaagaataaagagttacttttgtctgtagataacattagatgtgaacaaatgcatctttgtaaagtgctttaaacaatgcctaaaacaccaaaattgagttgctactactctaagatctgttctctgggataataacccctttcggccctctccaggcccagctctggttccccggctctgggctacctgctccatggctaccctgaaccagatgcaccgcctggggccccccaagcggccgcctcggaagctgggccccacggaaggccggccgcagctgaagggtgtggtcctgtgcacgtttacccgcaagccgaagaagcccaactcagccaatcgcaagtgctgtcgagtgcggctcagcactggccgcgaggccgtctgcttcatccctggggagggccacaccctgcaggagcaccagattgtccttgtggagggcggccgcacccaggacctgccaggcgtcaagctcaccgttgtgcgtggcaagtacgactgtggccacgtgcagaagaagtgacggctgggggcacagtgggctgggcgcccctgcagaacatgaaccttccgctcctggctgccacagggtcctccgatgctggcctttgcgcctctagaggcagccactcatggattcaagtcctggctccgcctcttccatcaggaccactattaagccataggagtcctgggggtgcaaagggtgcccctctgtcaacacccttggctcctgtgtttagaggggtggcctgaaggaccttttctgctgggacaagacactgtactgccctctgctgggaaggggttttaataaacagaccctggcgcttgtgatgt

SEQ ID NO: 36580 - DNA, 10404 bp, Homo sapiens
gaatttcccccagcgaggcgagtgaggcgaaatacccgtatggtgatagctggccttttcgcgccaatactgtaagtgctcaccgcagccctgggaggtgggtcccggcctcgcccccacgtttcgcctcctctaggaggccgcccgggcgcggcggcggcggcggcggcggcggcatccgccctgccacgcgcaggccgcagcgcggggacccaagctgctgcccgggagcggcagtcgccagtagaaatggacagaccggtcctgtcagagcctgtggcttttgttgtaaacgtctagaagttcagttaaattacaagatctaccagatctaccggcgggcagaattattactttgaagttactgaagttatgcgtcctgctggaagaccttgtaatttaatgcgttagtaaagaagcacacgtcaccctctcacacattttcaacaatatttttaaagtcgcctctcaacatattacatgtattttgtaatcgtctgtgttttagttcatgcagttggaagtatccatttgagaagggacaaagagaagaattcttgcctgtctgtgccaccacctgctctttgtgaccttggctagttacctcacatatgtccccaagtcccccacccatggtaaataagaaaactaaggcctgatgcgttggctcatgcctgtaatcccaacactttggaaggctgaggtgggaggattgcttgagcctagccggggcaacatagcgagacccggaggcatggtggcacacgcctgtggtcccaggtacttggaacgctgaggtgggaggatggcttgagccagggagttcagggctgcagtgagctgagatcgcgccactgctccagcctgggcgacagagcaagaccctgtctcaaaaacacacacacacacacacacacacacaaaagcagctgctggtttccaagggccttgcctggaatcagtccagaagctaaattaatgttaattgatattcctttatccacagaaagacagcaagaaaggtcatgcggagcgggggacataactaaccataaatgctaaaggcctggaggtgacagtgcctgctgtttaaacgcgtgcgggagagtctggggcctttagccaggagattgtcaggcttcccagggcttccctgaaagaccccagacccaggggccagtgctgttgaggtgttggctttcccatgccaggcgctgggggaagctgtgacgagatttgagtgtcacataataaggatcatggcaattcaaaggtacagggaagctaggctataaggtaaccagctcggttttcctgggggtcttggacaggtgctttgattacatggtcactgtcagcccgtacccccggtcagatagactgaacccctgcagccggaaagaggagttgctttccatgcccttcctggagttcttcctcgatcaagttgacagtgtttgactcttgttccagctctccgccctgcttgctggcaggcaggagggtcagactagcatgggtgccatggggccctaggtgggtgcagggaaggacctgtagacgccatgcggggcctcagctggtgtctcagctggagtcaggagctgaacggggaagtgcctgagaggaaatgacagctgagtcaagggcaatggccaggcgaagtgggcaaagggcttccaggacagagctgggcctgaggagctcacagggctggatggggatggcactttaagtctggccaagactttgggacatgatccaggacatggaatgggaagctggtcatggaagggtggaaagccagggcagacatgatcccatccagggctgctcaaagatgctggggctgcggtgtgcacacccctggacccagaggcttttttgactgggaggacggggcaggaggagttcgggtgccccatgctgagatggcaggcttgtgtgaagcaaggacgtatggagtgatagtgaggactgtggttcctgtgtggcaacaccatgcttcagagggcaatggggcacccacatgccaagcctggtggccctcctcagcaacggaactccaaggcaagaaggctgagaatgaggcccaggaggatgcggtgggccccaggacctgcttgagaagtgaaatagcaaacaggactggtaaaagggagcagaggtgctggctttgttctttaatataattgaattgaaattgagcagggcttcactgggcatctgaggaagagcaaggaatcagaccctgtcccacccatttggggcctaaattgcagtagggcagatggacattgcacctcaaaaataaacagtgcttgtcacatgaatcatttgcaaatattttctcctatattgtctcttcattgttgattgcttctgtgctgtgcaaaagctttttactttaatatactcccatttgtctgtttttgtttttgttgcctgtgattttggggtcttagccataaaatctttcctggagcatttccccattttcttctagtagttttattttatttattttattatttgtatttatttatttatttattttttgagacacagtctcactctgaaacccaggctggagtgcagtggcacaatcttggctcactgcaaccttagcctcctgggatcaagcgattctcctgccacaccctcacaagtagctgggattacaggcgcatgccaccaccctggctaatttttatacttttagtagagatggggtttcaccatgttggacaggctgggctggaactcctgacctcaggtgatctgcccgcctcagcctcccagtgtgctgggattacaggtgtgagccaccacacccagcctttttttttttttttttttttttttttttttaaagacagagtcttgctctgtcgccccaggctggagtgcagtggtgtgatcttggctcactgcaacctcctcctcttgggttcaagcatttctcctgccccagccccctgagtaactgggattacagatgtgcgccaccacgcccggctactttttgtatttttagtagagacggggttgcactgtgttggccaggctggtctagaactcctgaccttaagtgatctgcccgcctcaacctcccagtgtgctgggattacaggtgtgagccaccgcgctggcctcttctagtagctttatagtttcaggtcttacttttaagtctttaatccatgttgagttgattactgtgtgtggtgagagataggggcctagttttcattcttcttcacatacttatccaattttcccagtgccatttattgaagagaccatcctttccccaatgtaggttcttcgtgcctttgtactacttataatagctaagatatggaagcaatctaagtgtccaccagtggattgatatgtaaagaaaatgtggtatagatacatgatggaatattattgagccatttaaaaataaactgttggcgggcgcggtgtttcaagcctgtaatcccagtactttgggaggccaagacggccagatcacctgagatcaggagttcgagaccagcctggccaacatggcgaaaccccatctctaccaaaaatacaagaattagccaggtgtggtggcaggcgcctataatcccagctacttgggaggctgaggcaggagaattgcttgaacctgggagacgcaggctgtggtgagccgagattgtgccactgcactccagcctgggtgacagagcgagaccctgtctcaaaaaaaaccaaaaccaactataaaaaataaaaaaaataaaaaactattggctgggtgcagtaactcacgcctgtaatcccagcactttgggaggccaaggtgagagggtcgcttgagcctaggagtttgagaccagtctgggcaacatagcaagaccctgtctttcaaaaaaaatttaaaaatttgccaggcatggtaacatgcctgtggtcccatttacctgggaggctgaagtgagaggaccacttgagcctgggaggtggaggctgcagtgagctgcaatcacaccactgcactcagcctgggagacagaacgagaccctgtctcaaagaaataaacaaactaataagataaatcttgttatttgtggcaacatggatgagcctagaggacgttatgttaagtgaaataagccaggaacagaaagataaatattgtatgtgttaattcttatgtaaaatatttaaaaaatcaagctcatggaaatagaagcatagtgggtattagaagctggaaagattagagagtagggaaagattcggaggagtcggataacaaatacaaaatgccagcttcatagcatgaatggatcctgctgttctgcactgtagggtgagcactgttaactacaatttcttgtgtattttcaaaagactataagaaaggatttggaatgttcccaacacaaagaaatgataaatgttccaggtgatggatatgctaattaccttgtttgatcattatacattatatacatgtatcaaaatgtcactctatatgctattaaaaataataaaataggctgggcacagtggttcacgcctgtaatcccggcactttgggaggctgagggggacagatcagttgaggtcaggagttcaataccaccccagccgatatggcaaaatcccatctctactaaaatacaaaaattagccgggcgtgatggcccgcctgtacttccagctactcgggaggctgaggcaggagaatcgcttgaacccgggaggcggaggttgcagtgagccgagatcctgccactgtaccccagcctgccccacagagcgagactctgtcccaaaaaataaataaaataggccaggtgtggtggctcacgcctgtcatcccagcactttgggaggccgaggcgggcggatcacttgaggtcaggagttggagaccagcctggccaacatggtgaaaccctgtctctactaaaaaaaatacaaaaaattagctgtgcatggtggcgggcgcctgtaatcccagctactcaggaggctgaggcaggagaatctcttgaaaacgggaggcagaggttgcagtgaggcaagatcacaccactccagcctggacaacagtgcagacagtgcaagattccgtctcaataaaaaaataaaataggccaggcacggtggctcatgcctgtaatcccagcactttgggaggccgaagcaggtagatcacgaggtcaggagttgaagaccagcctgaccaagatggtgaaaccccgtctctactaaaaatacaaaaattagccgggctaattttagttgtaatcccagctactcaggaggctgaggcaggagaatcactcaaaccccggagggagaggttgtactgagccgagaccacgccactgcactccagcctgggcgacagagcaagagtctgtctcaaaaaaacaaaataaaatgaagtaataataaaatagtgctaagtggtctgcatatacagatactttttttttttttgagacggagtctcattctgtcgcccaggctggagtgcagtggcacgatcttggctcactgcaacctccgcctcccaggtttgagcgattctcctgcctcagcctcccaagtagctggaactacaggcatgagccatcacgcctggctaatttttgtattttagtagagatggggtttcaccatattggccagggtggtcttgaactcttgacctcaactgatccacccacctcagccacccagagtgctgggattacagacgtgagccaccacgcctggccactttttttttttttttttttttttttgggggggagagggagtttcgctcttgttgcccaggctggagtgcagtggcgtgatctcggctcactgcaacctccgcctcccgggctcaagcgattctcctgcctcagcctcccgagtagctgggattataggcatgtgccaccacacctggctaattttttgttttgttttgttttgttttgttttgttttgttttgttttgtttttctgagatgaagtctcactctgccgcccaggctggagtgcaatggcacgatcttggctcactgcaacctctgcctcctgggttcaagcaattctcccgtctcagcctcccaagtagctgggattacaggcgtgcgccaccacgcctggttaatttttttgtatttttgtagagacagggtttcaccatgttggccagactggtctggaactcctgacctcaagtgatccacccgcctctgcctcccaaagtgttgggattataggcgtgagccaccgtgcccggcctaatttttttgtatttttggtagagacggggtttcaccacattggctaggctggtctcaaactcctgacctcagatgatccacctgcctcggcctcccaaagtgctaggattataggtgtgagccactgcgcctagcttttttttttttagagatagggtcttgctctgtggcccatagctcactgcagcctccatctcctgggctcaagtgatcttcctgcctcagcctcctgaggagctgggactataggtgcaccaccatgcctggctaatttttattttattttttaaatttaattttatgtattttgtgtagagacagggtctcactttgttgcccaggctggtctcaaactcctggactcaagcagtcctctcaccttggccttccaaattgctgggattacagatgtgagccaccatgcccagctacatatgctttttgatgtataacagggtaatgtccagataaacccatcataagtcgaaaatataggaactggactttcaacttaagaggggtttagctgggtgcagtggctcactcctgtaatctcaggactttgggaggccaaggcaggaggatcacttgaggccaagagttcgagaccaggctgggcaacatggtgagaccctgtctctacaatttttttttttttttttttttagatggagtcgcgctctgtcgcccaggttggagtgcagtggcgcgatctcagctcactgcaagctccgcctccagggttcacgccattctcctgcctcagcctcccgagtagctgggacaacaggcgcccaccaccacgcctggctattttttgtattgttttagtagagacggggtttcaccgtgttagccaggatgctctcgatctcctgacctcgtgatccacccgccttggcctcccaaagtgctgggattacaggcatgagccaccatgcctggcccaaaatttttttaacaaaaattagcagggcaggccgggcgctgtggtagggaggctgaggtaggagaatggcgtgaacccgggagatggagcttgcagtgagccaagatcgcaccactgcactccagcctgggcaacagagcaagactccgtctcaaaaaaaaaaaaaaaaattagcagggcaaggtggtggtatatccctggtcccaactacttgggaggctgaggcaggaggatagcttgggcccaggaggtggaggctgcagtgagctgtgattgtgccactgcaccccagcctgggcaacagagcaagacccccgtgtctaaataaaaatacccaggccatggcagcagaaagcaaggaagaagccacgtggaagccctcctggcgcttcttccagggaggtgagcagagagcacctggggccaggaggcggcatgcctgggtttctgctcctcctcactgtaactttcagccaagtcaaactgctagagtttcagtttctttatctgtgaaatgccggggctggcacagatggtttctaagatccctcccaggcctggaacttctaagcgattaggtcaaaggtgagctaaccgggctgggcacagtggctcatacctgtgaatcccagcactttgggaggctgaggcgggtggatcacttgaggtcaggagttcaagaccagcctggccaacgtggtgaaaccccaactctactaaaaatagaaaagttagccgggcatggtggtacacgcctctaatcaccgctactagggaggctgaggcaggagaatcacctgaacctgggaggcggaggttgcagtgagccaagattgtgccactgcactctagcctgggcaacagagtgagactccgtctcaaaaaaaaaaaaaaaggtgcacaaaccgaggcccaagacagttaaggtgcaagatcacatggttagtaagtgggagagccaaggtttgaacagtctggcatcagctgaccaggaactggagcccacccttctctctccctgagcccgcctacccgcccaccctcttgagtgcgaaatttattaatatggaagggagaagagctttaatgattggagtcattttcagagcattaaagctcttctcccttccatattaatgtatttctcagctactagggctcacttacagcaccagtggccccaaagcagttgacagtcagtggtaattaaattgtctctctggttctgtgactgaaggagacagaaggctttatggtggcctgaggaaagaaggtgatttggggcttggcacttcaggagagggcaggcgagtgagccagggaagctggcctgggaagcctgcgggtcacccccttgcctcccggcctggtgcttgagtggcagacggtgaatcctcctcctcctccatcccccaccttgtgtcagaggccagagctcggactccatctaatggtctctagttcagctgggtatttggtgaaaagggctttggggctggagacgtccacttttataacacactgacatgggaaggcgcattctgagttgtaatgacagagctagacaggtcttgtctgtagatgcagtggctttaaggaaactaggacgatgggcaggattttcctaggtgccaggagaaaggggtgatagaggattctagaggcttgagagagtcagtgtgcagcggtttcactctgatttgcttctccagtgaagatggttggtagctcctgaggccgggggtcaggaacatggaggcggtgctggggacggtttgttttctaaccacactccttttgtaaccacaaaggaaaaaggcagaacgttcctccgctggcgccagccaatcagcaggactcctgccttccttcggggcaaggtcgcagcatctgcctcggaaatcacgaaatcacggggcttctttctgctggctcagccgggaggcccagagtgttctgcagaggctgcgtattgaaggctgctctctgaagctccctgccccaggtcacgccgccggttccagatgaatccagagtgggggcaggccttcgtgcacgtggccgtggccggtggcctctgtgccgtggctgtgttcacgggcattttcgacagtgtttccgtgcaagtgggctatgagcactacgccgaggcgcccgtggccggcctccctgccttcctggccatgccgttcaactcactcgtgaacatggcctacacgctgctggggctgtcgtggctgcacaggggcggcgcgatggggctgggtccccgctacctgaaggacgtgttcgcagccatggccctgctctatggccccgtgcagtggctgcgcctgtggacgcagtggcgccgtgccgcggtgctggaccagtggctcacactgcccatctttgcatggcccgtggcctggtgcctctacctagaccgcggctggcggccctggctgttcctctctcttgagtgcgtctccctggccagttatggcctcgctctgctgcatccccagggcttcgaggtcgcactgggtgctcacgtggtggccgctgtggggcaggcgctgcgcacccacaggcactatggcagcaccacctcggctacctacttagctttgggggtgctctcttgcctgggctttgtggtcctcaagctgtgtgaccatcagctcgcacggtggcgtctcttccagtgcctcacaggccacttctggtccaaggtctgtgacgtgctccagttccactttgcgtttttgtttctgacgcatttcaacactcacccaagattccatccctctggcgggaagacgcgttgaacccagggaagaacctgctgaaaaccgatgacccccagcattgaaatggactctgagatggcagcgtggtgccagtgtcagacatcctgtgtgtgatgatatgcactgatcacacaagactgccctttcctgagaagctgcgggcttcggtgtggaggggtggagtgctgtgatctcgacaacttactttcaaagacataaagcacagatctccgcacaggggatgtgtgtgttcctgatgtaatttgcataacttttctgtagtttgaaatgtttccaaataaatattggcaaggggagtggaaatgacaccaagaagcccctcatgctcatggttggacagag

SEQ ID NO: 36581 - DNA, 54913 bp, Homo sapiens
gatttatggaaagcacctggtgcgtggtgagtgtgcgaagaatggtggtgattttactaatattcccttttaatttgaaactctgaaaaaagaagataccttacttccgtactctttccattataccacctgcctttctgaaggataaggggggataagtcggactccttggaagagaagaaagaaataggtatggagaggctgatgatttgatttggcattatagcacatgggagagccctagtcccttgaacctctatgagctcagggctagagctggggcctgcgtccccagggtccatggccctgctgctcatttctggcagaattagagactgctccttggttctctttcagttttctcttaaaaagcgctttgtcttaaggagatacaaagggatcccccaaattagaagggacttccatagtctatctctagtctgtttgactttcctataatatcctgccctcaggccctctgatttctggaagtcctggaacttaggagttcctaactctaccttagccccgactgattgtcagtgtccagtacagggaggggacaggcatcttgtggggaagttgggatttgggagtatgaccaaacatattgatcatacctttttttcctcgtaaaacaaagtatagaaagaaagcgccataaagtcttggttaatgttgatatgcagaaaatattgagaataataattaactgatgattaaatgacctttcctgagtgcttattctgtaccaggtactggtttgggccgtttatgtgcattaacacacattgtagcaacgtaggtaccattattattctcttttgtaaaattaggaaatgaagcccagaagaaacttggctatggttacacagtgccaggatgtaaaggcagtaggcaggcagactccagagccagagttccaatgacaaaggattacaggaggcatgaattctacaaaattgtgaaaccctgtacttggtaataactgaggcctaaaagaactacttcttcccccaaacaaatccacaaggaggtttaagtactgctttttggagatgggtggagagaggattgaagaaataataaactgtaaaatattaggaaaatatagaatgatatgtagaataagataaatagcatgtaaccctactacctagagataagcgcaaagaaatgctcaaaggtaatagcatcagcagttctctccctacaggcaaaaaaatcaaaatggagaagtaaattatgagcagaaggttgcttgttgggcatagaattcagaccaagggaatttagggctcattcattaattcattcacaatacttagggactgctgtctgccaagtacaccgtgctcagtgcttaggatgcagtggtgaatgatacgacacatacaatttagtggagcgtgtgtggtgttaacaggcctgagatggccacagactcaccgtgggcctggaatactcacgatggggtggctaaaggtgtctgtgaccatgactgctggggtgggcactgctgtcttttgctgctgtgactccctttttcttgttctacaaaattggtcactttctccatttgcgaataaaggagttgagcctggaggtctttaagcacctctccaactgtaacattgcacttcttgttttgttttagggttttttggtcccagggaacctcgttttcagagcagtggctcacgcagatcctgagcccagttaatggtcatacctttccctgagtttatgttcattctatcctctgagattatctttgaagtctcattacatagatgtctgtaaaatccttcaagctatggacagccaaggtcagaggcacattttctcataagtggctgtttctaaattcataggtttgagatacataaagataaaccaggttcctttatgtcaatttccttccagttctgccctctgaggaccctgccctttcccaaaaggggtatcttaagaaggaaaatatggctgctctttgccggacagcagagtcccaggtgagttggggattttcctctcttcttggaaattttattttaattgagttggggattttcctctcttctcagaaatcttattttaattcctgaagcaaattttttttctcttagcatgaagcttgtcaaccacattagccacagcagtttgaaaggaaaggatcaagcaggtgggatggactgccaatgagatggtgtttgcgtgttcctcagttgtatggcagtagcagtgaaggtcaggaggcttggtagcctcgcccatcagttggcagtgtagagaaaggatggtaggggcaggatgggaatgaggcctctttagcagataattgaggagcgtgactcctagaacatggttgggtaagaatcaagcttctttttgttcacttgagacatttggcatagatatgcaaaggcacgtgaggcatttcttgcttgcatctgcttagaatattttggggagaaaagatgtacacaaatctgtgtggcacaaaccagcagatttattattattaaatagggccttattattaagggcctactcaatataaagtgtcttagggaaaatgctgtatggacttggaggagcaggagcaaatgtgtctggctgagagagatttaggaaggttttattcattcaactagcattttaaagtccttttaagcagctcctaggctaatgaaagtagtgagatttgatgtgggccctgaaagctgagtaaattcttgaaagatttatagaaagttagtgacataaatgacttagaatcaaagcaagatactgattcctctggcacaggaaaaaagtcagtacattgaaatcacagaggtgttgttccacaaaaacttaaaggcttcttatactcaaagttctttcctagatataattctcaagcttggcttatttctttttttctttttttttttttttgagacatagtctcgctctctcgcccaggctggagtgcagtggcgcgatctcagctcactgcaagctccgcctcccaggttcactccattctcctgcctcagcctcccgagtagctgggactacaggcacccgccaccgcgcccggctaattttttgtatttttagtagagacagggtttcaccgtgttagccaggatggtctcgatctcctgaccttgtgatctgcccgcctcggcctcccaaagtgctgggattacaggcgtgagccaccacgcccggccagcttggcctatttcttagtttcttacttaccatgtgtctctctcaacttaactgaagataaccttaaggccggctaaacaataggcttgggtgggaaggccacatccttaatctgacattttttttacagggctaaatcactttgtttagttaacaggtgtaatgggcctttattgctcaaagctcttgttagacttacttcccactgtatgagatctagaaacagtttgcttttccaaccacgtgaggcctcagatttctgcactctattctcttttgttttggcttgaaaattgacacattgtttcctgaacttaactcattctttgttcgccagacatatccaggagcattctacacaaagagcgttctggtgctttccaacctgttctagagccacaggcccagtgagcatttgccctggcctcatagttgctaattagtttgccagtgtatattaagagtctgcatctgttggctggatgcggtggctcatgcctgtaatcccagcactttgggaggccgaggtgggcggatcacctgaggtcaggagtctgtgaccagcctggacaacatggtgagatcccgtttctactaaaaatacaaaaaaaagtagctgggcgtggtggctcacacctgtagtcccagctactcaagaggctgaggcaggagaatcgcttaaacatgggagatggaggttgcggtaagccgagagcatcgtggccactgcactccagcaacagagtgagactccgtctcaaaaaaaaaaaaaaaaaggagagtctgcatttctccagtcgtaaatattcttttctttgaagcttgccacctgactgtcaatccaatgccacctgtgtatttgaactttttattatgatatctcccacttgaaggtgctgatttctgaattagtttgggttggcttactaataactgttgtaaccaatagacccaaaatatatatggccttaatacaatagaagtgtattgtttgctgtcatagccatgtgagtgggtatatagattgataggatggccattcagggacctgagctacctgaagctctagcctctttaccatatggcttccaaactcactctggggctcatggccctaccagccagtcagaaggggaaaacagcatggaggaacatacgtgagtcaggcctggaaagggcgcacatcactcctgcttgcattccattggttaggatctcatggccaggtctaactacaggaggttgggaaatgtttgtatacctagaaaggagaggaggaggcatattttcatggacagttagcagctcgtagcactgttctcaaacatttaggttatttagaacgattttgctatttttctattgtaaggtataaatagatgtgattctttgtttataactctccatatttctgatagttttctttttttttttttgagacacagtctcgttctgttgcccaggctggagtgcaatggcgtgatctcggctcactgcaagcttcgcctcccgggttcacgccattctcctgcttcagcctcccgaatagctgggactacaggcgcccaccaccatgcctggctaattttttttgtatttatagtagagatggggtttcaccatgttagccaggatggtctcgatctcctgacctcgtgatctgcccacctcggcctcccaaagtgctgggattacaggcgtgagccactgcacccagccgatagttttcttataattgagttctgtatataaaattactgtaaaacaaaactatcaaattatgtcagaggggtatacacattttaagattttaagattctttaatatacgagtcaataaaatcttgtctttgacactgtgaacatagtttaatctatttcctctccatcccatcagtctcccctaagtatgcctcatgtaactttttcttcagaaccccatgcaggtgtttcagggctttatgtcattcaaggatgtggctgtgaacttcactaggaagaatggagagaactggaccttgctcagagagtcttgtacagggatgtaatgctggagaactataggaacctggtctccttgggtgagcttgggtccttccaccccagattgacctttcaggatacctttgccttctaaagattcccttgcttctattagggaatggtaacaaatgaggctttggttattttcccccacagaatccagatcagatccttaaactgtttctcaccctacttgggtagaaattatttaattgcttttgacaattagttatttcgttttctcctctctaaaatgcaacagagtgggactgagaatagagtggtcctttctcttttgaacttaaaattacattctgtttgtatctcttcagtaggatttccattttccaaacctggtatcatctcctagttggaagaagtggtaagcccacgaacacaaatgcaggagggagaggtgccaagaagcagcggtacacgtaagtgagaacaaggcagattgcatctttagaaataagagttaggggttcttcccaaatcctccgggcctgtagaaaatgttgaatccccctgcagtctcatcttcacttgaccacatcagaatcctaatagcttacctctttatttcttcccagactcaaggaagagatacttcctccttaaagttataagcccaacacatgatccagagatcagctttgtgcctcatcctgaggcattttatgaggctattcccatttcctctttagtagctggaatcacttcttcatttactctgtccttatcctacctagttttctgctatataagaaatatgaagagaaggaaagaatttgaataattttaaggatataaaattgacataatttgttgtgtagatttgagaggtgagggagtaacaaagaaaattctcaggtttcggccaggcgcagtggctcacgcctataatcccagcactttgggaggccgaggcgggcggatcacgaggtcaggagatggagaccatcctggctaacatggtgaaaccccatctgtactaaaaatacaaaaaattagccgggcgtggtggcgggcacctgtagtcccagctacttgggaggttgaggcaggagaatggcgtgaaccccaggaggtggggcttgcagcgagccgagatcatgccattgcactccagcctgggtgacagagcgagactccatctcaagaaaaaaaaaaaaaaaaaagaaaaaattctcaggtttctggtctggatgtgtaggtgaatggaagttctcttccctgagatggaaaacacaggagaagtagcaaatttagggagtggaagatgagttcagtttctcttaagttgtttgaagtgtctataataagtctaaaccagtggttcttaaccaggggcaagtttgccccccgggggacatttggcaacgtctgaagtgtgctatgggcatctcgtgagtggagtccaggaatgctgctaaacatcctacaatgcacaggacggggccccacacaaagacttgtctgtctaaaacggcaacagtgctgcagttgagaaaacctgctctaagtggtaatgtctggaggctagatgaatataaggacgacatgccaaatgtatcttagtaaaggaaagagatcttaactgggggtacagatttgggagttgcctgagaatggatgaaattgaagccatgggagtggataatatcacccaaagagcacaaaaagagttacaagagagcctagaactctaacgaacacaaacattcaagtatctgcaaaaaaaagtatatatatatgtatagtatataatatatatatttttatattatatatgcaaatatatatgtatatacacatgtatatatacgtatgtgtatatacacatacgtatgtatacatacacatacgtatgtgtatatacacagggcttctctccagtgtggatcctctgatgttgggtaacatgggcgcttctactgaaggctttcccacactcctgacaatcaaatggtttctttccagtatgaaccctctgatgctgggtaagagatgaactctggctgaaggctttcctacagtctttacaggtgtagggtttctctccagtgtagacctttatatgttttgtaagagttgagctctgactgaaggcttcaccacattctttacacttgtagggtttttctccggtatgagttctgtcacataaatgtggcagagctttcgtgtagttcagccctcattagacaccagagacttcacagtggagaatctccctgaatgtctggacaaatccactcagactcttcatttggttaaataccaaagaattatacttttataggttgttacagtggcgatgctttattatattttaagggatgaaaatccctcctctcctaccctggttattttctcttgcaaagctatcagaatatcacaaatccaagtgaagaaacactgaactgaaatctggactagcctaatagactctaaagctcaatttttatatgtatatgtgtgtatttttgtctgtacctgaaatgactgctgtcaccatgcagtgattttaccccccttccctggcctcaggaataagccaagaaattctagttgtgcagaactgagcttgttgccccttcttgtactgatggaaatagtgccatgtccaaacaaaataaagaagctcatagctaattacatatcctaataccaccttcctataaaactttgccttaatctgtagtcattcctgcccccagctcataccctcctgtgggcagcttttgtttgctttacctcatcccactgttttgtgatcaccccccgggagatgagggactcagttaataggccagatgtcaagactgatgacatttcacacactaagagaacttgaaagtttactattcatacacagggtttctggggagagcaggatagatgaaagctggtccaaaatggcaagaacagagaggaggctgggcctttaaagtagctagggaatggggctggagagcattcgatctgtgggcttgagggattcaagcttcctgccagtgctgggagctcaggagatgcccatggatttctttatctaaagcaccaggtgtgcggtggggcagtgtgggggaggggagaatagaaaatggtggaaacttaaatgctgtcaatggccagacatcaaaaatggggccaaactctgttacatctaccttttcagaaatcttttttcacttatctcaaaatagctctttaatgttattgtgtcttttttttttttgagacggagtcttgctctgtcaccaggctggagtgcaatggcatgatctcagctcactgtgacctccgcctcccaggttcaagtgattctcctgcctcagcctcccaagtagctgggactacaggtgcccgtcaccatgcccggctaatttttgtattttttgtagagacagggtttcaccatgttggccaggatggtctcaatctcttgacctcatgatccgcccgtctcagcctcccaaagtgctgggattacaggcgtgagccaccgcgcccggcctattgtgtcttctgttgatgaggaatctattttgctttttccatctcccctttcttagaattttcttttttttccccttccttaaggctgaaattataactatcagttctcagaaagtaagaaccgtttaccttggaaactgtcagccttacatagtaactattatgcaatcccaacagaagagttagggaagattgagtcaacacttttagaaaacatttttaaaaaaatggtcatatgaatttgtatcagactatcaccagattaagttacttgaggctgcctgatgaaaatttctgtatatggctctaagaaattttatgtgtacctaataaagccaggcattattttttggttatgctgtgactcaacacttacatgcaaacttttttttttctttcaaatcttcctaagcttaaattgatgttagagtaacttttttggtttccatgaattattttccctgccttttttttttcttcctgttttagatgcatttcagttacctgagagtaatccaattgtataggattggagtcccttgactttcccatatcattcccagtgtactagccagaacctgagatttccctgctttctatttttctcactaaaagggctattctgaactctctctcctcacctgctttcctatccttctcttctgtttaaagaagtcggtgttagtacagcttgaaatttaacagggcttgaattacagaaggcacaactgaagttagagaagaaaggatttttgttctgaaaattagcggtgagacagaccactctgaataaacggtgatatctggaaataatttttgaaatgcccaaaatccttcgtaactttaagaaattgaaaaggggtggggagggtcgtctataagagtgtctgtcattagaataagacttcttaaagtaatgtttgttaacaattggtaacaaggtcatttccaaacatagttcctggagccagttggctttggattggtagaaaccattgttgttccttcagagtcctcatctttggtaatttattttagaactaaagactgaagacagatgtccttgaacaaaaggtctgtcctagaatgggtggattgcatgaattcgtggattgtactatagtgaattggtataattctcttgtagcctaaatataatttggatccagaaatattaaaattttgaggacattatagtgatgaaatatttgaaatcagaacagttctagaaatattatgactctgggacttacagagccttttttgttttgtttcagtttactctgactgtactgttagtagtatggtctatgcttgtgctctcctctcagattagtttgtttgtttgtttgtttgagacagggttttgctctattgcctgggctggagtgcagtgacgccatcacagctcactgcagccttgaactctcaggatccttgatcctcccacctcagcctcccgagtagctgggaccacaggcaagcgtcaccacacccggctaatttgtttgtattttttgtagatggtgttttgccatatagcccagactggtcttgaactcttgagctcaagcagtctgcccaccttagcttcctgaagtgctggcattactggcatgagccgccacgcccagcatttggatatttctataacagggttctctttcgtgggctgtagtgtagaccacacttacccttcatgatggagaatataattcctctccttttacaacctaagctaaagctcagtgtgtttgtttggttgtggtaaagtctggggtgggggtttgatttggggctttagatagtaaatgttctgatattttgatctctttttggtaggtaatctggattctttagtttttaaatcatgagtgtctaattttctaacttatatgttaaaattgcctgtatgcttggctgatatgtgtccaatgaagggaaaattaatttatatgttaaattaattcctccaagcaaattatcctgaataatttgcactgttgtgataaactaactagggtgaccccaggcttgatttgaggattgcaggaagagatatttagtgattaaagtagggctttctgtcttttcggaggaggcattaatactttttaggttttctttaagttaagaggcagttgtcacgttatcactcttttcattttgcaagttagtctcctttaggacccagcttaaggtattacctccaccctcacctcttggccactgtaactgaaaataatctcctcctctgaataccagtgctgcttacttactatttatatcactcacatatgcctatgaaacatgacaattttggtttgatactaatatccggccttattctcaatcttaacatcatcagggatcatgattttaacatcattatcatcatgatgagggaaacctatctttgtttagggctttcgttgctgattttacacaaaataatacttgcatacggttaaaaaaatcacgtgaaatagagtttttcaatgaaaagtcattcttctaggaactttgacctgttagatatatatcgtatatttgatgactgctgggtatgttttgccaagagtcatctatgcaaaatacagtggcttgagataaacatctcaggaaaaatcatctcatacttatattttacttaacaagaattcacccatatgcaccaagatatccccccaaaccaaaagataaattagtgtaattaagaatactataaaattatgttttgcacacctatataaaattctatatttatctattcatgagttattatcagagctatacacaaaactaggtgtattttatgggcaaattcaaggatttataaagacaatattggtattgccctgttttcatcttacatgctgactacagaagtaaccttgtgtaagagcacgacttcagtgaatctagaggcccagtcagttcattcgtgtgctagtttattcctcttcctgagtgtttttccttggtttgccaaagttgactgtatcagaagatatgccaatttatcctagtaggaagattgctaggatacagcaacacggtgaataaagaagcacttcagattaatccaagtccaaaaaaactccacgtaaccttaatcagcttcatatattagtcctggaataaatgtgactatagtgaaagtgggaagacattagacaatattcatttgtatattattgatatcagatgatgcacactgacaaaaacaaaaccctagaaatacagtaactgtatagtgaagtcatggcttaggattctttgcttattcagtatcacggtttttataggaccccaacactagaaattaaaaagattccagtaacaccaacctaattgtatgtagaataatcttcagtggagaaaatacttacaattgtatagaaagcctacagtggatcatttgtcatcatccctgttcatagattttagaaccaaagggaactttgaatatataatatgggccttttattttgcaagtgaggagatggagatctggaaaggttaaatgatatgcccgtgctatttggggtgagggcagtggatagtggagctgagcttccacagacctcccaaccctgcataaaaaaaagacctttctgtgacatgtagaccatagagagcatctgggagagcaatgggcatagggacgcttcgacgtgggggaaattagcggctgattgagggacaggagggagctggtttacatttagtggtagttattgactggagcactgtgatgaggccatggtacagagtgctttgaagtcctgccctgggcctgggaatagagtctggatacatgtgacaggctttgcatccttgttgcttctgccctgtggcaattggggatttactggatgaaaatgggttttcttcttactgaatttaaactgcagaatatcttcaagctatgaaaataattctgtgtgcatgcacctgtgggttagaacactcattctaactgacatgagggaattatctcatgaagactttacctggtgtgatattcttatgagtgaatgagtgaacaccttttgtttctctactttgcactcacaagactcattctttcacgttagtggttctcaaccaggggagattttccccctccaggagacaactgccagtgtctggagagagttttggttgtcacaattgggggagggggtgttactggcacctagaggatagaggcaagggatactgctaatcatcctacaatgcacgggacagcccctacaaaaaaggattgtcccacccaaaacggcagtagcactgagattcaggaatttttagataaccaatttactgtggcagtatatccccacgaggtggtggtacagcctcctgctgcaatgttaaactacagtagttcaccgtgagcagttgattgtaatagcgaatctattctctttttcaaaaagtacacttaaacattttttacattacaaaagtgaaatattctttgtgacagaatcaaatagtatactgtagaagtgtataagtaaaagaaagggcttcctgagttcccccttgaaatcctaccctttagaattgatgtgtatctttttagattctttgcttgtgcgtgtatatgtatgcatgcataactagtagtgtactgtttgtttttcaactcacttataactttcaacattatactttagacatctttaaaaataatttagaggtatctcatttttttaaatggatgcattgtgttctgacgtatggatgtcctataatttctatatattcttattaatgggcatttgggttctttccagttttttttactgatagaggcaattcagtggtcatgctgctatttctgtaggatagattcctggaaatgtgagagctgggtcagagtacatttaaaatattgatgaattggctgtactagtttatactctaacagtgtagcagagtgcctttttctctcccaaacattggatactatcaagattttatttttaatatatattttattatatttcattcttaataatgttgaatgtcttttcctatgtttatttttctatgtttatcagttatttgtagttcttccatgaattgccttttcatttcctttttccactttttattgggttgctttctttttatcaatttggagtagttccttatacattttgcttattaatgctttgtctgaagtttctttttgaatatgggataagttaaggataacatagctagccaattgaactaattgtccttattgaataattcctccctttctcactgagttgaaatatatacgtatatgaatctgtttttggactgtgttccatctaatgctgtgctagtttcacagtgttttatttattgtggcttgtagctggttggtgaagaaggatgggaagaatgtttggtggtgtgttttcatgtgcaaaagtgtgttttcatgtgcaaaagcctagagacaggagaaaacggcaagggactgaaggaaggccagaggctaaggaaggaacgagggcctgaggaagagggggaatgacgctggagcacaggtttggctcagatcatacaagaccccacgggccattttcaaatttggatctttattcttagagccatggaaagattttaaccagagaagtgacatgatcagacttatattttttgaagctttctttggatttctgcttctggctatgatggagtaactggtactaggctagccctcccaccataaactgctatacaacatgacaaaatagatgagacaactattttcaggcagtgaacaataggtagcacagaactactgatcccagacagagggaaactcatgaggtgaaccccatgatcacccaactttctgtcttagaactacttccaaccatggcacagatagctggagtccatgtagagcacagtggtcccacggagtggaggatgtggaaatcagggttcagagcagcggaagcagatagatcgtgcggggtgagatacagagaggagggagttgtataagagcgtacacgagtacatggataggtcccttgtaagccgaaggttgagaggcaagctgaacatgagctaggtgagatcactcaagggttataagatagtggctactgtggggttgagagtggaacagtgtcccggcgggatcctgggacatacaaaggacactagaaaaaaaaaaaagaaaatctgagtaagtatggacgtcagttaataatgtatcaatattagttcattaattgtgacaaactatcatagagtaacgtaagatgttaacagtagaggtgttgtgtacccctgtggtagaaagattgaagggtcttatgtacccctattgggtgtggggtatataggaactctttaaaaaagagtttgatctaccatggtagagaatttattctttccatagaaatgatggaattcttagatgaagaagcattcgaagagaagtcaaccaaaacatataggaagaagaaagtatcatagatgtgtatcaggaagttaattgataaatattctctctgggggaaaaaaaaagctacttctgcttgcatcttacacaattgcacgtgtacatttttgctggaaaacaatcagaagtcctattttgttacttagaatgttataaagtcatgtactcgagagttgagatataatgaaattaataatttttactgttgttatcaagtacattcttaaatgaaactggctttttttaaaatttattttcaatttttgagtgtgtggaaaagtacaatgactgctagcacagtttggtgccactgctttgatatgtgctgaggcctcagcaattttactcactattgctcctgcatcattgcgcaaatgacaatatggtgaaaatagcaaagaatactcaagtgttatcatgaaaatagttttgacctcacacatccctgaaagggtctcagtgaagcatcaagggtccatagatcttgcttttagaaccactgggtaacagcaggtatctggagtttatgtaagatgaaggaaggcaagactctacaaatactttatgcttttagacttatcccattcataagcctattagttctgctccatccaccgcccccccaaggcagagattattagactgaataaaaaacaagactttcttacacgatgcccgtaagagatgcattttaaatatcaagagccaggtaggctggtaaaaggatggggtaaagataataccaaatagcccaaatgtagaacaaacccaaatgctcatcagcagggtaatggatgaacacgcttggttacagacatagcatggaatgctactcagcagtgaaaacaacaggctactgatacgcaccatgacatggatgaatctcatagatgttttattgagtgaaataagccagacacaatagtgcctactatatatttccatttatatgaagttccagcacaagcaaaactaatttataatgataaaactcagattcttcgttgcctggaaccaggcatggtagaaagattgaataaaagggcatgagggagcttcctgggtgctgccaatattctctatcttgattgggtggtggttaccagaatggagttatttgtcaaaactcattcacctggatgcttaaaataggtgaattttattgcatgtaaagtatacctcagtaaagttgatttttttaaaaagctttctctgagggtgggtgcagtggctcacgcttataatcccaacactttgggaggccaaggcaaaaggatcacttgagagcaggagttcgagtctaacttgggcaatacagtgagaccctatctctaaaaaataaaaataaataaatacataaatgaaaagctttctctggatgcagaatggagaatggattggcaaaagcaatgagtagatgtaggaattctagtgtggagcctattgccataatccaggcgagagacaatgatggcttggactctagtaatagcagtggaaatataaagggtaaagggtttggagatgtgtgagatgtaaaatggtgatggtatggacatgggttgtgacggaaagagaggaggtagggatgctccctgggtttctgatttgtaatctagttgggtgctggtggcaatctctgagaaaagaacatgaggagggttaaatttgttgtgttgggatctagggaggccttacatttaattttggatgcattagattcaaggtgcctgtgagaaagtcaagtctttatacttagaaagtagttggatatacaggtctgaaagttgagctgagacatcagtttgtgagccataaacaggtggtaactgaaggcgtaggaatggatgagctcatctaggaagagagactaagttgggaagaagtgatcttgagttgagcttcaaagagcctctcaccttttcaggcagaggaagaggaataagaaaattggactgaaaagtaatggccactgagatgtgggcagccaggagaatgtgttatcacttgaatgttacccattcattatctggtttcccgatacattatgttgttttctttctttattttttttattctttttattttttagatagagtcttgcactctcgcctaggctggagtgcagtggcaccatttcggctcatggcaagctctgccttccgggttcacgccattctcctgcctcagcctcctgagtagctgggactacaggcacccaccaccatgcccggctaattttttgtgtttttagtagagatggggtttcactgggttagccaggatggtctcgatctgacctcgtgatctgcccgccgcagcctcccaaagtgctgggattacaggcatgagccactgcgcccggcctctacagcctctttaaaactacttaatgtgatccttttctcatgccattaaataatgaaaagttggttttcagtgagttgtatagcagcagcttaaaaaagcaaataataaaactttccagaagcaaacacaccctgttgagcaggtggtttacagtaccacccaactgcctatgccttttttttttttttttttttttgagacggagtctcactctgttgcccaggctggagtgcaatggtgccatctctgctcactgcaacctccacctcccgggttcaagcaatcctcccacctcaccctcccaagtagctgggattataggcacatgccaccacacctggctaatttttgtatttttagtagagtcggggtttcaccatgttggccaggctgatctcgaactgatctcaagtgatccacccaccttggccttccagagcgctgggatgacaggagtgagccaccgcgcccggcctgtttcctggttcttggtcggggcagcagatataagacacatcatgacgttgatactgtgacaggagccacttcactcaggaagcctccccgaggcgcattttcctaggacgtagtctgtctagctctgagacgctagagttgatggatcctgctgggaagagagcgcagatctaaacagaacagggcgcttgtggccacaggtcgtctctgtctggatcacatcagtgttttgcccacctttgttgtcactcaaactcctgacctcaagtgatccgcccacctcggcctcctagaatgctgggattacaggtgtgagccaccatgcccactggctttcattactttcactctcctccagctctcatatttactgtccccgtcttctgtgctttacaaattctctaaccagttgtggccaaacctggtgctgaatagattcatactttttcagcttaacccaagcctaggttccctaaggctacgtccagtcctgctacgtgctctgttttgagtttcacctgtgcctgcttctctgccctagaagagaagatgggatcatctgtgctgcttcttcaaccttaaaatggatttcttgcccttttctccctttttaagtatcaatgtatgaaatccacctgtaccaccctttctgccatacaaccgctgccacatctggctcctagaacctgttttgctttcatagatggatctcggaaccaagtgttaacttcatttttaaaccccattttagcagatggtttgctgtggtctgtctgtattcaccatggggcctgtacacaccacgtgtggttttagtcaaacacagtgccctccattgtggccacatgggagacccataacccaatactgcatcctgggctgatgacagcactgcatctgaccagacatgggattgacccggggtgggcaagcggagtgaacaggatcagccagagttctctcatggcattcattgtatggagactggtagggacaaggtcctttccagttttggaccccaagctgtaaggagacagtttgggcctgctatttggcatctttcctggcacctggagagagtgtaccatttaggatgcttccggctgcagcaataaggacacgttatcttacatgatttaaagcctgaaaacaagcagtttagatagtttaacagctcaacagtgtcactggggctctttccatttttctgtttctttatcctcggcttactgacctagtcctcacgttggttctcatggttgccagaaggctgctgctgcctgagaagcagaaatatcagtcaaattagaagggaaggtggaattccagagatattgtaaatatagaactggcagctgtgctcttcatgggcagggcgtgtgtcatattctgtacttattttgtgacctccacaaataagtatctagtgttcagcatctaatggctgcagaataaataatgaatgaatgaagcgatcctgagtggagaggagagtggcacgtgcaaatattttccaagttacctgccaggccaggccagactgggacaaatggacgtatccagagggcacttgggtggttgggaaagagttaaaatgaggaaagatgtttcaggagaaagaagaaatgccagttcctgagggggtattgtgcccttgtcctcctctcttggggaggagaaggctcccgagaagacagagctgacagtcaattaggaactgagggttcacagcccagcttcttcaccaccagcccaagtctaaagaaactcacaaatctgctagtgagtcaccacctccctctcctctgagcaactgtaagatacctagtagtagccctgccctatcctggaattagccagaacgtcctcatgtagcctaccaagaccgcttctggccctgtaatcaccagtgtgcatttgaattctgactccactatatatcagatgtatgggtttgggtcagttacccaatctcattaagttactgttttcttatctgtaaaaccctgtatctcatgtagataatgtattccctgcttagcacagtccctgcacagaatgtgtagtcagctatgatggtgctggtggtggcagcagcagtggcagctttcaaaggctgatctgctctcaagctcgagacaacacatgaatgaaaataatagctttgtgctagaaatgctctttgggagttgaggctggcatgttctgcgggtccaactacaggaaagatgaaatttaagaatggaaaaccaggagattcaaaatagaatgtgtgcattgtgtgtaaatagtagaagaaatgggtgagtatcaactaagaagtttaaagaaagcccagtgaagttgtgttaaggaatctgggactcaagaaaactggagggactcaggagcagccacttcctatcccaggatccacaagaaggtcccccacagtagctttttaagctttggagtcacaagtgtgcatttaaattctgactccatcattgggagtccccatttctgactcctcatggggaaagaggccggttttacaaatatctcttttaagagccaaggaaacgccatcagtgttctttccatatatcatcaacttaaatttgcaaagacttctttatccctgaagcagtcaccactggccgacaggctgcagtaaccaagtctggtgcagataaacagagcccatcctgggagctggagtgcatggatgtcggagggtcatgttttccaaactgtggaagaaaaaacaaaaagctatgttcttccaggaggtatttagaacggagcttgagtttgggattcagatgcctgggcctgtgtagttcacttgtggggcaccccagcaggggcctcctaatggaaaatgcatcctgagagaaggagttaattataagcttagctacacctcagaatttcagggtcagagtgggaaagtgggtctaaataggccagaatctgtcactaggagctgctctcaagccagcttccatggcgtcatggagcttaagggagaaaaggcgctctgagtaaagagaatgagcagtttcagtaacattagagggacacattgtactaagcatccttgctctgggcttcatctaacaaacaatatattatacttcattaccaggcaacctgggcaccatttggactgcagggcatcagaggcagcaatgataggaaaagaaggtgcccagtggaagacagtgccccagggactccaagaaacactgagaggaggggttgggcagatccgagacccttgcttagtacacagggaaaggagctgcgaaatatgaatgttgcctataaatgtgacaggcttctggggaagttggggtttcttacattttagagagaggagggtgatccttggccagctccttgtctcacagcttaagagaactcgctggaaggagccttcacctcctcaaatcctgctgtgtttgtacccataagattagcatacaagttcctttgcatttgcatgatgtgttcactttcattttctcacaaactgtaaggtttttgtaaggttgttgtaagtttattggagcagatactacatccccattttagaggaggaaacagattcagagaggtaagctacttacaaaggtcacacagctaaaaggtgctgggatcaggactctgaccacttgacacttctaactccagattttctttctgaccatattgggagccctccataacatctaccatttaccaggtcttctgattaatatgcctgtttccttcctactaaaatactcttgacaaggcagtggttattttgctctcacggaggcaatagccccctctgtgttctttttttttttttttttttttttttgagatggagtctcgctctgtcgcccaggctggagtgcagtggcacgatcttggctcactgcaagctctgcctcccaggttcacaccattctcctgcctcagcctcccaagtagctgggactacaggcgcctgccaccacgcccggctaattttttgtatttttagtagagatggggtttcaccgtgttagccaggttgttctcaatctcctgacctcgtgatccacccacctcggcctcccaaagtgctgggattacaggtgtgagccaccgcgcccggcccctctgtattctttcgagcattcttgttgctttgtttgcttcctgagtctatgcaccatgattggaggagggctgcctctcatcccaggaaacccacgtacagatgttaggcttcctccatgcagacaatcaggggtatagaaatatggagtgtttaaccatctggttttcagcagtgaggtggaaatcaaaaccatttgagcaaatgagtgtcctaggggaagtggaatgaagaattgagcttcagtggctgctgagacataagccatccctagcggacttggctgaggcagactatgttgtttatagaggaaccggctcattgtcctctggccctggccacagcaatcgagggaggggcacattttttggcccttgaatgaacaatgctttttccttcctttgttgaggggtctaggtctgtggtccttacttattgtttaaaaaaagaaaaaacaaacctctgagtaaatattgggaaggtgaagggtggaggggatggttttctgagattctttccaacactgaagggctatatctcactagtaaaaacaagaggaccctcaccctcaccctgtaacttgttgctacctgaaggtgtctgttcgcttacctacctgtgtgctcctgcccagcaagcccggcctgccctgccctggccattggccttgctgagctgcttctcagtgccctggaggcattcacacctggcctgagataagtctgccctttttgaaggtgagtgcggctccctggaatgtgtggtatcccagcaaatagcaagattagaggtgcccattttgactgggagctggacagctgcccaagttctagaaaaccagcagtgctgaaacaacaattggctcagggcctcaggggagccggcctgggaaaccatctcctgtcccagggcaagagaacatttgttacagattttttaaagatttacttcatttattatgtgtaggttgttttgacatttttaggcataagccataaaggtaactagagttagatttgtgtgattatttgggtttcataccaatgttagagttattacagaggttgatatggagattcaacaaagcatagttcaaatgtgctatgtgccgcataaaatgtcacgcccttgtgtctggaatttactgagagtcatttgagatgtggtcaaattcttgagctctccatttccagggcattgcagactcccccaagtaggtttctaggtggtctagctgctaattctggccccgtaagcttgggtggtctgagaagtgatcaaagcggtgcccgtgcaccacagccacacctcactggaagacaaaagagaaccctagaacagcccaggactagaccttcggagacttagggaagaaatgaccgtggtgcacctccttagctggcagatgtccgtcgctaagggcatagttgaagctgacttcggtgttttcttcatccagtagtggggtccttcaggctgtgtgccaggtactgagctggcaatctcgtctctgtaccaactggtgtgtcctcctgtctttgtgaagggaaggtacacgcagtgccctgggacagcccctccttcttgcggaggagccgtcattacaacaatcgtgttctgagactaggagcaacggcccttagtgtctgtaatctgctgtttgtctcacctttatttcgttcctttgttagtggtaattaattaccaaagtgatccaagaggccatcttcttcttttaggagaaagacagggctggagaccagtttgctgatagtgaccccaaaccagaaagttcattgggcctgcacctccaggtaagccagtaaaattctgggctggtttctagaggagtgatgcgacttccagctcagtggttctcagactttgagattttacgagaaaaattgcaaagtgaatttggaggactgacttagatgtcactcttccggacattcccaatcctacactcattactattatttcagaaaagataagacctttaattccagaaaaggaggaaggacacaatctcaataaagtacagtcccataaatcaatcaaattcagggttacgatcagtttatgatattatttttatttttctcagtctgatgggctgatttgtcttgaagtctggtggacaaatattacctgtgtttgtgaatcatagctctgtgtgactcagcagagacacaaatgaggaaaaaaatccagtgagatttttgaagagacaaatgaaaggctgttttggcttagcaaaaacgcttggatagcttctttagccagaaactgctagagagagtctttgggttaagaaagctcttcttacttgagttaacctagagtcctgagaatgatggccttaaacccctaaaccaggagggaacctgttggcaggcattgcttatatcctttcagaggacataactttcagagtttgtccattggtgggattatttgtcaagactcaacaggatgaaagatgaatacttacctacctactgccaattgcctaccacatatcttggtagcatttgagtcatcagaattctgggtggggattcctccctcaattctggaaaggaatcctgaaccacaccttgacctcacattcctggtggtaggtttggtttaggaaaaaagaatatctaggtgaagttacatttgttttgtgaaggcaagagagacacttcattttatgcaagagatacttcattttagcccctgaatgcttggggttaagaggaagccaatgatgtccaatcaacacctgatgaacctgaggcattttttccacggggcatttaagcaagctgtaggcatagtcagtaggattctcaattcttaagtttggaggttgggatttctgttgaatgcagactccaggtgtgaggaaggaaattcagatgcatgctacgatatgaatgaaccttgaagacattatgccaagtgaaataagccagtcacaaaaagacaaacactgtatgatttcactcctatgaagtgcctagagtagtcacaattatagacagaaagtagaacggtagcttccaaaggctggagggggagagggaatgaggagttattggttaatggctacagtttcagttttgcaagatgaaaagagttgtggagatagatggtggtgacaactgcacaacagtgtgaatgtacttaaagccactgaactgtacacttaccaatggttataatgagccaggcacagtagtgtgcacctgtaatcccagctacttgggaggtggagatgggaggatcacttgagcccaggagttcaaggctgccgtgagctgtgatcacaccactacaatctagcctgggcaacagagggagaccctgtctcaaagacaaacaaacaaacaacccagcctgggcaacataacaagatcctgtcttttaataaaagcagttaagatggtaaattttatgttatttgtattttatgtgtatttatctgtattttatcacaattaaaaataaaaataaatccagatgtgggtggtgaccatagggtaggtggcaagcattcagaggctggatgcagtggctcacacttgtaatcccagcagtttgggaggttgtgaagggaggattgcatgagcccaggagtttgaaactcacctgggcaacatagtgagaccccatctctacaaaaaatttaaaaacttacaaattagccaagtgtggtggagcacttgtagtcccagctacttgggaggctgagggctgaggtgggaggatcacttgagcctgggaggttgaggctgcagtgagctgtgattgcaccactacgttacagcctgggcgacaaagttttgagaccctgtttcaaaaaacaaaaaccaaaccaaccaaataaaaaacaaagaaggcattcagaggtagaacgttctgagaataacagagctggggtagagggggaggctgggagccagaagcgttaaatcttctgtcactaaggggaatgactgggaggctgtagaagacagccaggaggagaggaggcgtggtattttggggcacataaggggagcagggtttgcaaaggggctggggaggggcgatggtctagatgttgtgatgggggctgaggaggactcccatccacctaggcataggaaatgagagaaggagctacacgggttgagaggtggcaggagaaattgtctttgggggacattcaagttttggttaagacaaggagcaaagcagaatccgaggagagacagagtatcaagatgccccagggctcagtgggagcaaagtggggtggtgactgtagagcctttgaagcaatagggaatttgagttcaaaagaatcatgtgactttctagcctcaatatttgggtgctgggggtttgagcatgggcatttgagacttgatgggatgtgtcactgtccctggaagcaggatcagagcttgggcctagtggtgttctgctttgagggttggcattagaggggacttagaagttgtggtgaattttgtggtcccagagggctgaagatgagcctccagaggggccaccactcctaatcccatgcccctgccaaatatcccaacctgagcatgatgccgtctcccattgagctcggacatgcacttagaccccaccgcaacataattcctcagagggccaaactagaaattgatttaccggccctgacttaggacaacatactcatttcatggacaaggaaactaaggttaagtggggacacgcgttgggcgcggtggctcacacctgtactcccagcactttgggaggccgaggcgggcagatcacgaggtcaggagattgagaccatcctggctaacacggtgaaaccccgtctctactaaaaatacaaaaaattaaccaggcatggtggtgggtgcgtgtagtcccagctactcgggaggctgaggcaggagaatggcatgaacccgggaggcagagcttgcagtgagccgagatcatgccactgaactccagcctgggcgacagagcgatactccgtctcaaaaaaaaaaaaagagagagatcaaatgattggcacaggccaggctagggcccacattcccatttcctgttttccacaccactgtggaatgtctgctagctcaggacttcagtggggcattgatgaagggctgagcactcccatgaactgctctaaaagggttagccatagagaagcaggtatgaaacaattcatgagagaagaaagggtgggaatgagatagggagggaaggaatgaggaagaagtgagccacgtggaaacccaagcaggatgtatgccttctgatttctactgaagctgtagaaagggccaggcagggcaactaccttttcttccccattctcagagagatcagaggccctatggtatgcgggtggaccagttcagcctccagtaccaggtcactctgaaaaagggattaaaaggaaagccacctgtccattaatactggagaaaacactgacaatggtctggactgggagaagccagtcctcctggctggagacatgaaaaccatgaaattaaattccagagctctgacagaagcctgtatggctttgtgtggtctctgacaagctacatttttttttttcaatttttaaaaaggactcaaaatataaggacttcaatgacgggacagctattcatctttccccatctcatagtgctgtgggataattaaggaatcaaagagaccaagggattgaggaggatacttattatttattatttaggtgcactggcccagtcagattaacatccaaaaagactgagcccgaacaaatagtctggttaccttttaagcattttatggggcagggggagatctgtgcagggggaagcatattacagaagcgagaaacaaagacagttattcaattaagacatgcattacatcatttcttacttttcaaggaaaaaacatgttttacaacttgagtttatctgcctagtgaccttgcagctgcagagctagagaaacagcgtcttcacaatgcctgggaaagggagagaaaaggctcactggccacagaaaaacaagcagttaatttttaaaggacttcagctctttctcttcctcagggggaattgggttttcttacatacaatgaatttttgcttacacgttctttaatttcttttaattccttttccagtagaactggacctgaggcagctaggaataggatgcatgtttctgaccctggccaggatcagaaagaaggaaacctctcctgagggtcttcagcagtggaagagggcagtcaggacagggacagtgaggaaacgttacatcgctaaaaagggctacttatgcgtattctatgcgtggttgaaaataaacagcactgtgtctggaatgaatttgtaaagtcttcggtgccttctaactctgagtagtcactaggtctctcggatttctgaaaagtactagtcagtgacaagaaacatccctgtgtttatttagtttaatccaaatcctatagaactcaccgcagggatgcagagccatagggagtgtaatatcttggaaccatcctaatgcctgatccctggggctaggtggatctgacccctccccctccacccaatctctctctcttccattcgccttccaaattcatttgagttcaaatgtatctgattaaataatcccagggaaaactgtagaaagctctagaatttggggttcaggtaccctggaataatcctggattcctttgtatccatctgcaaacgctgggtacactgtgtacccccgtccaggggtcatgcctcgcagcctctttcttctaaggagctagaggcttccaagctcatgccctgaccgtgtgttacgggctgaattgtgtctccttcccctacaaatgtgtatgttgaaatctttgcccttaatacctcagatgtgactgtatttggggagaaagtctttaaacaggtaattgagggtgggccctaatctagtcttactggtgttcttataagaagaggagattaggacacagatacgtacaaagggaagaccatgtgaagacataggagaagccatctgcaagccaaggagagaggcctcagaagaaagcatccctgccagtgacttgatccagcttctagaactgtgaggaaatgagtttctgttgttgaagccaaccagtgtatggttctttgctatggcagccctggcaagctcacacaccatgcgtcttactgtgtttgtgttgctgtaaaggaatacctgagggggtgggggtaacgtataaagaaaacagatcttttggctcacggttttgcaggctgtacaagaagcatggtgctggcatctgcttctggtgagggcctcaggccgcttccatccacagtggaaggggtaggggagctggagtgggcaggtcacatggagagagaggaattaagagagggggtggtgccaggctcttttttaacaatcagatcttgtggcagctaatattgatagaacgagaactcactcatcactgtggggatggcaccgagccgttcatgagggatccacccctatgacccaaacacctcccaccaggccccacctccagtattggggatcaaatctcagcatgaggtttgtgggaacaagtgtctcaactataacaccatgtctaggaatgtttcgttaagtgggcaaaagggctgttaacctgaagggagcattctgtggaaggagacaagtcttccctgaccctcctgatctccactgagtacccacgtgatgttcatctccacgagtgtgacggacattactggaatgttcaggaagatgatatggaaaagtcagcatcagaagtatgcatcctggctgggcacagtggctcatgcctgtaatcccagcacattgggaagcccaggcaggcagatcacctgaggtcaagggttcgagaccagcctggccaacatggtgaaacactgtctctactaataatacaaaaatgagccaggcgtggtggtgggtgcctgtaatcccagctactcaggaggctgaggcagaagaatcacaaacccaggaggcggaggttgcagtgagccaagatcccacactgcactccagcctgggcgacagagtgagactgtgtctcaaaaaaaaaaaaaaaaaaaaaaaaaaggtgggcaccgtggctcacctgtaatcctagcactttgggaggccgaggcgggtggatcacgagatcaggggttcaagaccagcctggccaagatggtgaaaccccgtctctactaaaaatacaaaaaaaaaaaaaagaaattagccgggcacggtggcaggtgcctgtaatcccagctactcgggaggctgaggcaggagaatcacttgaactcggagggcggaggttgcagtgagccgagatcacaccactgcactccagcctgggtgacagagtgagactctgtctcaaaaaaaaaaaaaaagaaaagaaaagaaacatgcatcctattcctagctgcctcatgtccagttctatgagatgggagtagatgaatggctgtcctggtgttgaagtccttacattttacttctctttaaaaatgaaaacaaaaaaaaatgtcgcttgtcagaccacacaaagccacacaggcttataacagagctcaggaatcttctgtcctttccagagcaggcacagagacacgtggtcttcagcagagcctatggggttcagatgattcacataagaatagaagtttcagggctggacctggggaggcagcctgagcctgagccggctgtcctgagcctgagtactctagctgccttgtcgtcatcgcatctggctgccatccagcgccagcacacagtaatgagtggccgagcttcctctgggagggaggaaacagttaaaatcttgcagcagctgcaatcatctaggcgtggttctcttgtctgacttgggctgcacagatcctgggccaagggacagaagaaagacagcctaggagcagagcctcccagatggctgagttggatctaatggctccagggccactgcccagggccactgctcagcccccagcccctctcagcccagactctgggtcacccagcccagattctgggtcagccagcccagtggaagaagaggacgtgggctcctcggagaagcttggcagggagacggaggaacaggacagcgactctgcagagcagggggatcctgctggtgaggggaaagaggtcctgtgtgacttctgccttgatgacaccagaagagtgaaggcagtgaagtcctgtctaacctgcatggtgaattactgtgaagagcacttgcagccgcatcaggtgaacatcaaactgcaaagccacctgctgaccgagccagtgaaggaccacaactggcgatactgccctgcccaccacagcccactgtctgccttctgctgccctgatcagcagtgcatctgccaggactgttgccaggagcacagtggccacaccatagtctccctggatgcagcccgcagggacaaggaggtgagtgcttggggaccattcatccatttgggagagggcggtgggggatggtgtgcccagctggctgcagctgctaggtccactgacgccactactatgctctgagcatacctgaaaaagactagcttcagcgtctgcctgctgggtcagtgtaaatatacattgcacttggttttggaaactgtgtggagtaggttgctccgtccccatctctgtcccactgtctctgtgcgatctctgtctgtgtctgtctctcctccttcttgctagtttcctgctgtgccttatacagcttttggtgatgtgtgtttgggtggagggtgcagaagttgtgggggcttagggcggtgatatgtccctgtggctggatctgcatggcacatccattgtcaattaatgaaataaaaccttggcagaaattcaagagaaaagaacaactctttctcccagtttctctttttctcaaacaagagaccagtagaatgggcccctctggagataacaggaaatctaagagcttgaaaagtgctaagatagcagagaatttgaaacttaggtccaggtataatgtcacaggtggcttagggataataaaagttcctcaccagatggaggtatcaggagagactaagaaacatcatgctcatagcctgtcattttatttccatcggataaggaaactgtttctagaacaagtcgtttttctttgcctaaagctagatcctggagaagttcctggaaattggtttggcacctcatatgcttttttccttctactttgactttcagcgaacacttttagttttcagtcgggaagtgtagttgacgtttgccccacatttcctacattaatcatcaaggaagttccctgttgacactgagtgcaggtggcagacctatggccatttcttggcaaatgttccctggcatcaaaggaaagaggtttctaggaaagggggtctacttgccagggcccctcctctctgccaatccctagacatagattttagctggtgctagtgggattgttctggaaacctctgtattccagatgccaatgagtcactgtttccggcccgggaagccacttgccaaactgtttccagtgttcccagggtagggagtgtcccatcaggaggacaggtagatcaagaaatagatcaaaggaaaaagctcctgtagttgaggaaaatagccttcactgagtattgccatgtgctgaatgctttttgtggattttctcacccaatcttcaaataactatgaagttatctcatatcctcattatctccaccacacttgtccaagctcatagtcgattaagtcacggagtgaggaatggaagcctctggaaagccatcctactggagggacatgaagaaaggacacaaaaatcacaatattatcctctttttttgcaccaaaacctgccacacatatacaagaattttattatttttaactggaaaagtgatgcatgaagatgttaaaaaataatctccaccagccgggcacggtgactgacacctgtaatcccagcactttgggaggccgaggcaggcagatcatgagggcaggagatcgagaccatcctggctaacacggtgaaactctgtctctactaaaaatacaaaaaattagctgggtgtggtggcgggcgactgtagtcccagctgctagggaggctgcagtaggagaatcacttgaacctgggaggcggaggttgcagtgagccgagatcgtgccacttcactccagcctggtgacagagcgagactccatctcaaataataataataatctccatcaaacagtgcaatcaattttactaggaaaggagggtctccagtccatcccagatcaccaaacctccgttttctcctcgaaggctaatactgtctacactttcttatttccttgcagaaatgttctatgcctgtaccaacagagatacaatataaattttaaaaacagggcacctaatgtattagagagatgtggggtaattgcaattccaagcaggaggagttgtgtagagcacgcgcagaactctgaattcagacatcctaggagagaagtgtataaggtaaaatgaggacaactgaggaatgggcttgagggcagtttggggctgaaaagcaacatggctttaggtacagtgctaaaaccccattccccagacccctctgctttctggtctgcttaaaagagctcttgtcctttctgtgtccttgtcctgtgtccttgttttcagctcggagagcaagtttactctgtaagtgtagccacactctaggtggcttgtccaaatcttagaagccaaaaggtttcttgcagggagcccaggagaccagcctagaagacacagtaccttgacgaggctaaagcctccaccaggatgattttgaaagtcatcagacataactaaggctccggaagcccagtagtcccttcagctagcccaggcctgctagagttactcgctgaaggtcactttgggtcatgcgaagggctaattactcggacaggcatgctgtgtataggaaactgcaaacagcagggtcagccatgaagacacaaagtggctgagatcctgcttaggatccacagaatgactaatttctcagttaaccaagtgaaccctttttgaagctcctatggtttctagccatatcagtgggcagacactgtgtgctttgagaggtgggtgttctttgattatcttttctctcctgctgagcttccagagcccagctatttttcatggggacctcagcacttccctttaccccagaccagcatctccaggcccctttgtgtttttttgtttgtttgtttgtttgttttttgtttttttttttttttgagacggagtctcgctctgtcacccaggctggagtgcagcggtgcaatctcggctcactgcaagctctgcctcccgggttcatgccattctcctgcctcagcctcccgagtagctgggactacaggtgctcgccaccacgcccggctaatttttttgtatatttaatagagatggggtttcaccgtgttagccaggatggtctcgatctcctgacctggtgatccccctgcctcggcctcccaaagtgctgggattacaggcgtgagccaccacgcccggccccctttggttttaagagcagctgatcttgcctgctggctgccaagtcttctcaccttctctgaatctcaggcttgctatgtagaaatgagactgtgtgtgtgtgtgtgtgtgtgtgtgtgtgtgtgtatgaaatctggactccttctatgactgcctttcctgtttgttctgacccatgaagcaggtatggttctttcatgttcctcaagcgtatcaaatgttactgagtgcttcctatcgctaagtgctgggctgcactgtctagcctccaggagcttggactctaatcaggaagccaaggcacataccctaactccacagagtgccaagaggctggcacggtgcaattactgcacctttggaaccaaccctgggagcgaggtcagtgcaggttcctaaggcaggaagacctgagctgagccttgtcctagatctttggagaacattaatgccaggccacgatgctgaacctcagcatcagtcccagaaagttcaggactggatgctggctgcagacacagtctccatggtgagcaagagccaagtatctagagccaaaagtatccacgctcatctggggagcggttaactggcatcactcacagcctgtttgctggcagccgaaaggtggatgataggtgtatgtggccacttgggaaaggaattacttgggccgggcgcggtggctcacgcctgtaatcccagcactttggcaggccgaggcgggtggatcacctgaggtcaggagtttgagaccagcctgacccatggtgaaaccttgtctctactaaaaaaaaaaaatacaaaaattagcctggcacagtagcaggcgcctataatcccaactactcaggaggctgaggcaggagaatcgcttgaacctgggaggtggaggttgcagtgaaccgagatcgcgccattgcactccagcctgggtgacagagcaagactccatctcaaaaaaaaaaaaaaagaatttatttcagccattttggggaatgcccaggactcagtattacgtaacttgtttttcttattctcccaggctgtaagtattttgagagggggcagtgtgtgtcctatgtgactgagctggccatatgtactatggtgaattctgagcagctgaccgaggcatgcagtcagcgtccaggtggactctagttcttccttctctagaaaggctaaccctgtgtgcttggaatacaaaggaactggcacagtctgggattttcttctctcttcccactctccctgttctttctatttttcatctctaacatgacctggctgccactctttgtgtgccacctttgccctgtagcagaaggaacccttctgttagcatatttaggtagtcttgcaccagatgagaagctaaatggcttgaatgacttgacaaagcctatatggccagcaagtggcaggtcccaaaatatttcggactccaaatagtgtgcctttgacacatctgtcattgtcttgctgaagcaggcagagctctgtgtgccctgccttccagaactttctgtgctcatgggcaccacagtcccgcttctgggcagggcccaccctgacctgagatgtgtgtgtggctgacctcttgggaaaccctgaagccagtgtctgaggcaccccatcattttcaaggaacaggaataactggagaaacaagtctttcaaagtggttccaccttttgaggtaactgggagtgccttttcttggggtgactcagtcaggaaagtccccgattatgtacttaaggagtccttttctctccttttatggtagtctgcaaatagcagagagaagcccctcactctcgatgctccctgggtacctccctatggccccgctgctgccgactgcttcaacacattcttctgtccctgctgtttagatgccgtgttgtaggagcctgttgctagggtgtgttctgatgtgtcttccaccacctttaaacaagcagctcatgttccttttctctcccctggaatgggtcactgtgtaagcctttttcatagttcaagattccaggattgcccccaaataggccagatccacccccactccccactcccaggcatcacgtctcaggtatcaagggtgagaggtcactggggccccctcagctccactctcagtgacctggagcctgagcaaacatttcctgccttctgcagtgtcctggagaggcgagtcctctgcctgcagctgcttccctccccagggggcctggaattcccccagtcttcagtggagaatggagagacagtttatgctctctgagttctattagggcataatgactcgcagctttaaatgcagacagaagctattaagcagtgaaagcgattcttttttttttttctttttctttttgtatattgcccttgtggaagtaggaaagtgacagggtctttgaggtttgcaaaggcttaagtgcgccttggcacacctcttggcagaaggtgtttagtgcatcccaggaggcaagattgaagctggggccaaagcaggcaaacctgaggtttttgggcaggcacttgcctgggctgggagggctggctctgccttcgaatacagaacatgaatggaaagcagccatggtagcaggagtaataatgatgatgatgacgatgctggcacccactgacatttatggagctcattaataatgtccctggtactatacaaagttcttattgacatacgttatctcgttagtccattctttcctaatcctatgaagcaaacactttactgagccccatctcacaggtgaagaaatggaagtttagagatattaagttgtgaaataagaaacaggccaggcacggtggctcatgcctgtaatcccaacagtttgggaggccaaggcaggcggatcacaaggtcaggagttccagaccagtctggccaacatagtgaaaccctgtctctactaaaaatacaaaaattaaccgggtgtggcggtgtgtatctgtaatcccagctactcaggaggctgaggcaggagaatcgcatgaacccgggaggtggaggttgtagtgagccaagattgcaccattgcactccagcctggacgacagtgtgagactccatctcaaaaaacaaacaaagaacaacaacaacaacaacaaaaacttaggtttggtctctgcccccatttcctggcacccgacagctcttagaacccccagactctctgaagtggtaagtgtctgaatgccagtgagatgactgggtggctgagggggctcccgagagcctcaggatgggggctagttgccaaaggagccaaccctatgatgaaagggtttgactttcagccccatctccctgatctcctccagggagggaagtgaggctgaaggttgagaggatcaccaatggccagtgatgtaatcaatcatgcctacatcatgaagcctccatataaacccaaaaggcatcaggcgcggtggttcacacctataatcccagcattttgggaggccgaggtggaggcagatcatttgaggtcaggagttcaagaccagcctgaccaacatggtgaaaccctgtctctactaaaaatacaaaaaaattagccaggtgtggtggcacatacctgtagtcccagctcctcgggaggctgaagcaggagaattgcttgaacccaggagacagaggttgcagtgagtcgagatcgcgccactgcactccagcctgggagacagagcgagactccatctcaaaataaacaaagacacaaacccaaagggctgggcttccgggagcttctggattgctgaaggggtggaagtccatggagggtgtgcaccctgcactggagagggcacggaggtgtcacttccctcccacatcccttgccccgtgcatctcttccatctccaagtagggagtgtcagaattgagttacatcttaggacacccagctgttgttggagaatggcttcatgtggaaaaaaacccacacgttttagttatgaaagtgttctgtgttgtgtgactataagacaaagaaagtttgtttttcctattcataagtaaatttggccaaagtctcaactgctaagtaaaaaaatgtagacttcccacttggccatctggctccaaccctacactccctgtttggctcttgtggggtcagcctaggctcaactccattgatgaacttggaaacatgattttatcacctgtacctttgaaataataatcatgtttacctatgttgacaaaaggagtcaaactctgtaacatatttgaagatattcatcctgagccaaatatgagtgaccaatggtctgtgacacagctctcaggagaccctgagaacatgtgcccaaggtggttggggtacagcctagtatacattttagggagacatgagacatcaatcaaatacatgtaagatgtaatttggtttggtctggaaaggtgggacaactggaaaccagggcttccgggtcataggtagattcaaagattttctgattggcagttggttgaaagagtcaagttattgtctaaagacttaggaatgtctgggttaagataagaggtggtggaaaccaaggttttatcatgtgggtaaagcctccagggaggaggttttggagagaacagattgtaaatgtttctaatcagactgaaagagtctgctgtatcagtaattccaaaagggaggaagttataatgagccatgtctgacctcccttcccatcatggcctgaactggtttttcaggttaactttggaatgccctttgctgagaggagggatccattcagattgttgggggtttaggattttatttctggtttacagctagtatgggtatggcaaggatggtgtggggtaatccacaaaatgcttgaaatggtgagcagcacggcatccgtgctcactgtattttcgctgactcatgctgactgcagccccaggagggcacgggctcaccgccaacccttcgtgcctcccggctggtttctgagatcagccacagaagttaaacttctttccagggaagaagggcggggatgtcagggctggagagtgcccgtgtccttctgtgtgcattgggctccttcctccttaattctctgctttccacttttaggctgaactccagtgcacccagttagacttggagcggaaactcaagttgaatgaaaatgccatctccaggctccaggctaaccaaaagtctgttctggtaagaccagcctgggtcagccaggcctgtgagggtgtgggacgtggtactgcatgcctagcctccattcctgtaggttccttggggtttctccacaaatgagaattgtaggtacagttgactacaccatgcggtagcctcaccttgatgtcaggatttgttatgaaattagtttaagttttaaacctggcaagtgatttgctttttaataatataaattagaaccaagactaatcctgtaataacaacattcttatttctacatttgcttatgctgtcttgacagggtgtatgtgtgtggggggctgggagtttagtcagaggtccaaaaactatacgttatcttggcttcttccattatatgagggtgttctgcatgtgagtctcaccagtcctatgacctggcagctggaaaaaaggagttgagaactcaggattactgatggtatttgagaaggccatggtgtgccaggctaagtaggcagtaaatggtctccaagtggattctgaggagttctacaaatgcctctcatcagtggcaagccagtaaccaccactcagaagagaatgcaaaacaggccgggcacagtggctcacacctgtaatcccaacactttgagaggctgaagtgggtggatcacttgaggtcaggagttcgagaccagtctggccaacacggtgaaaccctgactctactaaaaaatacaaaaattagccaggcatggtggtgcacacctgtagtcccagttactcaggaggctgaggcaggagaattgcttgaactcaggaggtggaggctgcagtgagctgagtttgcaccattgtactccagcctgggtaacagagtaagactctgtttcaaaaaaagagagaatgcaaaacacctaccctatggaagtgaatcagcattgtcatctttatatcctgagaataaatgattccatccatcatccatccatccattcatctacccctaatgcatgtattcatttcaacttaattttcacctcctgggtgtttacaaccaactagctactgaaggatgaaacacctctttcttacccacaatatcttattaaaggaagaaagagaattatccctttaaagccttataaaccttcagagataatggatttccaggctcaagataacctgtagaaccacatggagggtcttgtgtttcccagctctttaattttcagacactttgatccctcctcagttctcataagtacatgatgaccaggggaggtagttattacaatagctaccatgcacaaggggcatgaagacatggagagatgacaatacttgtctagggccatctagattgatggaatgtgagaacctagagttgttgctcccttgacttaagaatgactcagtatattgataggcatgtacaccatcctcaaatctttaaaccattacctgctggctccttgaatgtattgaggcctctcctctctgtactgtttctgcttgtcatcattttcatggtaagtaatgccctttgcacattacatttacatgcaagaaagaagtgtttctcaatgggagggtttaggaatgagggccaggccacagcagaagtcaacctcaatccaccaatatcatctgacacctcccttccactatcctttctcaggatggcctcagttggggccgggggtgaggatttggatcctgagtttgtctttagtctcatcctcttagcctcatggtatcgtgcttctatgaggaacttacaggtcataattgtagacaggattctgctcctttcccacaacaccctcatgctggttcccatgctgtgtcctgctcctgctttctggaggtcatcgggagcgggcagtacaggcagggagcactctgtggcctctgtgactcctagagcctggctacctggagcctgagtgggcatgaagggtgagtaagccggggaactaggacacgttagctaatgcagagcctggatcaaacaccatcaccaccatttgcccccgctcccaaatggttataagcaaaactctcctgtcttctgaggtagatttcttcatcattacttctttgccatatggaaatgtaatttggcttttagatttaaatctagtaatgattaatatatcagaatttacagtgtttgcaatgtcaaggaggcaacacctgtaaacagttggttcaggaattgctgggagtcttggcctctttccctcttggtcgcctgctcagcagcagcctgtgtatttatagtccattatgggcataggatgttaccctaactggtgcccacagtgaacaaggggctaagccctgtctctcatctggtcttgggagggcttctgtttaatgggctgaacttaaaggtccttccctgcaacccccacacagccacagcccatgggctgaaagctcagctgaactcccattgtacctccccagctcatcctagtgaatgtgccagggcccagagggagaggtcaggctgtgccagctcagtgctatactgcaggcacatggatccccaaccctgggccctattttgaggcagtgtggaatggtggtcaaagggatggactccagagacagacagtcttggttcaaaccttggctgtgtgatcttgggcaaatcagtccatttatcactgtcttagtttccttatctaagaaatggagaccctaatagtacctaccttttagggttgctaggagaaaagtgcctggcacatagtaagaacttactacatgttggttgtttttatgattattgttatataattggaagagtgaccaggctagcagcagagggtcctcattctcaggagagtgggaagagggagagaggtgaagtgtcagagggctgcagagcctatacctggcagagccccaggcagcaggtttgccacttggggggcctgggtggggcccaggtagctttcctggttctcaggtcttcatttcagacagtgctctgagcctcccatccacagtccagagcccattctctgcctgcctccttctctactattgtccccacctgcagtctttctgagcagctggttaaggtgctactattcctcctcccaagggtgagggccagctctggacaacagggctccggagggagccacaaaaccagatagcctcaggtttcccaaatcgcctctcctgctgccctggcttctcaacaccgtcacctgtctaaaagcttttcttggtgtgggctggaagaatttggataaagtctaccatccccgctcttccttaatcctgttaccacagcttctttgctcccagctctgtccagctacctaacctcaaggaagccaacaggcaacggaaaagttggcataaaaatgagaatgtaggctggacgtaatcccacctgtaataacacctgtaatcccagcactttgggaggccaaggacggcagattgcttgaggccaggagtttgagaccagcctgggcaacgtagtaagctcctatctctacaaaaaatataaaaattagttgggcatgaaggcatgcacctgtggtttctgctacttcggaggctgaggtggaagatcgtttgagcctgggatgtcaaagctgcagtgagccaagactgtgccactccaacctggcaacagaggagaccttgtctaaaaaaaaaaaaaaaaaaaaaaaaaaagagagagagaatgtagggagattgtctgtgtcttcccaccatccccctccagtagggataccccttgctttctttcccctgcttattcttccctttgccaccagattgaagactgatcagagaccattctcgtggagtgaattgctgagccctggcctaagccagggcctgagccaggcagaagacctatctggtgtcatcattttttcttcccatctccctccaaacctctaggttcccactaagcctgggcccagaatcccatcctttctgagtcctttccttactgtgctcccctttttgatctgggtctcattctccctccctctctccctctctccttccttgccagggatgggaggtgcccctgaagcctctgcccaaggatatctgctatttgactcactttggagccctgatgttcagagctggcccttaacattgggaggagtgagagaaaacagcacctggaggggtgctcagaaagtctcagatgggatagggctggagtgcagtggcgcaatctcagctcactgcaagctccgcttcctaggttcatgccattctcccgcctcagcctctgagtagctgggactacaggcgcccgccaccacacccggctaatttttgtatttttagtagagacagggtttcaccatgttagccaggatggtctcgatctcctgacctcatgatctgcccacctcagcctcccaaagtgctgagattacaggcatgagccaccgcacccggctgtctacaccaattcttttttttttttttttttaaatttatttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctgattacttgagattagggagtggtgatgactcttaacgagcatgctgccttcaagcatctgtttaacaaagcacatcttgcaccgcccttaatccatttaactctgagtggacacagcacatgtttcagagagcacagggttgggggtaaggtcacagatcaacaggatcccaaagcagaggaatttttcttagtgcagaacaaaatgaaaagtctcccatgtctacttctttctacacagacacggcaaccatccgatttctcaatcttttccccacctttcccgcctttctattccacaaagccgccattgtcatcctggcccgttctcaatgagctgttgggcacacctcccagacggggtggtggccgggcagaggggctcctcacttcccagtaggggcggccgggcagaggcgcccctcacctcccggacggggcggctggccgggcgggggggctgacccccccccacctccctcccggacggggcggctggccgggcggggggctgacccccccacctccctcccggacggggcggctggccgggcggggggctgacccccccacctccctcccggacggggcggctggccgggcagaggggctcctcacttcccagtaggggcggccgggcagaggcgcccctcacctcccagatggggcggctggccgggcggagggctgacccccccacctccctcccggacggggcggctggccgggtaggggggctgacccccccatctccctcccggacggggtggctggccgggctgaggggctcctcacttcccagtaggggcggccgggcagaggcgcccctcacctcccggacggggcggctggccgggcggggggctgacccccccacctccctcccggacggcacggctggccaggcggggggctgacccccccacctccctcccggatggggcggctggccgggcggggggctgaccccccccccccacctccctcccggacggggtggctgccgggcggagacgctcctcacttcccagatggggtggctaccgggcggagaggctcctaccaattcttaagaataccagagaagaggaaaccttcagaacttggaaagatgttgtaaacatgatattgattgaaggcattcatagaggatgcttaccatgcaaaagagtccacatgcatgtgccccatcattcaaacccttaatgtttctcacatgggttttcttttatattttatttgaatgtcacattctgttctgcatatacatgcttgtcctggaattgcttgggtgccatggtcgtctgcaccctaaacattttatggggattctgtatgtggtagagacagtatcatcttagacatgcatttggctctgatggactcagtggtcagtttaaccgggcataatgaaatgctaagaaagctaattcatgctgattatacaaaaaaaaaaaaaaaaagccaaattctttacctcttgaaatatgactatcaagtagactgaatacacacattgctctggtaggaaaatcaatttcggaaacttgactaacaatcccggagtgtcagagttgtgagggatctcagaggtcatagaggaattcactctctcatcaaatggatgaggagaccaagttaatacgtaaatcctttttccaggaacctggaattcacatgagaataaaggattccttttacaatagggaactgctccctaatatatgtgtttctcaagctgacatttctgtatgttgagtttctatcaagttggatgcctcactaagaaatgtttggctgccttccacccccaccccctgccaggtgtcggtgtcagaggtcaaagcggtggctgaaatgcagtttggggaactccttgctgctgtgaggaaggcccaggccaatgtgatgctcttcttagaggagaaggagcaagctgcgctgagccaggccaacggtatcaaggcccacctggagtacaggagtgccgagatggagaagagcaagcaggagctggagaggatggcggccatcagcaacactgtccagttcttggaggtatgggggttgcgggggcagaggcatcccacagctgccccatgaagcaccctctctttgctaggcccatggccatctgtgaatggaactgttttttgttaaatggtgtgcacagggagcagtgggaacagagagaagcagattcttcattcagcagagtataggaggggtagggagggagaactgctcagagcagggaagcttgaagcaggtcccggaagatgagtcaggttcaacgtgcagtatgttccaggtagagggaacaacatatgcaaaggcagagaggtttgaggaagcacagctgatttggggagccaaggtactttaataggggtggagcctggggtactgggtgcagagtgatgagactggcacggccaggcaggtgtatggctgggaagggtttcagatgggagaatgatggagtcagtgagtatgttttataaaccgctccagcagtccactgcatggaggtttgcttggtagggatgagactggagcctgctgcttttcagagagggctgtggctggagtaattgaggagggctcagaagagcaaatgcttttcattacaatgtatcattagacattaaaggtaagcagttggaaccaggaaatgcttttcattacaatgtatcattagacatcaaaccgtaagccattggaacgagatctaaagaacatgtaacctttcgaggaaggaacactaggttgggggtaaactgcaacatcctgaatctgtcagaaaacagctctgttaacagctcttcacatccctgagtctcaaatttctcatttatcaacaagcccactggagtaaataattcagaaggctccatccaagctctgatattctgaaatacaattttttcttgcttgcatttttgaaaaaattctctgctagttacaaaaaacaaatgtttattgtgaaaaacttggaaagtacaaaaaaagaagaaaaaaaatccataatccttacacaagtacaacatagttaacttttgaatgagtaaaagagaaagacagacaaaaacaccaacaaagcgtctgtcagtttctttgcttttcagtatcaaaacacgaagaaaatatgaataaccatttaataaccatttggcttcccgcctcacaagtttcccttaagatctacccaaagagtatataaattatttctcttttctcgttttgtaactttatttatttttgtgtgtgtgtgttgttttttgagatggagtcttgctctgtcacccaggctggagtgcagtggcacgatctcggctcactgcaacctccgcctcccggattcaagcaattctctgcctcagcctcccgagtagctgggattacaggcacccgccaccacacctggctaatttttatttttatttgtttttttttttttttgagactgagtttcactcttgttgcccaggctggagtgcaatggcacgatctctgctcactgcaagctccacctcccgggttcaagcgattctcctgcctcagcctcctgagtagctgggattacaagcatgggccaccatgcccggctaattttttgtatttttagtagagacggggtttctccgtgttggtcaggctggtcttgaactcccaaccttaggtgatctgcccgcctcggcctcccaaagtgttgcgattacaggagtgagccaccgcgcccggccaattttttttgttttttcgagacggagtcttgctcttttcgcccaggccagagtgcaatggcacgatcttggctcactgaaagctccacctcctgggttcacgccattctcctgcctcagccttccaagtagctgggactacaggcgcccgccaccgcgcccggctaattttttgtatttttagtagagatggggtttcaccgtgttagccagaatggtctcgatctcctgacctcgtgatccacccgcctcggccccacaaagtgctgggattacaggcatgagccaccgtgcctggccaaattttttttatttttagtagagatggggtttcaccatcttggccaggctggtctcgaactcctgacctcgtgatccacccacctcggccccccaaagtgctgggattgcaggcatgagccactgcacccagcctgtaagtttatttttaacataaaagactttaacacatataaaataaattctagtgtatgataacttatttattggccgggcacggtggctcacacctgtaatcccagcactttgggaggccatggccggcagatcatgaggtcaggagtttgagaccagcctgaccaacatggtgaaaccctgtctctactaaaaataaaaaaaattagccaggcatggtggtgcacacctgtagtcccagccacttgggaggctgaggcaggagaatcgcttgaacctagcaggcaagaggttgcagtgagccgagattgcgccattgcactccagcctgggtgacaaagcaagactatgtctcaaaaaaaaaaaaaaaaagatatttatttattttggcaaaagataacgttttcccccaaatttttggttaggcattcaaaacaagatttattgaataacttatccgaataacttatcctttctcccactgatttaaaatgctacttttgtcatgtacagtatatagcattaaaatgttgaattacccttttctctatcaattctctggttttgatttccatggctctatctaatcattttcatacaactgttttcattgctatgttttctgctgtacctggtctgctttttaatgcttcagttgcagctgaagtttgatactgtgttatatctgaaagcatctttcctgatcacacgttatttcaaaacttacatgaaactatgtgattatcagtgtgaaaacactttccaaatactaaagcaaggtacaagaattacagaaatttatgcattggatgaaactgacaaggaagaggcagcactcctgcctgagagctcctccattttctaccatggcttgtgtttaaattgtcaaaaaacaagtactgacggaatgaacaaagcaagaatgttctttattttttggtccccagtctggactgtgtattggagctgttcatggccatctagtacatcttgatttttaaaatcccatgttctcacttgttttttttaaaatcccacttattctgagggtctagcagctagagaagtgctttctattttgttagaccctgagcttgacacttcacatgtactttctttgtgaaggacacattaccgtcagcccattttacagatgcaaaaagtgacttaatgaggagagaagcccgagtttagaaatacagaaaccacagcaagttctgctgtttccttttctgcaggagtactgcaagtttaagaacactgaagacatcaccttccctagtgtttacgtagggctgaaggataaactctcgggcatccgcaaagttatcacggaatccactgtacacttaatccagttgctggagaactataagaaaaagctccaggagttttccaaggaaggtgagacgcattctgggccatggactatagtgagtgtgtctctagcagtagatgataggaaggtgagagagagtcagggaagggaggatgaaatcaggggaatgtttcattttcttttttttttctttttctgtgagacagtcttgctctgtcacccaggctggagtgcaatggcgcaatctcagctcactgcaacctctgcctcccgggttcaagagattcttcttcctcagcctccctagtagctgagattacaggcacctggctaatttttgtatttttagtagagacggggtttcaccatgttggtcaggctggtctcgaactcctgacctcaaatgatctgcccacctcagcctcccaaagtgctgggattacaggtgtgagccaccgtgcccagtcaaatgtctcattttcaaagccatgcttcagacagggtatgttactaatggactctcatctcgatgattttcttttacaattgagacccaaagaaggacaattagtcatgcttatattatgcgatcggctggcatttctgtgactagcttcccaggttgctgatgcctatacttttaagttaaatccaagatggtctggatcactttttcagtggtttatgccttacctatgaaagaaatgtagtctattgagcgtatttctgtgaaacattaccaggcttcagccccttctttccccaggaagcccagggaagggtggctgggaagtcctgatttgcagattctcctgaccacctggacaggtgtgcattcacaactctcttgattttctagaggagtatgacatcagaactcaagtgtctgccgttgttcagcgcaaatattggacttccaaacctgagcccagcaccagggaacagttcctccaatgtaagttgtgaacggcacccgcttctccagttgttgatatcagtgcagtgctttgctaagtcagaaccgccatctctcatctaggtttcaggttcttgcaacttcatatctatctctaaatgatacatttcttaaaatttaatttaaacaatttttttaacttttcattttgaaataatatgaaacttacaaaaatattacagaactaagacaaagaattcccatatatctttcactcagtttctcctaatgttaacacattacataactacaatacattgatgaaaaccagggaataacattgctacaatgctatcaactaatctacagaatttattcagctttcaccaagtctttcatcaatgccctttttttctggcccaaagtccaatccaaggtcacagatgtttccatgtcttcttagtctccttcagtctggatcagtctttcaatccttgtgtttcatgaccatagcactttgaagagtcctggctagttaccaagtgattcatttctatgtatgacttggccagaattgcataactcattgacctatcattaagtgttattgacttggtccattagcatttttaaaacactgcacagttgacccttgaacaatgtaggggttgggataccaatccctcgtattgttgaacatccacgtgtagcttttgattcctcaagaacttaactagtaatagccttctgttaattgacataaacagtcactaaacacatattttgtatgtttacatatatatacatgtagacatatatatatgtatgtatgtatattttttgagacagggtctctgttgcccagactggggtacagtggcttgatcatggctcactgcaggcttgacctcccacactcaagcagtcctcctccctcagtctcctgagtagctgggaccacaggcgcatgccaccacatctggctaattaaaaaaaaaatttttaaacaattgtagagatggagccttgctgtgttgcccaggctggtctcaaactattggcctcaagtgattctcccatctcagcttcccaaagtgttggcataagcctctgcaccagtgagaacttttttaattatgggattgttttaatagcctttaatatgctaattcatttggcaagtatatactgagcatcttctctgagttagagaagaatcccatgcaaaatgtgaagctgatagattagagggaggacaagcaggaaacaaacactcacatgaatatatattattacaaatggagaggggtgccaagtttaaaacaccatggtgctctgggagagagtgagttagagtcacaaagggcctcttcgaggacatgaactctcagttgtagcctgaatggatcggtaggattcaccagactcagagtagggcgtgatcacatctcggagggaacaggctgtaccaaaggctcaaagaggattgagtgttgagtaggtctgaggtcagcacggtggaaatgtagtaatcaagggagagagtcagagacacaggaaaggaccagggacgtggggcctggtaggccagggcaaggggttgctgctttatcataagagcaagggacaccatgaaagggttttaagctagaataacacgactggcctcagcctacagctggaaacaagcagcatggctctgttgtggagaaggtcttgaagggggcaagagagaacagcgaacgaccagtcagaaacccgctgaactagtctgagtgagatgagtggtggcttaggtcgggggtaaagcagggggctggagagaagtggtagaatccgtaggagttactgcttcctgtgtgtgtagtgaggataggggaagaggatgagggcaaaacaaatgtcagaaatgacatagagcttgacttgagcaatggggtgcatgagaccctattattctttgggagtgggaggagaatatgagggcgtgtttgagagttcttcatgctccatttgatccattcattcatttttaagatgttggtcaaatattttaaaaaatgaatgaatggatcaaatatgggtataggagtacctgcttccccaaacacttgccaacactgggtaggataatgccaggcattcaatacatgtttgttgaatgaatgaatgaatgcatgaatgagtaaattaatatatttcttgattcggttcatcaaataatatcatcaatgtcaagcaacttgagcttcataagggaagggagtagatgatttgtgctctctgttttctggtcttcactcacctcatttcctagggaaacagcagcctgggtaaatagagaacagagaaatggatgttttctcatatgtgctttggagcccagctgggtttaaagcattctgtctgaatcagctgtcagttcctgaaccactctcctgccttctgtgtctcctcagatgcgtatgacatcacgtttgacccggacacagcacacaagtatctccggctgcaggaggagaaccgcaaggtcaccaacaccacgccctgggagcatccctacccggacctccccagcaggttcctgcactggcggcaggtgctgtcccagcagagtctgtacctgcacaggtactattttgaggtggagatcttcggggcaggcacctatgttggcctgacctgcaaaggcatcgaccggaaaggggaggagcgcaacagttgcatttccggaaacaacttctcctggagcctccaatggaacgggaaggagttcacggcctggtacagtgacatggagaccccactcaaagctggccctttccggaggctcggggtctatatcgacttcccgggagggatcctttccttctatggcgtagagtatgataccatgactctggttcacaagtttgcctgcaaattttcagaaccagtctatgctgccttctggctttccaagaaggaaaacgccatccggattgtagatctgggagaggaacccgagaagccagcaccgtccttggtggggactgctccctagactccaggagccatatcccagacctttgccagctacagtgatgggatttgcattttagggtgatttgggggcagaaataactgctgatggtagctggcttttgaaatcctatggggtctctgaatgaaaacattctccagctgctctcttttgctccatatggtgctgttctctatgtgtttgcagtaattcttttttttttttttgagacggagtctcgcactgttgcccaggctggagagcagtggcgcgatcttggctcactgcaagctccgcctcccgagttcaagcaattctcctgcctcagcctcccgagtagctgggattacaggtgcctgccaccacacccagctaatgttttgtatttttagtagagatggggtttcaccatgttggccaggcagatctcaaactcctgacctcgtgatgcacccacctcggcctcccaaagtgctgggattacatgcgtgagccactgcgccctgcctgtttgtagtaatttttaggcaccaaatctccctcatcttctagtgccattctcctctctgttcaggtaaatgtcacactgtgcccagaatggatgaccaggaaccttaaagagtggctgaaaagattgcagagttatcataataaattgctaacttgcgt

SEQ ID NO: 36582 - DNA, 71317 bp, Homo sapiens
gtggcagaggcggcgccagccatgttggccgggcggaggtcttcgctgaggcccggggcggggtggcgccacccctgattgcggtgccacggactgctcctgctgggcggagaggacagattttgcaaagcggaggctgcgacgggtcctgcagggggacagtgaggaaagggccgcctcgtctccgctcctgggggaccgcaggtgcgcagcggggagcgggggcgggctggcggcggcgggctgggggctgggatcctggggtggtcccggctctgccctctcggtgccccggggccagcgaggtgtgctggaggctgaggcccggtccggcgcggggagcgttgagtgctgagcttgccaccctctcacccacttcgctctgccggggccgggggcccggcctcctccagctcccctggattaggtggaaagatgtggaaaacggtggttcgagcatctcgcccagcacccacccccacctcctgggccacccacctccacccaagtccatcatcgcctctgggcccttggacttactgtttcattccttgccagatatggagtgtcctagactttgaacccaattgactacgtcaccgtaattcagccttggaagttaaaggggttaaaggggaaaagagcttggtaaagataatgccttgggttttgattacaaagagttcagttttccagcaggaccagccctatctcactgggctttctttctacggtaggtagtgtttcccgatttggtggtaaaggtactgcctgaggaaggtcatagtaaatctacatcaatcactgaagtggggatgtggaattctcgttttcacttgaactccctcaacctctaccgtccaaagccatggataactagccaaattaacttggtttaaaaaggttttagatttaaatataaatgcatgttgagttttccttctctttctcctctggtagtgaatgaacatcatttcagaagtccagctattttttttttttctgagacggagtcttgctttgtcgcccaggctggagtgcagtggcgcaatctcggctcactgcaacctccgcctccctggttcaagcgattctcctgcttcagcctcccgagtagctgggattacaggggcgagctactatgcccggctaatttttgtatctttagtagagacggggtttcaccatgttggccaggctggtctcgaactcctgacctcaggtgatccgcccgcctcggcctcccaaagtgctgggatcacaggcatgagccactgcgcccggccagagtccagctatttttaattgacttacagaattttagagttagatgggaccttgtgattttctagtccaagtctcttattttgctgatgagaaaaacaggattcagagaggttaattgtccaagatcataagaagacaattcattgaggattttggaagtgaaaagtaggagacaaatttaattggcaactaacaaatacatgtaattggaaggaactcaaatttacttggcaagtacattttcaattagatatgaataaaagggcttaaaattagaatattgaaaaactatcatagggaaagtcttttttgttttttttttttttgagacggagtctcgctctgtcacccaggctggagtgcagtggaacgatttcggctcactgcaacctccgcctcccaggtacaagctaagctattctcctgtctcagccgcctgagtagctgggactacaggcgaccgccaccatgcctggctaatttttgtattttcagtagagacggggtttaaccatattggccaggctggtctcgatctcctgacctcatgatccaccctcctcggcctccaaaagtgctgggattacaggtgtgagccaccgcgcccggccagggaagtcttacttttaaaagacttgggcacatatttgatatactaggttaaagtgacatagtggtttgcttcttagcttttagctctattatgataaattatttaaccaaagtatattgtactgaaattggacatttctttgtaatagtcttttgtgttttgtatcactttttaaaaaaaataaagactagtggctgggtgcggcagtttacgcctgtaatcccagcactttgggaggccgaggcaggccaatcacctgaggtcaggagttcgagaccagcctggccaacgtggtgaaaccccatctctactaaaaatacaaaaattagctgggtgtagtagctcacgcctgtaatcccagctactggggaggctgaggcgggagaatcgcctgaacccgggaggtggaggttgcagtgagccgagattgcaccactgcactccaacctgggtgatagagtgagactccatctcaaaaaaaaaagagactaatatgctaagtctgcattctaatatagtgtgtggaataatatttctttggtttaatacttttatgcaaacatgttagtattaggggagagagtgcttatcaaataatatcatgttatgaaaagctagtttgtggctgggcatggtggctcacacctgtaatcccagcactttgggaggctgaggtgggtggatcacctgaggttgggagttcgagaccagcctgaccaacatggagaaaccccatctctactaaaaatacaaaaattagccaggtgtggtggcttatgcccgtaatcccagctactcaggaggctgaggcgggagaattgcttgaatccgggaggaggagtttgcggtgagccgagatcacgccattgcactccagcctgggcaacgagcgaaactccgtctcaaaaaaaaaaaaaaagttaagttggcttgtaaaaggactttatttcagatatgccattgtcggacatgggactaagcctggcaaattttgtaattgaattcgtgattttaagattgcatgactcctactatggaaaggtgagggaagtcagggaagtgttgtgcatagccatgtaattggaccaattgagaaacaggtgggattttcttcaaactactgctggaatgtgggaatgtaagaagtataatagatgtgatttagcaagcaaattgatcttagagcagggagattgagaggaaaaaatgtgaagaagagaagagagttgtgcccagatatcactcaggtgatatttagtatgtcttaataagaagtaagaatgtagagatacaatccagccttttaaccagttgtagaaagttaaacctggctattgtctgtgtgtgaatgtcttcctgctaagactcctggaacctttcttagtgaggtttcctaatggtcctaaggcagtggttttcagaacccctaacttaaacattattgagtatccaaagagaaaaaaaaaaggctaaatagaagacaggtgggttttcatatctgtttctgcagtttattgtgatatattgttttggttgaattgtatgaaggattaattaataaattaaaaggttaattgcagtgtggaatctgaaagcttaggagtgacctttttgtactttgttaccttaaaactcattggcctattctacactttgaatggatcatctacccatgtgtgatattttcatatcacaaattgacggtttggaagatattgcttcactgagtaatgtatatcttctaaatgttaatacattttgttatatactatcaaacaaattacattaataccaacactgatctcatcagaaaaatctttacatattaggaacttgtcaagcttatggtagcaggcacaagttttaaaacaatttaatggcggggagcggtgcctcaagcatgtaatcccagcactttgggaggccgaggccggcggatcacgaggtcagacaattgagatcatcctggccaacatggtgaaaccctgtctctactaaaaatacaaaaaattagctgggtatggtggcacgcgcatgtagtcccagctacttgggaggctgaggcaggggaatcgcttgaacccgggaggcagaggttgcagtgagctgagattgccccactgcactccagcctggtgacagagtgagactccgtgtcaaaaaaaaaaaaaaaaaaaaaaacccaaaaacaatttaatgtttgcttgaaagctcaaatttttatcattggcaaaaaatactataagttgttttctatgaagtgataggtttacttcatacatttttgagaaaatatctgtgtaatacctaagtactagttatgtactatccttgggagaattgagaaaacagtcattgaaaacattttttgttttgtgtttcagctattttaatgccttttgcagatgtgttttagatgcattttattttttttttttgttatggcacattagaatttttattttttcttaataacactggatttcttatgacttattttttgtcaaatgtagtcatccctgttctgatttcattttattttattaaattttttttttttttgagaaggagtctcactctgtcgcccaggctagagtgcagtggcatgatctcggctcactgcaacctccacctcccgggttcaagtgattctcctgccttagcctcctgagtagctgggattacaggcactcaccaccagctcagctaatttttgtatttttggtagagatggggtttcaccatgttggccaggctggtcttgaactcctacctcaagcgatccgctggcctcagcctcccaaagtgctaggattacaggcgtgagccactgtgcctggccttaaaattttttttatttttaatttttgtgggtacatagtaggcgtgtacatgcttcttaaattataggagcaattaagtagtaaacacaattttatttgccttatgttctgtataataaatgtggaagaggtttgcatagtcttagaatttatattcacatcagtaacatggaagctgttgctaaaaactggatttctaatctccccctcacccccacgtcctggttgttttttctttattgccacctatgttacggtggagtttgacatcttctaactctcctctgaatatcccacacctttgttttatcattatctttcaacacttttccttgaaagctcataccacccttctcaaagctgccttctatatttaccttcaaaatagttttgtttttttttttgagatggagtcttgttctgtcgcccaggctggagtgcagtggtgcaatctcagctcaccacaacctctgcccccccagttcaagcgattctcctgcctcagcctcctgagtagctgggattacaggtgcatgccaccctgcccagctaatttttttgtgtgtttttagtagagacggggttttgccatgttgaccaggctggtcttgaactcctgatctcaggtgatccacctgcctcagcctcccaaagtgctgggattacaggcttgagccactgcacccggcccaaaatagtcttttctaaacaagtttagtcttgggatttctctttaccctttatgcacctttgaaaaaccacaatcttttttgattagcgtaagattttctagctgtctccaagattctggcacaattggaggaaatacagtgttttctttaatttttattttcttatttaaagaagagaaagttcttaactgcttggaatgcttagatttgttaagcttcactttctgccatttgttttatgaaaatttatttgaaagattttctaaaattaaaattgttatatctaactttttccccccaaataatatctcttctttcttcacttaaattttagaatcagcttcttgtcccactattgctcttagcaactttaaacatccatgttgggttttccaggcaccctaggttcacagttcacttctttcaacttgacgtccttcctgtctgctgcataacacttgaatgtctttgtcctcccacacctttaaattcttcagcttccttccatgactaactactgttgcagtttgagagcatgagatagagctgttgcctacgtaggaaagccggcatcctacctaggcatttagacagtaaaaatggagctgtcttttgatactggtccctccccagagtgcatcctcttcccttggttagtaaacttaaattattatactgaaattttatatctcaaattggagtttaaaatgctctcataatttggaatgttcaaaatattctgaagtaagtttctgcaaaagagtctaaatgatatataaattgggggaacagcacttatcaagcattttatttattgtgccacaaatagcctgtacttgcacaataagaaaattacctgtccaaagcagaagtgtccagttttaggaaaatctttttgttacataccattaaacattctcttctgtaaagtttagtggaaacttgttatttttcagatagaaaccatgtgagttttagaactttataattttgaaatctgtttatatgaattcttataattttcaaaactgatatggaaaacataggatctaggttttccccctatttttgcatttctttcctatatatccttaaagaaataagacactattttttgccatcatcttttagagtgaataaaaaagtgttaaatacctcttattgggccttgtgaacattgggtagagccattaattattttgttatgagttgcttgctaatttttttctgagataaatattttcatttggtcctgattttttttttttttgagatggagttttgctcttgttgcccaggctggagtgcaacggaatgatctcggctcaccacaaactttgcctccagggttcaagagattctcctgcctcagcctcctgagtagctgggattacaggcatacgccaccatgcctggctaattttgtatttttagtagagacggggtttcttcgtgttggtcaggctggtctcgaactcccgacctcaggtgatccgcctgtctcggcctcccaaagtgctgggattaccggcgtgagccacggggcccagctggtcctgatttctaaggtgttaatattgctgaatgaggggagaacattcatattttgaacgttcttaagaggatcctggattttaaaatattttaaaattttgatacagaaataagaatcaaactccacaatgacaacctatttggaattcattcaacaaaatgaagaacgagatggagtccgatttagttggaatgtttggccatcaagtcgactggaagctacaagaatggttgttcctgtggcagccctgtttacaccactgaaagagagacctgacttaccacctattcaatatgaacctgttctgtgtagtaggaccacttgccgtgcagttttgaatcctttatggtaagtaaaatatatagaaaaactaatgtggcaatgtgattttaaaatgtcggggtttttctgcatatttttataaaaatccctttgtttttgttcatactaattttttcaaattaggacagtcaaaacaatccagagagctgtaaaattttaggatcattctagttgtactgagttggtaatataaagagaccaaatgtaaaagtggcactataaaaactgttagattccatcagtgtcttctgaatagtggtgctggatgtgtatcaacccatcttgcatcattagataagtcataattggccgggcgtggtggctcatgcctgtaatcccagcactttgggaggccgaggtggtggatcacctgaagtcaggagttcgagaccagcctgacgaacatggtggaaccccgtctctactaaaaatacaaaacttagctggggtgtggtggcatgtgcctgtagtcccagctactcgggaggctgagacaggagaattgcttgaacctgagagatggaggttgcagtgagctgagatcgtgcctctgtactccaactctgggtgacagagcgagactccgcctcaaaaaaaaaaaaaaagttgtgattgagtgacatgatgttccaaaaatgttgtgatttctgttgctgaagccaaaatctcaggaatcatctcttacttctctttccattccctctccccccagccaatccactagcaaatctgggtgatctacctctagaacattatagattctgtctcttacagcctcttattccatctctggtagtataccctgcttcaagataccacagtctttttcctgggcaatttcaatatcctcctacctgctctccctgtttctattcttgtctttcagcagtctgttctctacccagaagctagagttttatgaatgaaaatcagatgatgaacatcttccagtagtagcttcttattcttggaatgagaaatacaaactccttatcaagatctataaagccttgtatgatctagcctctgtatatatttctgccttcatcttgtgttatccattttccttattctcatctacataataccttaaccctgttaccctctttctgattcttgaacataccaaacttactcctaccttgacaatggtatagtagctgtgcattctgcccggattcttctgtctccatattttcgtatgattgcttccttttcattctgatcatactttagttgtctatttaagaaggctgttttttaaagcagccctcttaaacacattctcacattctgctttgttttctttaatctctgttattacaatgtaaaagtatttttggctgggtgcagtagctcacgcctgtaatcccagtgctttgggaggccaaggtgggaggattgcctgggcagcaaagcaagactccatttctacaggaggggaaaaaaaaaaaaaaaaaatatatatatatatatatatatatatatatatatatatatatatatgtgtgtgtgtgtgtgtgtgtgtgtatatatatatgtatatgtgtatatatgcatatatatgtgtatatgtgtatatatgcatatatatgtatatgtgtatatatgcatatatatgtgtatatgtgtatatatgcatatatatgtatatgtgtatatatgcatatatatatatgtatgtgtatatatgcatatatatatatgtatatgtatatgctgggtgtggtggtatgtgtctgtagtcctagctacttgggaggctgaagatgggagaaacacttgagccaggagttcaatgctgcagggagctatgattctaccattgcactgcagcatgggcaatagaacgagaccctgtctcaaaaaaaacaccaaaagtattttcttgtttgtgcatctgcttgtcttttgtctgttttttctagaatgtaaactccatgagagcagttctctttttcttgtatcaccagcgcctaaaatagtggttggtacttattaggcattcagtaaatatatttttgacctgaataaatgttttctaggtctgagtgtagatgttactgaagtcacttgaagaaaaaaataggattattttaattttattgatatttgctgtatatatgtgtgcatatatatatttttgagatggtttcactctgtcacttagattggagggcagtgttgtgattgtggctcactgtatctttgaccacctgggctcagatgatcctctcacctaagcctcctaagtaactgggagtgcaggcatgtgccaccacgcctggatgattctttgtattttttgtgaagactgggtttcaccatattgcccaagctggtcttgaactcctggactcaagccatctgccgcctcaggcctcccaaagtgctgagattacaggcgtgacctactgcacccagccaatatttactatatgttaaaagttatattcaccatttaggtaaacttgtatatgttaaaagtgtgaattagatattggcagtatctaaaactacatggcttttaaaagttactttgactatcaatttgaatatgttcatgttttaggaagaaattaattttattgaaattaggatttttgtaaaattgaactgaaatatgaactgatatgtcttttctttttttttaaaacagtcaagtggattatcgagcaaaactttgggcttgcaacttttgttaccaaaggaatcaggtaagaaaacatccattgcatgccgggcgcagtggctcatgcctgtaatcccagcactttgggaggccgaggcgggtggatcacgaggtcaggagattgagaccatcctggctaacacagtgaaaccccgtctctactaaaaatacaaaaaaaaaattagctgggcgtggtggcaggcgcctgtagtcccagctactcgtgaggctgaggcaggagaatggcatgaacccgggaggtggagcttgcagtgagccgagattgcaccactctactccagcctgggcaacagagcaagactccgtctcaaaaacaaacaaacaaaacaaacaaacaaacaaatgaaaaaaaacccataaaacatccattgcagatgttaatgccaaaatactagtcatgtagaaaaatgcatatttaaaaaaagatacaaataattatttctcatttaatgaaaatgcctttttaaaaataattaaatgatcaggaaatactttgtttaaaattttattaatctttctagcctataatttgttaaaaatttttgtttgttttctatttgtagtttccacctagttatgctggtatatctgaactgaatcagcctgctgaacttttacctcagttttctagcattgaatatgtagttctggtaagaacctaagaacaaatatttaagaaagttttaaaatttatactgaaagaattgttaaattatgatgatttagaaggaatcatgcttaattctcacattgatttgatggaacatttcaaaggtaagaactgttgaggtcagtttgagcagggtaattcctatgttgtacttatttgatgggtggccaagatactgggtagggtggtgtgatttgctatactgagtagatcagtaaacaataaagtataaatcttgctttgtagttggaaggtcagttaacaaatatttagtcaatatgatgctggagttggctaatgtatcccccaggtctaattaatgaaaataatcttgcattggtctttaggaaaatcatttttattctctttctgaatacttaaccatagttgtttacatgttttactgtggaagtaatatcttttatgaatgttttagagaaaacaattatggttcacttggaccattcagtaatttgtccagcctggctagtttctagttatctgaaaatccaagtcaggtttactaattattttaaaagagtcaaatgaaaccttatgcatgtagttaaataaaatggaaagtgaaagtcccctctgtgtaactatacctcatgttcttaaacttaatttttcacctgatgatatgtcttagatctctctccatgacagtagaaataacctgtttcatttctgaaatggctttactaggattcttttgtattcgttatttaattagttccctgttgactgtcttgtatgctgtgctttaaactacatattttttctttttggtgaattttttaaaagcgtggtcctcagatgcctttgatattcctctatgtggttgatacttgcatggaagatgaagatttacaagccctgaaagaatccatgcagatgtcattaagtcttttaccacctacagctttggttggacttattacttttgggagaatggttcaggttcatgaacttggatgtgaaggcatttcaaaaagctatgtcttcagaggaacaaaagatttgtctgccaaacaactgcaggtaaacaacaagaatggtagtttttacctatctgaaaattactctatatatgtttataaatgccttctgtatgtttctaggacaaatttttattatgaataactaatataattgtattataacaaaggctttaaattcagtgctggcttcagttttcttttcatgtgccttaaattgttatacagattaaacacccttcacttttaactatatctttaaaatttaaagtcaaaccaacagtattttactagagatttgaagggcttatgaagagtcatgctgaaggctaagagagagcaactgcagaatattagcttgtttcttttttttttcttaagagttcagcttttttattgaacatgttataaaagaggtttagtcaaaaagaccaaagtccatgtcatcatcatactcctcaggttcttctttctttgtttccactttcttttcctcagctggggcagcagtggtggtgggggcaggaccttctgcaggtgcagcaccaactgttggagcaggtccaccagcccctacattgcagatgaagctcctgatgttgacattggccagtcctttgcaaacaaatcaggccagaaaggttcaacatttatatcagctgctttaacaagggcattgatctaatccactgtgatggtcacctcattgtcgtgcagaatgaggtccaaggagatacagaagaacttgagatggaggccatgatgtgggcgagtgcagggctggtgctgcctgacatggtgctagtcacctgatgaagtgagggtctcaccccagtgtggtcttggcttcctcataagaaccgagaaccttggtggcagctgaggagagagcttttatttcttaacatttcacttaagaactaaatacttttagtatgtttggtgagggaagttattttgagactggacgatttttagtgtaggaactatggttacatatgttttttagtggtttttatcactgggacaaattgaagctttctcttccaaggcaaaggagttatgtgtagcatactaggatcatctgctcagatgaacatctttttttctgcccagagattttgatagtccataagagagtaataagtgaatgtctgtttgtattgggggatagttggtatatataccttatatatataatataagattgttcatgtaggtactttgaaaaaactttctaagtaattctggtgcaactcctagttgagaacatttaccctagaagatgatagataagcctggcataaagttgacagatgtaaaatcagactttagaggcttccaggtagaccaaaatgaagaagaaaggaagagatttttgagggtgagtctaatttgaaacttggcagactgaggtagtggtgctgcagttaactaagagaacatactaggggaatttgcaggtttaaatggggaggataatgagtaatgaatgcgttagtcaatgaatagtgaataagatttgagaaggtagagaaagttgaaatttgttctttttcttctgagacaagagtctcgctctgtcacccaggctggactgcattggcacaatcttggctcactgcaacctccgcctcccgggttcaagctattctcctgcctcagcctctcgagtagctgggactactggcacccgccatcatgcccagctaattttggtatttttgtagagacgtggtttcactatgttggccaggctggtcttgaactcctgacctcaggatatccaccttcctcggcctcccagagtgctgggactacaggagtgagccaccgtgctcggcctgaagtttgttcttttaagaggtttgttgaaggtaatgaaggaggagatagcatgggaatttgagagagaactgagttaaagagatgtactttaggaggaaggagaaaggaaagagactaaagagggtgagttaaagcaagagtgagatgaggaaagtcaggtttaggaagacatagtagggattccttcaggagcacaggaagcggagtaccttagagaggagaatcatgtttccatgagacaggagagaaagtgaaccagttgaaatctctgtgctttagtttttttcaattgtaaaatagagatagtaatagtatataccttatagtgtagtcatgagaattaaatgaattgtacatttaagcatttgctactattaatgttattattaaattatgaatttatttagaatagtttactgttctgattgtagagtaccttttacttatataatgcatatgaagcacataaaacatcttcctttttttttctttttttttttttttttgacacggagtcttgctctgtcacccaggctggagtgcagtggcatgatcttgcaatctccgcctccttagttcgagcgattctcctgcctcagcctcccgagtagctgggactacaggcgcatgccaccacacccggctaattttttttttctgtatttttagtagagaccgggtttcaccatgttggccaggatggtcttgatctcctgacctcgtgatctgcctgctttggcctcccaaagtgctgggattacaggcgtgagccaccgcgcctggccaatttttgtattttttagtagagacaaggtttcaccatgttagccaggctgcttgaattcctgagctcaggtgatccccctgcctcagcctcccaaagtgctgggattacaggtgtgagccactgaggccggcctagtttttttttgtttgtctgagacagagtctcgctctgtcacccgggctggagtgcggtggcacgatctcagctcactgcaacctctgcctcttgggttcaagcgcttctcttgcctcagcctcccaagtagctgggattacaggagcataccaccatgccttactaatttttgtatttttagtagagttggtgcttcaccatgttagccaaggttggtcttgaacttctgaccttgtgatttgcccaccttgacctcccaaagtgctgggattacaggcatgatccaccgcacctggccctaatttttgtatttttagtagacatggggtttcaccatgttggccaggctggtcttgaactcctgacctcaggtgatccacccgcctcggcctcccaaaatactgggattacagctgtgattcactgcgcctggccacatcttccttttttcaataggcaagtgaatgcctgcagactgaattttttttctccattgaaacatgtttattttctttccctatttagattaaatttccctattctttccctattattagttgaaaagagcctggcctttgctccccagatagtcctggattcaaatcttaaactcttctggttgtatgatcctgggtttttgtctttgctgattgtgtcatccttcatagaaaggaataaactacctattttgccaggttattagtactaaatatgaaattctcaatatggtgtaaacccttatagagctttatagaaaaacctggatttaaaatcttgctttgttacttactgattgtgtaacctcagacaaattacttagtctttctgattgtcaattttcatttataaagtagaatttaagaagaaatctatttcattattgttttgtgaggaaatagtatatataaaggttttagcatagaatatggaacatattaagttcttagtaaagagttgctgtttctgctaacagtataggaaatattgcaggattagttcactaattttatctttgtacatctttagacttcagttttctgttacacagttttataactccagtacttcatgactaagcatttctagattcaagaaaaatttagtataacattattttcatttgtctagagagaaattgtgcacatatctgaaattcaaaacaaaggtggcagttcgtagtttggttatgaattacattagaaaatcaagatgtatataggtacaaagtacgtgagccttataactccccaagtcctaacatttactactgttgcaattttacatttatttatctgttgatttgattaatttatgtttctggattttaatttccatgagggaagggactagttagtttttaccattgtattcctgccacatagcaggtgcttatgatatagtttgctgaaacggatgaatgaatataaattaagaagtatggacatttaagttacacaacaatttattttgactgttaattagaaataaagtgtttttgagctaatatgcctcctctttggttatataacaccttgtgcttttctctctcatgatgattattttgtgttattgttttcttgataatctctcccactggattctttgttttctgaggaaggagaccttgtattttttatttttgtgtttctaatgtctagcacagcattttatacatgataaatagttgataaatctttgtaaaagtaattaaatgaatattgcacaagtaatctctttacaggaaatgctggggctctctaaagtaccacttactcaagcaacacgtggtcctcaggtacagcagccacctccttccaacaggtaataaatatgatgaagagaatttgaccgtttctgtagctattttaaacattccatacccttgaacataggcattcagtgatactatattgttaaatatttttaggaatataagtaaattgtattaacatactttttaaagaattgagtcaaaatcatgtcattaaaatggtttgttttttgtcttaacaatgtaaggagttactttagttttgttattttccttattttttattttgaactttggaaaaaacttgtttttgtgtggttttagggcagccaaggtttttattttttcttcttagctttagaggtagcttttcccgctaaggtttctggagtgcagtggcatgatcttggctcactacaacttccgcctcccaggttcaaacaattctcctgcctcagcctcccaagtagctgggattacaggcatgcaccaccatgcctggctaatttttgtattttttgtagagacggggtttcaccatcccaatctcctgactttatgatcctccctcctcggcctcccaaagtgctgggattacaggtgtgagccaccgcgccctgctagctttttcccctaagctttctaatcagaggtagtattactaaaatttagttgatgtattttctcataattatttcagtaacctaaaacttactagactagtgagagatgaaatcctgaagtacttggtttgagtgtttcgtttattgtggttgtattcaaaatgtggtttctggggctgttatcatcacgtgtcacctaggaatgcgtttgaaatgcaaattcttcggctccactccagacctaccgaaacaaactctagaactgggacctagcaatatgtgttaaaacaagccctccagctggttctcatatacacgaaagtttgagaaccattggtctgctgtgtgttcagagtgttgttttctatttttaggaaagtgaaatttgtttatcgaactctcacccataaacatttacaaatggctttttatttaattctgtttcttagattcttacaaccagtacagaaaatagacatgaatctcacagatcttctgggagaactccagcgagacccttggcctgtaccacagggaaagagacctttgcgttcctctggggtggcactttccatagctgtaggactgctggaggtagggaagatggttttgttttggaatgtaaagtgtgtgtgtgtgtgtgtgtgtgtgtgtgtgtgtgtgtgtatatataattataaggataagaagaaccaaagtgctttttttcctccctattctctcactcagcatcaacaaagaatacttctatggttttcccccacataccaaccaagcagttctgccttcgataccacctgggtgtcctgtaattcagttcaattctgatactatctaactggagataacatcacatctcacagattgagggctcagtcccacaagactgcccccacttaagtgccagtcacatagtaggttgtcacctatacttctctgatagactggctgtaaattggacactcttgggtttgattaatttgctagaatggctcacagaactctaggaaacactttatgtttctcggtttatgataaagatattacgaagactatagatgaacagtcagatggactagatgcatagagtgaggtgtgggagaaggggttccaaatttctgtggcttctctggggcaccaccctccaggaacctccacatattcatttgtctggaagctctccaaactgtgttcttttggcttttcatgaaggctcactgcataggcatgattgattacatcactggccattatcccctctctccttctggaggttggggtgtggaactgaaagtctcaaccttctaatcaggctttagtcttttcagtgaccagcccccatcttgaagctatctaggagtcattttattaacatacaaaaggcactcttggctgggcacctcatgcctgtaatcccagcactttgggaggctgaggtgggcagatcacctgaggtctggagttcgagactagcacggccaatatggcaaaaccccatctctgccaaaaatacaaaaattagccaggcgtggtggcgggcgcctgtactcccagctacttgggaggctgaagcagggagaattgcttgaacccaagaggcggaggttgcagggagctgagatcgcatcactgcactccagcctgggtgacagagtgagactccgtctcaaaaaacaaaaacaaaaaacaaaaggtactcttatcattctacagaatccaaggcttttaggagctgtgtgtcaggaaaggagaggaaaaaaatatattcacagtattataggaaatggtatgtataagataatattgagtgaaaaaaaatcaggttataggacagtgggtgtatgattttatctacgtgaagtgttttcctccagcatattgtcttgtgtattgttttgtatatatcctgtacagacatgattctggaaagaagttcacccagatgttaacagtgatacaataagtggagttttagtagaatttgaaaattttatgctatacatatcttagctttagaattacaaaatagtggctgggtgcggtggttcacgcctgtaatcccagcactttgggaggccgaggtgggtggatcacgaggtcaggagatcgagaccatcctagctaacatggtgaaaccctgtctctactaaaaatacaaaaaaaaaaactagccgggcgtggtggcgcatgcctgtaatcccagctactcgggaggctgaggcaggagaatcgcttgaacccggaaggtggaggttgcagtgagccgagatcatgccactgcactccagcctgggcaacagagagagactccatctcaaaaacaaaacaaaacaaaatagtttttaaaaatgttttttaaaaaatttgaaatgctatcaaatttacagaaaagatgcaagaagtgtataaataatttttttctccaaactatttgagattgtgaaccccaaatatctgagatagtctcaattaatttagaaagttaattttgggcttggcgtgttggctcacgcctgtaatcccagcatcgtgggaggccgaggtgggtggatctcttgaggtcaggagttcgagaccagcctgagcaacgtggtgaaaccctgtctctactaaaaatacaaaaaaattagccaggtgtggtggcaggcgcctgtagtcccagctacttgggaggctgaagcaggagaatcacctgaacctgggaggcagaggttgcagtgagccgggattgcaccactgcactccagtctgggtgacagagcgagactccatctcaaaaaaaaaaaaaaaaagaaagtttattttgccaaggctgaggacacatgcctctggaggtcctgatgacatgcgtccaaggtggtcagagcacagttggttttataaattttcgggagacatgagacatcaatcaacatatgtaagatgtatgttggttccatccagataggtgggacagctcaagtagggaggggcttccaggtcacagataggtgagagacaggtaggtgagagacacaggtaggtgcattcttttgagtttctgattagcctttccgaaggagcaatcagatatgcgtttatcttactgagcagagggatgactttgaatagaatgggaggcaggtttgcccgaagcagtttccagcttgacttatccctttagtttaatgattttggggtcccaagacttactttcctttcacaagattaagttgcagatatgatagtcccaaccccttgaaactttgtatttcctatgaaccaggataatctcctatataaccacaatataaaactattaaaattaaaatgttaacactgatacattactaccagctaattctcagaccccattcaagttttaccagttgtcccaataatttcctttactgaaaggatttagttcagtcctgcatttatggctatatctatttaccctccttcatcctggaacagttcctcaatctttcctgatctttggaagattcagaccagttatttggtaaaatgttcttcaatttgagtttgtcttgaagtattctcgtaatttgattcaggtcttgcatctttgggaggaatatcacagaagtaatgctgtgttcttattgttacattttacaggtggcacatggttttcatttgttctgttactgatgatattcactttggtcattcattaaggtagtatctgccagggctctccactttaaaattactctttttttacccctttgtaattaataaacattgcaaaatattaggaacccccatgttgatttatttcattactgctgatgttaactttccttacttggttaaggttgtttttgtcactgtaaagttacaggttttcctattgtaattataaatatcttattaggagataccttgaaaatatgtgaataaccagtgtactcagcaaacttttacccactagtttagcatccattgatgattcttttctgatcaattattattatgatgcatgccaaatagtggctttctaattccatcatttctacttttattaattggctttctacttgaggaagagctttctctcctctcccatttacgtatttatatatatataaatttatatacacatatatatatgtaaatacatacagaatacacactgggtgtattcttacattcttattttatacaacaagatacattcctttactatcataatttactttgatgcttaagttttccccgatttggctagtgggagcctcttcaagctgcttctgggtccttattaaatgccgcatgtttgcttaaatacttcctttctggtatagtaagttgttcagggctcatcttatccttttcctgctctggacctgaaatgaaaccacttaggagccctgtttccttttagccttggttctaccaagaagataatgcttcatgtgcacccttaccctgggtgtcattaattctaggtcccagcggatggagctaagaagaagatgtatgtgcatatatatgtatctatagatgtatataaaatcataagtatatgtgtgtgcatatatgtctgcatactccaatatgcatctatatctctattaaaataaaaaaaattttatattaaaaaccaatgtttctttcaggtatgttcaattcagtaccacagggtttattctatccttcccacttttccatatttgtaactcattctctatgagaaacctgctcccgttatcaaatatatttacttatttgctcagtcctagaatatatagaatagtttcagagtttctagctcatacctctgttagaaagaagcttaggagttagagcccagtatttgtttaatgttctgagaatatatagtacaaaatataatgttcaaaagttaagtgggttattcccctccactgcccttagtgtgattatgttattctttgctgtaagttttatttgtatcttctagtaaatttcttaagaagacttaagagtacagaatttcttgggctgttgaatgtttaaacttttttcctgtggttctgatagttgaagaatagcttggttggatataaaaagctttggttctaatttttttttcctggaggttttggaaaatgctttttcattattttcttaccttgatgtgtgtgtgtttttttttttttttaaacagagcctctgttgctcaggctggagtgcagtacgtgatcatagcttactgcagcactgcaacctcaaactcctggtctcaagcagtcctccagcctcagactcctcccaagtagctgggactataggcccatgccactatgcccagctactttttaaatttgtagagacagagtcttgccatgttgcccagacaggtctcaaactcctggtctcaagtgatcctaccaccttggctgatgttttttgagaaggctgataccagccttattttcttgcccttgtaaattatttgatcattttgcttcaaggtcttgaggaattttttttttatcttgtagggtttttgttgcaggttaattttctctagtatgtggtaggccctctttatatgtattttttcctataaagttgtcttatagtattttttcctataaagttgtcttatagctttaaatagtagttttgttccattgttttattttatttaagaactcccggccaggcgcagtggctcatgcctgtaatcccagcactttgggaggccgaggcaggcggattacctgaagtcaggagttcgagaccagcctggccaacgtggtgaaatctcatctctactaaaaatacaaaaattagccgggggcggtggcacacgcctgtaatcccagctacttgggaggctgaggcaggagaattgcttgaacccgtggacagaggttgcagtgagccgagatcatgtcactgcactccagcctggccgacagagcaagactctgtctcaaaagaaaaaaacaactgccgttatatataaattgactcttctttgcttgctttttatttcagccatctttttatttctttatttcattttcattctcttggtttttttcttttctttagtgcctcttaccaagttttcatttgaatctgtagtcgttcttctaggcctgctgtttgtttccctcttctctcttctgtgtacttcttcccaaactgcccttgatctttttggagaattgcaatgagagcatgagagatacagttcacggggatttagtggcttttttttccctccagttgtaggaaatttgaagtttggatgttctttgtgtcatagttttatgaaagtatctgtatatagttttatttgctcttttcttcattttttcagctttacatgactgctattatctcaaatacccagaatgaagagagtatttttgttattagttaagaaagttatagaagtaataatcataccttgtgaaaacattcaaacaatatgcaatggtatatacaaataagtagaagacaactttccttgttctctagatttgttaaccatatgattttattttattttattttatttatttattttttagatggatttttgctcttgttgcccaggctggagtgcagtggtgcaatcttagctcactgcaacctccacctcctgggtttaagcaattctcctgcctcagcctcccaagtagctgggattataggtacccgccaccccgcctggctaattttttgtatttttagtagagacagggtttcaccatgcttagccaggctggtctcgaactcctgacctcaggtgatccgcccacctcatcctcccaaagtgctgggattacaggtgtgagccactgtgccaggctaatcatatgactttaaaaattatcatgaagtttatatcgtttacattctgttctgaagctgtagtgtaggttgaaaaatgtactctattttgtccaataaccacttatagaaattagagataaaatagcctttctaatatgacaatacaaatattaattgtggaataaagtagagcgattatacacagagaaggatactttcatatgtaaaagtcataggatatcttttacatttttttctagatcctgtcacttcctttggatcatacgcagttgctcttttgtttcttataagtattctgagttcttctatattcaaacattaaaaaaaaatggccctctcatttcattggtagtttgggtggctatagaattctagtttcaaaatagtcttcacttggaaattcaagtcattcctctctagttttctgacatagacatacagtttattgatgataattggatgtagtctcgttctttttttaggaaacttattttttcactagacatttttagaatattctctttaattttggagttctgaaattttgttaggctgtatttaggtttgattttttctttctttaattacgtttggttttggtagaccctttaattctgaaaaatattgtcattcttcagcttaatttatttctctttctattctatatttgttacattgatgctggacctctatatctctttatatatttatttttttcctcatatctttctttgctcctatttatatgagatttcctcagctttgtttcccatatttctagctcagccttcagacatgctttttggcccatccattgaggttttaaaaattttcttaatgcttttatttccagaaacttttgagagttgtcatgtttgttgtgatatccattgtaacatgtgcttggttctgtatctctcagcctctaattttcatgcaaagacccttctccaggcagatggcctgctttctacagagagtagttcttaggaattgctgatggcagaatctgtcatcagctgctgtatctggaggtatagatacacactgtttcttctttggttcattgctgctttttgtattttttgactccaaatatggagctttttgggcatcctcctttgggaagatctggggcttacttttgatatctgtgatgtgtttcgttgattcttttgataatccagtacaatttattgtttgaattcctcaaaatttctgatctactgcttgcattatttcctatctttaaattttatgtactttttgtttttttttgagacaagagtctagttctgttgcctaggctggagtgcagtggcatgatcatggttgactgcagcatcgaactcctgggctcaaccaatcctcccacctcagcctcctgagaagctgggactatagcatgtcccatcatgcccaactgattttgttatttatttatttttttcagacaaggtctccctttgttgcccaggctgatcttgaactcctgggctaaagtgattctcccaccttggacccccaaaatgatgagattagaggcatgagccacagtgtctggcctatttatttatttttaattttactttattttattttagacagtgtctcactctgtcatcctggctggagtacagtggtgtgatcttggctcactgcaacctccacctcctgggttcaagcaattctcttgcctcagcctcccaagaagctgggattacaggtgtgcactaccacacctggctaatttttgtatttttttaagtagagacagggttttgccatgttggccaggctagtctcgaactcctggcctcaagtgatccacctaaaacaacttttctcttatttcattgacatcttgtgaggaaggggaagtagattggggtattcaatccattaacttggactggaagtgtaagtcatgcatacttttttttctctctctctctctctatctttgtctctctttctctttctttcttttttttgacagagtcttaccgtgttgcccaggctggagtgcagtggcacaatctcggctcactgcaacctccacctcccgggttcaagcaattctctgcctctgcctcccaagtagctggaattacaggcgcccgccaccatgcccggctaattttttgtatttttagtagagatgggttttcaccatattggccaggctggtcttgaactcctgaccttgtgatccacccgcttcggcctctgaaagtgctgggattacaggtgtgagtcaccgtgccgggcctctttcttttttttttttttttttttttttttttgagatggagtcttgctccattgcccaggctaaggtgcagtggtacaatcttggctcactgcaacctcaacctcctgggtcgaagcaattctcctgccccagcttcctgagtagctgggactacaagcatgtgccaccatgcccagctaatttttatatttttagtagagacagggtttcaaccatgttggccagactggtttcaaactcttgccctcaggtgatccacccacctcagcctcccaaagtgctgggattacaggcgtcagccactgcgtccagcctctattttttttttttttgagacggagtctcgccttgttgcccaggctggagtgcagtggcgtgatcttggctcactgcgacctccacctcccgcgttcaagcgattctcctgcctcagcctcccgagtaggtgggactataggcgtctgccaccctgcccggctaattttttgtatttttagtagagatgggatttcaccatgttgaccaggctggtcttgaactcctgacctcaggtgacccacccgcctcagcctcccaaagtgctgggattacaagtgcgagccaccacgcctggcctttttttttgttgttctatgatacttgtgttctaaacatcaaaaacaaaagtaaaacaccaacaaaaaaatagaagagccaggtgcagtggcgtgtgcttctcattccagctacttggaaagctcaagtgggaggatcacttgagcccaggagttaaagtccagcactggcaacatggtgagaccttgtctctaaaaaaaaaaaaaaaaaaattaaaaacccaaaacaaaacaaaagaagatgttcactcttccacttttctctccactcttccctgtctgagatgagttaagcaggagaaatatccatgtttatagggattaggctcatagattagtttagaattaggaatgtgctactatataccataggattttaaaagaaagttgttcagatacctttgtttttaaatttcattgtaaacatttgattattttatttcttagaaaatatatgcttttctcttatttagaaggaatatataaaaaattattatcagaaatgtatattcatatgttttcttttaaactcttgactttttttttaatagtgtacttttcccaacactggtgctcgtatcatgatgttcattggtggtcctgctactcaggggcctggaatggtggttggagatgagttgaagacacctataagatcgtggcatgacattgacaaagacaatgccaaatatgttaaaaagggaactaaggtaattttgactgttaaatatttttgccttattagaaaacaggtattcatttgctggcagaagaagaatacaaatagtttttgatagaaattggtattatacagtttgatactataactggtattcagaattggagaaatattcattttttcttgataatttgttgtaatgtttctggtttgaaatatttaaacacttcatagtacgtgtcagtaggtatctccttaaaaattattactgagagaaacattctatgcctttttaaatattcatgttaaagaatgcctttctgtttaggaaaagttgtttttacatttttcagtttttcatttccaagaggcagtccttaatttttcctttagatatgaatattgttcatagcttaaatagtccatcattttcttgtaagttgttttatgttcatctaacttcccattttttgggtttgtgtaagtacatttcactaatgttgatttttgactctcttatattcgttctatttgttaatatctcttaatttttaaattctctagagttcagttttaatttggcttgtgctgtatcatgtattttttgatagtcttcatcagtattatatgtttaaaagtaatttatgacataatttttgccactgttggtgcttttctttcctgccaactaatttcctttttgagcttggaatttttcttggttacagcttcaaaaaaggttttagattcatttatcttactgctttttgtattttctctatttttggatgtttttgttacttgggtatggatttagctaggaaagagagttctctgttgtttttctttctttttttttgaggcaaagtctcgctctgttgcccagactggagtacaatggcatgatctccactcactgtaagctccatctcttgggttcatgccattctcctgcctcagcctccctagtagctgggaatacaggcacccaccaccacgcccggctaattttttatatttttagtagagacggggtttcaccgtgtttgccaggatggtctcgatctcctgacctcatgatctgcctgcctcggcctcccaaaatgctgggattacaggcgtgagccaccacgcccagcctgttgtttttgtgctatgtttatataggaagaacaagatatgcaataggactttctttaagtttggcttcatttaggggtttatctagaaagagtggctttcaaggaaaatgtgaaaatgtcagactcacagaagttgttgtataattttattaacattacagaaagttaaataactaatcataatttaaattatgagttactcttttagtccttagatcattttgatctgttaatggaaaaaagatttataggacaattttgtatattattttaattaagaaaatcttttgtagcattttgaagcattggctaatcgagctgctacaactggccatgttattgatatctatgcgtgtgcattagatcagacaggtctcctggagatgaaatgctgtcccaaccttactgggtatgtatttaaatttttacagtttttgtaattataagcaaatgatgacatttactgatataaaccaataatgaccatttagggaaaagtgtcatcttcccactacttcaaggcaacacatctgttagtagtttttgatattcctttcagtaaaacacacttttgaatttgtttaaaaatatggagttataaaggtccaaccctgtttctaaagctcactttgatatcttgaagtcattattttgatttattacttcaacagcatttttgagataaaattcacataccataaacttaccatttaaaatgtacagtttgatgcttttagtatatttacaggatgcacagccatcaccgtaatttgtttagaacatttgcattaccctagaaactatgttcccattagcagttacttcccattattccctcctttttcttctcaccaccctctcatccttagacagctgataattgcctgttctgggtattttataaaatgaaatcagaggctgggtgtggtggctcacgcttgtaatcccagcactttgggaggctaaggcaggtagatcatgaggtcaggagttcaagacaagcctggccaagatggtgaaaccctgtctctactaaaaatacaaaaattaggtgggcgtggtggcaggcacctgtaatcccagctactcggtaggctgaggcaggagaattgcttgaacccgggtggcagaggttgcagtgagctgagatcatgccactgcactccagccttggcgatagagttagactccgtctcaaaaaaaaaaaaaaaaaaaaaaaagaggaatcagagccgggcaccgtggctcccaactgtaatcctagcactttgagaagccgaggtgggaggattatctgaagtcaggagttcaagaccagcctggccaacatggtgaaaccctgtctctactaaaaaacataaaaattagctgggcgtggtggcacgtggctgtaatcccagctactcaggaggctgaggcaggagaatcacttgaacctggaggtggaggtttcagtgagccaagaagattgtgccactgcactccagcctgggccacagagtgagactctgtttcaaaaagaagggaatcaaatggtctcttgtgattggtttcttttactcagcataatgttttcaaggttcatccagactgtagaatgtactaatattttattttattttattttatttttactgctgagtaaaaagggaacaaggggctaaagtgcatttaatagtattccatttgatggatacaccacattttgtttaggaatccatcagttaatgaacatttcatttccactttttggctactgtgaataatggtcctttgaacatcgtgttcaagttttggtgtggagattatgtttttgtttctcttaggtatatatctaggagcagaattgttgcatcacatagtaatctgtccttaacattttgaggaactgtctaacgattttcccaagtaactgtaccaatttaaattcccattaccaaagtatgaggattccagtttctccacatctttgtcagcacttgtcgttgtctgtattttaattaattttttttagatggggtctttctctgttactgaggctggagtgcggggtgcagtcatagctcactgtagccacaatgtccagggctcaagcaatcctctcacctcagcctcctgagtagctgggactacaggcacatgctaccacacctagctaattattaatactttttttttgtggagacgaggtctcactttgttgcccaggctggtctcgaactcctgggctcgatcctcctgcctctgcctctcaaagtgctgggattacaggtgtgagccaccgtgcccagcttattgtctgtctttttgatgatatctgtcctagtgggtgtgaagtaatatctcattgtggttttcatttgcatttccctgaagactaatgatgttgagcatctttttatgtgcttactggccatgtgtatatctttggagaaatgtctattcagattctttacccatttttaatttgggctattgattttctttttattgagttaaaatagtttgttatttggatataaatccctttatcagatatatgacttacagatattttctcttatgggttttttccctcacttttttttttttgagacagagtctcactttgtcacccaggcaagagtgcagtggtgcgatctaggctcactggaacttctgcctcctgggttcaagtgtttctcctatcttagcttccccagtagctggaattacaggtgtgcaccaccacacccgactattttgtatttttagtagagacagggtttcattatgttggccaggctggtctcgaattcctgatctcaagagatccacccacctcggcctcctaaaattctgggattacaggtgtgagccaccccgcccggcctccctcacattcttgatggtattgtttgcagcacaaaagttttaaattttgatgaaacctatttcatgctttttctttcttttttattttgagacggagtcgctctgtcacccaggctggagtgcagtggcgtgatctcggttcactgcaacttcttcctcccaggttcaagcgattctcctgcctcagcccaagtagctgggactacaagcgcctgccaccacgcccaactaatttgtttttgtatttttagtagagactgggtttcaccatgttggccaggctggtcttgaactcctgtccttgtgatctgccttcctcggcctccgaaagtgctaggattacaggcctgagccaccgtgcccagccttgattttaaaaaattttttaatttttaaattttgagacagagtctcactgtgttgcccaggctggagtgcagtggtgcgatctcagctcactgcaacctctgcctcccaggttcagcagattcttgtgcctcagccttccaggtatctggattacaggcatgtagcaccatgcctggctaattttcatatttatttcaagttatctgcccgtcttggcctaccaaagagagctgggattacaggcatgagccactgtgcccgtccaacaattgatttttatatgttgattttaccccctgcaaccttgtggaacttgtttattagttttaatagtttttctgtggacttcttaggattttccctatataacatcatgccatctgcaaattggtattgttttacttcttccttcccacctgcatgctttttcttttccttgcctaattgccctggctggaatgtccagtacaggattaaaaatgtgagagtgaatatccttgtgttgttcttgatcttcggggtaagtcgtttagtcttttttttttctttttttgagatggagtttccctcttgttgcccaagctggagtgcagtggcacgatctcggctcactgcaacctccgccccctgggttcaagtgattctgctgcctcagcctcctgagtagctgggactacaggcatgcgccactacgtccagctaatttttgtatttttagtagagacggggtttcaccatgttggtcaggctagtctcggactcctgacctcaggtgatccacctgccatggcctcccaaagtgctgggattataggcatgagctaccgtgtccagccctgtttagtcttctaccattagaagatattagctgtggatttcatcagattgaataagttcccttccaaaaactctcatgaaaatgtgtttttgggattttgttaaatgctgtttctatagctattgatatgatcatgtgacttttgtccttattaatatggtatattgcactgatttttggattttaaacctaccttgcatttctgggatgaatctcacttggtcatggcgtataatcctttttattattgctaaattcaatttgctgtcattttgttgaggatttttgcatctgtcttcataggagatactggcctgtagttttcttttgtttggtgttggcatcagggtaactgtcgtcacagaatgacctgggatgtgttctttcctcttccatgagcagttattatttttgaaataatttaattaggcttaaaaatcaattagatatgtcaacactttctcaggtttatttatttaattcattcatctaataaatatgaatgagcacctgctatgtagccaactgctcaaggcactgcaagtaaagcagtgaactaaacgtaaaaatctttgcccgcatggagcttatcttctagcgcagggctcttccgtataatttcgcaatggatatattctttgtgctgtcccattgaaatgtggcaagtatgactgaggaactaaaatttaattttaattgctttacatttaaatttaactagccacatgttagtacagttctaatgagaggagataggataagtatggtagataggatgtcagatggtgatagcattgggaagaaaaaagttcaggaaagaagaattggggtttgcagttctaaataggatgaataggcagagccttattgaaggtgatattttagcaaagatgtaagcaagtgagagtgagccatgtgcatatatgaagtaagagtgttccaagtgaggaatagcaagtacaaagttgagaatgtacctggggccaggcgctgtggctcacacctgtgtaatcctagcactttgggaggctgaggtgggtggactgcttgagctcaggagtttgagaccagtctgggcaacatggtgaaaccctgtctctaccaaaaatacaaaaattggctgggcatggtggtgtgcgcctgtggtcccagctacttgggaggctgaggtgggaggattgctggagcttgggaagtcgaggctgtggtgagccatgatcgcatcactgcactccagcctgggtgacagagtgagacctgggctcaaaaaataataataataaagagaatgtacctgtgatgttgagaaatagcaaggagaacaaagtagctggaatggagtgagtgaggagggtaggttacaaagtccgtttacctttttaaagggctttggactttaccttgagtgagatgggaaggcgttggagagttttcaacagaggagttttatgatctgacttaatagtttaaaaggatcgctgaattcatttgtcatttgtagagtatagggatgtaagaataccaagtgatggtagcacagatggtgggaagtagttggattttggatatatttggaaaatagatgtaagggtgtggacaattccttcatagaggtttactgtaaaagggagcagagaaatggggtggtataaattgtcattaatctaggatgtattatcaggtataatgatgacttagatcatcatagataacatgtttgtagaaaatctgaaagaatttataaactattggtattaatatgtgaagttggcaagacttctggatcaaggtcagtgtacaaagtttaattataaatttatgtaccagtaacattaaaaaatttaaaaggatacaatttctaataagcatcagagataacaaaaacttctaataatatcaaaagtaaaattatggtcaattagttataacacatcagttttattcttttgcctattttaatttttgattgtatcttttattgatgtttaatacttaaaatattttaaaaatgtgagcaagtgtatctaaatatttgtatgcatgtgtatcatataaacaatattttatacatctttcctctctttgtgtttttcacttgtatcctagaaatcagtctgtagcagtgtattactccattgtgtggatgtaatattttttcaactagtctctaattacatgattatttggattgttttcagttttctgttattctgagtttgtgtttgaaatacagtatttcaaacacaagggaaaaaggaaaaaaacttttgttgttacaaatagtgcttcagcgaataaccttgtgaatatattttgtttttctgtttttgttttgttagagtatctttggaatagattactattagtggggtggctggattaaggaggaaatccatatataattttgttagatattatcaagttactctgtactggggttgtaccattttgcagtcccagcagaagtgtatgagagtgcctgtttttccatagcctcaccaacataatatgttgctgtcaaactgatttttgccaatctattagagaaggaatggtatcaaaatagtttttaactttcaagttaatattaaaatttttttaattaaaaaagtaggtatatgcttattaaaaaaattaaaaataagtgcaaaaagtgaaaatactctcaattttcttccattctcatttgcttggtataacatgtatatttcatgtgacacagatagtacatgcatatacatacacacacatacttgtttttaagagtgagaatgggccaggtgggtggctcatgcctgtaatcccagcaccttggcagcccgaggtgagcatattgtttgagcccagaagttcaagaccaacctgggcaacatggcaaaaccctatctctacaaaaaaacaaaaaaattagctgggcgtgttggtgcaacctgtagtccagctacttgggaggctgaggtaggaggatgacttgagcccaggaggttgtggctgcagtgagccgtgattgttccactgcactccagcctaggcaacagagtgagaccctgtctgaaaaaaaaaaaaaaaaaaaaaagagaatgcatgctggaaactgtcaggtacctttaccaatatggagaacatttgttactatatactcttctgtaccttttgaattttgtaatatggtggatatattgcctatttaaagaagaatttttttttaaattaccaaggacaaatgcaactgttaggggtactctgttaccttcggaattgagattatttgtggggtgaggatattctcatatatatttgaatattaaaaattagtaatacagcacattttgggaaatatctttaaaatttattggtagttttgagaggtaattttcttctacgattttaacacacggactcagtaactgtgtcaagtatgttgtttttttgttctttccatgcagaggatacatggtaatgggtgattctttcaatacttccttattcaaacaaacttttcaaagagtctttaccaaagacatgcatggacagtttaaaatgggctttggtggtacgctagaaataaaggtaagaaccaaaacttgacatgtgcgatatgttatcaaaagacaacttataggcttgagtgtaattctaaaatgccattaatcaaatttaatatttactttcaaaattgtggttattttatattgaaacctgagttagagattttcttcaccagaagagtgtcatcattcaatgtgtgagactttacttgagcatttctgaacaattgttagaaaagtagaacaatattggtaaaatattctttaactttttaatttttttctttatatagggcttagctctttaaagtatgttttatcttcttttttttgagacagagtcttcctctgtcgcccaggctagagtgcagtggcatgatgttgtctcactgcagcctccgcctcctgggttcaagtgattctccagcctcagcctcctgagtagctgggactacaggtgtgtgccactgtgtctgtctaatttgtgtttttagtagagacgcagtgtcaccatgttggccaggctggtctcgaactcctgacctcaggtgatctgcctgtctcagctttccaaagtgctgagattacagacatgagccaccacgtctggcctgttctatcatttgtagagccaaatctatttatgttagtgctaggttaatgataggaattgttatctaacttaagaggaaactgttttttttaaaaaaaaaaaagaggaaactgttttttacctttcggataatcagtaattgttttatgattagttgttattgcataattctatcatttatttcaaatttggatttaaaatacccaaaggctaagtgcttctaatcctaattgattcttattaaattaactctaagcacattaattttgaattttcattaaatatttattaatcttgttttattgaatgcttgctatatgcccaacattgcttgggaaattacagagatgcctagggatatctaaggtacacgtcttgctatagagaaacttagcattctcttgatagagaggcagggaaagaaaacactgcatgtaatagaatgacataatggtaaattataaaaacactataaaggtttagagaagaaaaatgaacatatataggacacaatttattctagacttctagaggagtgtgacttatagttttttttttttttttttttttttttttttttttttgagatggagtttcgctcttattgcccggctggagtgcaatgtcatgatctcagctcactataacctctgcctcctgggttcaagcaattctcctgcctcaccctcccgagtagctgggattacaggcatgtgccaccatgcccagctaattttgtgtttttagtagagatggggtttctccatgttggtcaggctggtcttgaactcccgaccttgggtgatccacctgcctcagcctctcaaagtgttgggattacaggcgtgagctaccgcgcctggccacagttgttttcttaaagatgttagaggatattgcattttattcaggaacccagtgtgaggagaggcatagaggtgagaatcagcattgtatgtttgagaaaactgcccagtgagagtagatgctttgtatttgaatgaaaggaaatagcttaaatctgtgggagctggctgtagtgtggagacacatgtgtaggcagaagtcattaggtattttgggtaagattcatctgacagtggtattctgcatatgtcaggaaaaagaatctcaagtaagaaaacaaaagtaagctttccaatttttttttttttagacagaaggtattgtgatagcttacattttggtggcaggagagactggggggagaccaatcttggtgacagattttctatgggaggaaaaatagaatagggtgtctaaggttttagattaggatatgtgaattttgggtgggtaggtagaagtgtgaagtcaggatgaggttcccaaatggagacctcgtatgtgctaatggaaatagaaggttaacattaggttggtgccagattttaaatttgacagtgagcatagaagtgcttattgattgattatttttcatgttagtatattttcattggctttgagttttaaatatagatgaatatcttatattcttatacacctgtagttgaacatttgaacgtatctttgaggaaaccgaacatgctgtattcttattttgcagacctcaagggaaataaagatttcaggagctattggaccctgtgtgtcactcaattctaaaggaccctgtgtgtctgaaaatgtaagttgtgtttattctaaaaagaaaatacaggaccaggaactgtggcttgcacctgtaatcccaggtacttgggaagctgaggcaggaggattgcttaagcccaggagttagagaccagctcaggcaacatagagagaccctgttcccctcctgttatccccccaaaaaagaaaaaaagacacagcgaacgcacaggacagcaccaataaaaacttggggtggcagcctatagcattcctttcaaaattcttatattgattgttttaggtagttcagctcccattggtatacctctattcatggttgctctttctgcatacccttttcccatccatccctaattaaaacttttgtactgtcaccagtcttctattttttatgcctaaattatgtcttgccccagtgtgcctaaaaaaaaacaaaaacaaaaaaaactcatgatttggaaatttggagacttctgaaagtcaaaattagctctaaattgatttttgataccagaattttcaaaaaagtaaccaaattagccagatttggaatttcagttctttatgttctttttatccaatttaatggaagtataacgtactctaaaatggtagaatcatgtagctgtggagaggatgatgggacaaataatacaaagtgggtaatcaactttaaaaatgacaaagctaaaaaattaatatgtacaagcagtttgcgtggtaaaggtctgtctatatctatgacgttttcttgggaatcagagtgcttaacaattctcatccagagaacatgtgttcgtaaatgcatatattatatgttaaatcagtttctctttatacagatcaagtagttggatagaaggataatgttagttgcaattacttcattaaatagcatatacttttattttttattttattttttttgagacggagtctcgctttgcctcgcaggttggagtgcagtggcgccttctcggctcactgcaagctccgcctcctaggttcacgccattctcctgcctcagccttccaaatagctgggactacaggcgtccgccagcatgcctggctgattttttgtgtttttagtagagatggggtttcaccgtgttagccaggatggtctccatctcctgaccttgtgatctgcccgcctcagcctcccaaagtactgggattacaggtgggagccaccgcccctggccaaatagcatatgcttttaaagagaacagtatgaagaacttatattaatacttttgtaatttacttagcaagaatttaaattttacttttattatgtaaaaattattttattttttattatgtaaaaatgctttattttataatatacttatggtcttaaaatattttaagctcttaacattgttgaattagtttgaaacatgacttttttttttcctgtggtctttttccattttcactttaatataaaattaataaattgtgtctctagctttcaaacatgctatattttatttttacaggagataggaacaggtggcacatgtcagtggaagatatgtggacttagtcccactacaaccttagccatatattttgaggttgtcaatcaggtatgactttctacatctgaatatcaaaacgtacaacgtacatttgaataagtacttactttaggccatgaatagttcatattttttttcctatagtagatataacccaacatttattttctgtattggaatttatatttgtcgttttttatttttcaaggctaaactccttggtgagagtacatattgtaatagaaatgcagggaaacctacaaacgccaaaccttgggtagcccaacttttagtctgttttctttctttcttttttttgaatataaaattgaaggataaatgcagttatttaaaattcccttctagctacacatttttgcaattagatgtctagcttttcctagttgtcagaaagtatatatgacatatgagtctttgtacaagaaggtctaatatgtcaaaatccatagaaaaagtttggaaagtaatcgtatttgggaagatttttttttctgccacaggagataattaatcacattgaagaataacacaaattactgacttatatattaatagtttttagccataaaatgaaccacaaaatattaacagtcagctttcctaaggcaggtgcaatagtttttttttaaacattaaaatttataagaaatatattgactcttattgacaaaaacaaaacaacacacaaaaacaaagcaagaatgtctgttgtcagaatgcaggaataaagttttcctattgattacttgtatttctttctgatgataattattatatattgctattagtttcttctcattattaatctttcattggttggttgttcatcatatgattatgttcctaaaagttctgctttcatcttctatacctaggggaggaggacttagctcaatttctgtttatctagttacaagttgaacatctcagatctgaaatctgaaatgtttcaaaatctggaactttctgaatgctgacatgacactcaaagaaaatgctcattggagagcattttggattttggatttttggatttggggatcttcaattggtataaggcaaatattcctgagtttaaaaaaatacaaaatccaaaacatttcgggtcccaagcattttggataagggatattcaatctgtgcagtttggcttaaatggcttcacttaggaattgtcttttaatttctttgtgctctcccttttctttgttctttcatgtccctctggcttatatattacttgaaaattgatttcctagcaggactgacttctatcattcttgattattttcctcctctccaaattaatttctcctcttctgtgtaacaaattataactgttttgaatgcactggaaataagtatccttctaatcaattttagaatgaattatttttagtgctaggacatgtagcctgtgattatatgacaacagcatagtaaattttgcttaggttttactccattatatttatacagcataatgctccaattcctcaaggagggcgtggtgcaatccagtttgtgactcagtatcagcattcaagtgggcagagacgcatccgagtgaccaccattgctaggaagtaagttgtatttgttagagatttgattttcatatcacaggtatctgggttgtgtttccaaactggattcctattttgggtgacatccatgactagcaagtgaatatttgtgactaatagtattttatttatttctttctaacccagcttatttgctacaatatgcattactaagaaccgtaagagcaattttaaaaagtacttctaagacacacccttcaaaatattattttatttacctcattcctgtgagaggagaaaaatcagatatttacctataatagtcaataataatatatataatccattatatatataaatgatatagcacagtaattaatcacattacttttcaattagtgataaaaattcttagctatttttttttcaagttttattagtcatttaattcatttattatgccattactcagcttctgctttgtggagtaggttctgttttaggagagtatgaatgcggaagccgtgaacgtacttagcctcctgctgtatgacagtgtggtatagagtcatcctcacattgtctgtggtaaagggccagttgtgttttttttcctaatccttcgggtacagatgcttttattaaatacaataaaaatgaattactagaaaaatgaaattttaaaaagtgatttaaaacaaactccctgttttatattattagattaataagatataagattattttgtgaagttgctcagtttctaaatatttattctcagttcctcttttgacttcatggcactggttcacataccacactttgactagcacttgttgagaccacaaaaggtaaagtctctatctaacagattcaattatagggtagtattttgtgtaacatagtcatgttctaatttattgatataggcagggtccccagaagggaataataaggcccaacagataccttttcttattcctatctttgtgatagattttccaaataaggcatgtatttgttcatgggctctttgcccagcatttgcagagacaacaaatttaactgaatttagtacctttctttttattaagaattacgaataaattatttctctgctactttggtatctctgtgtatttgtgaagtataaaacaaaaggaaaataattgtggaatgagtttagttaggaagaggttttttagatgaggtgaatctagaaatgaacaggctttggtctttatttctgtttgtcttgaacttggttgtctggataggaaaagtgttgatcagtaaacttacccagtttagtcatggtctcgacaatggacaaggaaggcatttgtagctctcattttcattaagtgtacttaaactctagcttcattcctgaaaatcttaagacttttgttgagtgatggacatgaacacaacatttgaactgagtattagctgtattgggtgatctattacttagcacagggttgtacatagatttagtgttctgttctgttaccttgctttgacttaacatcctggaacaatgtcaaggggatacattattcatttgaagaaaaaatgtcagctgaaccttcccttagatttattcagatttcagataaggaacttggaagtactgatgcttggcaaacttctcagtttatttatggctctcaacgtgtgtgcacacacacacacatgtgtgtgcacacattaaatttgacattcagaacatttgcttaaggaaacaacgacataccaaatgaaggactttttacaacttacaaagtcactggtttgtactattcaaaaatgtcttggaagacaaagaaagtctgagcaactgatccagattaaaggatactaaagaaacattaccactaatgccaatgtgtgatcatggacaaaatgcaaatgtcagggaaaaattttgctttagaagccattattagacaattggggaaatatgaatatagtctctttctatatgataatggcattatatcagtgttagatttcatgagtttaataattggagctatataagaaaattttttgttcttaggagatatacactgaagtatttcaggcagaaggtcataatatctccaacttaatctagaaaagttcagcaaaaaatgtgtatataaatggagagagagaatgataatgcagatgtgttaaaatgctaacaactgatgaatctaggtgatggttatataggagtttattccactcttactgtctttatgtttgaaatatttttaaaatgaaaattttaaaaggttaggtgactctttcaagagacagggtgctgtcttatgagaaatattatgggcttatatattttcagtttgcacagaatttatgaggctatttgtagagacatatgtgtgttatggtgccatttatagcattgtgtcttaccaaaagcatccgtcttttcaagttaacttatcccaaccatttccaatgatcagagcaccttgttgttttttttttttttttttttttttttttttttaaactaggactatgactttaggggcctagacaagtgtttttgttaagtgaataagccatatgaaaataaaggctcctgagaagacaaagttactctatttttcatgtacaaaatgactttgatctaggaattttggtttaaactagttgtaagaatcacagtgaagggatacgggaaatgtagaagacagatttttacaatgtcaagaagccctttaaacttgactttaagagcccaccttttaatttatgtctaaacaaataataattagtaaatttgcatgtgttcacttggaatgtatttcctctcctgcaccattatattttcagaattaaaaaagtcacctttgtagttcagtttaaagcaaataaataccgtcattcaagtttagaaagtattgattcaaacagtgttgttttaaattctttgatttttaaaattaaaactaaaataattaataaaacactaaaccaaactattagtataatcatgaagtctttaaattgcattaaaacataactttcaaaattaccaatgtcttcttttacacattctcagtcttttttgcttcttactgtttactacactgagataattcacacgtttcaaccatctgggaaacatttaataattattttgcttattgaaagaaaattaaaaatacagaaagaaggccgggcgcggtggctcacgcctgtaatcccagcactttgggaggccaaggcgggtggatcatgaggtcaggagatcaagaccatcctggctaacaaggtgaaaccccgtctctactaaaaatacaaaaaattagccgggcgtggtggcgggcacctgtagtcccagctatttgggaggctgaggcaggagaatggcgtgaacccgggaagcggagcttgcagtgagccgagattgcgccactgcagtccgcagtccagcctgggcgacagagcgagactccgtctcaaaaaataaaaaaaattaaaaaaaaaaaaaaatacagaaagaagggagaagaattttaaacatgctgctgcctgaattcccttaggatcactcatcactcttacatgtaaaagtggttcagcacttattttcaggaagtctataagtatgtctggccagtcactatatctgaaatattaaacaaacaaacaaacagataaaatgtattgctgggtctacctaggttcagtttgatctgagtctacccaggatcagttggatttatacagcatttggatttaataaattgctgctattttatgtgtagtatcaaattaatcccttagactgaagtttttacttattaacttttaattggttttagtcagtgtattaacatggaaataaaagaatacaaagtaattttaattatttgatttttatcactaatgattgaaagaccaatgagaaacttccgacactttattcattttccagtggaataaacaagaattacttaggttgagagaaaacctttatttttgtatttctatatttctgctttaacaaaattaaataaatgaaattttaaagttggatatagggacttgcatatctatgtgtgtgggcacacgtatatcctattgtttttacttgtaaaaatcttttattggccaagtgcggtggctcatgcctataatccgagtgttttgggaaggctgaggcaggaagatcacttgagtccaggagttggagactagcctgggcaacatagtgagaccctcacctctgaaacaattgttttaaattggctgggcatggtggtccgtgcctgtagtcctgctgctcagaaggcggaggtgggaggattgctggagcccaggagtttgaggtgaatcatgattgtgccacttgaaccatgatcatgccacttcattccagcttgggtgatagagtgagaccttgtctcttaaaaaaatctctgttttttaaaaacttccttattttatgactttaaagttttttttttttttgagacaaagtctcgctctgtcgcccatgctggagtgcagtggtgccatcttggcttactgcagcctctgcttcccaggttaaggcagttctcatctccagagtagctgggattataggcatgtgccaccatgcctggctaatttttatagttttagtagagacagagtttcaccatgttgctgaggctgatcttgaactcctgagctcaagcaatctgcctgcctcagcctcccaaagtgttgtgattacaggtgtgagccaccgcaaccagcctagagatagggtcttgctgtttcccaggctgaactaaaacttctgggcttaagtgattctcccaccttagcctcctgaataactgggactatagatgtgtgccaccatgctgactggactagtaaaaatattaatattttaaggaatgtggttggagagctgcctttacacttactttggaagatttctttaggtttggttatatttttctgaaaaacagtgaatgctatactaaaactgctattagtgatttaaaaaaatgctaatttgagcctggtgtggtgctcacgcctgtaatcccagcactttgggaggttcaggtgggtggattgcctgagctcaggagttcaagaccagcctgggctacatggtgaatccccatctctactaaaatacaaaaaagttagccggagcctgtagttctggctactcaggaggctgaggcacaggaattgcttgaacccaggagacagaggttgcagtgagctgagatccttccactgcactccagcctgggtgacagagcaagactctgtctccaaaaaaaaaaaaaaagctaatttgtctaagtaatattggaattttgaaatattgaagtaggctgggcgtggtggctcacgcctgttattccagcactttgggaggccaaggcaggtggatcacttgaggtcaggagttcaagactagcctagtgaacatggtgaaaccccctctctactaatgttgtgggaatcaggagactggagagactagtaagtagaacaggaggattttattgagtgcactcagaaccagtggattaacatccgaagactgggccctgaacaaagacagggcttggcttatctacacacttttgaaagggggctgactagtttgaaacaagcttacagtggcatgaagcgtagtggcacgaaagctcatgtacagaggcagaacaaaggcagttaattaaactgtgacaggttcataactcaggcttatgtgtgactcctgctatgtggcccagatggctgttatctagctttgctcaagagagccttgcacaggcttatctcataaccttcgctatagcgcctagatggttgcaatccagtcccgctcaggcatgtctcatgaccttcgctgtgctgctcagttaaaacagactacttgaagttgctagttatagaaaacaggaatctgtaaactcataggtttactcatatcgtaagagaaaggaaaatttgtttctcttttccttgtgtttgagggagtgctgggagggtctccagagcacattcctttgagccctggcttcttggataatgttatcgatactttgcctgggtctgggctttgcctgttactgcctttgggatgagttagcctaatacctaaagcttgtttccttctcttgtttaattttatttttctttatttgtttaatttcctgcctcactaaaaatacaaaaaaattagctgggcctggtggcaggtgcctgtaatcccagctacttgggaggttgaggcaggagaattgcttgaacccaataggcagaggttgcagtgagctgagatcgcgccattgcactgcagcctaggtgacagagcgagactctgtctcaaaaaaaaaaaaaaatcctagtagtttctgtatcttttatcttttaaatttaaatttgtgtggtagccaactatgatattgtgggtataataattcagaagcatttctatgctttcttattgtcttcagctgggcagatgctcaaactcaaatccaaaacattgctgcatcttttgaccaggaggcagctgccattcttatggcccggctagcaatatatagagcagaaacagaagaaggtccagatgtgcttaggtggctggacagacagctcattcgactggtaagaaataaacactgtgcttttctaaatctgtatgctttcatttgtagtaaatgtttgttgcagataatctctttcaaagtacttaacagtgtatctgaaatactgtatgagaaactcctattcaaattactgagacagtagcacagtaatgaatagtagaactcattaatctcttccagtaaactagattgccttttttccttaaaatgtaagagtgacaattatgtaacctattatttttctattcttattggctggaatgaggttagttcccaatttaattctatattattgtaacaatttttagtgcttttttacatatttcttcattgctgtggctttagttttttactttcattttaatggaactattatatgtgcatctcttaaaagaaattaggccaggaatggtggctaatggcagtaatcccagcactttgaaccaggagttcaagatcagcctgggcaacatggcgaaacccctgtctctccaaaaaaaaattggccaggcatggtactgtgtgcctgtagtcccacctactccagaggctgaggcgggaggatcactgcaacccaggaggtttgaggctgcagtgagctgtgattgtgctgctgcattccagcctgggcaacagagtgagaccttgtgtcaaaaaagaaatgaactggggtagaaaaattatgcatattaacatgcaaaatatagacaagtctgtattatctggttctagattaccaagtcgtgtgctaataaagttattagtagtgttgatttacttagatttttaacatgccagaacaccattactgtacttacattatgacacagagcacttgattaagcttagtccctttttttttttttgagacagggtctcactctgtcacccaggctggagttcaatgagatgatcatggctcatcatagccttgacttcccctgctcaagtgattctcccacttcagcctcctgagtagctgggactacaggcacacaccaccacacctggcaaatttaaaatttttttgtagagatggagtctgcttatgttgcccaaggtggtctggaactcctgggtttaagtgactctcccacctcattctcccaaagtgttgggattacaggcatgagccaccatcaccatacctggctaatttaaaaaaaattttgttgagactgggtctcactattttgctcaaggtagtctcaaactgctatgctcaagcacccctcccaccttagtctcccagagtgttgggattttacaagcatgagccaccacacctggctaagctcagttcttaatgcttcatttttacttagcaacctctggcttattctttgaaggtacttctttatgcactctagcttaaacacccttttgagaactctatttgctaagctgtcgaatttctgtgtccagtggcttttgtgtggttggtgtaggctttcatgtaattttaaaaattcttgagtgaactagacttgttttaaaaagttagccatttttatatcatcattcagaacttttttgatttcacctccaagagttttttttatactagtacctctttgaaaaaagcagcattatgacaatattaccttttttttaaaaaaaaaaaacaagaaagattaatcctctcatagggtccactattgatgggacactattagaacaaatgccaacacagttccttcaaggtggatcttttgtttccagatagatataacattaaatatattttgacccttgcttatttaggatagcagaaaagtttctctttgtagcagaaattttccttgaatttcactgttatttagaaatctgacatgacatcattgaaacctgttaactcgtcaatctgtagagaatctgttatttttcagcttattatacacagatgtctccagcatcatgtgacatgtcatcagtgctttgacttattgtactgtttttaaatgggaccttttcaatttctcagactacatcttttttttgttttgagacagagtttggctcttgttgcccaggctggagtgcagtggtgcaaccttggctcactgccacctctgcctcctgggttcacgtgattctcctgcctccgcctctggagctgctgggattacaggtgcacaccaccatgctggctaattttttgtatttttagtagagacgggtttcaccatgttggccaggctggtcttgaactcctgacctcaggtggtccacctgccttggcctcctaaagtgctgggattacaggcgtgagctaccgcacctggcctcagacagcatcttgtcctagcattttcacttactgtgattttacatattggcaatattcttttctcaacaactgtgtgacttttccttttctaggtaataagttgtactctgaaatagcttgcttccttagtttttttcactaattgtgactttgtctcaacaaatgcttcattgtttagagattctaaaagctgcttgatgtaatcagcaccttttgcttgtcaaatggctgtgatttgtagtaaagggctttttccattttgccagaggtattgctgaattggtaggttgtcacatatgacacaaaattgaacagtacaacttggattactgtcccatgtaaaacctactgattttccttgtaaaggtggattttttttgtatgtcccttgttgcatgaatacactgaaatgactcagatgattgtaattcttcagaattatcaggattctctgaagacttatgtctagaattgttctcttttatatcttttatctcacatctcaattttgagattgttttttaatttttttttttcaacttttaagttcaggcatacacgtgcaggatgtgcaggttttttgtataggtaaacgtgtgccatggtggtttactgcacagatatcccatcacccaggtattataggccagcatctattagctattcttcccaatgctctccctcccctcactccccacaggtgcccagtgtgtgttgttgccccccatgtgtccatgtgttctcatcagtcagctcccacttgtaagtgagagcatgtggtgtttgcttttctattcctgtcttagtttgctgaggataatggcttccaattccatctgtgtccctgcaaaggacatgatctggttccattttttttttttttcgagaaggagcctcgccttgtcgcccaggctggagtgcagtggcacgatctcggctcactgcaacctcctcctccaggttcaagcaatcctcctgtctcagcctcccaagtagctgggataacaggtgtgtgccaccacacccaggtgattttttttttgtatttttagtagagacgggatttcaccatgttggtcaggctggtctcgaactcctggccttaagtgatctgcctgccttggcctcccgagtactgggattacaggtatgaaccaccacgcccggctagtcttgttccttcttatggctgcatagtatttcatggtgtatatgtaccacattttctttatccagtctattattgatgggcatttaggttgattccatgactttgtctcacacctcaatttcaaaaattgccacattatttgacatgtttgtaaaatgtaagcactaatgtaaaacagaagggcctagtaattaattaaatgagacaactgcaaaaagtacaaaattacataaacctcacagtgtactttacttctaatctacacattctacattctgcagcatttacaacagcagcagggcagttggggctagagaccagattagtcttgtggccccattttatgataatgactgaaggaagcaagggcttcctgtcatgttaaaggtatccaaaacagacatggtgccagcaccaatttggctctgtaatgcacactgtctccaaaacagtacacaaaaaatgatgtttctttttaattaaagttactctagtaagtcatcaaggaaaagaaaacatattactatgctaaattgagggaaagaaatttattagtataatttcctaggtttttgattaggaaaaaacttacaaaaagttttaatacctaaacagtattaactttttctctatttgtgttgctgttgttgtaatagctaaaaattcagcagtgaagttgtcagtacaagaaaatgaggctatcctagaatagctactgaaactaaagtgcgttatcacctaagtcatttatcacataagatactggtatccacacatgatttactgcctctattctcagtcccttgttcggatccattgtgcatccaacttcagggatctgttcatctctttctttctttctttctttcttcctttctttccttcttttgagatgggatcttgccatattacttacccaggctggacttgaactcctgggctcaagtgatcctcccacctcagcctcccaaggagcaggaactacaggcctgtgccactgctcccggcttcctttttgactcctggccttttctgtttcacaacttaaaattgatggctgattcatctctgacctttggtttacccatcaaccactaattgtgttctcccttcagctgcattgctagccatcctgggtaaacacttcatctaatcagacttgactcaggaaatcttctgtcttaagactattgggactttccctgcaagccaggttttctcttgctgcaccaatgggatgaaacactttagctttactgtttttacagataccgcttttgtcattaccattttcttatagaggttaggcattgacccctagggtccttttatgtggctgcctttatgcataaataattactgaattaaagaaggaattagcctttttgtaagggatgttattttcctcaggaaaatcattactgttgctttatctgcccagttttattacttctgaataactcaaatagtgggtcttggatataccttctttatgcttcagtctgttttccaccggtattagtgttttggttgggttgtaaataaggactgctcctcgtgactcaagtagttgatactagagcattttacaggtgttcaaaaaattgtttttggccgggcacggtggctcacgcctgtaatcccagcattttgggaggccgagacgggcggatcatgaggtcaggagatcgagaccatcctggctaacacagtgaaaccccgtctctaataaaaatacaaaaaattagctgggcgtggcggcggatgcctgaggcaggagaatggcgtgaacctgggaggcggagcttgcagtgaaccgagatcgcgccactgcactccatcctgggtgacagagcgagactcttgtctcaaaaaaaaaaaaattgtttttttctttttcgagacagaatctcgctctgtctcccaggccggcttgcagtggcacgatcatggcttacagagtagcctcaacctcctaggctcaagcaatcctcctaccatagcctctcgagtagctgggactatagtcacgtgcaaccatgcctggctaattttcaaaattttttgtagagacaggatctcgctatgttgcccaagctggtctcaaactcctgggctcaagtgatcctcctgtgttggcctcccaaagtgcttgaattataggcatgagtcagcacacttggctcaaattttttttttttttggagacagagtcttgctctgccacccaggctggagtccagtggcacgatctcagctcactgcaacctctgccttccggattcaagcaattcttttgcctcagcctcccatgtagctgggattacaggcgcgcaccaccatgcctggcttatttttgtatttttagtagagatgcggtttcaccatgttggccaggctggtctcgaactcctgaccttgtgatccgcccgccttggcctcccaaagtgctgggattacaggtgtgagccactgcgcccggccacaattttttttttttttttaatagcgatggttgtcttgctatattgttcaggctggtctcaaactcctaggcacaatcttcccaccttggcctcccaaagtgctggaattacaggcgtcagtcactgtgccagcctttttggtgttttaaggcacgtgttgagcttttttgttgttatctaagagctctttatttgttgtgagagacacttagttaaaaaatatccaaatattttaaggtgagttattaattacattgggacaatgtggtgtttgtttctgaaatttagatgttttttctttggttttgtctcttggtaagtctataagtaatattataattttattctttatcaagtatctgcttcctgatgattggtaacttcttgtaaatagaatatttataggcaacagtgttagcttttattccaggaaataaattactaacacattttattttatttagtgtcagaaatttggagaatatcataaagatgacccaagttccttcagattttcagaaactttctccctttatccacaggtaagtaggtaaaaggtccatattcttttcttttcttttttttccttttttagagacaggctctccctatgtcatccatgctgaagtatagtggctccatcatagctcactgtaacctggaactccggggcttagtcagcctcctgagtagttaggactacaggagtgtgccaccatgccgagctaatttttttttttttggtagggatggtttcctgctatgttgcccaggctggtcttgaactcttagcctcaagcagttcttctgccttggcctcccaaagtgctaagattgccacatccagacagacccatattcttttcttgtgtggccagtagcattgagcctcatttttccttttttattgctctttttatggtatctattttattgggttattctttttgttaggtaagttttgggatagctaagaaattaatattgtgctacgagtagttggtgaaaagtatataatatttttatattggccttgcaaatagtcatttatttgtggtgaatagagacttattctggaaccctgcagtgggtagaattacatgtaaggctggttagttttccatttgacataaggggacctaattatagtggtaccagaaggacttcatctgaggttattttaccagttagctagtcttgcagtatggtatcatcacctgagaacaattttatggggccagaccagataaatagaaaataaactcatttgatttaccttacagaatattttccacctggagcagtggaatctatccctccatcttcctgttgatttgatagatatttttaagtctgtgtgtttagagtgctgtgtgcagggaactttaggaggatacaggtgactgacatggatccctcttacaaggagcttttaaaagggtgagatgtgaaatatacataaacaacacagaacagaaagtgagaaatatacagaatttaaaggaaacttaaaggagtccttccaaatggatgattttatatatcttttgaaggaggaggtggccttttagcttaacttggaaggatgattaatattgagatgtggaaattcatatttttgcccatgagaactttgtttaaagcatcagctttctttttcagagctgctctgtttttttttttgttgttgttgtttttgttttgaggatcctttattgctgattgatctataacccagaaactccatgcttacagaggagagacttccctaaaacctctggtgagatcctggagaaccaggaaaaggcaaggtctgcttgtcttaaggcatgtaaaattctttgttttgtcatttttgtagcagaaactaataggaaagtgatggagggcattagcctaagtatttgactaaattctgcacactttctcttctctccctgcctcaagccttcttgttgggcttttagatcttcagagagatctggacatttccatctttcttcctttcctggaaataggaagcagaggaccctggaatactttttgtcttgggttttcaaagtctgataatcttctaaaaggtagcatagaccaaatttaagggaagtcttcatccccaaaatattacctaacatttaccaattggtcatttctgtgagtaaacaagaatgactgaagtagtaagggatgcaagagcctctcaatgaattatggatcctgaaaacagaataggaatcagaatttcagtgaatgacatgttgggagaaagctgttgagtgagtcccaggcaggagcaacatataggcacttaagacctgagggttggaggaatttaagagaagtgactaaagacaagtgggaatactttctggctgatcctaatcagttttatcaaagacccagtgtaactgtccattattcaggcctaactctccctctttttgatttctttcatgtgaggagtaggtggaagggaaggaaagtgaaaggagaaagaagcagtgaaacaaaatctggagaatgtttcttaggtatagggaagatattaaatattaagaaattatatgggtatatatgtggttgtttttttttaaaccagtgtagacccttcccagtacaatttttaagtcatggtattcgttctcatgttgctaatagacatacccgggactgggtaatttataaaggaaagaggtttgtttatttatttatttatttttgagacagagtctcactcttgtcacccaggctggagtgcagtgatacaatctcagctcactgcagcctctgcctccctggttcaagcaattcttgtgtctctgcctcccgagtagctgagattacagacacatgcgaccatacccggctaatcattttttgtatttttagtagagacggggtttcaccatgttggccaggctggtcttgaactcccaacctcaggtgatccacctgcttcggcctcccagagtgctaggattacaagcgtgagccaccatgcccagccaagaggcttaattgactcacagtttcacatggctggggaggactcacaatcatggcggaaagcgaaggggaagcaagacatatcttacgtggcagcaggcaagagagcatgtgcaggggaactcccatttataaaaccatcagatctcctgagacttactaccacgagaacagtatgggggaaactgccccctgacatgattcagttccctccatctggccctgccttaacaagtaaacttgaattgacaattcaaggtgagatgtgggtgggtggggatgtagccaaatcatatcagccatataaaaagtagaaaatctgtaatttatttttatatgttcttagaatctttggtgttggtaatgagtagtaataaaaaagcccaaagatatggtcagacgtgtgaagattaaaaacaaagaatggtcatagttttactacctggcgtcagcctctgaataacttagatttgagcaaggggtttttgtctttttgtttttttccttttaaatacaaagtcttgttatgttgcctagactggtctccaactcctgggccccaagccatcccagagtgttgggattacaggtgtgagccaccatgcccagccatccttttcttactttaacttaaaaattttttttttctttcttaaattttttttcttgtggaattttatttttaggcagctgataaattttgtgaataggattcctttcctgagggatataaattagaacattcttataataacatgttttgttatgttgttaatagtttgtaatcaaatatttttgctaatagtaaacacctgttttaatattaaaatcagtaacaactatcttacgtgtttatcttacagtttatgtttcatttaagaagatcttctttcctgcaagtttttaacaatagtcctgatgagagttcatattatcgtcaccattttatgcgtcaagatctgacccagtctctaattatgattcagcctatcctgtatgcgtattcttttagtggaccaccagaggtaagagggacagaaaaaaataaattggtcttgttactgcaatgtgtggcattaaaaaagtgaaaataactaaaaaaatgcatatagttactaaatataagaatttaactaaaagaatggacatctcaacctattaatgtattcgcttaaaatatttatgaatgtttactatatgctagataccatgtaggctgtattagaagattgttaaatttttttttttaaaggagatggaagagactttcagatcattttgtccagccatttggttaatcaaatcctccaaagcatatgattattctttacgtctttaacaatgtccagaagtgattataattctgtagactgtagcttattccagagtttagtgtctgtgacagttatgacattctgtctaaacaaaggctcttgttttaatctcattttcctttgtttttttgagaacataaaaaatagttgattataaagacacatgcttagaagattgataaagttatccatttaaccttcttagcagactgtcccacttattttaacctgttatcaaatgaaccatttttccattctgtagttaaaatggtctgttttactacttaaaagtgtgtagttactgtatttgaaaatagtaaggtcaatataaagagaatatttacaatatctattgattaatgatccctcatgatgctattattcacggttttgtaaaataatgggtaaaatattttatttcgttacaatgatttttttgtaattggtcaaatagtttctatttttctaggaaatatatatttttaatatgttggtttggctatatgtattttgccttgtattctttgaatcaggaatgttttagaagtaacttttttttcttctgagtaataacgtgcatgtagacatctgaaaaatgtagaatggtgtttagaagaaaattggaatcccactgtccctagtgcctgctcctattaaatttcaaccttttcatttaatccatgaatcctatcagcttcatgttcttagggttttgcttttggagttatcttctttctgttctatataattactttctgtccatctggatcattcttattaattaacatagaaaccataacaacagtcaggtttataacaaacggccaaaacacccccaccatgacccacgctttctctaactgccaccccatttctctgctcctggtgagagttgaactcaaaaaagttatttgttgtttatactttctcacctcacattgtcttctcaacctatataagtaagacttttgtccctaacattatattgaaatggctcttataaagaccaccaatgtcctacatctcaccagagctctcaacagtatttacctagtcttcactagtactcagcccttgaaaaccttttgccctaggcttctgtgacacctataccttcctggttttcctcttactcactcaccgttctttctcagtcttttgctagcttttccctttcagacctctaagtgttgacatgcttaagggatcaatcttctggctttccctgtcttccctctcagtgatgtagtctaatcccattgctttaatctttgtgctttaatctttgtgcatgtgacacctagatttatgtcatcagttcagaccactccctttcatttcatatgcagaactattttcccatgtgctccaaatttgctctatcccaggcctttccccatttaggcttaggagttatccttgaattcttcttgactttactctatttttaaattgtttgttacctcagcttaaagggattccttaaaaaattaaaatacactataagaattcataatagcaagagattttaggtaataaaatataaatttcaaatttaggccatcatggcctaagtttcaaatttagtgctgagcctgtaatctcagcctttgggaggctaaggcaggaggatcacttcagcccaggaatttgagaccagcctaggaagcatagtgagaccccatctctacaaacaaaaaaatgaaaaaactagctggacatggtgttacacacctgtagtcccagctacttgggggtctgagttgggaggattgctgaagcctgggagtttgaggctgcagtgagctgagatcatgccactgcacaccagcctaggtgacagagcaagacccttctccaaaaaaataaataaataaataaataaaagaaacttggaaaataacctggaaacatctattttatattattgagtagattatttttcctttttcctcatttctcattgttttctttacgttagccggttcttcttgatagcagtagcattcttgcagatcgtattcttctcatggacacattcttccagattttgatttatcatggtgaggtaagatttcaatagcatttaaagctatgcatgtaaagtctttttacttagaaaggttttcttacttctaattgtatggctagtgtttcatctatgataaactttgatttccatttttataaaataataaaatatgatgctgcctactataaggttttaggcttcaattgcagttgacccacatgtgattattttattcatttgtcacacaattggattttgcgcaaagcacagtgttgtgaaagtaagaacactgactgtacatagacaaatggcacttttgggttttacctgaaaacattaaggggggaaaagtcagcctttgtcagtgggcaggctttccttttacgttatgcaatcattataagttattattaagtgttctacatgatcttgaaaactcatttaaagcatacatgaattaaaatttgtaacttcattggaatggtaaatgattacagagagcagaagattttagtagctattaagctttaatccaggtatttagcagaccttgatgcattcctgcagttactcattcagccaattgttaagtgcttcctctggatgctttggaagatatagatgtgttcttttttcacagatctgttctcaaacttacagtctagtgttttactaagttctgcagatttattttttcagttgctttaattgtaaatgattttagatttgcactgtgactgggtgtggtggctcacgcctctaattccagcactttgggaggccaaggcaggaggattacttgagcccaggagttcaggactaacctgggcatcatagtgagaccctgtctctacaaaaaaatttttagaaaagatttgtactgtaatagtaaagacattactcaaaatattctttgaagtagtactacccaggacttttttttttttttttttgagactcagtcttgctctttcacccaggctggagtgcagtggcgctatcttggctcactgcagcctctgcctcccgggttccagcgattctcctgtctcagccttctgggtagctgggattacaggcacatgccaccacgcccagttaatttttgcattttagtagagacaggttttcaccatgttggccaggctggtctcgaactcctgacctcgggtgatccgcccgtgttggcttcccgaagtgctgggattataggcgtgagccatcgcgcccgacctacccaggagttttaaaagatttaattattattattgtaaattatttttaattgataccagtttctaatgccctttacttgttaagaataatacctgttttaacttcttgcctttgttaaaaaaaaaaaaaaaacctgtaatactgacagggctttttttttttttttttttttttttgctttttctttgttttatggtgatttttactttttcaagtagcttgttaaaggagaaatcagaaatgcacatgattgttttatacagaggtataaagctataaaagaatgtgttgactgattcagctaacttagaaaataaaccaggcataagtttttagatgatttaattacatggtgtttagagctacttacctatggattgattcaattgctttcacgtatcataagcttaggtagatagcttttagctaacattcatttgataagcatagtgttttaaaaattttctgacttatgtaagtattctttcattttacttttaaaggagaagaaatattctaattttatatttattaagaatattttctctactgaaattgtaacttttaaaaaattgaggtaaatggaataatggtctataatttttttagtttctaaagattattttctttggaaaaatctcaagatttttggatgggcaagaaatttaaagtaatttctttaattgttttaaaattagaccatagcacagtggcggaagtcaggataccaggatatgcctgagtatgaaaatttccgccaccttctgcaagccccagtggatgatgcacaggaaattcttcactccagatttccaatgccaagatacattgacactgaacatggaggcagccaggtaagtagtgttaatttgtttgtgtgtttgtttgttgttaggtttgcagtgaggtgtacctgcttgccttctgattttaatagattgcttcataaagcagacagaaaggtaaggagataggtggggaaggtatcagtgcttactttttgcattagcttttgagagcaaaacagtaagattattgactagttgcctaaacctggcactttccatcatcttctgtctctagcctagcttcctgaacagggccaggatggcattgtggtggtatactagctttggttgaacaagaaaatgtgaacagcttggaaagtaatatacttttcttaaagccgtttatttactgttaaagtctatgaatatgacatttgtggtaacttacattttttcattgtcttcattctatcattccaattttctagaaaataaaattttatgtaataggaaaacactgtagtattatgaaaaggttttgtggcttttaggattttgaggatacatatacgttagatacatatacatacatacacagttgctttgagaccttcagaaggctaagttaggttccttaacatactctcataaaatacttcttacttctcttttgtaattcttataagagttataataaattaattataagttgttattaatttgttttacatgctctttgaaggcagggactatgctttgtattccctagtgcctagtacggtattataaaataggtagcaaatatcagtaactgttattcagaaatgataattactattagttttactgtatttatatgagagttatttcatattgagaatttgcaaagtacttctgcatgccttatctcatttgatcctcataagaattctagtgttattttcatttaacagataataaaactgagatctaggttacttatggccaagggaacacagtaaatacaggagtgggatttgagtcctggtactccagggccagtgctcttcactgttaggttaaactgattccttagagagtagaaaaagattttgtatgatactaaatttcaaaagatgttactgtctatgtgcttccattatgagttaaaaatcttactggttctttcattgatgtctcactgtgtgtattaccattttcctcttttattctggttattattttcatgatgataagccatagtgggtagaaggataaaatgttggatcacttgtctcatagaatcacctgtggtttaagaaagcttaagggtcattattttaagcaaaagaacatacagattttcatggcttttgtttttatcattatttgggattttgaacttctgaccaagtgtttagtaatttcacaccaaccttgtcataattgttgcacacataatttttatatgctgagttttggactcaacaatgtatttgttattttggatgtatgatttggagagaagaggtgcatttattatttatttgtaacacttagtgacctatacatttcaaagtttaatcttttaaaaattaagttaataaaattaattttaccaacacatactaaataaaattgattttgcatgatataattattcagctgatattgactgaaaccatttttgatggataatgttatttcttctttgcttttaaggcccgtttcctcctttcaaaagtcaacccttcacagactcataataatatgtatgcctgggggcaggtaagtttaaatagcaggtcttggaaattatttctttgtgtatttattgtttattattttagtgaaagctacatttttttcctgtgtatttagtaatggtttctgttggaaaagtaatgtaaaaatgagagtagaaaacagaattaatatttggcgacaccataggacaaaagtgatcctatcaaatagactccaagtttagcactatacccttgagacaaaaagcaatgaagtgtgtaagacaggaagtggtgactccagtttaatgctaggttgtgaaccacaaaaggccacgataagccaagagaggccagggatcatagttgagaaggaggggcaggaaccctgcaaatcattattgatatagtttaatttggtaaaagtcctgctgggtgtggtggctcatgcctgtaatcccagctgctcaagaggctgaggcaggaggatcacttgaggccaggagtttgagaccagcctgggcaacatagcaagactccatctcttaaaaaaaaaaagtgttaacctcttggtataacatatcaacatttattgagtgtccagtatgtttaggactttgtattggctctttagggtgcagttattacccatgcctttggagagcttgtagtctaatattagagataaaatacatacctaagtaaattacaaggcagaatgggatatttgtccttagaaagctatgaagtattacaaaggttagaagaggaagatggcaagaggtcacatagtggtagcaggaagagggtgtgtaatcagaaaagagctcagaaaaaagaaacatttcatttaaagaatggttatttcagtaattggaaattgcatgaggaagggaaatctaggtagagaatagtatgggctaagataaaagactacatgcagagctgactagaagaacataaaacggaaatgtgttgtacaagtaaattgtggaggatcttgaatgtcaggttgaggagtgagaagttgagtatttatttggtaagtaatggagagtcattgaaggtggacagagggcagatttgagtcttagtatagttgaatcttaagattaaatggaagcagtctgtaggttgaaagtatatttacgaaaataatccaagtgagagggagtaaaggcaagatggtgaaaggaatagatttgggagatattttaaaagtagactcaataggacttgattagaagttgcaggaaagtaattattccagggcatggcaactatgcacaaaatctgaattctgattgaatcctggattaaagggagagaatagctataaagaacataattgggataatttgtgagatttgaatatagatcatatatcagataactagtacagaattattaaatttcttgagagtgataatggtgtggttatgtaggagattcttcttgatcttaggagatacatcctgaagtatttaggaataaaatgtcatgatggcttcaacttccagaagttattcaacaaaaagaagaaaaaaggaaaaataatgtagaaacataaagcatacgtggcaaaatgttaacagtcagtgaatgtaggtatgctatatgggtgtttattgtacttctctctcaactttaatgtagtcttgaatttttaaaaaacaggtgaggggaaacagggtattttggggttttaagcctgagtgactaggaaaacatatgtcaataaatgggagagtggagagaaattgtttggtttagacactgagtttgaggtactatctagaaggccttattgagccacaataagatgaccatattgattatggccatgttgagtgggctgttggcaatttgggtttgatggtcagggcaagaatgagaaaggtgataaagtcatcacagtaaatgcttgtctgaagagagagtaaagaggtaaaggagagatgagacaaaaacttcaggggagtacaagtggtaggagtgtttagtgaattatcagagaggcagaatgaaaagaatagtatgtcataaaaggtgactttatagaaggaagaagaaggaggtaacaaactgacatgccgcagacagttgaagagggatacagagtgagaaaaggtgcttggatttgatggctaggaggttattcgtggcattgtgtaagcggctttagtatggtggttgagtaagaagataaatttataaggaattagtgggtgagaaagaagcggaggtcgaaagtataaatgattcttttgcaaatttaacctgaggataagcagtaggataggcagatgattgttattacggtaagggcacagaacttatttggagaccaagcataggaaagacacaaaagaacagatatttaagatcctcaggagacaatatgatcataagcagtatatggacgttaagcattggtaaggaggcagggcacttatttctgcaaaagcaaaaggtaagaagggtgaagacagaaaggtttttaggtggagtgaaaactcacattggataattgcctgtttcttttcaataatatgagattatttaggagtgaaaaaggctggagttaggggccaaaaaaactagaaaagattaaaaacagttctaaagaatacaaaaatcaactgaagattaataaaacgcttttgcagcagtggtgagggcctattttatttactaaaaatatctagagcatgcttccataatgttctttttttttttttttttttttttttgagacggagtcttgctctgttgccaggctggagtgtagtgacgcgatctcgactcgctgcaacctctgcctcctgggttcaagcgattctcctgcctcagcctcctgagtagctgggactacaggcacacaccaccatactcagctaatttttttggtatttttagtagagatggagtttcaccatgttggccaggatggtctcgatcttctgatctcgtgatctgcccacctctgcctcccaaagtgctgggattacaggtgtgagccactgtgcctgggagtatccatgaatagattttaattgtttcatgagggcggaacccttatgacccagtcacctcttaaaggccccacctttatactgccacattggggattttcaaaatgagttttggaagggacagatattcaaaccatagcaccgtcctacaattgcatgattgaatttgtgtaatatccctgtcctgtcatcccttttcccgcctccattttttatggcattgctcctgttagattattaattacttgaggcaataactgtcattttcatttttgattttccataggaccttaaacatagcatatattgaatacaatagatctggacaggagagagcagagattagaatattggaaatctgtggaggtggctaggagttaagagtttttgtaatataggtaaataaattgaatcccaggtccaaaagttctaaaagttggggaggttataaaaagtaatcttggaagggtggaaggctggtaatggaaaatgcagactctgcaagttacttgacttctctttgttttcacttccttgtctatagagtttaataaaacatgcttgaaatggacagtaatactcagtaaatgttagctattagttttcactattatcaatggaaaaaaaagtcacttcttatatttaacatgggaaaggaaacctattttaaactctgaagtgtaattgttactgcctggaagtaggggcattacaggcataaataagagtgctcaggtctttcttaagatttttatgagtaatgatgtcaatattttaataatcataatatctaatacactgaatctactgttttagtcactatgcttttagtgtactctcatttaattaacttttataaggtggatactagtaatcctatatttcatgagaggaaattgaggctcatatagattaagtattttatgcaagatcatgtagctaaactgtggcagggtctagattttaaccaaggtctaactccagactctgaatttttaatcaagttaatttgatgattgcatttaaaggaaataacagtaaccaagaattttactaaaaattaatggactctaatagcttacaggattttttgggggtcagaaatcaaggaccctatgataagtattatccatgaacggccgtaagagggcaccactgcaacacttctgtgacagtgctggaggcctctgttgctgtagtgcctcatatactaaataatgtaaagcttgtacctttctgcctaatcctggatatattttaaatagaaaaagggtccatttgaaaagttgagatcagctaactgctaattttttataaaatcgaatgagcattggtatttatcatttcaagcaggagctctgtggtatataaattaggaaatccttatattttgtcttgactaggagaaatggctctgagattgggtgacttgagatggaaaacattgtaaaatgaaaataaaatcaggcatagttacaggaagaaaaaagtaagagccatgaggttgttactggtttaggttacagttttgagacttgtgcttttctgtgttagctatgcatatagaataaagaaaagtatttcattgttatagatttttgaacaggaggaacaatagaaatagctaaaacatgtatgtctactgtgtgtactaggtactgttctgtttgctttatagaatttaactcatttaatcattacaacaacttgtgtaagataggtcctgttattatccttgttttacacatggggaaactaagacatagtttaaataacttattcagtcatatgggtaggaagtggcagagccagaatttgagcctaggcattctggatccagactctatgcccttaatcccagtaagggattgcctcccttcattatcaaatctttcaagttcttttgaataaacatatgataaaattgatttccctttattcaggagaggttatggcatgtttgtggctatgccagactagaatcacaggagctataagttctcatctcacatttgccaataatttgctgaaattacttaatttccctgttttagactttgaatatttataattaataagaacttgagtataagaagaaaaatgtaaaattcagattaaaaatcttctagaaataccttctcttgctgaagtaaaatttcattgttaatggattgggttaccaagatcattctgtcaatacagtttttattaaaatggataataggaattttccctaactcttgttaattacttggaacctacagaaatcaattaaaacgacctgaaaacttgagaagcatagtttatttaaaaaatgatattatgagtttgcttccttccagctgggatttctcttaaaatgccagggagaaagggtctggaggtcaggctttcttttaaaagcaccaagcctctaattccattgttagtcttcgtggtgactagccgccatcctgattcatctcatctcatagcataaactcctatgtgatcccatcagcctatgaataaagacactcctattatcagggaattctaaggatgtagagtctccctcccagcaaccagggacggaggccagttagattctttttatttaataggaccataggcatttcaaatgatttccttgtctattttaaacatttgtgtataaattccatgatatcaccctatgctttaatcataacaaatatcttttttcctctaggagtctggagcacctattcttacagatgatgttagtttacaagtgtttatggatcacttgaagaaacttgctgtgtccagtgctgcttgaagtgctaataatgttaaagacacttaagaagatgaaataatattcaaatttcattttttcctttttccatttatctgtggaaaccaacagatattgctctatattttttgtattagtatggtttgagacaacatatggaaaatgttcacatttgtagattaagctggaattataatgagagcaataagaacaaatttattttgcttaccacagtgttatagctggttctagaaatttgaagtctttataacttaattatgtttaataaaaaatagagtctgcctcgtactacagatgtaactcatttgtatattgcagacagacccaaagtggcactgaattttcttgctcaccttttaaaaacttgttccttaattttagccagaaagcaaaaaaacaatagtaatgataaatgtgaacatttttgcttattcattgaatatttttctgtaattttcagcacttatgtatacactttttctgtacttactaggttaaggcagatttatttttatgatttgtttaggaattatttgattttataatggtaattttcatgatgataatgtttttggttatttggaaagatagtttagagatgaaaggtttttttgggtaacaatcccgcagctgacaaaaaatgtgaaatttccacaaaatatccaacttatgtgactaaacgcagtagtttttttaaaaggggagatagaaaataaatggttttgttggagtgcattttagtaagcctttgcagtaaaatgacggttgtaactactaaaccaaatttagttttcacagcatggttttgttgttttccccttgtttttcagaggtaaattttgcattatatccttcagtattttaacactattttggcagtttacacattactttttgtttttccttcctttttgtgaaatgtattaagttgtggttcttattgaaacagtattatataatgtttgcttaattatatcatgtgatgctcagttctattttgatttattcattagtattcacttttacctttaaagtttacttgtagcaaatatgtttacattgataaagccagatatgttttgacaatgaaatttacatatcaagtactgcaaataaaaggtggtgctatgatatatgcttaggaggacagttttaatgattgtacttgcatgaacacaatcatatgatggtaaagcagaaacttaagaaaaaattgtttatgtgttatattcaattagcttaaataagttgctttgttatattttatttgaattgaactacgctaggcctaaatgccaataaaatatacttttcactgtt

SEQ ID NO: 36583 - DNA, 51802 bp, Homo sapiens
cgcctctcttcccccacccggagtggccggcagtccccggcaggcgtgcgccgggcagcagacagccgggagagctcgagcgccaggaagctggggacccgtgaccgtcacggagagatagagaacccctagcggacctgaggaacctgggctctgcttcctccgcctgctgcctggactgctcagtgaggtggggggatccccggccaccggtaagtagggatacagtgggcggcctcagggctctgggctgagaggccctttctgccagacttgctgtgtgacctgaggaaagtggcattccctctctgggccttggtcgtcttctctagagcgagatgagctctaaactccatcctggttctgactccctgcgcccaaatctatgcctctgtgttggggtgagccgtctccttggaagcttctctggctctgtccttgcagccctgcactctggctggagcctgaggagtggcgaccagagactaggagccggaaggggacaggatcacatccatcctcacgcctccacatgcacccacatggcgccacagctggcagcccttctattggctggcaggaggaagaccaggatagggtttgagagctgggatgtgtatatcactaggatgggggatgaataggcaggctgggggcacagttctgtcccagggagaagggggctggagtcctatctccaaatatattggggtaaggggtcctttctgttttcatttcctatccatgattgagggaaggaaaattggatttcattagagttggaaggaatgcagtcagacttgcattagaacttcccaacaggaagacctacaggaggagtggtcataggctggctgtgcgcatgtgggtatatgcaagctggtgtgtctgggtatatcagcgagcatatgtttccgtgagcatgcctgtgtgcagatagctttgtatgcacactggtaccacatatgtgtccttatgtacatgtacctgcgcatctgcatgtgctgtgctgacacatgcatggctctgtgtttgtgcacgtgagctgcctgtcctgggggaggccagacgatgtatggctctgctggccacttgctgagcctgcatcgatttatctgggcccatccatcagggtttaataaaactaaaagacaagcatccatcagctgggggcgggggtggctggcaatgaggtcctgagccctagagacctgctctcctgcccactatacctatggggaaagcttccttggcccccacacagccctatggaaggctgtggcccacaatctcagcccagtcaccagcccctgaccctgtgggtgcctgggagggcttcctgggctgagctgggtgcgctagtaaggtatcaggctggtatatataccaggacagtgcacaagatgctagacttgaaatacttccacgtgtcttgaagaatagcctcttctttaagccctcatcactattccaacttctctggccttctaagaccttctagacctctcccaatccagcaagtatccactggcacagccagatgctgcctggacactatttcagtgcagtaggcagctttctgctttgcctgaaagctggtatccgtgccataccggtggttaaatattttgaatatcgcctctgctcaaatcctagcccaagggctgtggttgggcctctgagagagactgatgcctggccagacctcctgccaccccaataccagtgcctgggccccacaggctgtccacgacttgcccacgtgtggagttgtgctgtgtgaactcagaaatccgccttcccggtctctgtggttttcaggtgctgtggctgtagctgacctctttggaccgggatgtgggtatcctgggctcctggcctgtggctgctcggtctttgggctaccttcggccatggggcaaatacaggtgagatgacacaggagagtcacagtatcacaggcctgcaactggtatcctggggtgctggggtccttgcacatatgtgaccatgtatgtgtggtcgtgtgggcagttatagcagagtctaggggctgggctcagggtgatctgaggtgttggcacccttgagcctgtgtgcagtgagctggagagtgtgtgtgcctgtgtcttcgtacgtttatgtctctgagcatctctgtgtttgtctctcagactggctttgtgcattcgtatgtattcctgtgtctctgtgtgtaagagaacaacctcccaccccaatacgtaagccaatcctgtggacacattgctggtaggaccagtggggtggggaggaacaggcagtgagctctccctgcagaaggacgccgcctccccagagaaccccaagtcctgctgatccttttcatggtggagactccatccctctagctcacgtgcttctcctcctccacggctggccctgaatctctaataaaaggcccaccccgaggcccagactctggatgagacagagggtgcagctttccagggcccaaagccaggggaagttgaccgggcaacttgcctggccttgctgggtgccctctgggctcagtagctcagctgcttcgccaagcaggaacagaactcctaggacccaaacccagctaggaaaagcagaaaaaccaagaagctgaggtgaaagggattgtggacccagggtgagtgtggccgcctgccccttgtatgtgcacatatgtgtttctgcttgtgtgtgcgtgagctttgctctcctctccctcactgggtcccctgggggggatggggcagataatttcaacatctgtaaggaatctgggcccattgccaaggggtgagtcacccattgctgctgtgatgctgaagacagtgatggtctttctgaccagacctgggggagggagagtgcagtggggtcattggcaccgggccccagggccccaggattccttcttccagccagtctagccagagagtgcaaggccagcttctaggagctgtcttcaccgtcttctcccacctatccctctgcattgatgagaaggcctttttgattctggcctctgtctttcctgttgtagcacctcccccaacacttctgctcagtcagccccagggcgagggaggcccatggctgcccacctgttctttcagggctttggaaacctgagttaagctatctccttctctgggagccctaacccattaatatgcccttcctggagctccaaggccctggtggtacccttgagcttgtggtcccctcagaccctcagtctcttctcgctgtttcacaaggtggttattcaggtaaatattcattctgttggctcctacttgtgtctggcctgcttgtctgatttggatgtaggacgttcctattgctgagaacacgtgtgccagctgcacatgtcatccctcgtggcatgggcacctacaactcccacatgtacagacacgtacatataattgtacataacacacaatgtgcatgattctgacatttccttacccctgaagagctcctctgccccccacctgggtgtatgtcatggagggggcacatgtgtaaatacacagctccccactccatctgtgctcgagagccacctagagcttcgtgtattctctcccttgctggcctagctcctgacttggagtgctgggagatttgggttcctggagttctgggcctgctctgctgttggctcacttagtgaccttggcctgggcctcagtctctggacctcagtcttccaaactgtatgctgggttgggggcctccaggcttcctggggagccagggtcagaaggcaggtggtgaaggcaggatctagctgatggtccagagtgaggactataaacttgctccctcccaggttccccaggcgtccagccgtgcagcaaccttggcctgagcgcacctaatgcccccctgccccttctcttctaggtgcacaatgcccaccttcacagcaggaaggactcaaattggaacacagtagtagcctgccagccaacgtgactggtgagcacccaaccatctcatcgcgccgtccctgcaaccttcctctgggagtgatctgtacccctctccacctgctcagctgagctcttcacctgatgtctcccccaaaggcttcaacctcatccaccgactcagcctcatgaagacgtctgccatcaagaagatccgcaaccccaaggggcctctcatcctgcgcctgggggcggcccccgtgacccagcccacgcggtaaatgcatccatgtgaccactgagaatcaacactgacctcagccacactcctcagcaactccagatgtggggcttaagcccaggggcctgtctgtgggtcattgcatcccagcccctgccaggagtcaacctggtctccacccctgggcttgcagggtgggctgagaggtggtacctggcagacctaccttctgtctttcccctgtctctggccagcagtgggtgggaacaggtctgcatcctgtgggcactgtgagaacacaggatgtgggcgggaacctggcaagagtcatgtgcgtgtgtgcatgtgtgtgtgtgcgcacatgcgtgtgtgtgcacccatgtgtgtgaagtccaaattcccacaagccctggcctggcccctgcttgcctcttcaacctcagctctcaaaatgctcttttttatctcttgctgctctggtcatgctgaaccctttccatctttttttcagtatctctccttccacccttgctccagttattcacctagggtattctgggttcattggaagcacttattcaaattgcaatgcgatagcgaaatagtcattctggggattctttgctcatggcctccctgcccccatcagacgtgaaggctccatgaaggcaggcagtgcctctgtattttcaccactgtgtatgtgggttttttgtttgtttgtttgtttggttggttggttggttttctttttgagaccaagtcttgctctgttgcccaggctggagtgcagtggcgtgatcttggctcactgcaacctccacctcctgggttcaagcaattctcctgcctcagcctcccgggtagctgggattacaggcgcctgccactacacctggcgaattttttgtatttttagtagagacggtgtttcaccatgctgcccaggctggtctccaactcctggcctcaggtgatccgcccacctcggcctcccaaagtgctgggattacaggcatgagccaccgcacccagccttcaccactgttattcccagcagccagacccgcacctagctcgcggaaggcactcagtaaaggtatggagagtgaatgaatgtatatgatggaagatgtgtgcctgtggatgtcttgggtaggctcagcagtcctgagggctcagggtgggcagcatttgggtcctcattggagcctcagggcaccctccctgctccatctccagaagagtattccctcggggtctcccggaggagtttgccctggtgctgacactactgctgaagaaacacacccaccagaagacgtggtatctgtttcaagtgaccgatgcaaatgggtatccacaggtgaacctcccctgtgccctgattgcctcttagggcattgggtagcaccagtccagcccacctttcatcccggcttgtgacttctggggtctccctgctccatcctgtgcctaccctcaagcctgtccccagcccaccagtacctacctcattctttcaggatgtatagctccttgaccccagccggctttcttctctttctgggcctcagttcccctcctgtgaaatgagttcaaggtccctgaacgtgcccatggtgtgactctggagctctgaatctctgtcctttccctttccaaattctacccagatatccctggaagtcaacagccaagagcggagcctggagctcagggcccagggccaggatggcgactttgtgtcctgcatcttcccagtgccccagctcttcgacttgcgttggcacaagctgatgctgagtgtggctggacgtgtggcctctgtgcacgtggactgcagctcagcctcctcccagcctctggggccccgacgacccatgaggcctgtgggccatgtatttctaggcttggatgctgagcagggcaagcctgtctcggtgagtgctaggtcaggccctgacctctgttcctgccttctgggaacctgagtgggcttcctggaatccgtatcggaacaagtccttctcctgcttagaatcttcccctgctttcctgttgccctccaaatgcagcctaaacatattcacctggcattcaaggcccttcatgatctggtccttataagtgtctgcagcaccatcttcctttacatctctccgtgcagctctgctctgatcaattccatcctagccatccagcgcacccagtgctttcacactgccgtgcctttgcctacgctgttacctccacctggaatgcctttccttgcatactcatccgctgagtagctaccagcccttcaaagcccagcatgaatggaacctcctcctcttttgttcctctgggcctcctctccctcgttcctgtgtgcgcagttttgttctgcctttggtgacaactctatttttgatgtctcccaggccagactggaaacaccctgaggtcacatcctggggcagagacatctctgtgcctcctggggggccaggacacagagctatttgataaaatgaagtgaaattgatgtgtgtgtctcctgcagtttgaccttcagcaggtgcacatctactgtgacccggagctcgtgctggaggagggctgctgtgagattttaccagcaggggtgagtggcccggcccttgggctgcccagggacacactgtgctggagatgagggtctggaaggtgatgcctggaggtcttaggaggagtctgctcctgtactgaccctagccccgctcttccaccaaacagtgccccccagagacctccaaggcccgccgggacacccagagcaatgagctcattgagatcaatccacagtctgaaggcaaggtctacacccgctgcttctgcctggaggagcctcaaaacagcgaggtgggtgggcaggacaggtggatgccagcacaggcaggcacaagtgagatacccctcccctgagctgactgacgtctgccaccagggtcagttggccatgggcccagggcaggaggggcactggaagccctccctatttgtacgccacccctaaatgattcagggaggcagagacagcccactggccaccactgggtggccctgtgcccacctacctatgggtgttgagagtggtaccatctagctctggcactgcctagaccctcacggatgccatccagactcttctgatgagggcaggaccaggcttgtccctcaaagccagtttctccagaacagagatacctgggatcagaggtcaggtcatactgcttccccccagggatggctcactctcctgggcccagcgccggccagggccagactggttttacacccagcaccatggccagctgtctgcccactctcaggttctttagaggtggcatggaagcctggttcctcctttagccccaccccctggctgggcactctccctgcccgctcgggcatcttgcccagccttgggctgcaggaacacaggatcccattgatgcatggtcttgttggctctgacatcacatgggtgggtggggggggaaggagggggacctgttggggcagccacaggggcctgagcaggcccttgatgccccaggaggtgccagatgccaggctgaaggattacctggggcccatgccccctgcctgggtgcccctttccagcctggaccccagaacttccccctcctcaagggtttctctttgctctgtctgcccaggtggatgcccagctgacgggaagaatcagccagaaggcagaaaggggagcaaaggtagaggtgggggtggggggaggagcctacctgccctcagtctgccctctgtgcccctgtaaaccccagggataaggtgctccactcccactctcctcccgcctttcccacctcctggacagagcttaggacatgtaggtgccagctctgatcaagaaggacggatgggggtgagacagacgcagtgcctggcactctctagagtgcccactcctgttggtttgggggtaggggtgttggaaacagtgctcggccccctgagctccctgcccattcccacaccccccaccctttcctcaggtccatcaggagacagcagccgatgaggtaagcctcccagtggactggcagcaggggaggtgccagcatgaaccctttgcaccaggctttgggcacggatcctcagcataggggtgctggctgactacacagctcctggcattccttgagggcctgatgctgggccctgtctgtccactgcctctcgttgggttggggggtaggtagccctggaggacactcctgctgagttggcagcaaatggccacgggcatcatggggagagcccagccttcagccacggtgcccttggattctgggccgtactctgccccagcatgctgtgtgacctggggcatattgctattcctctctgggcttcagtttccccatctgaaaaatggctgtggggctgggtgggtgggaaatgaggggtgaggcttgttttataggattcctatcttcaggctcccctcagattccactcaagatatgtgtgatgttctgtgggcctggtggtgatggaggtggggagggctcaccccaggggctcagaattgacctcttcgcctgctcttccctttcagtgtccgccctgtgtccatggtgcccgggacagcaatgtgagtgaatggagggtgtgcagggtggagcgggcaagagccgggagtggacgttgcctagagctggcttggcagcctcctgggtgaggacaagggggtctttgtacactttcacactcgctccctgcccatctcccagagccgggcttaacccccactgccatctccaccaagccaggactgtgtggaagaaagcctgtgacctgccttgtcatctgcagtgtgttcgggttcagggcatgggcacgggatggtggccggcaggaccagcgccttggttgctgatcgcagctttgcactccctgcaagttctccccctgccctggtggaggcttccttcattctcctggaggcctagagaaggggaagagctggctcagcacggcaagggctcccacagcgttggttcagggcctgctgtctctttctagctggccctggtccagccttcctatgggggtccagaagggcaaggagaggggctcagtgtgagcccagctggcacccaactgtgcctcttccataggcagcatgagtcaccatttttctggggcctaacattctgagttgacctgccacattggtccaccaagggcacaaccccagctcccctcagctctaagccccctgactttgggggacatcaggagtacctcctaggctccctgctccctctttcaatccagtcccccaccaaatctgttaagactgatggtccccagatgtgcagaggttaccatggaaaccaagcagccatgttatcccagcaactgggaggcggagctaaccaaagccaggcagtttagaggaggtaggttagaccctctgcaaatgttacaggctgaggaaatggaatcggcttgctagtttgcctgggaagcagagcaggggctgggatacaggctgctggtcctgctaccatgctgtgtgaccctgtctaaattgcttgacttctctgggcccctggttttctctctctaccggaagtgtgatgccctctcctctgtcccctcaggtcacacttgctccctctggccccaaggtgagtcctaatggagaacgggacattcccgtcctctttagcatccccagccattcccacagcatgtgaccctgtggctgtgtgtttctatcagggccacctgagcctgtatgtgtgtagggtgattaagtgtatgcgtggtaaagaaagcaggggtttgtgtgtgtgcaaagatgctaagagctgcccttttctgaggcccttctgtgcaccaggccttaggccacacctatgcacacttattacccttttgaaccctctcaatagtcagcctgcagggtgggtgctatcattttacttcaggggaaactgaggcccagctgtgcccacatatgtctgacagggtgtgttagaatgattatgtgtgggtgtggctacatgcatctctgggacacatgtttgcatatgtgtggcacacgaaggctggagttgaacccatatacctgtgggcctaacgaggctgcagagcttgtgagtgatggggagcgaagctatgcaactgtgagttgtgcttgtgtgtgctcgtcaataccgttttattgatgaagaaactgaggctcagaaaggcgacatgacctgctctgagtgacatgctagcaagtacaggatttgaagtcaggcagcctgacactcagccagcatgggtttctgccaccgtgcatgtgtgtgtccatatgcctccggctgtgctgtgtgtgagctgatgtgcttgggtacgggtgtgggggatgggatacccccctgcttgagactgtagatttgccaaatatagcatcttggggtgggagggcatgtggatgaacaggtgtggaatccatatgcttgtgtgtggtggggggaggcgtggggcaggacactgctcacatgtgtgcgtatttgcgtacccgtgtgtggggggatgggtggagggggccagaagtggggagagctttctcaaggctcccatgtgccccctctggtcctatcttccattctggtttcactctcagggagggaaaggtgagcggggcctgcctggtccaccaggctccaagggagagaagggagcacgggtaagtgtcccagccctgcccgtggcaggacctttgccagctgtgccctggggtgaggtgggatgtgagccatcatcccatcatcccggcagaaagcctgcagcttggcccagatcacgggaggggggtgagggccagggtctttctaggggtttgggtgtagaagccccccttttctagggatacttaggactatggggttcccgggccgatcctcctcacaacacatctaggggacttccccaggagttcccacccctgatcccttgttccctactcccagggcaatgactgtgttcgaatctccccggatgccccacttcaggtaagacttggaggtgatgcctgcttcagggccaatatggggccagcccctggggagggactgtgcgcttggcagcccatcaggtgaccctctgcccctctcaacactgtgttcccctgttcagtgtgcagaaggcccgaagggagagaagggggagtcaggagctctggtgagtgtgggaccagggatagggcagggatggtgggtccagggcccagccttaccctcccttcctctgtctcccttcctcatctcagggaccctcaggactcccaggctcaacaggcgagaaggtaacaagcctggatttggaggggggatttccagggaggtctgcaggctctacagccatgaggaaggaggagtcggggttctctgaggagagggtgtcagtgggcacagagctggcaggaccctccctcccccatctcccccaccccagtcaccctgcctcgtccaaatacccagccgacctagagggaaatgccacagattcccccagtaagtggcctggctggtttggaagttctacctgttgtctggtctgttgtctaccctcccgtggtgattgaagccattcaccctcaggggagacagagaccaggggtctagaaggcagttgtccctccaccagatggagctgcccagctgtcccaggcccttccctcatcctggtcactctgcttcttccttccccagggccagaaaggcgagaagggcgacggaggcatcaagggcgtgccgggaaagccaggccgggacgtaggtgcctgggacccttccccaccacaacccacagcacggggtctgagaatgctgggatttaaccttcgggaatccagccccctccccttgctcagacagggtggggaggggctgtgccacaggaggcacagcaagaaggggacagaaaaggacctgagcccaggccccctcactcccagcctcagagccccgaacctctaacaccataaggttgacatgtgctgaccttggggcaccagggtgggctctggtttgggggaggggcagggagggtgggacaggtgggcattcacctctcccagtggggcggtgccaggcctcagggctgtttgtacaccctcccccttatccccccacagggccggccaggagagatctgtgtcattgggcccaaagggcagaaggtgagttgtggatgtttgtggggtggagatggggtggcagggctggggtggcagctctctgatgcccaccttatgtctgtgccagggagaccctggctttgttgggcctgaggggctggcaggagagcctgggccccccggcctccctggaccccctgggataggactgcctgggaccccggtgagtacccccttgcttctcctgctgtgcttttctcagagaccgctctcccaccctggccagggaatgaacggggggaagataaggctctgtcccagggatcctggctggaggagagggtgagggtagaagatctcgctgtagcgagtggtccctggaaacttccacgtgactctgtttctgccctcagggggatccaggtggcccaccaggccccaagggagacaaggtgagcataggtgggagtgtggtcacgtggggagctccatgcttgacaggaggagagagaaggggccggggcagcttcccacaggggaagcaagtcccagggaggaggccgggcctttggaggaggaggctgggctcggcttggccaggccccttggcggggagcgtcctgtccccatcccagtgctcactgagctgctcactgcaacctccgcctgtgttccaggtatagggatgggcagacctaagtgttgtaaagatcaaagtggactttgctggagggcccaagctcattttagagccttgtgcctggatgtgcagaaagctctggaaatttctgtctgtgactgctggggtcacgcggatcacctcttaacctgtgcaccagtgaaggggcacacagaagcttcattttctcccttcctttgaaacctagaatggcttgggttagacacggagggcaggcaacaggaaccgaccgaatggaacaaatggcaacaagagatttggcaacgattgttctgccatcacagaggggcacgggtggggaagggggaacgcaccgagattgcattggccagaaggctccccgcttatcctttcttctgaccacagggcagctcggggatcccaggaaaggaaggccctggtgggaaacctgtgagtgacaccaatccagcgggggagggtcggctcttccaaggcctctggagggaggggctaggtcctccggccctcagttggcacaccagccctctgccctggcactgatgcccattgcctcttttctaacaggggaagccaggtgtgaagggagagaaggtgagtcctaggcctggctgcccagatcggggtgggaacgggaccccctttctgcacatgacagtgagcatcaagggccctaggcctaggggtgctggaccttcctcaggggacccccacccgttcttcctctgatgtccatgtgcagtgagtacataaagaacctggcttaggggtgagctgggttcaaactctgcctccaccacacacatggttatgaatgtgccagatcaattagcttctctcttagcccaagtttccatgtctgtcagtggggcacagtcatgttttaaggcttacggcgaggatgtagttttgcgccaccctggaatcttgtggtgaatgaatgagtcagttgaacaggaagccccagcggcattcctgctgtccactttgatgttgggggtggggctctggtggacccaatgtctagggctggtctgcgcaagaggccccttgccttccctggggtctcagccccaccctgtccacatactgcctctcccttctgctagggtgacccctgtgaagtgtgcccaacactgcctgaagggttccagaactttgttggacttcctggaaagccagggcccaaaggggagcctggtgatcctgtaccagccagggtgagtgcccagggtgaccattgagggacctcccccaacacacaaagaaacctggggacatgatcatagagaggaattgggcagaggggctgggtacttctcgtggctacagagagattatgggcagagagtctaggctcttactgtggtaaggggtctgaaccatagaactcagggctgggctagagtgccacctccggtctccatggcaacctcccagggctttccaggagactctagggtgccttttgggcaagctgggctggagcccacccttactgtgagtgaggctgtgtcctaggattgggtatgttttgggggtggaggaaaggagtgagcaggactgggttagccccctctctcacagaccccctctttcaggagcacctgggagctgtcagacaaaaaggtgattgggtatatgcaggaacttcccactgggttagcttaacctggcgtcattccccccgccacgctcctgcttgttatgtgggttgatgaaccctgcctctggggtgctggccttggaccccatgggacccctaggtgtttggacggtttgcgtgtgtgacattgctgtcctcgcatattgccagggagtttgggggtgccccatcgtgccctgcctcagcccacaaacctttttaccctgcagggagaccctggcatccaaggcatcaaaggagagaaggtgagggaaccctgctctcctggctgccctcctctgcctacctggaagcatttctgatccttcctcttctttccccagggggagccctgcttgtcctgcagctcggttgtaggggcccagcatcttgtgtcctccacaggggccagtggagatgtgggttcccctggctttggtctgcctggccttccggtgagtgacgactttctcccagcccagcccagttcagccatccttgccatactgttgatctccctggcttttcagatcccaagtctcagggcagggatcaggagggaggggaagaggcaggtgtcccaggcctgtctcctggtccctccctccgtccctgtgctgccccaggctccttgccctggaacttcctcttagcacctctagcttcagttgtctaactgaagaaactgtccagctacctgaaggacataattcctatcttaccgttctgtttctggttggacactgggacccggggagccttggagaggtgggagtggggagatgctgagactctgtcttggttgtttttcagggtagagctggggttccagggctgaaaggagagaaggtgagacctgggttagatgtcagggacactggagtttcttggcaggcaggcaggggaggagtggtgcgggcggggaataagggtaatataaacaagagattcagacggtaaattcacagtgaaattaatttactagtgttttgcagacttgagtcaaagaatttatttctgagagccctcatgttctgtaagagaattccttagtgtagctgtgatgatattctaaaactattaagcacattcaagattaccttattatatttataatatgtaacacttctttattgcttatgatgtgccgggcactattccaaatcttgtaagtatattcacttgttttgtcctcccagagtttatggggtatgtgctccattattcccatttcacagatgaggaaacggaggcacacaaaggccaagtaaattgccaggtgattggatgcagagctgggattgagcccaggaagcctggctccagagactgtaatcttcactacgcctgtgggtcactcaatttcagtgcctgtgttaacgtatctatttatgattgcattggagacaaatggcaggcttgaacttctaatgcagtgttacccaaatgttacccaaattctgtgggtgtacgagtgctcaagtgtgagaaacactgaagtatgtgtgcagactcaaccctaacaggggaagcccacatgtcacatcacatgtggggcctttgcacccccaccccacctgccgcctcttcccagcttccccatctcagtcatcagctcacagccagcccctcaaagcccagccttgcggtcgtcctcagatccttcactcctgacgctgccccctccctctagccccccagcgagtcctgacagttctgcccatgatggctctctcaccccctccacttctctccacgcccaccactgccatagtaatctgcgtccccatggcctctctcctgcatggtggaacctcctctggcctgcccgtggccactgtagccctgcagcagtccggttttcacctggtagtttttcgtgtgtgtgtgtgtgtgtgtgtctgtgcgttgttggtttttttttttttttttttgagactgagtctcactctgttgcccaggctggagtgcagtggtgtgatctctgctcactgcaacctccacctcccaggttcaagtgattctcctgcctcagcctcccaattagctgggattacaggcgtgcaccaccacactcagctaatttttgtagttttagtagagacggggttttgccatgttggccaggctggtctcaaattcctgacctcaagcgatctaccctccttggcctcccaaaatgctgggattacaggcgtgagccatcgtgcccagccttcacccggtagtttaatgtggctttgtagaagaatcagtatttccctccttagagtccctctgtgacttactttctaacatagctccactgtatctcacaggaccccggatgccccagcccccatccttcccaaattcatccgcttcttccccttctcttcgggtttactctgctttagccgtgcggatcttctttccattatggaatatgtccggactactcccacccgtcagattttgtacttgtggttcccactagaagcatccagaatgtttttcctctctaccctcccccattctttcattggatgaccttattctcattcttctggtaataatcagggttaacacctctctgaccacctccacttactctgtctcatcaccttgttgatttccttcatagtactcaccactgtttaaaatgatgatttagaaagttctgcgtgtgcaagctcaacaggcattgctgtttgtcctgctcactgctgtctacccagtgcctcagcccagtgctccgcctgtaaaggtgtccaatgaaaggctgttggaaaaatgccttcgtgatttttgtgtgctgagacatggctgagggtgggctggattccatgaggtgaagctgggggcagaaatagggcttctagcccctggctggttacagactcccttggggaccttggagaaagccctcttcctctctggacatgagagggtagtctggacatctgaaggggttgcttttacagttttgggtttgggattgctctagcacccagactccatcccctctttaatcatggtttctgtgctttctctcagggtaacttcggggaggcagggccagctggcagtccagtaagtatgttttggatggcaacagcttgggagaggacaaggtgggaggggctgataggcatggccctggcagatgctgggcattacctgtagcgtcttaacatgcaggggccaccaggaccagtggggccagcaggcatcaaaggggcgaaggtgagtctggggacattctccgtgctgcagcctgggtgagcttcctagatagacactcgtcttgctcgacttcgaaccctctggggctccttgctgtctgtcgggcagagtctgactccttagcaaggcatggagacccctgatgactcagctccacctttgtttctttcctgttctcccttcatctttcccaagataacccctcacccagcagaggtgcagtgtcagacccagtgacattccccagccctagattccaaacctcgctcaagtgcactagggcctgggggaccccctaactcaatgtccttgcttggcagggggagccctgtgagccgtgcccagccctgtccaaccttcaggatggggatgtccgtgtggtggccttgcctggcccatccggagagaagggggaacctgggcctccaggctttggcttgccaggaaaacaggtgaggtgggatataggcaggggcctctggacgggggatgcaggcggggctaaggagaggggaggggtcctgcctgggtctcttgactccctgggcagttgggggtagtggggagggtgtggcggggtcagagcctctgtctccagcaggagcggccctcacaggtctctgccctttatcctgggacagagtatggcagagtgggcagaaagcacgccatcctaggagcagagagacctgggttccaatcttagctttgcttcttactaagtctttgacttgagcaagtcaccttctctccacctctgtttcctgcacagagtaaagcctagtaatggcgtgtgtgaagtgcttagtggtacaccatgggcactggggaaatggcagttaccactgtggttattatcactgttactgctttcacagtaacggccagcactaccacagtggacactatgtgccaggcactgctgcacacgacatattagcttgtctaacctcacaggatccctacagggcagaagcctatactatttttatcatccccatttgacagctgaagaaactgaggtacggagatagatgagctaatttgctcatgtcacccaggcaaagagtctggcacaaatctttgctctgcacctgggcaagattgcttcactagcacgaaagcagagattttgtttgtttgtttactgttgtatgccccagcctgatgtggtgccgggcactttggggtggctggtatgagtgagcgggtgctggaaatgctttctcctcagggcaaggctggagagcgtggactgaaggggcagaaggtgagagggcgtccgtgggcacgggggtgggcatggcatcatctcagatcccctccttgcctcattttcctccctccctagcccccaaccctcagccccggcaaaggagtgtgagtgcctgcgagtcccaggggggcaacctgcccccggctgggccatccttgctttccttgaaccccactccttacagggtgatgctgggaatcctggagaccctggaacgccgggcaccacagggcggccaggactgtcaggagagcctggagttcagggccccgcggggccaaaaggagaaaaggttagtcaggcggggtggttggggtcggggagtttgttgcataaaaaaaatcaggtgtcgcaccagtgagggaaggactgcagggccagctggggccttaacggctgtcagagtcactgagcggaggctcctcggggcttctcctctgctaggagtgtcaggggcctgttttgatttcccaggctgacgtgggagcattcaaggggcagagtgttcagaggggtgcagggcgtcctggcctgggtgccagccccggctcatgggctcctggctgtacccatctctgaccagggtgatggctgcactgcctgccccagcctgcaggggacagtgacagacatggcaggacggcctgggcagcccggccccaaaggagagcagggccccgaaggcgtgggccgacctggtaaacccgtgagttgcctgccctccggcccttccctgcctgggctttgcctcctctccctcctgtccccctttctcctgtggggactccatgggccaccttatgccttttagggccaacccggtctaccaggagttcaagggcccccaggactgaagggcgtgcaggtatgtgtgagtcttggggccctgggccgtagctacgtgagggcaggggtgggatagggagatccatgggggcagtgggcctggagtgggaaatggaggcagggtgcagggcaggaagaagctggaggagaaggggctggggagaaggggaaagggtgactggggaacctcgagccagggactgtccttctgcctcttcagggagagccagggcctccaggaaggggagtccagggaccccaggtgagtctctagccctgcctttgcctgtcctctcagcacttccattagccagctacctacttccatccactcccaaacttcagggctctgcctgcccccagaggcacaggacttagttctgggaccagggatcaggccgcagccctggcctgctgttgcttctgtcagggacttgcctttgaccccagcctctctgaccctcagggtctccttggggagctcttctgaatttgggctggcagataccccacccagaccaggtctgccggtgcggcagggccagtggggcaggttggctgtggctgctgtgccctagtctgccctttctgacttgcagggggagcctggagccccgggtttgcctggcattcaggtacgtctgcctgagtcctgaaggaggatagcaggggagggggccattctaggatatgggttaactaactgtgcttccatctgcagggacttccgggacctcggggaccacctggccccactggagagaagggtgcccaggtgagcctctgcctccatgggtattgggcctgcagtattccagagtgtcccagaagcaggcacaggggacatgggggccaagtgatgcctatcagagggctgcctaagatctgttgagatgtgtcttacctgctgggttgtagctggcttccaattctgcccctgagacctttgtaccttctcttacacagggatctccaggggtgaaaggagccaccggacctgtgggacctcctggggccagtgtctctgggcctccggtaagtcttctctgtgctccatgctggtggtgttgctggaaccaaggatgtttctgctgggaagagggcacagggctgaccctgcccatcccagcagcacaggggatgggaggagagaggcctcagcccagcctcagacaaggaaaacctcactcttttaggggaatgcttgaataatacaataatgatcaccaccattttttgagcagtgatcatgctgaggccctgtgctaagctctaaacacagaaattcatgtcatcctcacatcagccctgtaagggaactcacttcatagatcaggaagttgaaggccagagggtgaggaggcagagccagggacttcaacctaggcctgtctgactcaaaccaaagcccatccccagtcattagggacatgtgaaccggtgctgcccagtacaactgtctatgaggatggaaacgctgtgttctgcacaaccacaggtggctgttgagtgcacctgaaatgtggctagtgtgactgaggaactcaattttaagtgacatttaattttaattaatttaaatttaaatagccccatgtggctatggactactgtatcagacggcacagatccagaccagcaactacttccagtataattggaaagaccttccctttgtactattcacccagtggctcccacgttttaagagacatgtctattgaacaaattgcacggattaagtaatcataagtgcattttctcatttttaatcatcaaagacctgtatagtcgtcagcttctactccacatgaacccgctagaattttaccagataatctaattgcagccaaaatcaaaggcatgctacctttcagccagtctgttccatgccaggcggtgggcaaatgcgtaatttgtcttgggcttttggtaatgttaaaaatagcccaggtgaactgtatcctcttctgtctttgcggatccctggagaaattctagttccagtttgggattcactgataggagagtgcaccaacgtccaaagcaggcagggactcgcccaagcccacacagccggtctctattgtccctcagagctggacagccagggttcctgcctgtcccagggagccccaggcaaaaggagagatgtgggccaggtcctcaggggcttcaagtcccacgtgtgaaggtggcggagcccacatgaaggagctatgagcacagagctacgagcctctgcgtggccaggctggcttctcctggcctgagcagactccatgccgttgcccaaactgctttccttttcaggagaacgttccagacctctactcatgctgaattccatccagcaggcttcccttcctcagccccacactcgctaggggcgtgaccctaggcaagtgacagcttctcaaagtctccaatttcttggaggggctgaaatccctttctcccagttaggtcaacagatgtaacttttgtgatagggagaaagtgtatcaagcactaaagggagagaggagagagcagagacttcaggctacacacgcctggctgcagctggctgttgggtctgtcatgaagtttcttcagggctcagtttccacacctgaaaaccagaacaataccgtcctgccgggctgggagagcggattccattcagtgttccccgacgggtacttggcccagtggctggcactgagacgtgctcaggaaatgccagtcttcttccttgtccggcacctcagtctcctcctctggaacgtgggccctcggccctgggctccaggggaacctggcgctgcttctgtttgtcctacaccccttttctgcagcaggccagatggctggccgctgcccagtctcaccctctgactctgggctctctctcttcagggccgtgatgggcagcaaggacagacgggactcagaggaacaccagtgagtacagtgccttggggcagcaggaagccatggccggccctgcctcggcacccctatctgctcaccttcctgtgtttcttccctgcagggtgaaaaaggaccacgaggagagaaggtgagttccaagggcctgtgacccatattctaggggattagcagcccctccagccttcccacctgtgacccgtactctgggggattagcagcccctccagccttcccaccatgaaccaggggagcctgtgcacatgaagctgccttggactggaggatgggggtggaggaggcatcctgggctccttgctacccccagctttctggtttcaggggctccacgtatccccagcttcacctggttgctggcctgggactcaaccaggattatgggagactggaaaactccaaggcccccttaggagggcagctgcattttcaaatgggggctgagtcagaggatggggcaggaagtgagctggaaaggactagtggtgagagggcagagaggtgaggggctcccgagcgaagggcatggaagccaggctgggcccagaggagtggggctgcagttgtactgaaagcgagattacctgcgtggcagcagagaaggttataactgacgactgtaacagcaggaccatcgtttgctgaataatcaccatgcgacaggacccctgcatacacgaatccattttgtcctcctgagactccatgcgcttggaattattgttcccattttacaggcgaggaggctgaggtgcagagagtttgaacaggttgcctaagggcacattagaagaggcagatcctggattgaaaccctggcctctccatctctagagcccacgtgcctctcggatgtccatttcaagagagcccttcgtcttcatccatgtctcacaaaggctcttgtattttcagggtgagccaggggagtgctcctgcccctctcaaggagacctcatcttctctggcatgccggtaagtggcgctgtgagagccttcccccaactgggggagaggaccagcttcagcctcgtctggtgcccagtgtgcaaaggccccgcagggccacgcaccccagccagccgcctccccacgcagccccgcgcttggtgtagacgttgcctataacctctccccttcttttgcgacccccactcccacccagggtgctccgggactttggatgggcagctcctggcagccgggcccgcaggtgtgtcgcttgtctcctcttgtccgccagcgccccgcggcttgtccaccctaaacagctgctctcggccatggggcagagctctctgctggctctgactcttttctctctccctcagggtccaccaggtattcccggaccaccaggcccccctggagtacctgggctgcaggtaaagggggagaagagaatgaggagcttgggtggcagagctcatgggtcaggatggctgctcccggctggaccccaaggatgctgctcccccaccccaaaaacacagacatgccatttctcactcctctgtttacctgcctcccagggtggcaaggagggcccactgagcctctaggccaggctctgcactcccagcactgtttcaagcaatgcactgttgcgtcagctgtcaggcacccacaatctgggtcagataaaaatcccttaccctggtacagagcccggcccactgttttggagtagcattcaacactcattcatgcaacatgtgtttttgcacatttgctattttctggcactgctttaactgctgtgaatacagtagtggctaaaaataaaagtccctgccctcttggagcttatattctagtaagagagacagacaataagcaagataaataaataaaatatagtgtgttagaaagtgatacatactaaggagaatggtaaagcagggagtgagtatagaaaatgggatgagggcaggagaagtatttgcaaaatgtactgaaaagaaggtgatgtttgaatcaaaacttaaaagagatgagaagctgtgagggatagcctttgtggcagagaaaacagccggtgcaaaggcccagaggtgggatgtgtttggggaattgcaaggaagccagagatagtgagggaagagcattaggagccaagatctgtgtgacactgtgaataaagggtacattccagaggcaggcagcctgaacttgaatcccggctctgccatgtgctagctgtgtgacggtaggcaagttccttaacctctctgtgtctcactgccctcttctgctaagtgcgcctaactcatagggcttttgtgagtattaaacaagttaatgcatgtgaagggtatagaattgtacccatgactattatatattatttatgtgacaaatgcttagaaggcattagctatcattattatgatgatgagtactattattattttacgtccattcttttattcatttgagccttacataaaagccccaaaaggaaggcagtattattattcctaagtcacagctggacaagctgaggctctgagcgatggagtatcttgtctaaggccgcccgactaggaattgacaatgctagactggggcttccccatgcaaagcactttttaccttcttctgatgcctttcaggacagttcccagtggtttgcctagcaagccacgttttccagaggttctaggtggcatagacaccactgtccgtgtgtctggctcccagctcctaagagagtgattctcacctgaagaagcagggcagcatcacatggaagctttttacaagctactcctccttgccccaatgatttgatagattttgtatcttccctccccacccccgccaccctggcacacctcccctgccaccgtgggctgggagtctgctctagtgagccactgttgccgatgggagtctctgccaggatcccaattctctctaccctattggaagtgctgaactagagcccacgccacatatttgcagccacacatttgccgagtgtctggggcttttggggcttcctgccacactgccaggaaacaggaatctgtctgcagagggcttgcagtttgcttggggaagtgtaagagtcatttcaaagtgacccattaataagcgagagctgatgtagtgtaaaccctgccaagacatgctggggaatgaggcagaaaagagtgactgctgagtctggtcccaggcaccagagtccttacctagtgccagtgcttgagaccaagccgaggctgctgctcacaggtacctgccccatgccaggtgggatgcaggagggccaagcagctcctttattcaggtatagaaacaggctcagggatgtacagcacttactcatccaaggctgtattgtcccagtgcttagttatctcatttcatctcagtccattccacagaggaggaagctgaggcactgaggttaagaaagatgcctgaggcaactagtaggtcattgagcccagctttcaattctggctgcacttcgcttccgcagtaggacaacaggtagaacatttagttctgagaggtcaggaaaacaattacaaagtatcaggcttgaactatcacactggccctggagaggggagcaagggatgaataatgatttaaggcataataattaacatgttcgggccaggcgtggtggctcacgcctgtaatcccagcactttgggaggccaaggtcggcagatcacttgaggtcaggagttcgagaccagcctggccagcatggcgaaaccccgtctctactaaaaatacaaaaagaattaaccgggttttgtggtgcatgcctgtaatcccagctactcaggaggctgaggcaggagaatcgcttgaacccaggaagcggaggtttcgatgagctgagattgcaccactgcactccagcctgggcgacagagtgatacatctcaaaaataataataataataataaataaaaaataataattgacatgttcaaggcattttccctgtgccaggcactgctctaagccctgatggtgcacagaggtgccagggggcctggatggtggctggctccgggtctgacccaggcctggtagagcctgcctggaaattgctcgggggctggtgatatgttccattgctgggagctgggacttgaaggaaggccagatctcagagtgcgccaaggaaatcctgtgcagggaggagcaggctgagcagcggtgcattcactcaacacgtacttactgcacatctcctccatgttgggtgctggggattcaaaatggaacatactccctgcctccatggagtatttaatatgcaaatgtgcctcacgaatctgcaaggggaacattgtccgggtggcatggatttaatgtaaacatcgttgcagccattgtctccttgaagcctcaccataaactatccctgttttatagataaggcaactgaggcatagaatttttttcccccaaataaattgccaaaagttatacaggtagtcagaattttgtatctagatgaatctgactggcaagtacccacccttgctgtgtacatgaatgttctggggatgtctgttgaggaatgatgctagaattgtggttaagagaggggttagaagccagtgatccttgctctggacctcagctctgtgccttgctcaacttgtgacctttggcaagttacttactcctctgggttcttttttttttttttttttgagacggagtctccctctgttgcctagactaaagtgtagtggcgtaatcttggctcactgcaacctccatctcccaggttcaagtgattctcctgtctcagcctcccgtgtatctgggaccacaggcacacaccaccatgccctgctaacttttatatttttagaagagacggggtttcgccatgttggccaggctggtctcgaattcccggcctcaggtgatccgcccacctcggcctcccaaagtgctacgattgcaggtgtgagtgaccgtgcccagcctcctctgggttctttgtgctatttttaagatggagataacagcacctagttcaacaagatagctgtgatgattaaacgagaaaataggctgggtgtggtggttcacgcctataatttcaacattttgagaggctgagcggggaggatcacttaagcccagaagtttgagaccagcctaccagcgagacctggtctctataataaacacaaaagaattagccaggcatggtggtgagcgcctctagtcccagctactcaggaggctgaggtgggagaatcgcttgagctgagtttgaggctacagtgagctataattatgccattgcactccagcctgggtgacagagtgagaccccgtctctacaaagaaaaaaagaaaaaagaaaaggaaaggaaaaagaaagagagaaaatatagaaaaacgacttagcacagaaataaacagtagttccatggaagaccctctgctcaatttctgaccttccctctgatgtggggggaaaacacttgctgttggacggtttggggggtcgctcttctgggcctccctggctttccctataagggtcgagaggcttttgagctaagaatagatgtcagccttgtgccagccagggctctcagctctgcaggacaaggggaagaggaggcggggatgatgagaaggaaacaggctgaccagcaggctagagagatggagcccactcactcgtgtctcttcttggctacagggagtgcctggaaacaacggtttgccaggacagcctgggctcactgcagaactggtgggtactggccaggactccctgtgcatgccccttccctgcccttcccagggctgctcaggctatgaagctggcccggtagctgcagtgggggtccctcttctctcccacttctgaggctggaaggtgcatgacgtgtcccaaggctctccctgatcccataagtctccatgttccttcccctcacctgcttgagcccacacatctgtctcttgcagggatccttaccaattgaacagcacctccttaaggtaagagggtacccaggagggaagtgtgagctggcgggggtgtctcctaaggggattctcttagtaagtgctcagctgtgtggcacctcgcagagagagcagcagtttgcagggaatacgcattccaagcatctgtctaagagggcctagctgatgcctggcttgtaacaggcccccaggcaacatttgctgaatgagtgcttaaaggaatcctgtgaaggtgcccacatggcagatgctgtcggcagaacccagccctgaagcctgcccgcagcagctggcaatgagaccccgtagcacccgggtcaccctgcggcagagcccagcagcttccaaagcaaagcagagggggtgaaagtgcagtggtggggggctgtgagattgggtgtggcctggaagaaagcttcagctgttctctagtcaatccagaaagaatccagggaggagatggatttgagaagcacttctggtagtctaagaaaggggacttcggacctggtcagagggtcggcctgtgccagggcctgtacacagccttaatgctctaccagagggctgtggcctgggccggcttcccaaactgagcagaagttcctattggaatcaagagtcacatagcccatctttgcttagtcacctctagaaacgagagcacagtaattccccaggttgccttcaggtttttgaaggaggcccttatgttcctggactttctctcctctagcccagcatcctcaggggtctttcccatgtgttggcctccagagccccccctcatcctggccaccctcttctgacactggctaattagtgccctggacatcccatgaccccgatgggccttggtcagggcagagcatgggggctgtctaccccttccctgctctgaacggcagatttctccagaagcagccagaggaggtcggggtaacctcttggcatcagttacatgttggatcacagtgaggttgtggcaacgaaacccccagctcttctcccctctgcttctgtcaatgactgggcagtgatcgtgtgactccaaatccaggatttgacatttctcctgtaacatttcatctgttggcttcttcatcaagtgctcttcagaggattccaaatagaaagtgcgcatagtgtggagaaggggtcagatggcaccccggggcatgctgacccagagccccagccaccacctgcacccatagtccaggaagcctggggagagagcactggctgtggcctaggacaggcccacgccaatccaggctcccactttccttagacaagtcacgccgcctctcttgagtgggctttcccatctccacaatgcttataagattccctgtctcactgcgccgtcaagatggcatgtgataatgtgcagggcttattatgtacaatgcccagcgtcatgggtgctgagtaaatgccagtcgttattactgggcttggtggtgagcagtgaaagtgagcaggggctcctgcctgggcatctgtggacacgacactggccacaaacaggctccgggctcctgagtcctcagaaattgcaggctggttttcactagtgggtttgatttttctgagaaaaggacccatagcttccatcaaactctcagaggggtctgtgacccaaagaaggttaaagcccttcctgtggggaagacaattctggtggcgcgatccgagccaggagcctgtgagcaatctgagatctgtcccaggggctcctgggaagggcctggctcctcccgcagctgttcctttgctcccttgggcagagaagctggcgttcggagccagcctttccagcctcactcctcgtggcttgtcctcgcagtgggtgcaggttgcaggaacagccgggacagatggtccctctgcgggcccctcgcctccacccacatgcctgtctggaaagtggctttggcttagctgtaccagagcttcttcctggaggaaactcaaagccaattgttgggagtgggtcccccgaggatggagcaaagctgccgcagggatgcggctggggagggagggagtgtgggaggagggaagacggcagggcagggagccctggctctgggttctcactggggctccccagttggcccatcctgcccatctctaacccaggccccactcctctccccactccctgatcagagtatctgcggggactgtgtccaggggcagagggcccacccagggtacctcgtggagaagggagagaagggagaccagggcatccctggtgtgccaggcctcgacaactgcgcccaggtaagggactgggcttggggctgccctatgcaggagggttccctggctgcctcatcagacaatgtgcctctcattgtcccttgcagtgctttttgtcactggagcgcccaagagccgaggaggcccgggtgagtgcctcgccttatctcccccgatcatgccccatgccccacagggacaggccctgactgctcactatcaccgtctccatccttctccagggtgacaacagtgagggagatcctggctgtgttgggagcccaggcctacctggtcctccgggattgccaggccagagaggagaagaggtaagaccagggatggggattcatcctcaagggagctggggccctgtctgcctttgagacctcttgggggcctccgaggcctcacctgactgatgccctttaccactctgggctcatctgctctcctggcacgtggcttctctgggatacacaggacccagcgtaggacacactctttctccccagtgcccagctgcatcctctgcctgcaacgctcttctccagggcttattcctgcactccttcagctcggctcaaatgtctccttctcagagagacctcccctgaccaccctctttaaaattgaactccacaccaaccccagagcctccagtccccttggcctgcatcatactcatcaccatccaacatcctgcctatttacttcattcaggaacattctacaggtgtcagctcaacaccaactatgtgccagctcctgttctatttgttagtgtccgtctctcccctagaatgtaactgctttgaggcaggggtttttatttattttgtttatgctgtgatcctagcccctggactaatgcctggtacgtaatagttgcttgttaaatgtttgtaggatgaccgaatgggccaaatgaaagattgttcgaacatcagctaagtggtcctgcttggacagcagccaccctctgttgaccttggccctggcaagctgggaggaaggctgctggaatcccaggggctctatggggcctgggcctcttcatccatttcccttggcttcctttgcagggtccgcctggcatgaggggctccccgggtcctccaggccctatcgtaagtatcagtggtgccctggtctgcttgagaagctctcaaaggggtcattacactcagacaccatcccgcggccttgtccccaaaaggctgggcaaggcaggaggagggaacttccactgccctccccatccctccgcagagcatctgcagggactgtgctctcccaccaccggatgccctggaaccgccctgctctgcctactgcctgcggtcctgcttaggggaggtcctcagaggcacctctttgcttccctgtccccaccctctgctgcgctttccacagtggccccaggccgccctcggcagggggcctaggcttcaggctcacagcctcccaaccagggaagcatgcggcatgctggccagacctctccatgcccctgtgactccagtccccacaagggctcggggctaagatggagctgtcctccattgctctgtagggccatctctagggtaaatctacaaaaaccagaccagggtatctactctggagtcctctgtgatgttgacatggcaggaaaatagaagtgactaggaaagattgaaagaactgaaaatgctttctctggagaagaaaatggctggtgggagctgtcttagagccagggagccccccactcgggggacaggtggaggtcgggtggcaggcatggtgggcaaggctgaaagaaatgggcttctgctgcaaccggatcttcagttagactccggaagactcaggaagccctctgactctggagccattccgcatctccgtcaacggaggagccattcttcctggagccaaggggaggaacagttgtcttttgagccaagactttcaaggagtctcttttccagctgccttgaaaatactcccatgacctcctctccccatgacccccaagccccagactgtgccctccaggctgtcccagggttactgtgcctgtgagatgtgacctgcctgtttctcccaccagggccccccaggttttcctggtgctgttggctcccccggattgcctgtaagaacctagcgctgctcgacctcccctcccccccgtcagccaggtctctgtggcttttgcttgtctccctcctgtcgtgccttcacctccgtcctccgtgtttgttgtcccccttcaggcacggtagctaacgacacgggttctctgaggtcccggcagcttggacatcctcccagtctctgactcctttccgttttctcctctccctcctctcctgcgttctttctctcctcttctctctcttaccccgttctgtcttccttctccatttctcgcaccatcttgcagcactcccccaagtcctcctgagctcgtgaaccttcctcttaagctggtgcctctagggggcccctccattcctgccttctcgctctgcctcctgcttctcaccaccttcggcgttgcctgaagatttgctgaaagtagttcttggggccctgccaggcacctggctcagagcccagcagagatgccaaagctttagggcttcacattgcaggctggcacaggtttgctgccctgctgcttggcagggctgtccagaggcacccagggatttaaaggcagcccttcctgcgccttttccgtcgtcctagaggaaactctcagctgcctcctcttcgcttcctcttccttggctccagtcccagtctgctccaaggcggggcatgtgatatcagccagttgggtttctgggtgtcgtgcggccctgcccctctgtgcccggcaccttggccggctccttctgccaggtgtcgttaattgctctgccttcgtcatcgtcacaggtgtgtttacatcacccccagcctcattgttgctccctcctgggtcacggaaactaacctcctgtttgtcaggttttgtgttcctggggcctggctcctctcctcccaggcctggtgatggaggctcagggagcagggcccctcctcgtcacagttccatctgtccccacgtcctcatctgtggccgggccttgtctgtttctgcttgcttgggtgaaggggccatctgtccgtctagccatctgtcttatgtcatggaaaggtttgggcgtcatctcttgaggggatgagggagaagggggcaggaaaggtgcccttaatggcatggcacctgcaaaggctggggtaaggaattaggggtgggggctgtagctctcgtggaaagtgacatgccctctcaccctacaaagtgacagggactgctctggaggcagccttcctgtgtctctcccctgcctccctccaagaaagtgatttttgcttggggtgggggacttggacaggtaagtgttgggtatctgatgatatgatacactttggtggcagcatccatctggggtacctctcctgacagttgcccctcagaataagcacacatctgatccatcaccttcctaaaggtgtacgccagtcagttaccatggcagggcataccagcgacgggcacctgagagataccctcccagagtcacctctgctggagggcatatctctatagttatctatcttgaagggtatcctcctgagaggcacccatatgtggggttcacacctccaccagtcatcctgctggagcacacccattacgggtcaccttctagggacactacgagagccactatggcctccatatttgcctggagtgggaacagaaggcagtggggcagggggaaggagtcaggggctgggtggggaccgccggctcctgcagtttctcatgatttttctctccaagggccttcaaggagagcgaggtctcacgggcctgactggagacaagggggagccggtaagaagaagctggcaggggctggaaagggctggaaagggaggaagagctggggaggcagagcttgagctctgaagggtggctgctgagtggaagctgggaggtggactccttgagactctctgcccttctgccgggattccctcagtgtgaggtttccacactcccccaggagcaaaggaggccgatctccatgtgccctgactccctgccagaagcatgcacagcccctgtcctccagcagcgtccctgggggctcccctccctccctcggctgttgtcactcagcatcccagcccaccccctcttccctggtcctcatgcctgctctgggctccctgctccggctcagctctcagggtctgggccaggctggggttcgcctccccagcccaggtctgtggtggtggtcacgaccgaggggacctggggcttggggagatggcccagtgtgcaatgctggggcaggctggcacctgctagatggcagccccagaggttttagctttggccatcctcttacccagcgaggggagaacagaaatgttggggggctatccatcatgtctgcctttctttgcagggtcctccagggcaaccaggttacccaggtgccacgggccccccaggactgcctgtgagtaaggggacccttgctggggagtgggtgccaggtaccagaggtttgggctggtggtcaggacacagccaggctgggcaaccctcggcgggctccccattaccgggcatttcagcctcctcctttgcctaaagtccatgcagccccctctccccactgtaggcccccttggcagtgtggattggtcccaccactctgctcaggcctgactctcagagcactctgccaggcccagacacagcaagaactgagatctgcctcctgggggtgaggggtttgggagattggagagacagcttagaggtgccacccccacagaagctgctgggtgggtgtgtcctcctttccactgggggcttggggggcacggtggcagatgggaggcacggcagctttggagcacccagcggtcctcccagtgccattcccccagagccagtctgggtgccagctgcagtctccgctcctcgcattagtgccgtgacggactaattctgtggggctaattccactgtctctttgccacttgtcagggcatcaagggggagcgtggctacaccgggtcagcgggagagaaaggagagccggtgagtcccagcggcgtggggctggatgcagggctgcacgtggagccacacagtctcgggctggagacttggcagcagcctgtgaaggggaggatcgtgacccctgctgcccccctgcccccaagcctgcagcacaggctgggtgctgtggaggtggaggctgtgaggagaatccccgcagggctgccaaggggagggtgccaggaggcagccgcagaagcactcctccgcctcctacaaaggaggacctgggattatagacccccagtggaccccagctccccagagccaccctccagagccaaggcctgccaggccccacgttgagcacaggagttgggctgtgaccagatgaggacactggggcccccagagtgacaaagctgagactcacccaggctcctgaagctagtgagtgaggtagtggtggaacctgggcttgaacacacatctatctggtgacaaacctcacaaacctcagatctaggatcagccaaactgggactgcagccttacagattcaccagtttcagtgaggccccagtgggattcagcaaactccatcaggcatttactcagtaatagatatttctcaggggcctgtggggtgccaggctcccctctgaggatgtctccatgaacagagcgcagttgccctcttgccctgccgtgggggagggagctgccagatgaataaacaagtgcctaggaacgatgaggactgggactcatggaggaaatgggacaggggaaggggctggagaggtgtttgggcaccatcgaagcggaggggcaggaaggcctctctgagcaggtggcatatgagctgagagctgactagcaggagggagggatccctgtggctgtctgtactggggaattccagagggagaggctgggtggggcactgcaggaacagcttccagccatcagatgatttggcaagggttcaggggacctaggaaggggggaagggggcattctaggtagaagagaaagctgtgctaagggtgcaaaggcctgggggtgtgagggtatagagtgtgtcagagaacagcagtctgactgagcaaggcggaagatgagaaggagagagggaggagaagtgggaaggggtggctggtgccagatcacaggctgcctcaaagaccagcgttggtggaaagtgtgcgccccactcagaggcagagggagccgcataaggtgtttgagcaagagagtgacataatcagagctatgctggaggagaagagggcagccatttgctggctggcttgcagtgagccaggaggtggcaggacgagttaggaggctggttcagtagctcgggcaagagcagggaagcctgagcagatcaggcagagggggcctgccagcccaggggcctcccagcacatgccacctctgttctgggcagtcccctgtcacatccccctacctcatccttcacctccccaggaggagtgactgattctgttcctttgtatccttagggccccccaggatctgaaggcctcccaggccccccaggcccagcggtgagtgaaggagggcatggggagatgtggtcctggtcttgtcctggggtctgagggcaggaagattaggtttcggctgcattgttctctgtgggtgacagggtcccagaggagagcgaggaccccaaggtaactccggtgagaagggcgaccaggtgagtgacgactgggacctggctgcagggaggcagggaaggagctgggtccctggtgatcaccagctctagtctccccaccctacctgtccttgggttgtgacctacctcatgcccagagcctcacctgccagccatggtgggcagaggggagggcaaagcccatgggtttgagggtgccccccccgtcactctttccacctgggcagccaggcaggagagagggggtggcacagcacactgccccttgcttctcaccctagggatttcaaggccagccaggctttccgggcccaccggtgagtgaagaagacacaaagccagctctgtctgatgtggtctcatcgggaggggcaggcctgaccaggccaggctggggtaggatggtcctggggagaagaggggagaggcaggggagaacggcctgggtggccaggcctgattccaggaaccaggacctggagagcccagcctcttgtgtgggccccagcccagcaggccaggcagacgtaatgctcccaagtggtgcttctaggaagtcaaaatgaattgcattaacaacagtgcatcatgcacaggaagaataaagaaggggagctccccctccagccccactttcattcctgcctgcccctttgttgatacagggtccccctggattcccaggcaaagttggatcacctggcccacctggccctcaagcagagaaggtgagcaggaccctgggttggcaaagtcacagatctgagccatgcagctcccatgcccctgtcccacccctagcatcaggctttcaggaaattccaagactgacccagttgcactgaggctgggaaaagaggcctccaggatgggcccagtgactactggaggccgacagggcttgcagtggaccagtgggctcctcgggatgtctgcttggcccaggatgcctgcggcctctgtgcagcccaggcccttgtctgctgtgatggggggaaaggcagggaggtaggtggggaggaggcagggggtctgatggaggagtagaatgtgataggcagcccaggccaccttcgtctcctgggcgggaggatgagcgaggagctgagagaagggggaagcacgtcctgaaggaggacaccaacgtggaaggggaatgggctcctcctgggtagccgtgctccagttgtccccaagggcccagagagggcaggggtggcccgtgtcctgcctggtgacaagggttgggggagcagcagttggcggagctcctatgctggctgctcttgactttggcttgataaatgctggagacatggctctgccttggcttggggctgacatccctgtctcggcccaacctctgggctccctagatgtgctgagtgggtggtgtaagaagcccgaagattgacttctgagcttggggtcgggggacctgggttcagagggacaggtgggagcctctttcccctgagccttgtggagagcctctttcccctgagagcacacgcatgaacgtctcactgtgcaggtgaggaaactgacacccacaaggcttggggcagcccagaggcacacagtggtgttagcagcagagctgagacttccttcccagctccaggaggacccgggcacctcactacctccccagagcccatgctgatcagccatgcttgggacagtggtggttgctagcccccttccccttccccttccccttccccttccccttccccttccttcccctccccaggacctgagtggcagcccctgctctccttaggctggtcattgcagagaatcccaaacctctggccagtggttcttcatcccaactgccagtgggggccaacattggttggggctctgctgacccctcctggtggctggtggcattacagagcccccgagttcattttcccctttgctgggtctctctagcgggattccttcccttgaccaccctacagccactgatccagggcagccaccctctccacactgggagaatgcagccaccttccccgctatgctgcttgcctccccccgccttttctggtaaacattccaatccatgcatcagttctcatcactcttctgctttgaacattcaatggctccccagtgcctgtagcaggggttttcagactttattttgtagtcccagagtctttttatcacataaaagcaaatgtaaaaacctcaatctataaaacaaatacaagcggagattccctggctaagacaacggtgggggtcctagagtccctctcttcagtccccacttcatgcccccagcttctaggctcccccagaagccccagtgctctgagaagtacagcttaaaaaccactgactgttcgataaagtttagcacagcgttcagggcccccactcatcatggtgactcttccagcctcttctgcctgccagcccatcccacaggctcccccagatgccctggccaggccaggcatgtgcccacttgcaagtctttatccttctcttaggttccctctggcatgcacttttctcctccacctgcccaatcccagacatcctcagagtctagcatctggtgacacttctgtgacactttccctgatccccagccagagggaactgctccccgctcctgagctccctgagcccctttccacacagaacacttagactgttgtattgcccctggttgtgttgggcccatgaccctcactggactgtgagctccttgaggacaggggcacccactttttcatcttggggaatcagagcccacatggtgctgcgtgcgctgttgaggcctctgtgcagcccgggcccatgtctgctgggatggggggaaaggtagggaggtaggtggggaggaggcagggggtctgatggagtagaatacaacaggcagctttcacagtggattgaagctgtgctttcagttcagcacatgctactgagcccctgccatgccagcccctgggtcagcactggagaagatgccctgtcccttcctcatggggcagcaaggaaaggggatgctttgcagatgaagacagatcctcctggggaggcgacgtgtggcacatatgcagttagacagggacagattgggcccagaagccagctgtcctgtttccagcagtcaccaggacccttgacccagggcctggtctccatgggtggggcaaagccctgctgactttattgtggggcggggggggggggcggcgctggtttccagggcagcgaagggattcgaggcccatcaggcctgcctggctcccctgggccaccgggacctcctgggattcaggtgagtgtgtgccctttcagcgtggcagacgtgtgcgatgcatgcgcatgtgtgtggtgcatgtgtgtgtgtgcacctgtgtgtgtgtgctgaggtgggagtcaggggaggggtggagagaattgaggggttgggccaggcctcccacctcctagggctcccgcaccagcatgtagaaatgcctctttcctgtttccagggccccgccggtctggatggtttggatgggaaggacggcaagcctggcttgagggtgagatgatgggctgggagggcgggcaccccttcctctcctttttgccagaggagccaaagtcaagggaaccctgatggaaagaaccgaagtatccccgtctttgtcagggggcacccatgccctccctcggtctgtctccctctaccccagctccccgatggcaccacagccccttggcttcccagttctcctagtggccttaagcaggttaggcgagctaggtctcaccaaaggcaggatggtgaaggcatgatgtatgcagaaactcaagacagctgaggaaaccaggctgggcttcaggaagaatgagggtgtggacatggaaggacttgagcaagccctggctcctggggttttgctggggaatctgaaagggctggggccacaggacagggtagaacatcaaagtcaacccccttatatatcccaaagaaggaaagctaaggcccggagaggggctggaagtcactgaggatccacagccagtcagaggctgagccaggcttggattcttccctccatcttaggatagctggggagggctggagagaggggaggacagaggtatgagttggatacaagctgggcaaaactcttgtctcaatcctcctcgtctctttccctagggggaccctggtcctgctggcccccctggactcatgggaccaccggtaagttgagctgcaggaaggagttggaagctgcgaagttgcagcttctgcctgggtggctgcaacagctcaaatccagatcctccgtggaccgtgttatgactttggattggtttgaattgtttgaactgaggaaggaggagtgggaagaggcccccagctgacatgagggacatgagaactccctgctttttctttcagggctttaaggggaaaacaggacatcctggcctcccaggacctaaggtaagggctggtgacctctgccaagcaggttatctctgctctcctgaaggcttgcccccaggcatacatggcagcctatcctgggcagagaggccatcccagcatcagagcctcctggggccactggtgcctggcagactgggtcagggcttctctgtctaccagctggagggcatcagagggcctctggccaaagctggggcaggtggcagggtccctctgatgtgaggttgacttggggtagggatgtcaagtgaaggtctggtaagctccagctgctcctctctcttctagggtgactgtggcaaaccaggtccccctggcagcactggccggcctggcgcagaggtgagggccagggatccacatggctgccttcagtttgccttcagactctgcagagtctgggatgcagccgcttcttcctgctcactggcaaagtggctgctttctgtcctcagccttctgggaggggtgtcacccaacactgcacgtcttgaactttctccctcctattaagggttgtaactggttctgctccctggaggttactgggtcaccaacctaaaaaggcagggcctggcctgctcaggctgaggatccgccttctctacctaactctccgggaaacttgggtctggaggctgggaattggcccagctcctttggccattggcattaccatgtattctgcccagccccctcccatccgacagccacatggtgcaagcaagtcagtttcagtgtcattttttcctttttctggctcctgcagggtgaacctggtgccatgggaccccagggaagacccggtcccccgggacacgttgtgagttgaaccacttttgtctctgtctccataagagttagcattttggcggggtggttggtggtgcataggctgtcatgacctgagagaacttgccataggggctgccccagccgtgggagcacgggggccactccttctgtggtttccaggcttttcgttattttcttattttctgggcacattcaagttcacttatcagatggaggtcattcagtcaacaaataattgtggagcccctgtgccatgccaggcttgggggacttgctgatgagctggattggggttggggagacagagtgacagaaagagaagaaccaggggtgactcctgcatttgacttgggcaactgggtaaataggtggtgtgtttcccaagatggggtgacttggagaggacatttatcaagcaacaatgaatttcctgtctactttactcatcactaacatagatgactgccaggcagtgcctttgatcagtgtgacggcactgagctgatgggactccagagaaaagcgaagatactggcattttgttgcagccctgttgtggctggctgcataataatttccaggaggctttcggaaatgttaaaaatagttcatgaccaaaaaaaaaaaaaaaaaaaaagaactctcaggcccccatcactatttttatgcatctcaaggggtccagaggccctggattgggaatgccatatcaagcctggttccccctcacattacagatgacacggggaggtgcactcagaagcgtggccccattggagactcagtagggctgaggttgagggggtgcagggttccgcctctctcttccgtgtgtccagccccttcgtcttgcagtgtggcagtctctgtgctggacacttccaccccaggagactggagatgaatagaacagaggctatggctctggaacgtgccacctgggggtgttgagggaagcactataagagagacccaagtgccccgggggttcagagaaggtgtcactctgatcagggaggtgatcttttgcaccacagaggcatggatgtaggcatcagagctagggaagggcatttcagacgcagccctagtgcagcagcagggactgtctgggtgttggagtcccgtgcgctccagtgttggccagcaagtgttagctccttgtcactatggatgtcggggtcagtgccaagcccctgcccctcaccccctgctacacggacccccagcttctggtcttccctcctccatagaacagcaggaagtagactgcctttagggaagcaagggtctcagtagccacctaggccagggagtaactcccccaggcctttgtcctctgcacttggcctctggccacggctttcagatcatccccctcagcacagccccagatgctccactcagcctgggttggagggagggtcctgtgtgcccaggacccccaggcctcagctctgggcgcaaatcttgtccgaagctcaagtgcaagaccagagcgaaggaaggtttccagaggaaatggagctgctgaagtttagagcttgtttctgctgtcaggccctgtgcctcccaggggtcttactattagaacctgtttctatcccactgactcatctctctttaggggccaccagggcctccaggccagccaggaccagctgggatctctgcagtggtgagtaacatgctccactccttcctccctcccaggagttttgccctgcttgactgtgggctccattcagaggaagctggggggatggagaacagtttgtctcatcccctccttccctggtgtcagcctctcctgcctccaaagatctcgccttccaggatgtggcagagggctttggagagggctggaggtcatctcagagtcctgctgcaagttcaggcagtgccacctctccctgtagtccctggcacacgatggggtgtctgtctctggctatatgggagtccactttgcctgctttcctcccctctcactgtcccccttcctattctctagggtctgaaaggagaccgaggagccaccggagaaaggggccttgcaggcctcccaggccagcccggcccccctggacaccctggccccccagtaagatcccacattctacagcatagcccagggggaaagagtcaattggctcaaggcctgttgagcacagcacaacatatctggggtctctaaggaaggagaggctgtcagcatggcaggatggcagcgtggcgttcgggcctgaggatcatgctgaatttggaaggataggccctgcagtgctgtgccaggctgcacatgaggtcactgcccatgacggtgcctcagcatcaaccttctgcagaccccttggctacgtgtccctgttctgcctcttccccttccccaggggagcttgtcagtaaccacagaaaatcttgctaaatgtcaggaaccagaaatgcagtgctgttactgtaacttcctgaggtcctcggaaaccaggacttggtctcagctcacgtttaacactaagagcgctgatatatcggtcaccgatgtgtgccgaatggtggactaagtgcttgctgtgcattttatcttaatctgtgccgcagccccatttagtggatctgattgtccccattttacagatgaggaaacgggggctccgcaaggttaggcaggttgctcggagtcacatagctagtgagtggaagagctctgacttgatcccagcctgcctgattccagaactcatgtccttagccactctgcaaatctacctctctcaaaagttccagacaggtgaaccctaacaggtgcaactgattgccagggtcagggatgaaaagtctcctgggagagcagaggcagggacccaggtctcctgggacccatcaggatgctttccatcaacgcagactttttctggggggcagcagcagtgaccgtggggctggtggcctgggctggggtgtttgactccagtcagcccatctgccaggcgggcccagtctcaccacgcctattcgctctgattcctgccaaggaccctgcctccctccttgcaggctcaggagcctccatggcccctggatgaatctcccacttgcctagcaatcagagtcctcttccccagcagccaccagaagagaggctgccttgctggtctcagggagggggccggctcaggctgttcatgtgttcattcagcaaacgtttaacatagattcagagccagggagtgtgcaaggtgccaggatccaagcacacagcaaggcaggcacggtctgttcttcccttgtaaagctcttgtagacgggggctgggagctgttggggctctgggatcacgctggagtatggggtgggggtctaagtttccacggcctgtgcccagattgtcagagggtgagggctggaggatcgtggcctctgggtggaacagggggctgggcttgccccatgtacaaagtgaggcatctgacaccaaactgggttggagctcctcatgtctccattgctctctactccccagggcgaacctggtacggatggtgcagctggcaaagaggtacagttgtactggtcttctctgtttccttgggggtgcttcttgctcctcgccttgccctgacccctcttcatttttttcagtaaacattccttctatgtacgggctgtctctggaaattgttaaccctgttgtcctggggagaggaattagagacttgaggccaaggatgggagtgagatttgttttacctttttttttttttttttaaaccctgtacctggtcaaaaagaaacaacaacaacaacaataataatgataataataaattccaaacaaacatctcctgggtaccaggtctttccaggccccccagtatgccacagactggccctctcattctgacttctcgcctctcttcatctgtgatgggggcccagccaacatgcttaaacaaggccatgccccagaggacattattttcccttccagctgggcagggaggctgcgctcctttctcacacagagctgggctggacacacctgggggcctcaggctgtggaaggggcctcttcactgcacctgcctccccagggagcctcagagatgctgcccggacttcacctctgacttttgctttcctctagggaccccctggaaagcagggattctatggacctcctggtcccaaggtgagtgggcactggctgggcttgagaggagaagctcacgagtggatgaagcccagctgcaagttacggctttagccacagagaggagacacaggaaggccagtgggcagggggcaaaaatgcagaacttggagcaggatagtgtctgaaaatttctcacatggggtcattagctgtggttggggggaaggaaatctccagttcatttactcactgattgactgattgattcattcattgtttccatttcccgagcactcccttgctcctgctcacattccaggcccttgtcctggcctcaggtaaacagaggtccctgaacaataggtgctcacaatagaccagtcacacttacactagggattggcaagttttccagaagacatgagacatagcgctgtgggatgagagggaggagcacccaacccagcctggggagtcggagaggctgcagagagaacaggaacacttcagctcaggaggggtgcactggatagagagagatgaggggaagggcattcaggaccataacaacatggcagaatcagagaatcatcaccagtgaggtctggtgggaggcagagggtggggagaggaggctgaggaaggaacgatcaggaccacataatgaatggccttgcatgcccggccaacgaatgagtgctttatcctgaggacatttgggagccatcagaatttctaagcagggagtaacaccaggagaactgtcttctagaaggaccactctggggcagtgaggtggagtgacctgtcaggatgctgtggccacagtctagagggagacgctgggggcctggtgggagggtggagagaaaagagcagattggtgagacatcatgatgtaaatttgacagcactaagtatctatctttgtagggtgatccaggagctgcaggacagaagggccaggcaggagagaaggggagagccggcatgcctggtggacctggcaagagtggttccatggggcctgttgggccaccgggccctgcaggagagagaggccaccctggagctccggggccttcggggagccctggcttgcctggtgtgcctggctccatggtaagggggaaggctggcagctgtgggcactgtcccatagagcaggcatgtggggtggagctcggatcatcttccaagctcctgctgacattctgtgggaaagagcctggctcccatagagggcagctcttaactgtgtgcggaagggtggggatgataggaccctctccccagaaaaatgcacttaagaacaaaatgttttgtatcatatctgggtggttaggactttggattgagaatctacggaggttgctgtgagccaagatcgcgccactgcactccagtctgggtgacaaagtgagactctgtctcagaaaaaaaaaaaaaaaaaaaaaaaaaaaagaatctgtgggaggctcctgggacctttgccttcctccccatcctttatttccataggggaaaatgccaggcttggaagtataattgaggcaggttttcttctctttcttcagggagacatggtgaattatgatgaaatcaagaggttcatcagacaagagatcattaaaatgtttgatggtaactggcagccagctgggtggcagtgggtgctgtctgcccttccttgtgacttctctgccctgccttggcctctttctccttaacgctcaatgtcctcctgctctcaccctccacacactcacaggcctggggttgacaggcagatgttcaattatccttcagaccttccttgtcacctgttctgttcagagataaaatgattccctcctgcattccccgagcccccacttgagcaaaggagacagacaagaaaattggtattaaacgagtctgcctgaagtgagctctaaatacaggggcgagcggcactgtaagatggctggggtggtttatttgaagtgtttttttctgttcatttgttcatccaacattgatgtgccagggactggggaaaacacaggccctgtcctgaaagggctggacgtcttgcttgggaagcagaccttgaatgccaagcaaggaatgcggactttattctgaagccagcggtgaactaatgaggggtgttggagcagagatgccatagtcagatctgtgctttggaaggatctccatggggagcgacgtggaggccaggacgtgggaacccccttgcgagacccacccccatactccttgccctgacatccctgtgaaggaaggctgctgtggacttcatgctggtggcctatatgcagcatctgcagtcattctgagtccctgggggaccctctgacctgtccctgtccttgtcctttttttacagagagaatggcttactacacctccaggatgcagttccccatggagatggcggcagctccgggacgaccagggcctccagggaaggatggtgctccgggcaggccaggtgctccagggtcacctgggctccctggtcagattggcagagaaggacggcagggcttgccaggagtaagaggtagctctgccctacagttcccaagggacacatgtaattctttggggcaggcctaagtattccatgaggtctgttgtgaatatgggatgtatgtgtgtgtgtgtgtgtgtgtgtgtgtgtttcaagtaatctgactggctgtgtcatttttctgctcagggataggacttatttatttcttttgttccaggattgcctggtaccaaaggtgaaaaaggggacattggtattggcattgcaggagaaaatggtcttcccggccccccaggtaggaaataccaccatttgagaccatgaatccagagcagcagagaccccttttctttctgtttcttctatgacacagctgtgtcaaactccaaataacgacaggccagtcaaccacatttataggaatgccactgtgtgcaagacactctgccagggcctgtggggatgtgggggcggaagactcagtacctgtccttaagtcctaaactgggctagcatgatgcagtaggagagagctgcatggaggtggggatgaggaactcgagttcaagttctactcagcacctcactggctgtacaccttgaagaggccacttaagccctttggaagtgctctctacgatgaatgtttggctatatagcctgaaagaggatggccaaagcctgatgacctggctctgagacccagcatcacaacttaccagaggtgcaacctctctgagcctgtgtcctcatctacaaaattagacaatagcttctttctcaggaaattgtgcagattcaatgaataatgcatcaaaagcactcagccctgtgcctggcacatggaagttctaaataaaacttgccagcagtattgttattgttaaatcaacgtgaggatcagactaggtcttcatgaaaacatgtggtaacttgagaaacagtcatcaaatgtaaggtattatttgatgccattatggcttcttttcccttatgatctgggtcttctgattttccctctgtggcccttccctccctaggtcctcaaggtcctccaggctatggcaagatgggtgcaacaggaccaatgggccagcaaggcatccctggcatccctgggcccccgggtcccatgggccagccaggcaaggctggccactgtaatccctctgactgctttggggccatgccgatggagcagcagtacccacccatgaaaaccatgaaggggccttttggctgaaattccccacctgcctttggatgaaagactccgttgggaataaatggccaaagcttataggactctgtgacaggttgtgaatgttttttttgttgttgttgttgtttttaattgctgttaatattttttaaataataaagaaacaaaactatctgccctttcccttccagtgggttcctctggtgctgcagccagagctccctgttgccctccttttcccgtttagtcccaggaacaaaaaagggcattttgggtacaggggcatatacctgtaatcctagctattcaaggggctgaggtgggaggatcgcctgagcccaggagtttgagaccagtctaagcaacataatgagactcagtctccgaaaaataaaaattaaaaaataaagggtatttccctcctt

SEQ ID NO: 36584 - DNA, 48245 bp, Homo sapiens
gatgacggtctcagcctcctcccgaccccttcctgcgcgtccgctcttcccctgcgcccgcccgcgcccctccgcccgcgccccggccccgccccaggcctcgcctccgcttcgccgccgccgccggccgcagccaggagcagcagccgcgcctgcagaccggcctcgcggagcccgcgcgccgagccccacgtgagtccggcgggtcgccgccctgggcaccctcgcgacggaagggccggggtggggacaccgacgagcgcttttcatctcgtcccagttactttgaaaccgaaagcgcctgctggcgtccggccggtccccgaccggcggggagggcgcgaggcggcggctgggccgggggaggcggaggggcccgggcttgcgggagaccggcggggcaggtgaccgccgacggcccggggacagcgggagcggtgcggagcgggtttcttagccggggagaggtgtggcgagggcggagactgggggtccaaagctggggagctggtccagagggcggctgtggaccggaggggccaggttccgtcggggtgcactggcggggaggactttcaggcacgtcccgcacatccgcactgcaaaccaggccctggcccccttccgcacccgaaggcaccctctccacctttgcagggctttccaatcaaagcaactccagaatgaaacttcaggattgcaaggaatggaagcctctaccagctgttcgtttgcgcgtcttcctttagaaagcagctacccccctcccccagaaggcgagctctaaggaaccttgacgcaaaccaaagctccgagaggtggaaggagttgcccagaggcacccagagaattcgcagattctgagttctccgtaccagatggtctccactttgttcctgttctgcagggtcttggtggttctgagaattttcggggccacgctcttgctgcgggtcccactgggccactctggctggccgactttctctgctcattcggcctccttctgctaagtttccatatttgggtatttcagatttactttcatgagaactcagttatctcgctgtggcaggcagagctgcctcaggcgagcattgaggttggtgaaaccaggcgaggctccctgccagggctgcccctgcagcccccaccctccatagccttgggctctgacccacctcctgtgaggataggcatctggtaaccagtttaattctgtaaatatttattgggcaggtgctgtgtgagaactgggctggggccagtggaatatggttatttcctccagagatacttgcattttaaaagggctctggaagacctgagatgcaaagaaattagttgaaccatttctggaaatagaacagttttgggtgtgtgcgagataattttaggcagcaaaaggctgggctaggaactctcaaatcccagtgcagctgctctgccttatgtactcacaaagctgaaaacaggggtgttaatgtaattgatggtttgggtggaaacacttccatccctaactctaatttgaactagaaagacagaaattgctgcaggaacgatggatgtaagatggaagtggaaaacgcctagcttctgtaaaggtttttgattttgttacagttactgtttttgttgtaactctatggaatggatcacctctcagatccctggctcctggacagaggcaggagaaagtgtctgagccagcatctggaacatgggaagtgatggagaaggcgacttctcccacggcctctgggctgagaggcctgttgtgacgggcagggtaggatggtggtatttccctctgtcagcagcaagcccgctggacttgggtagtagggcgatggaaagagtgtggaaaagagctgccgtccactgaacgtcctgacgatagggactgggatgtttcagtggggatgatttgcacagtcggggagctagatgcctcagagtcagtcttgttaggcttgcagtgggaaaggcacctcagtacttagacaaacctcctctgattagctcagctttactggggaggaccttgaaggaaaaataattatttgtttgtaaagctcgttcctttgcaaagcattttctctttgttcttgtcgttttgttctcatttcgtcctccatgacgccctcatgagttagagcaggcttattctctacatctctcagattgtgagggtgaagcactgaggcggtaaatagctccctgagctccactgctggaccaggatcagagcattgaggtgtcttgttcccctgctccaggcccctcaccctggcttctcagagagccatatctgcccacctcttcctccgtctgaggggtcagcaaggggacccagattctgataatgcctctgtggtctgtccccagcaacatggagcaagttctgctggagactctggcctaaccaccacaagaacagacatccactctgttagctctgcctagccaggcaaactccgggcaagacccttgtctgttttcatgtgtgtcttggaacctggcatagagtaggcctaaacagatgtttgctgaatcgaattgaattcattcagggtacgtctcccttggggtctgagctgccaggaacaagtgctgggtaggcttggcagagagaggttgagctcccagcaggacttgcttaaatccagaaattagaataacactgtacagcttacgagaagcccatctcatctgattaacttctcactacctcctcaggagaagggagaggcacatgctattccttccactttacctggttgcaagctgaggctcagaagtgatttgaaagacctcacagcatgtagggatggggcaggacctaatcccaagtcttctttctccaattcctgtgtttttcccatagtatcttaattaaaggaagccaggattctgggcaggaggaggatgagagaaccagcgagacagtcatcaaaagctgcctgacacctttgtcactgatcaggggtcagtgtctgactcagtctctgaagagcttttttctgcccaggttgtggctttttctgggattctggataggagttctagctccagcagaggtgtagcaagtgagtatctgtgtgtgttggggcagaggagaacacgctgcagggcagagggagtcctcagagctggcaggcctctgctgctgctgccgctgccaccacccaggagtgggccagcatgaatttgttgccttgcccagaggaaagctttatttgaaggatcactcagcagccttgacccatatggcctccagcaagtcctatcttgtgagaaagtggcttggaggaccaggcaggagataaaagtgaaagtactcattagtcctgacagaggaactcagtctgtttacagtgacagtggtgagcacattttgcatatttgtacctggaggcaggtggtggtgcatgcttggatcgtgctgtagcaaaagcagtatacatgcaaatggtctgtacactgtgcagtatccgtgtgatgtgcaggtcttagagacccagtattaagtgacagagcccagtgagtgccctcccaggatatctcacttactttcagcagagccccatgtctcatttcttgacaccacaggctccatcaacttccctccttaccaattcagaacattcctgaatttttttccatggctttttttttttttctctcaaggagaaagtgctctcctccagaacaaggcgagagtaccttttccacgtacactcccaagtcagctctctcctcctccctctgaggcaggttccctccctgcctccctcccacagacttcttccctcccccacaagctgagttttctgttagtaagaagactccatgtttccccagtccctcttctctttctttcactgacaagcttctgtaaagagtggacagctcttgcactcgctcctcactcggcaccgtgcacctgctgcgctgctctgattgtcctgtgtaggtttccaggacctggtactcctcagtcaccagcccataccagcccacgctgcagctattacttatctccttggaggttgctacaccgtccccaccagcattcccttccttgacctccagcttcttatcctcctctgtcctgcaagtgcaggtatggggccaaggctgggtcctcaggttggatttcaattctctgtgcttctctccttgagcccttggccattcccaagacttaaaccaacacttttaaggaaaggctgatcaaatttccatccctcacccagttatcttcttggccactatgatttgcaatattcagaatcttcaccatgatgtttcagaagcaccttagacatttgtccgaggccgcctctttctctctgttctctctgttgcagaaatcgctgctgttcctcagtcacctttatcctgtccccctcagccagtcctgatctgtctattcccagttcagggccacagggactctttcctgggcaaccttaattaagcattgactcattttcctgccccaggtccatctgtattcaattttccttttcatgctgctgcagaggggcctctttaatacatagcctagtcaaaaccttctactttcaatgatggtgtagtagaaacagtgtggacttcagaatctggtgggcctgggttcatatctgggtttatgatttgctggttgtagttatataatctgagcaagttgcccaacttccatagtgtctgtattcccactggtaaatagaaatagtaatgtgtgccacttggggttgctggaaagattaaatgagtcaatatatacacagagcctggagtctggcagatattcagtaaaactggttttctccttccatgtggttaatagccatagagcattgtggggtttctggggagctggaaactgcatgcctagcctaaaggcattcaaatttaaattaaaaaccagcagaagaattgctgtgtgtcagagcaggccatctttttttttttttgagatggagtttcactcttgttgcccaggctgtagtgcagtggcacagtctcagctcactgcaacctctgcctcgcgggttcaagtaattctcctgcctcagcctcccaagtagctgggattacaggcatccgccaccacggccggctaattttttgtatttttagtagagatggggtttcaccatgttgggcaggctggtctcaaactcctgacctcaggtgatctgcctgccttggcctcccaaagtgctgggattacaggtgtgagccactgcacctgggcgagtagaccatcattgaaactagcctattgctgccactttgccatctctggaccaggtagacctcaggggccagggtagggaagctgggctgggacagggtatggtgggataagctgggatgagttcttggcaggcagaggggccaggcagcctcagaggctggggccccatggaccaggtttcaagggcaggagtctagttttcaggacttgtgggcagagcaggcggcagctttggaggaagaatagtgcttggcagagagccaacacaggaaaaaataaaacagatttggaaaacaaaaatacaagctctggcttgatagccaggagcagaccagttactttagccagatccaatgtgaaggcacagcaggataaggttgacctgatgcaaagccaccacccagagccctttctgttctcctgtactaaggcgtatggcttagaacagccaggctgtgttctaaggcttctgttagggagacccttgaccctggaggatggagggaggtgggtggggctaagctaagcggcagccatgaaggtccctcttctgtcttcatgattttaggatttctgaggtagaggctgggttgatatctatgatgcaacctaggaaaacttaccatgcctccctgttaaaggcagaataatttaatataaagcaaaggcttacatgctcagcagatgcagaatgaaagaagtgattaaaacattgggtggagttattccaggaataacccactagggagtgagggggtagataggagaaatggagggggaatattggacttgagcaaagatgttttaaaaagatgaagaacattttagtcacccttaatgaatgggaagtagattatttgggagcagactgatttccttatgttaaggtgttttatttcaaaagtcagtactttgggatgttgcctcaaattatctgtatcattcccacagacctcccttagagatatttattgccatgtattagctgtggacagccagaggctaagttctttccccacctctttgatactaacagttcccatagggcctatgtatgactaagtggttcactttcacttcacttacactggatcttcctaacaagtggacctctctagccctcatctcttctacctcgtaacagaagtgctagattttctcattaattctgttcaagccttgttaaatagctctaggcccttcttttttttgttttgttttgttttgttttatttttgagacggagtcttgctctgttgcccaggctggagggcagtggcgccaactcggctcactgcaacctccgcctcccgggttcaagcgattctcctgcctcagcttctggagtagctaggattacaggcgcctgccaccatgcctggctatgttttgtatttttagtagaaacgggatttcaccatgctggccaggctggtcttgaactcccaacctcaggcgatccactccccccccactccccactaggcctcccaaagtgctgggattacaggcgtgagccacggtgcccagtcttgttttgttttttgagatagggccttgctctgtcgttcaggctggagtgcagtggtgcaatctcgggtcactgcaacctccgcctcctgggttcaagcgagtctgtcacctcagccccccgagtagctgagattacaggcacccaccagcaggcctggctaatttttgtatttttagtagagatggggtttcaccacgttagccaggctggtctcaactcctggcttcaagtgatctgcccgtcttggcctcccaaagtgctaggattacaggtataagccaccgtacccggcctaaggaaaggtgtaggtctttctacacctgacttgcctatgcctaccttttcttacatcatttctcctgcctagaatgcctcctgttcaaaaccattaatccatacccctgccactcttttcaaaacaaattcaaaattcatctcttgttaggcttctttgttgggggtccccaagaccattcccaggttcagtgatttgctaggagaacttacaggattcagcatccagcagatggtcatactcacagctatgattcatttcagcaaaagaatacaaagcaaaatgaacaaagggaaaaggcttatggggcaaagtccaggggagaccaggtgcaagcctccaagagtcttggaaaagactctgcaaaggactgccgagggggaatcacacaggatgtgctgaatttctccagcagtgcattgtgacagcaggtgtgaagcactgtctaccagggaagcccattagagactcagtgcccaaggtttttactaagggctggtcatgtagataccttcatctagcacatgtcagaattccagcctccagaagaaaaacaggtgttccacataaaacacattggctgggcgcggtggctcatgcctgtaatcccagcactttgggagaccgaggcgggctgatcacaaggtcaggagattgagaccatcctggctaacacggtgaaactccgtctttactaaaaatacaaaaaattagccgggcttggtggcacgcacctgtagtcccagctacttgggaggctgaggcaggagaatcacttgaacccaggaggcggaggttgcagtgagccgagatcgcaccactgcactccagcctgggggacagagtgagaccccgtctcaaaacaaaacaaacaaacaaaacaaaacacattgtttacctagatggtttaagcacagtgagccgctcttagcagttcaggtggtgggagccttactgaaatccatgttccagacaccagccaggggccatccttgcgaggagaactttctagagatagcagtattaggcttgctgtgttaacttgtttctgcatagctttccttcataatctcatctgtcctgtcctcccagtgcctaactatagttatgttgtagagaaaattgccctagacaaagaaccagaagacctgggtttcagcccagcatggcctcctactgctgtgtggccctttgaacccctcaaactccattttcctcattgggaaaagaggaattgtaattcttgcttgtaggtctcaatggtgactaaagaccaaaggaaatgatatagttggtcattccttccatcccccataatcgagcacctcctttatctaaggcagtgagtgagctgtggtgagtaagacgtgagtgtgacatggtggctttgacagcagacaagcctgaatccctacccagagttaccagctgtggtacctcaaacaccttgtgtcatcccctcagctttgggttcccgatctgtaaaatatgaagatgaataatacaatgagggtctgcaaacgtgggctgctgtgtgaattaagtgggacaacctatgtacatctcctgcagtatctagaacattatggcaccccaagtggcaactgttaattgactcagatatttgagtgcttgctctgcgtctgcaccttgaaaaatataagacacaattccagcactgctttcttcgtgctggggaagactattattgaacagataattaattacataaacaattatttacattcccggcaagtgctgttaaggagaagtacaggtggttaaagggcatgtcataagtgggggggaccctaacttgatggaggaggcacacagaggcatggctgcatatgtgaggcttcatctgggcttgtatgtgtttagctcagcaagaggtggggagagaggaaaagatgtttccggaagagacaacagcttgaggaaagggagacccagccttagggtgaaggctgtaagggggaaaggttctctgttcatatgaggagtggcaaaaagaccaggaatccaggagaggtggaggacaggtggggagattggcctaattcagaggtcacctctgccgccaccctggcagggaaggggcagagcaggggccccatgcagggagatttgcaggtgtggtggcaggaagtagaggtggtctggtctgatgatctctgtttttttttgctgtgcagtaaggaagtagagtttcctggtgagactggagggagtggtcaaggtttgtggaggagagaaaggtttaaaatcaacattgaacagagtgagctgagaaggaacagctggctttgtgctatgttattgtgttggcatgatgaagtctctggaaaaggactctggcaaatgggattttagatctctagcaccttgtacaatgcctggcacctaaatgagggccccataaatgttgattgcattgaattattggctggctacctatatacatttttctcagcatttcccctttctcaggtgcctgctacccttgggctaaagcttcccacttggcacctcacccagaggctagctcacattagtgtgtcagagggagcgctgctcaggctttactcttccggtcctagttggctacactgtcccctcaccccttacagtgactccccaactcctaccccaggtcagccatcatgagccagccttgcactctccagctgggactggtagaatttcaggacttacaaacaggtgaaatgaaaaggtttaggcagtgagaagcgtgcttagcaggagagaggctgctctgcttgctggagaatagctgttacagtcattctgtaagtatttactaagcacctgtcatgtgcactgttttgtttgtctgtttgtttttgttctgttttgagacggagtcttgctctgtcatccaggctggagtgcagtggtgtgatcttggctcactgtaacctccacctccctggttcaagtgattcttatgcctcagcctcctgagtagctgagattacaggcgtatgccaccatgcccagctaatttttgtctttttggtagagacgggtttcaccatgtcggccaggctggtgtcaaactccagacctcaactgatccgctcacctcggccttccaaagtgccgggattaaaggcgtgagccgctgcacctggccagacctcaactgatccgctcgcctcggccttccaaagtgccgggattaaaggcgtgagccgctgcacctggccacgtgcactgttttatgtgttgggacttcagtacccaaagaaacaatccttgctgtgctggagcttatattctattctgataggggaagacagagagcaaagacatgaacaagtaatatgttaggcagtaataagtgcattggagaaaaatgcagtagaaggtgggtctgccagggatgttgcattttccatgtagggtggtcagcaaaggcctcccttgtgagataacatttgagcaggttcctaaggtgaaggaacaagcccttcagatatcagggtgaagagtattccaggcaggggaaaagcaagcagaagcctcttctgctgttcaagaagacgcaaggcagtgttgccagagtgagtagacaagggggaaggcactaggaagtaaggacacagagaatggagaggcagagaaacgaagggccctgacctctaaggacactggcttctaccccgagtgcaatggggccattggagcagaggagcagcagagacagcttctgtttttaaaagcatcactctggctgctgggttgtgaatgggctgtaaaggagcaaggcagagcaagagaccagctaggagactgatgcaataaccactggggagatgatggcagcttaggccagagtgattatgctgacagtggcgaggaggagaggggggatatgttgggaaggaagatcccatgggctttggtgttgtgagatggagagtaagagaggagccaaggatcactccaaagtttttggtccaagtgacgctgtgattggtggtaccatttcactgagatggaggaaggctatgggaggagcaggttgggtggggatttgatgtgttaagtttgtgatgcctattaaatgtggaggcatagactaaacagtggagtgtgtctggggctcaggggagaggtccagattgcagatagaaatcagggcattgtcagtcatagctggtaaggccaggagctgggacgtgctcacccagagaatgagtgcagatagaagagagcaggtccagcaccagcccgaagctccaagagataagagaaggtgacctggaagctgccacgatgatctgactggtgctcctcacactgtcatgagctgtagaatctagcctgggaatttgctagaaaatcagattctagttgctactgagagatcatgatactgaagtgtattaatcagggaaggctaaactattataacaaatgggtcccccttcctctggggtaaggtgtccaagctagcattttcatcatgttctagaacagattcttagcagagcatctggggccctgactgctcagagagctgctgctatagttttgtgcatatgcatacgcatatccctaccttgactgaaaacttcctggggacaggagctgtctggtaacccactctcctccactcccataatacaatagggcgcagactttgcatgtgaccggcactgaataaagctggctaggagggcagggtggaaatgcatggtgattaagtgcttatttatgtgccaggaattgtgtgataataatttacgtggattaattcatttaatcttaactccaagcctttgtagcaggtactattattgtctttttttttgagacaagagtctcactctgttgtccaggctggagtgcagtggtgcagtcttggctcactgcagcccccacctcctgggttcaagcgattctcctgcctcagcctcccaggtagctgggattacagatgtgtgccaccatgcccaggtaatttttatatttttagtagagacagggtttcaccatgttgcccaggttggtctcgaactcctgagctcagacaatccgcctgccttggcctcccatattgtcccatattctagatgaggaaggggtgacacaggtaagtgaatggcagaagggtttgaaccccagcagtctggccccagagctggtctctaaccagtaagcggtactgcctgccatcaagccctcctgtttggtgttggctgcaatggggtacattttctcccagctgtgacagagtgtagagcactggcttcggagtcagaaagtctatattcaaatccctgtgcccacgcactagctgtgtgatttggggaaagttgtttaacaacttgaggcctcggactgttcattgggaatatgatgatgatagcagtattgccacagggttagtgtggaactgtgtatggtattatatgtaaaagtgcaggctggaaattactagtacatgtcaggttttagttttattggtatcatcattatcttgagaaaccaaactgtggatctcctaggactaaccagaagagctgccagaggcctgcggattgcagcaaatccaacaggccctgcttcaaccagaacaggtattctgtatactcttacttactgatgtttctgcatgaaactcggtttggtaagtttcactgtgaaacagtgaaacccttgggtagctgatcccttaagtccttccagagctgacaggctcagttgtggggtgggggaatccactcccccagttctacctacttctcttggacctcctctctgggctccctacctgctctccctcttctgttgccctgatcaggcccttgagtcccaacagcctgagggctgcattttttaaaccagactctaggatgcctgcctgtatgtgggcagggcacctggggtgtgcctggggtgtgtctggggtagccctccgccaggaagcgtctctcgtctgcttcctctgtggactgggccagagctggccttgctgtcaggcgggagggaattgccctgtgtgcctctcacaacatgtaccccagccacagtcctcccagctctgggtagtaggcagctggcagtatgtcacacatctgaggtcagctttggaaatataaacttacacaaagtcagctgtggatgagcatttgtgggaaggtggggcaccgctagaatgatgttgacctttggtagctaaaagtcaccaaaaggtcatgccacggtttctaaatactcattggcatttctgttctgtagcccgtctagggtggtctcaggtttctcccctttcttcagagtaccctgaggccatggagggtggggctgggcaaagcctgggctcagtcctcatttgaaaatattcctgaattccaagctaaatctaaacagttgtctgttggctgtgcatccaagctcgaggggcccctggagcctcattcactttacgagtgtttgtgctctttgtacttgtttttgtttttgttttttgagatggagtcttgctctgtcacccaggctggagtgcagtggcacaatcccggctcactgcaacttccgcctcttgggttcaagtgattctcctgcctcagcctcccgagtagctgggattacaggtgtgcaccaccacgcccagctttttgtatttttagtagagatggggtttcgccatgttggccaggctgctcttgaactcctgacctcaggtgatccacccacctcggcctcccaaagtgcaggaattataggtgtgagctgttgggaaaaagctgagtgttgggagggaaactgaggcagggcttgcataatgtcttcgggaatatgtctagactttctggctccttgcttctagccctcctaggctcctattcccattatctcaagtagcagaacatgttccatataaatgctaaaccatcacagctgtaaatcatgtgcttaatgcaacgtgtccttttgacctccacattcttaccacctgtttctctgttggattaccaataagtagcgtgggctcccagagctggcggtcttcgcagcctccacaatcgcgatggccctctggtgtcccacctttatctctcaaactgtctttttctcagtcctttgactctgctggactttgtcacccccacgacctggtgctgggtctgatcaccccaacagtgagccaccgcgcctggcctctttgtaccttctttgtaagcaaggaggatggtcaggaagggggaagggggagagaagtgtgagtctgagatgacagccccatagctccatgcagtgggcacacccacccccatttgggaatgtagttgaggtggcagtaggtagcctttccaatgaggagaagcctttccaatgaggagaagttcttgagctgagtcaagaacaaagggcagaaggctgacctagctttggggaaccctgcaggagtggaatgctgacaaggagccaccaagaggtgtggttcagagctgggaggagaaccaacaaacacagaaccctagggccaagggatcagggagtttcaagaaggaagtgccaaatgtcacataaagggcaggagggcagtgatttaggagagactagtcagcaaatgtgatgatgtgattacagtttagatcatcaaactaacataatatgctttcccaggctgtatatggcctcatataccacatgcccagatgatttgggcctgccgacttattccaggtagagtacagataagcttgggagggccagggaggcttcagagaggcactgatgggatctgataaaggacacaggtctgtgggtgccacctggaaggtgtgtttccatcgggcattgctctggagctgggaatgggaaggagagaggggagaaagaggttgatggggcattgccgggctgaggatggagaatgggccagagctccagggggtggggaatttgggcccatgtgctgcatttttgtttcctcatcagtgtctgcctatggtaggttcccagcaaagaaatgatttacaaaaagtgactgaatcaataaatgtttagcgcgagatagtccagtgtaaccatgaattcaaaattgggtgaaatgagaaggcaaatagcatgtcaggcagtcaggttatctcagagtgggggacattgatggagagactcaggggcaagtgcttattaataatagcccttatgacacctctgtgtactaccactataagttcttcatgcatagaggggtcagcaaacttcttctgtaaagaaccaggtagtaactgtgtatttgaggccttgtgggccatatggtctgtggggcaactgctcagctcctctgtggtagcacataaacaaccatagacaatatgtaaatgaatgaacatggctgtgttctaataaaactttatttacaaaacatgtgatgggccaacccctgatgtatatagtattgacgtatttaatcttaagaagttctatgtggtaactactgttattatcaccattttattttgttttttgatatatttttcttttttttgaattgtgataagtcctacttttttatttttatgggtgtgtattaggtgtatattggctacatgagatattttgatatgggcatacaatgcataataatcacatcagggtaaatggggtatccattatctcaagcatgtatcatttctttgtgttacaatcatcccaattcttttagttatttttaaatgtacaataaattattgttgactatagtcaccctgttatcaaatactagattgtattctatacgattattctgactatatttttgtactcattaatcatccccacttcctctacccaacacttcccccaccccacaactacccttcccagcctctagtaaccatccttctactctctgtctccataagttcaattgttttaatttttagctcccacaaacaagaacatgtgaagcttgtctttctgtgcctggcttatttcacttaacataatgtcctctagttccatctatgttgttgcaagtgataggatcttgttcttttctatgactgaatattgtgtataggtaccacatgttctgtatccattcatctgttgatagatgcttaggttgcttccagatcttggttcttcagtgttgcagtaaacatgagagggcagatgtgtcttcaatattctgatttcctttcttttgaatatatacctagcagtgggattgctggatcatatgtagttctgtgtttagttttctgaggaacctccataccgttcttcatagtggctgtactaatttacattcctaccaacagtgtatgagggttccctttactccatgtcctgtccagcatttcattatcatcgttttacagatgaggaaacggagaaacatagcgactaagtaatttgcctgaggtcacgtggctatgaaggggtatgggcaggatatgaatccaggcaagtctactccagagttcatgctggtaattgtcatgccatgctgactcttggaaccttggaggggcagggaggaaccccagctcttcatcccctgagggcctccaccactacctggcagtaggagctcactaggcctccatttcctcattttaaaaaaaggggaataatgataatatatatatcatatcatatatcaccctgtctcctacgctggagtgcagttgtgccatcatagctcactgtagccttgacctcctgggctcaagcaatcctcccacctcagcctccggaatggctgggattacaggtttgagccaccacacctggctgaggggttaaaatgagctaatgcatataattagctgtctctgtgcttggacatagcctcagtacttgtaatcctaacccatatctgactccagccttaggctccattcacttcttttaatacccttctcttgccctctgcctcaatcggaactctcctagattgtcttcacggccctttctcactgtggcctcacagtgactcggagtttccacactgattattgagtcatctgagttattgggtactctggcctggggactaatgggagctcgaggaactgtccctaggtagcagtggggactgttacagagctggagccaaggatgggggcttcctagtggagaacaaggcttcctagtggagaaagctgctgtgtgggaagatcagtagagctttctttgttattttttcctcttggtctggtttctgagagcaaatctaaaggtctcctggataccttaaaagtaccacctggagtcaggtagactctacatggttctgaggagaagagttccactaaaggcatctctgtaagtgggactgacttgaggcagcagcagctttcgtcaggccagcatgggtgtgcagcctggagggttgggggaagagggatgcccttcagcctttgcactcccatctactcactgtcagtgcttgctgtaccgccaggagaatggggaaccagaggtttcctgacaacttggagagaagtcacagttctctttaaagtaattaaaattatactcacatcattgtttgtcctgttcccaagacaacttccttctgtgaagacataaggaaaagcaaagaaaacatacccttatctctgcctctaagacatcaaagccagtcatcctggggcaagaacagtgcgtcggtggactgtggtcacatgttgtctggttgtcgtggtgtcacctggtctctgcatgagctcccagccacattaggtgtaatggaaaatggccttattggttctccctttctccaaggccttcgtctttgacctgcctggttaaaggggtttcttcttcagtttttgagggaaggcctctttaggccatcacagacagaagctttggaaaaactgtgagaccatttcagttctcctttgtgccaggaggatagcctaacagataaagtgctttctcctccttcgttttcctttccttttttaagttaaggtctttctctgtcgcccagggtggagtgcagtggcgtgaacaatgaacacggctcactgcagcctcgacctcccaggcccaagcgatcctcctgccacagccccccaagtcgctgggactacaggcgtgcaccaccacaccctgctaattttatttatttatttatttagagacataattttgctcttgttgcccagtctggagtgcaatggtacaatctcggctcaccgcagcctcctgggttcaaacgattctcctgccttagcctcccaagtagctgggattacaggcatgcgccaccatgcccagctaatttgtattcttagtagagacaggatttctccatgttggtcaggctggtcttgaactcccgacctcaggtgatctacccacctcggcctcccagagtgctgggattacaagcatgagccactgcacctggccaactaatttttgtattttttgtagagatggggttttgccatgttgcccaggctggtctcatactcctgagctcaagcaatcttcctgcctcggcctctcaaagtgttgggattacaggcttgagccactgtgccagccctgcgctccccccccctcctttttttttgcttcctggtagtaactgttcttcctggaagagcagaatcacaggattcaacgccagccatgaccttgagagagaactgccgatcctagcaggagagcatctggaacccaccgagggcatggattccagagacccgttgggtcactgcatcttgggattgaacattttaacttttctttatcaccagccacagtctctcctctttaagcccaggacccattggtgggccttgggtgggtttggggaataacatatttgtatccttcccatgctgctcaagtgggtattaggcagttgaccaacactgccagcaagacctgagcagagctgagaaatggacagtttgccttctggcagcctgtccacagagagaggggccatctggtgtcattagagccatggaggagcaccagtcactgttgagatgctgcccagcacccagggatcggggagagatcccctggcttgcccctcttcccactcttcccatcccagtgcctctcattggctgaacctaaccagaagccagggagcctggaaaacagtttgcggcatcaaatttcaccctacctcatgctgcagagctaagcagagcaagagtagggggtggatctgggcaaacaggcaaatgactggcatgttcccttaattccacttcagctacagttaattgctaaccattctagaacttttgtgatagcaggaaattctttaacctccttcatctagaaaatgcctcctctttcttcaagaccagctgagatgatttcttctctgtgaaatcagcacagacacctcagaaattgttagctacccctcacctaggctgtaccagttctttgtcgaaatctctgtttgtggtacttgccagtgggatattgtaattgatcatttttgtgccttatttcttctgtccttggagggactcaagggcagatgcaacgtcacagcctctgcattctcaggacctaacccaggatcagtgcagggatgtgcagatgagtgggctgtggggtgtcctgctcacggtttcatggatggtgagtggcagagcagagacagaggtctctggtcctgtgcccttttcactctgggattttatctgtagtaatcagtaattccccaagaatcagaacttgaaaaccctgaagacaaattttgtggacttatgtcttatgcactataacataatatatttaaaaattccccagtttttcaaatcttcattaatccaaactggatgttggcaggggtatggaggtggtatggatagacagagcaggatctacctttctttgttaaaccttaaactctgcaaaatacatatcttttttgttataactgaaggctaagctcacgttgcttcagaatgtgagaatatttgtcatatgttctccagaaatgaatccgtagagatacgtaagtaaagaatgtaaatggtggcatccacagctttcctttggaattcctaaaaaattctcatggaaaagatgcatcaatttatgaaacaagaagatggcatttcaaagaaactcaacaagagttcttagggaatagatgggatgtgactttcttttgtctcttttggcttgagttaacaactcttcagtaggagtaccacactgtacatcccattgatggcaagaatacgaatgccattgactgcagaaaggtgatatataagctctatttttagcagttttgatatgttttttttttcctgacttgcaagaactgagctgctttgttgttcctgttacgtaagctgttatacacagaggggaaagattttaataaaatggagtgcttactcatttccactaaatagctgcctgggaatgacagaataccagctgaaagtatctaattaattagataaatatatttgttaggtaaagaagcatagcctttctagttctgctgttgggctctctcatgtcagtgaacaaagtgggtccaggcttgaggaagcttcagaaggagacggatcctgccctgggaggcatcacagctctgtttatatactagaacctcacccagaaagacacctcaagtccacatctcatggccgaacataaatgcttatttttctacaatgtgttatgagattaaaaacccaatttcataaaaacaaatagtggacaagacaataaccgattagagagtgaacaaggtcagtgaatgacttaggcctgttgaataggtctgggaaatacacacatggatggggagaggaaggatggggcattcagtcctctgctggctgttcagcaggagcaaggagactgtgagagtcacatgtgctgtgtctgccaggacaaagctgacaagacatgggcccacacagccatctaatagagcagtggtttccaaagtgtgcttcaagggcccctggggtgctggagcagctcttactaggaagtcacttaatggactcttacttcaggtgagttcaggtaagagccaattgtgtgcatctctttcccagttccagttcagtgacctttttcattgttaccttgaaattagccatagtggaagtgtttaaccacagaaatcggcaaatgctacaagctggagctttcccccagttgagcagattattaaatgtttactagcacagcactgcttggggctccctgacacactttcaggggatctgcatggtcaaaactattttcataatagtactgacatcgtttgccatttgtactctccttttacaaatgcacagagatgtttccctgaagctaaatgatatatgatatgcaacagactgaatgtaggagcagacatgagaatccagctatcttctattaagcaacacattaaagagatgtgcaaacatgtaaaatggtggcactcttctcactaattcttttgttttggaaaatggttatttttcataaaaatatttgtattaacatataattggcttattatcttgaagtaaatacttttaaaattcctcaatttgactctcaagtatggtaaatatgaatagatataatttgcgtaaacaaaaactcttaggggtcctccattaaaaaaagacaagattttcttttagagcagttttaggttcacagcaaaattgaatggaagtctgtttatccattctttctttcacggattgtgcccttggtgttgtacctaaaaagtcattgtcaaactcaagatcctctagattttatcctgtgttatctagtaggagttttatagttttgcattttacattcatgtctgtgatccattctgagttaatttttgtgaagggtgtcaggtctgtgtctagcttcattttctgttgtagatgtccagttgtcccagcaccatttgttgaaaagattatctttgcatcattgttttgcctttggccttttgccaagggtcagttgactatatttatgtggatctatttctgggctctttattctctatattctttataatcaagtataataagttttgaagttgggtagtgtccatcctatggatctttggctcctcaagttttaagagtgttatcttagaccaggtgctgtggctcatacctatagtaatcccattgctttgggaggctgagctgaaaggattgcttgtggccaggagttcaagaccaggctgggcaacatagtgagactctgtctctaaaaaaaaaaaaaaaaaaaaaaaattagccaggcgtggtggcacgcacctgtagtcctaactactggggaggtttaggtggaaggatcacttgagcccaggagttggaggttacagtgagccatggttacaccactgcactccagcctgggctacagagtgagaccctgtctctgaaaagaaagaaaaaacaagagtgttatcttagtctgtttgtgttgccatcacaaaatacctcagactgggtaatttataaagaacaaaaatgtatttctcacagttctgaaggctgagaagtccacaatcaagacaccagcagattccgtgtctggtgagggctcactttctgctcccaagatggcagcttattgctgcatcctccagagatgaacactgtccttacatggggaaagttggaagggcaaaataacctagctagttcctttgagcccattttaaggtcactggtcccatccgtggatacaaagccctcatgacttaatcacctcctaaaggtcccacctcttaatactatcacactggaccttaggtttcaatatacgaattttgggggggacacatacattcaaatcatagggggtccagagaccgaaaagttggagaactactgttgtagcaaaagatggacatacacacagatgagtgccatagattcttgtgttagggagagtgcagagtgtagtggagggaacctgaactgagttttgtacatcctactgccttattctggggactgaatgagcctgttgctttaggatacatctctgagagtccaaatttagatactgtgtgacagacttgggcctggcctcagaagagaatctcagaaggacatagaatatgacatcagggcacaggatgcgaagtgccaacctccgcaggaatgagggaacacaaggcagagcagggcagtttgaaagtggttcttccagttctctgagagaaaggtggggcttggttattagggctgtgcatgtaaataaaatgttttgcctcttcatcttcagaattaaaacttttgttaaatcccaagagtcaaccatgttacaggagggaacatttgtatcttatactgcttacctaccacccttgaagttttgcaggaaacactagggaaaaggtggagctttggtctcaaaccccaggcttttttttttttctttcttttttttttttgagacagggtctctcgccctgtcacccgggctggagtgcagtggcataatcatgactcgctgtggcctccacctcccaggctcaagtgatccccccctgcctcagcctcccaggtagcttgtgcgaaggccctgtggcatagagtgtggtgtattagaagaacaaaaacaaaaacaaaaacaaaaacaaaaaccctgtgtggctggagtacggaaagccaggaaagagaggtccaggatggtgctgtactggggaggatacagtcttgagcctgcttagcattgtggactttctctcagaacctgggaagccactaaaagatgaagggagataacctaacattgtacttgacattttgaaagtctcatcctggctatagtatggagagtagattggagaagaaagcaattaatgaactcatatttagttcaggtgagaaatgatgtggcttggtacttgtcttagcttgggctgctataagaaagcaccatagactaggtagcttataaacaacagaggtttctgacagttctggaagctgaaagcccaatatcagcgtgccagtgtggttgggttctgatgaggtccctcttccgggctgcagacttaactgctgtatcatcacatggcagcaagagggccagggacctctctggcctctttagagaggaggtctcgccatgttgcctgggctagactcgaactcctaggttcaagccatcttcccacctcagcctcctgagtagctgggactacaggtgtgcaccaccattccctgctctctctgtctctggcctcttctttttttttttttttttttgagacggagtcttgctctgacactggagtgcagtggcgccatctcagctcactgcaatctctgcctcctgggttcacgccattctcctgcctcagcctcccaagtagctgggactacaggcacctgccaccacgcctggctaattttttgtatttttagtagagacggggtttcaccgcgttagccaggatggtctctatctcctgacctcatgatccgcctgcctcagcctcctaaagtgctgggattataggcatgagccactgcgtccagccttctctggcctcttcttataagggcactaatcccattcatgagggctccactctcatgacttcattacctgccaaatgcccacctcctaatactgtcacatggggggttagaatttccacatataaattttgggaggaatacaaacattcgatctaccgcaatggcagtgatagatactgtgagtaatatatttgtgtgcaaggagtcattgccaaactcaagatcatctagattttatcctatgttatctagtaggagttttatagctttgcattttatgtttatgtctgtgatccattctgagttcatttttgtgaagggtgtcaggtctgtgtctagcttcgttttctgatgtgatgtccagttgtcccagcaccatttgttgaaaagacttatctttgcataattgttttgccctttctcctttgtcaaaggtcagttgactgtatttatgtgggtctatttctgggttgtctattctgttccctggatctatttgtctgttcttttgatagtactacactgtcttgattactgtagctttataataagttttgaagttgagtagtgttagtcctccagctttgttcttctccttcaatattgtgttgctgtgttgggtccttggctccacaggttttaacagtgttatcttaggccaggtgtggtggcttacccagtactttgggaggctgagccacaaagatcacttgtgtccaggagttcaagaccaggctgggcagcatagtgagaccctgtctgtggtagtccgttttcatgctgctgataaagacatacccaagactgggcaatttataaaaaagagaggtttaatggacttacagttccatgtggctgcagacgcctcacaatcatggcagaaggcaaggaggagcaagtcacgtcttacatggatggcagtaggcaaaatgagagagagcttgtgcagggaaactccaccttataaagccatcagatctcatgagacttattcacatgagaacagcacaggaaagaccatgattatattacctcccactgggtccctcccacaatatgtgggaattcaagaggagacttgggtggggacacagccaaaccatgtcactgtctctaaaaaaaaaaaaaaaaaaaagtttttttttttttttaattggcctggtgtggtggtgtgtgcctgtagtgcctgtagtcccagctactggggagggatcagttgagcccaggaattggagattacagtgagccatgatcacaccactggcctccagcctgggctacagagtgagaccttgtctctgaaaaaaagaaaaaaagtattagtctgtttgtgctgacgtaacaaaatacctcagactgggtagtttataaagaacagaaatttatttctcatagttctggaggctgggaagtccaagttcaagacaccagcatgttcaatgtctggtaaacgcttgctctgtgcttccaagatggtgagaaatatatttgtctgcttctaaaaattttaacaaaacctgtgtttccattctctcattgagtggaagaaaaattcctaacagtttacttataatgtaattaacacacctggctatattttgtccaagcatatggccaaactgacagggtaatttagcaccctgtaaaagactgatggacaaagaactgaatctcgtagaatcttgctagaagtcatctggtccagcctctaacctgagcaccccaaagacattgcacctttgccggagccccctagtggcaggaggttgtcactgttgtttcagagtcacaacagaatgaccatgtgaatgatgtacactaattatgagacaaataaccaaagcatctgatggctgtggttgtttcagtgtttgcacacttaattttccctctcctcccctgacctctgcagaatggcttattcagaagagcataaaggtatgccctgtggtttcatccgccagaattccggcaactccatttccttggactttgagcccagtatagagtaccagtttgtggagcggttggaagagcgctacaaatgtgccttctgccactcggtgcttcacaacccccaccagacaggatgtgggcaccgcttctgccagcactgcatcctgtccctgaggtgagtgggcagggcctgcaactctggccatggcagtcctagcatccaggtggcaactgtggccactcaactgttttcatgggttttggagttgttttacttggccacagaaccatgactgtaaggaaggactctcccagatcccctctgtgagggcctgaagaataatcattttttggtcactaatttacagatatttaccttttcttaaaattcagactgtacctgctttgcatgggacagcagacctagacacacactccatcatgggagctggctgtggagaagggcttgaatctcacaatgtctgtgttgtagtcaccccaatcttcccttgccttgaggcagaggtgctgtggcacctagaagggaccttgctgccatggatgctgtccactcctgggcagctgtaagacctgggtcatactgtgttgagggaggataccaggagagatgtggaagcaggtacactttggggggttatataggaagcaaggcagtcattttaccctgccaagctttgaaagggggttattacagcacatcctcattccctcatgtgtttgtgccttcagcacctgtgtgttctgtgctgtcatgctgaagagctacaatgtggaacaggaccccatgtctgccctctagaatgtcccagtctagaggagacaaatgtggcacagcgtgataaacaaaggacagggggcattcagctctgtccagggactcactgactgcatcccagaggttgcatgaagtttttcaggcaaactgaaagaacaggaaggtgctgaaggaggggtacaggaggccccttctgggtagagggaacagcatgtgcagacagggaccagcctgcccagggctagagcatggctggagccctggggctggtcttggaaatgctgttgaggtaaacaactaactctggctccattttaatttttttctccagagaattaaacacagtgccaatctgccctgtagataaagaggtcatcaaatctcaggaggtaagaaagtcactgcttttgtctagcagctctcagggtgatggagaagaagtcagtgaattggacattgagataggagcaggagagtggtcgagggagaccttccttggagtccatattcttctgctgtggggtcacatcagaccctactcgtagccctgtttgagaggcttgtttgggtctttattgaccacacccctcctccaccccaagtctcctctcctgcttcttcctcatccccttcctacactggctccagctaatatatttcattatggttttgatttgcattttcctgttggctaatgaagttgagcattttttcatgtgcttattggctatttgtacatcttctttgttaaaaatgcctatttagttcctttgctcattttaaaaaattgagttatttaccttttattgttgaattataagagttatttatagcctgtaatcctagcactttgggaggctgaggcaggcagatcacatgaggccaggagtttgagaccagcttgaccaacatggcgaaaccctgtctctactaaaaatacagaaattagctaggtgtggtggtgcatgtctgtaatcccagctacttgggaggccgaggcacaagaatcgcttgaacctgggaggtgggggttgcagtgagctgagatcatgccactgcactccagcctgggtgacagagcaagactctgtctcaaaaaaaaaaaaagttctttatatattctggatataaatctcttagcagacatttggctgctaagatttgcaaatatttttcttccattctgtgggttgtcttttccctttcttgatcgtgtgtttgaagcacaaaaaattttcattttgatgaactctaattcatctatttcttttttctttttttggttgcttgttcttttttggtgttgtatctaagaaacgattgtctgttccattgtcatgaagactttctcccttaaaactcctctttaagttcagttttcttcctttaagattctgttgcaggatgttcaagcagaagctttccttgagcctctagtctgctgtacacgcatcttctctatactccttatgaggtgttttgcaaatacctacaacacggctgtgctgcatttagtgtctgtctgacctactatccaggggttggcatactacagtcttgggacaaatccagcctgctacctgtttttgtatggcctgtaagctaagaaattctttttatgtaatggtgggtgcatagaaaccctcatatttttgcaacttcttgtgagtcttaaactacttcaaaataaaaattcattttaaataatccaaagaagaaagtttggtgacatgtgaaattcaaatttcagtgttcataaatagtgttttattggaatgtagctgtgcccattcatttaagtattgtgtatggaaaagttgaaatgtggcaacagagatgatcgtgatgtggactatctgaccccttacagagaatgtttgccgactcctggtttgcgctaaaatagcaagccagcacagcctcagtgacactgtctgataagtaatacatttaccctgggacaggaagctgaaagcatcacccttggccaagcttcacctcctgacctttaagaatgtggggtcaggttcaccatgagtttcacctagttgcagcctggtgcgcagggcattgttacctggcttgtatgtttaatggtttgtcaaaagcatgtatctgagacagccttttctttcagtgtggtgtaagtgtgatatttccattccagctgatgtctggaagtttccacctgccttctgagatacactcgaagaccaaattagtaatagcttaattcacattgctgtaaaactttgaagtgtgtgagacctattatgtttatcttttaggtttttaaagacaattgttgcaaaagagaagtcctcaacttatatgtatattgcagcaatgctcctggatgtaatgccaaggttattctgggccggtaccaggttggtattactcatgaacgatatctgcttttgccatttttccaggaatgtgtgttgaacccctttatgtgacagttactgagctaagcatggtacagggattcagtgaattgccctcaaggattcccagtctagcaatacaggtggctacagtgctgtagcccacctacggctgaggtgtgagtgaagaggttcgtcctgtatggagcgcatggaggacatcttgtatccactagaccttaattgtgtggtagggatcattgagccaaaagagagggcgtgggacatgctggacaaaacaaacactcaagaatatgccattttgggggaactgtgtgggacccagggcatgactacagaaagacacaattgtgaggtccttccccaaaagcatttgctctctcacttggtgctgtcgtaggtgtttcccagcaactgtgggacctggcctcatggggtttatgatctaacggagatcactcagaccaggacagagacaggctgtgggttaaaggtgaagcattgataggagagacaaaccaacaaggtgtaggggaaatgtgagtgaaggggaattgatgcctttcaaatgaagtgaccccagctgctcttccttccagctagggaaggtggttaaaggggaagctggaagtgtggcgctgcctggcaggcccatgtcaagtttgatcacactgcaagtgaacatgactcaggcttctctaacttctagggaattgctgagaggctgctgaaatttctcccgcacacccacacattttggaacacatatttcagatgattcagtcttttctctatcacacctccaaatccctcagggactgagcttataaatgtgtaaatgatttccttgttaatccaggaatttatttggaggttcatagaacttttgttatgttttcatgtgtcttttgccccttgttttgaatagtcgagtcctagagcaaggccttttttccaactttgttgtcactaagcctaaaaagtaagtgaggctcaaatggaccattgaacagctttagtgaccaaaactggcttatggagagcagggcctgggttctctccacctgtttcttttatatttcccctcattccttgtttcccacccacccacttctatggtaaggtgtagaatcttacaggtagcagagttttgatgaatgttgactgtttgggtgagagttgaggagtaatatcaaccaattttggagaagagatggattccaactgtgatcaccatatgattcttactaccagaggtgaaggagaatagctgcatttgtttatctcactgtcaaaaaactgtttgctttttcttctgagaagggatcagcaaactctcttaagagtcaaacaataataataataatcatcatcataatcataaaagagccagatagtaactattttaggctttgcaggccatacagtctctgtcacaattactcagctctcccattttagaggcaaagcagctatagacaatatgtgaaggaataggtgtggctcctctccaataaaactttaattataaaaacaagtagcaggccagatttggcctgtgagtcttagcttgccaattttgtcttaaaggaccctcagggggacaagttctctaacattttgttaacttgccagcatcacaataactgcagtgattcaaaggttttcactgagatatgcctgcttttaaacctctagaatgttggccaggcgtggtggttcatgcctgtaataccagcactttgggaggccgaggtgggcagattactggagatcaggagtttgagaccagcctggccaatgtggcaaaaccctgtctttactaataatacaaaaattagccgggcatggtagctggtgtctgtaatcccagctacttgggaggctgaggcaggagaatcgcttgaaacctgggaggcggaggttgcagtgagccaagattgcgccactgcacttcagcctgggtgacggtgcgagactctgtctaaaaaaaaaaaaaaacaaaaaaaaacctagaatgtccagcctggccaacatggtgaaaccctgtctctactaaaaatacaaaaattagctgggtgtggtgcacacctgtaatcccagctaatctggaggctgaggcacaagaagctcttcaacccaggaggtggaggttgcagtgaacggagattgcgccacttcactccagcttgggtgacagagagagaccctgactcaaaaataaaattaaaaaaaataaaatagaatgtgaagaaccctggaatgaacactgtccatgtaatcattctctaatattaaataatattaaatagtatatatagttatatattacatataatatattaaatactataatatattgtttataataaatacattattgacatgtaaataaatgtttatttttaataataaataacagaatatttaaaataacttttaaaataaaattagagaatatttaaaataaaatttaaataacttattatttgtgttacctaggctggagcgcagtggcacaatcatagctcactgcagcctcaaacttctggactcaactgatcctcccacctcagcctcctgtgtagttgggaccataggtgtacaccgcaacacttggctaattaaaaaaaaaaaattgtggagacaaggtattggggtctcactgtgttgcccaggctggacttgagtcctggccttaagtgatcctcccatctcagcctcccaaatttctgggattacaagcatgagccaccacacgtggccaataaagtattattaatggttaaaaatatttcctgactttaccagtctgaccattcctagcttctcttgggcttgcacacctatatttcctctgcctccttttctttatcatttctggaatagcttactgtcccttcttttcatcttcttaatcctttccctttcttccttgagttaggatatgcccttctctccttttttccttttcctgtgtccttttaccatctgctatgcagagacccatacctgatgctggaggttgggatgaagagtccacaaaagaaataaaaatgtccttgaagaactggtaaattaaggaaaatatccaagaactaacctgagaatatgagcacattattagatcatctaaaacaaacttggtgtacttccctcttcacctatcttcccctgtcctctgaatttcccccagccaagactggctttcccatctctggtacaagcagccctccccatgccctctcctcagcagagacagtgggcagcatcccctgagagcctaccctctgccttgccctgtgcaagcctttctgcccagctgcccaccctgttctctctccctccctaggccttccagctgacttctttcctaccaccctggtcagcaggtcccactggcctgttgttatctgttgcaggatcaccttcagcagtgcttatttcaacctgtgcagtgttctaatgagaagtgccgggagccagtcctacggaaagacctgaaagagcatttgagtgcatcctgtcagtttcgaaaggaaaaatgcctttattgcaaaaaggatgtggtagtcatcaatctacaggtgaaaaacaacacatacaacagtcatctttatggagctaaattatgcctgagtggtcacagtgaatcaggtggaatgccagaagaacattcctgcatttatttttgtacagaattaggtctaaagaatttgctttttggagagaagttctgtgaaaagcttaaaaccttcttgttggtagcactccatttattattggcaaaaatattatttgaacacatgctgtgtatgtgtaatgaatgctgggtgctgagtcacaaggaggtgacaataatgtctactctctgaattctgcagtgtagctggggaggcaggatgcaggcataaaaagaaagcatgggtaccttttacatgtcccgaaggagctatgctggcagttccccaatctaccttctttgaatcctgtgttctatgactttcttttggaataattggaaaatttaatattttaattaagttcatttacacctagaaagtggacatctttaatccttttttggaattaggcaataacttcctgtagagagtaagccacgtgacatataatccccaaagagacacaggtgtaatcactgtgaggccatgaaagacaaccctttgttttattgcactttctctatttcagaatcatgaggaaaacttgtgtcctgaatacccagtattttgtcccaacaattgtgcgaagattattctaaaaactgaggtaactgcaaataatcctctctgtagattttatggaagataacgttttagtaatcattgtggtctgtgtttgatacagtcccaaagataagggcccagggcttaaattacacgcatgaccatgacgtatctgtcttcccttctctttttcctgcgaactctcttcaactttcatcatagctctttcttgccaggcctctctccttctcctggtccttgccttcttcccaagccactcttggctccctgattgctgcagttggagaataagtgatgaatttctatagcttgtgactatccatttcgtaggtagatgaacacctggctgtatgtcctgaagctgagcaagactgtccttttaagcactatggctgtgctgtaacggtatggaatgactttttgtttctgcctatacattctactgtataattcacttggcaagttcagtttactctctgttccatcgaggatggagaaagacatacagttctgagaaatttaaggctaattattttagagttctccagagaaacagaaccaatgggatatatacatatatagagagatttattttaagaagttggctcttgcagttgtgggggctagcaagtccaaaatctgcagggcagctcagcaatctggaaactctggctggagtttctatgctgcagtcttgaggagaagcatttttttcttcaggaaaccttagtgtttgctctgaaggccttcaaatgattggatgaggcccaccacactatggagggtaatctgcttacttcaagtctaccaattgttttcatcacatctgcaaaataccttcacagcaacatatagacttgttttgagcaaacaattgggcaccatagcctagccaggttgacacataaaattaaccatcacaataattattcgggttttttttttttttttttttttttgagacagagtcttgctctgtcacaggctggagtgcagtggcatgatctcggctcaatgcaacctctgcatcctgggttcaagcaattctcctgcctcggcctcctgagtagctgggatttcaggcacccgccatcatgcctggctaatttttgtatttttagtagagacagggtttcaccatgttggccaggctggtcttgaacttcagacctcaggcgatgcgcctgcctcggcctcccaaagtgctgggattacagcaccgtgcctggcccacagtaattatttctaattttgattccattgcctccacctggtttgggaaccttctggggttactcctctcatgattacaaatcctggttttatggtgatatactcttgtatatcaccaagtatactgaaacaaaatggacttaaaatcgtgttttaatatgtatgttattaccttttaaatactttaaaataataatgaattacacaaaataaaaataaaatttgatttctacttcagtctttttaatagattccaggtggagcaaagttttaggcattaaaatatgtcatgctctgtattattctgtattttctgtaaatctaaaattattccaaaataagaagttaacttcagaaatcatgaaaatactagaaggaaaaatgagtgaatttttttattcttaaagaggctggtgcgatggcttatgcctgtaatcccagcattttgggaggctgaggtgggtggatcatttgaagtcaggagttcgagagcagcctggccaacatggtgaaaccccgcctctactaaaaatacaaaagttagctgggtgtggtggtgcacgcctgtaatcccagctacttgggaggctgaggtatgagaatcccttgaacccgggaggccaaggttgcagtgagccaaggtcgcgccactgcactccagcctgggcaatagagtgagactgtctcaaaataaacaaacgaaaaaacccccccaacaacaacaaaagccctttcttaaatgactaacacaaaaccagaagccataattttgataaatttgtaaatatttaaaacttctgtatgattttaaaaaataccataaagtcaaatagcaaacagtgaactggagggaaaagtttgcaacatatgatcagacaaaaaaaaggggggggctattttccttaatatacaaagaaaccttacatgttaataacctactcaacttaatggaaaaataggcaaagaaatatagtatatgggcagttccagaaaaaaattcatttggctgataaatgtaagaaaagatgctcagtttcactcctaaataaatatacattataacaagaaatatactttaatatcatcaaattgacaaagattaaaacatcttatgatatctcactttttttagggcaatttggttatctctatgaaaataaaaaatgaatccacacattgaccctgcatttctgctaggatttatgttacagatatcctttcttaagttatacagtgatttcacatacacaaagacacacaaagatgtttattctactattgtttgtatagcaaaaaaaccccacaacccaaagctaaaaacaacctgtaagtctatcattaaaacaccaactatataattatgtattcatattttagaatactatgtagctgataaaaatgagatatatgtaaaaaattaaatatagtatgttctcatttgtgttaaaaatgtgtatatccttactgacactctggtaaaactaggaaagtgggtgtggagatggacagaagaggccttttactttttattcttcatcttatgttgtttgacataagcacatatttcttttattttaaaaaccatttgaaaaaatgtatattctgagaaggatttaaaaaaaaatcagcgaagagtctataaatttgtcacatatcaaaccagaggttgtcttggctgcaaaaagaatagggtttacctttcttgtgcatgagcacaattgtccagcttgggcaacatattgaaaccctgtctctaccaaaaaatacaaaaatcagccaggtgtggtggcgcaccctgtagtcccagctccttgggaggctgaggtgggagaatcccttgagccagggaggcagagattgcagtgagccaaggtcatgccattgtactccagcctgggcaacagagtgagaccctgtctcaaaaaaaaaaaaaaaaaaaaaagcagaattgctttctagctctaaaaatgatctttacagtcaggcccaaatctccagttggtttgtattctagaacttgcctcagcaccagagcttgggatggctgggggagttattctccggaaccttatttaggacagcctgtcaccaaagaagccaaccctaacccgaatgaaaattgatgataaatatttagttaaactgcatggatcaccttgaacacctaacaaacatttgcttttactgtaatataggcagtctacaaaaaaaaatattttaatgattagggaaaaagcaaccatttcttcttgcaaatgtagtctatggttttgagggcaacaaatttgtatgggctgaaattaaaatcaggtggcattcctcctgcccatggcagccagtccgtgattggaggcagcatggaaatgtgcttgacaggaggaagaactagcgttgacttaaaactgatttgaagaggccaggcgctgtggctcatgcctgtaatcccagcactttgggaggccaaggcaggtagatcatgaggtcaggagttcgagaccagcctgagcaatatggtgaaacccccgtctctactaaaaatacaaaaattagccaggcatggtggcatgtgcctgtaatcccagctactcgggaggctgaggcaggagaatcacttgaacccaggaggtggaggttgcagtgagccaaggttgtgccaccatactccagcctgggcgacagagcaagactccatctcaaaaaacaaacaaacaaacaaacaaaactgatttgaagataaccctcaaaggagataggttttatatgggaatagttgagagatgataataactacgcttaacccatagtcatatactcccagggcaaggaagaaaatcagcactgagaattttgatattggcctgattctctgtctcatggatattgtagaatcctaaagctggggccaggtatggtggctcaaacctgtaatcccagcactttgggaggccaaggtaggcagatcacttgaggtcaggagttcgagaccagcctggccaacatggtgaaactctgtctctactaaaaatacaaaaattagctgagtgtggtggtgcacacctgtaatcccagctactcgggaggttggggcacaagaatcgcttgaacccgagaggcagagtctgcagtgagccaagatcataccactgtactccagcctgggcaacagagcaggctgtctcaaaaaaaaaacaaacaaaaacaaactaaagctggaaaagggacccactggagtcatttttcctgcaacccacctagagactggtgcgtgtttaaactattaaagtaagcaaagttgttaagattctattttagcagaatatcctaccacctctttcatttttggagcctctcagcaacctgacttatttttctcttcatattgaaggataaacggaggaacctgcagcaacatgagcattcagccttacgggagcacatgcgtttggttttagaaaagaatgtccaattagaagaacaggtaaatcttcaaaggttcaaataaaaagtgaggcaacagaattgctgggatttacctgctctatgctggtatttttctattctcccctgtttcagtataagtcaattagaggtagatgtttttctattaagtggccaaacaggctcataggattatagaacattagaattggaaggtgcccttaggatccttgggtccatcctcctcattcaacagataaaataactgaactctgagaaatttttatatgttttaatcgtaagtagcataattcaatctcaaaatccatgtcctctgattctaagtccagtactccccatggtataccataactgcctctcaatagcctgtctacacaccttttggttaatatctgacacttagcaatttgatgtttcagttaaattaatattactgtgaaacaacagttgactattctaagcactatgggttttataaattttgtgataagtctaaactgcctttgcagaagctttgcaacccaataaatgcatacatacacacttatttcactgagttgtgattatcaagggaaattatatgcaaatgcctgccatagtgcctgtggcattcctattaacctcaataaatgctgattctattgagcaatttttaggaaagttaattattttgttagaacatctcagaaaatcagacttttcaagcccaggtagggaagaaaaccatccattttcagaaaaggagctgatgtttactactgcagatgattttttgatgtctgattttctattaaagtaggtgtgtgagttccagggtcagattctggagaaaattaggaagactgattaaacagtaactttggtagaaggcatgctccctagtaaccgttcccaagttttttctgtatcagttgcctcattcatccatcttttcattcaagaaacacctactgtatgtcaggtacaatgtttgctgctagggacactgagccaaggaagatgtagcctctacccttgaagaactaacataaatgtaaacaggtaagttgtcatgccttgtaggacatgctgtaactcagtctggggtacagagactgcagcagtttattctaggggagttggggaagactttcaaggtaagacatccaagctgcctcttgaagtaggaaagattcatcagttaaaatgttgtggaagaaggacatccaaaagggagagcttgcactgaagcagggaggcataagaaatcctgatgagtcaaggaaatggggttttaggatgaatggacttctgagtgtgagatagagaaaggctagagactggtgtgttggatccagattgcagtggccttccgtgtagcctaagaagttttgaacactgcattcaattatttttttatcatttatactctgccttgtttcagaaaggttttaagggccagaagtttgaactaatgtttttttcaataatagggagctaatggaggtttcttaattggaaaacacttggtcagctaattgtttgtttgtttgtttgtttgtttgtttgttgagatagggtctggccctgtcacccaggctggagtacactggtacgatctggactgtctgtaatctctgcctcctaggctcaagagattctcctacctcagcctcttgagtagctgggactataggtgtgcaccaccacactcggctaatttttgtattttttttgtagagacagggttttgccatgttgtccaggctggtctcatgagctcaagccatctgcctgcctcagccgcccaaagcggtttgtttgtttttcttttttaaagcaagacagttggtaatagcatggcaattgataagagtgaaggctctggagccagaatgcttgggtttgcagccaggctgcacactagccatatgagtttggacaaactacctcatttctgtcatccccagtttcctcatttgtaaatggggttgtggtgatggtaaaaagggataatatagttaagctagtagtacaatgcctaacacataataagtacttcaatagtaggtggaagcaagatgctggaggtggtggtggtgatggtgaaggctcaaccaagtccatgtcagtggactggaaagagagagagtatcaagaggccttctgaggttgtaaatgacatgcagaaagctgagtagggaggggacatggtaatgatattaaccaagatgggcactacaaaactggagcatgttagaggtgagggtgcagagagagacaaggagtttgcttttggtcaggcaggtaggtggaagtcagctctaggggtctaaataaaggattccagggccagagatcaaatgattgtctcagccatttgtgcattcattcataaaatatgtatcaaatgccctctctgtgccaggcactgtcctaggctctaaggataaagaaataaatgagatgtagtctcaagatacaatttaatggagaagaccaaaacaacaacaaaaagcaagttataagcatgataatgatgatttatacactagaatatggacagggtatcatggaacttgagaggtggtctcggcgggtggtgcaagtaaggaaatatttccaagaggatgtacccatgagtggaggcttaaaaagtggtagtttttagatgaagagagaggtgtctgagagggcagagcctgacaaaataggagttgtgtggtcttgctgggcaggatgcatgtggaatgtgaatgggtttgaggctgaaagtgtagccaggggcaggtcacgtagggcccagtgtcacctgtaaaagcaagccactagaaatgtttatgcagggaaggctcaagaccagatttgtctcttaatattattctggtcacagtaaggagtacaaattgaaggagaacaagactaaagccagggagagcattcatgctgttcattcatttaacaaatatttattaagcacctactggtaccaggcaccagtccagttgctggggtcatagtggactgtgaggttcatggcagttccagctcccatggaacttatgttctggtgtgtgctgggggtagaatgggtagagcaggaccagttagaaagctgctgttgcagcccaagagagaaataatgaagactgaaactagtgctgaaatgagaaatggatttaagtctttttgtttctgttgtcatgttaaaagttaaaattggcaactgttgcagattgaatggatatgggaataagagaagagctgtctaggatcagctttaggtatctgtttctttcaagtagattataaaatctgtcaatatgctacccacgcattttgcctatcacttgctggcttgtatgctggatgggttacttaaactctctacctctgtttcctcatctgaaaaatgagtctaatattcgtgcaactcatagggttctttgaggcatacaagagctaatgaatataagggtatgatagacagtcagcaagtttttgtcattattacttttgctactgtgcatgtaacatttaatgtggtatggtgatcagtactctttggtggtagttttattttgttttaagagacaaggtgtcactatgttgcccaggctagactcaatctcctggactcaagtgatcctccccatcagcttcccaggtacctgagattacaggggcctggcttctgtggttgcttaataagtccatgttgaatgaatgaagagaaccagttcagtaaattcagtcaggtgatgtctgtcattaggtgaaccatcatagtaggttaggtatagaaaaggctgatgagaaattctgtagatgtggctttttggaaccacctgtgaatatcttcctataattatgtaggaatctaccctgtaaatattttcctagaaataaatatgtagattttttcctagaaatactttcttagctgcaagtgcatgcatattttaactatatgcatgcagttatattcagtgactttatttttcctcacgttcctgttattagatttctgacttacacaagagcctagaacagaaagaaagtaaaatccagcagctagcagaaactataaagaaacttgaaaaggagttcaagcagtttgcacagttgtttggcaaaaatggaagcttcctcccaaacatccaggtaagaaatggcctttgcgttgaaagccaagatttggctttcaattgcagtgagagtttttcttttaacttcttaaatagaaataatttaaaatatacagaaaagctgtaagaataagatggtgcaaagaacacttgtataacctccaccctgattcactcatggccaacattttgtcccgtttgcttcatcattcatgctcccctccactgctcctcccccgacgtgtatgtgtgtgtgtgtgtgcgtgtgcatgtgtgtgcacgtgctctctctaaaccatttgcgagtacgctgcgtatattatggccctttacctctacatattaatacttcagtatgtatttcctaagaataaagatcttcttttacacaaccccagtacgtttagcaatatcagtaactttaacattgatacaatgcttctatataatttatagcaattagggttttaattaatgttgggccatattaatcacttgattgcagattcattgagagcatctgtagttctgcattttgtggtcaacaagtgaaactattaatttccttgggaagaaaatgctttaaacatcactaaaatatagcaaaaataatactttgtaaattatgaacattaaataaccataaatgaattctgatgaataatgtctttatcatgattataaaatttatagtgaaaaagatttcaagacatgtggtgtaggcaatatatttgaaatttaagttatcccagaaaatctaggccctataatttccatacttggccagcacattatacattaaacacacacacacacacacacacacacacacacacccttcatatacatacaatgtatatgtatgtgaaatatatataaagtatatatgcacatgtgtatatacattaatatgcacagatgctccttgacttacaatggagttatgtcctgataaacccattaagttgaaaatatcgtaagtcaaaaatgtgtttgatacacctaacctattaaacatcatagcttagcctagcataccttaaacatgctcagaacacttacattagcctacagttgggcagtcatctaacacaaagcctattttgtaataaagtattgaattccacatgtaatttatcaaatactgaaagtgaaaaacaaaatgggtactttgagtagccataccttatattgtacacacataggaaaagggaggagtagttttatttagtctcttccacctgagagagcagtcaaaagtttaggccgtactcagggccttctgcaccacctgtagagctcaggccagaacaggtgggcgtattccatttcattctccaccttctagcagagcaggagtgaatcaggagattggcttctaagaagagaaagaagtgatagggcaagaggagaaacaacatgaaaataaatatataaagataggttggagaaccaagcagagggaaacagagggaggataaaaatcagataaagaaaagttcaaacatttagaacaggagctgtggtaggagaggaggaggaggaagataattaggtggctcatctctctgtgatcctcattgaattttattttctgggcttgtatttttcattctgttaattgattaaatgtgatatgtttgaattgaaaaaaattttaatctcaatgaattgctaaaatattaactaattttttaaacatgattatccattttgtaatgaaaggtttttgccagtcacattgacaagtcagcttggctagaagctcaagtgcatcaattattacaaatggttaaccagcaacaaaataaatttgacctgagacctttgatggaagcagttgatacagtgaaacagaaaattaccctgctagaaaacaatgatcaaagattaggtatgtctgatattttatttctcttttggtgactcatttgtctgcatgtgttcatgaaacaaccaaacacctggccaaatagagagtcacatctgtccaggataaacaatggctgaatctgctatttgtgaaagagaatggtaagattctggccactcaggcaaaaatgagggagggccacaaggggggttgagggactgggctaggaaattccaagactggaaacaggccagcaaattccaagaaagggattgatgactttaaagaagaatgaaaaataatgagaagactcagggagagatgtgatgggatcattgttttaggtatggaaaaatattaaagggtttggccatttaaaagcattctagttagaaaagtttggggctcagcatgctgattcacgctagttgaatgctcagtgtgtcttctctacacttcagtgagtttaagagtacacatctaggtttccttggaggcactgtgccaagacatgatattccctgagttaatattactacaacaaatgaattcagctcatctttaggatggcaggattttgttgattctctttcaggtaacaaaattccactttgggaaaattttaaagataacttttaggcctatggaatcttttttttttttttttcttatttgcagccgttttagaagaggaaactaacaaacatgatacccacattaatattcataaagcacagctgagtaaaaatgaagagcgatttaaactgctggagggtacttgctataatggaaagctcatttggaaggtgacagattacaagatgaagaagagagaggcggtggatgggcacacagtgtccatcttcagccagtccttctacaccagccgctgtggctaccggctctgtgctagagcatacctgaatggggatgggtcagggagggggtcacacctgtccctatactttgtggtcatgcgaggagagtttgactcactgttgcagtggccattcaggcagagggtgaccctgatgcttctggaccagagtggcaaaaagaacattatggagaccttcaaacctgaccccaatagcagcagctttaaaagacctgatggggagatgaacattgcatctggctgtccccgctttgtggctcattctgttttggagaatgccaagaacgcctacattaaagatgacactctgttcttgaaagtggccgtggacttaactgacctggaggatctctagtcactgttatggggtgataagaggacttcttggggccagaactgtggaggagagcacatttgattatcatattgacctggatttagactcaaagcacatttgtatttgcctttttccttaacgtttgaagtcagtttaaaacttctgaagtgctgtctttttacattttactctgtcccagtttgaaacttaaaactcttagaatattctcttattatttatatttttatatttcttgaaagatggtaagtttcttgaagtttttggggcgtttctcttttactggtgcttagcgcagtgtctcgggcactctaaatattgagtgttatggaggacacagaggtagcagaatcccagttgaaaatgttttgatattttattgtttggcctattgattctagacctggccttaagtctgcaaaagccatctttataaggtaggctgttccagttaagtagtgggtgatgtagttacaaagataatatgctcagtttggacctttttttcagttaaatgctaaatatatgaaaattactatacctctaagtattttcatgaaattcaccagcagtttgcaagcacagttttgcaaggctgcataagaactggtgaatggggtaagcattttcattcttcctgctgaagtaaagcagaaagtactgcatagtatatgagatatagccagctagctaaagttcagattttgttaggttcaaccctatgaaaaaaactattttcataggtcaaaaatggtaaaaaattagcagtttcataagattcaaccaaataaatatatatatacacacacacatacatatacacctatatatgtgtgtatacaaacagttcgaatgtattttggtgacagtaataaatcaatgtgaggatggatagaatttagtatatgatagagaaaatgtcataaatggataaaaggaatttacaacttgaggagaaaacctttacaatttcctatgggtgtcagaagtactctcagcgaaaactgatggctaaaacagtatctactattctctgataactttttttttgagacagagtttcattgtcacccaggctggagtacagtggcatgatctcagctcactgcaaactctgcctcccgaattcaagtgattctcctgcctcagcctcctgagtagctgggattacaggcgcccgtcaccacacccaggtaatttttgtatttttagtagagacggagttttgccatgttggccaagctgatctcaaactcctgacctcaagtgatctgcccgcctcggcctcccaaagtgctgagattacaggcatgacccaccgcgtcaagcctctgacaactattgaatttgtaagctgctatgcaaatgggcatttatataaacttgtgatgtttcttgtcagaattctgagtactctgtgaagaacagaaatgatcatattcttatgcatctatctgtatgggtctgaaggtgtatatacaaactgagatgagtccttatgactcttgataagcctgagtttaacaacaacaaaaatgccaagttgtcctgagcccttctgcgttgttatgccacttccctactgctcatatgcacgctggctcccctgggcacgcaaggatgagtatgggccatgggcccctgtagagctgcttacctggtgatgaccatgcaccttacaatttctgaacagttaaccctatagaagcatgctttatatgagtgtcttctgggaagaggaaccttcttaatctcttctgtgggattttcaaaatgctaaagactcacactgcagcaatcatcccagatgattaaattcaaagaaataggttcacaacaggaatatactgaagaactagagtgtcactgctggtgaactgtggcacggttgctcaacacatcacctcggacaaattcaggaagcatttctttagcccacaagtccagacccaggtgctctgtatgtttgtttttaatattcatcatatccaagttcactctgtcttcctgagcagtggaagatcatattgctgtaacttcttttaagtagttgatgtggaaaacattttaaagtgaatttgtcaaaatgctggttttgtgttttatccaacttttgtgcatatatataaagtatgtcatggcatggtttgcttaggagttcagagttccttcatcatcgaaatagtgattaagtgatcccagaacaaggaatactagagtaaaaagcacctctttttcac

SEQ ID NO: 36585 - DNA, 97776 bp, Homo sapiens
agttgtacgttcgaaacctgtcgccgtcacttgcgcgtttggcattatccattgtcaccgcggaggaacgagcgctcgagatatcatcagtgcccgcaaatctccgcgccaaggcgctgagctactcctttccgaggtgcgcctctggtcctccgtccctggtgcccagcagcggcgaggcggcatctccgctcccgccgccgtgtccaccgagccctgggatcagggtggcagttctcaacgatgggcaggagggacctcggcggcgacccctaaaacaataccatgccccgggatccccgctgctgccgcgccagcgtcttccctttccacctccctgaccctgtcggattcggatgagcccattgcaaggagaagacgcagccgtcaggtaaaaggggctgcgttgccaggtgaagtttccagtaaccggccgagctgctgctacgctggcaccacgctgtctcttcgggggattttttttttttgaaagagctgggggtggtcatcttaagtggggtgctctaggctttgtctttcacctggagagaaaataggcagcttagctctctctcgactttggggacatctgtctgctggtcgaatccacctcctctacggagcatcatgactgagttctgggtcaaaacgcaaattttcttgcctggtagatgcatcgatgctaaattggggttctcagtgcccctaaccttgtcagagttcagtctcctacttccctagattgaatctcttaactttcaccagtaacaaccctctcccctccacaagctgttgttaatgtcaccagcgttattatcaggctgttgtatctaaagacaccaacctactacctgcccgtaatctgggatctattagcagttaaacagatgcggtggatactaattccttttccttccagttggtgggggcgggtggggctttttccaaaaccaagtcccttccagccctgcttgtcctcttcgggctggcgggcactgagctggggccatcacgcctttctagagcgcctgcggaggtggcgaaggcttggagagcatacgaggcggaatccggatcgagtgagttccttgagccgcttgcgtgggacgcagggagagggcgaataacgccctcaggcgctgaatgcaggggcaaggagccagcgagggtggctggagcaggccttgccagctgttaccaagtctctccacaggcttgggggcttggggcctcctggaaagatccctccgccgcgctgaccagtacggggctcgctcccgcactttgaaggctgccgcggtctttcgtcatttataatcaagcccaagatcaaggttgcaagctgaggtcggggtactgacaacgggaatgaagccataggggaagaggataactgggacgggctggacccatacttgatacccgggaaactcctagagcgtgtggtgctcctgccagcggcagttactggtggagctgaggccaccgctactgtcgtcgttggcgctttgcttctggaacctcccagcaagatggcactcactgtctgttcccttccgattagcacccccagccgcgctccctcctccccgggatacgtattagtcacatactgtggggagaagatgggctatgtaaatgtaagtcaacgcgctttcccagccacctttgcataatgcaacaggaacagcgacccgcgcgcacgaaccgggtagtgtgcgcgtgtgtgtgctcgcgtgtgtgagcgcgtgtgccagcgtgcgtctccgcgcgggcgtgcgtctgggtggatccttgcgtggcttgggaggcaaatcgggcgtttctccaagtcgtcttaacatgatttaggctctcaaatacgtgaaagcggtagacacaacagggatgcgaaggaaataaaaaacaattggggaagtggtgccaagtcactcaggctttgaactgaggacgagtagtgcggtcgcgcctggggcgcgtccggaaatcatcctcagcctgtggcggccactgccccacttaaactcttctgcggggagagttgagcggatccctggggggttggtcctgggctagttttaaactctccggttgcatctcgcgtggccccaccgacggcgcgtctcggcgtagctcttggcgcgggctcgttctccctcttctgttcagattcagcctcaccggacttgttacaacatgacagcaacttactggaggcaggaagagcagcacgaaataagatgagaaaaccaaaaacatctcctccttcctaaatagagacgtgcacctagctttttttacttgtttgtttgttttttacattaccctttaacctttggaaagagactgcgaagtggaaacgttgcctgtacagaaatcaggcttcttagctgtcaagactgtttcctaatctttaggctgaatctttctttgtccgctgcaatctatggggaaatttaacaacgctcttgccagaagcagccaggttgaaggaagaaagtgggggtgtttaaattaatcctattaaattttggattactcccccagttaaagtcatttaaggtggtccaggatgagggaactagtgatggggtgaggagtggggggcacatcaccaaggttgcctgcatttgaaataacgccattttggttgagaggtttgctgtattttaccctctaatctcacatttcgatcatttctcagtgtctaagtaatagatcctccctcttggcagtacaccattaagcaggtatggggaattctcctttcagggttcagatggtgacattatccctaaggactggtggtaggaacggcatgtgccgggtagatagagagaaggtcagggtggcatctgccgggttagccaggcgctcttcaactcttttcagagaggacagggttaaaagccaagtctgactttgcctcttggaaatcactgggtagcagccgcgcctcccaagcattctttaaaccagaaaagtaggagggactccgggagagagggagggaatgagggagggagagaaagagggctccaggagcggagcgcgccagagcgcgagggacggagggagaggaggagcgcgggagctgcggaggcgatcccgcgaattcattactgtaaacatatccgggggtgtcaggaggggtaggggtgggggccgcggcgcctacattagcccggccgcgtcggattgaggcagtagtgtggtctgagcagcctccagacccacgccgggcgggcgcagcacttggagcgagccctgcgcccgcccccgcgcagcgccgcacgcccggctccgagctgtccgcacacacgcgtcggaggagagcccgcctagctctcccgccgagtcccgggatcctccaaatccgaggagctccggcgccgcggggcagctttctgccgccttccccgctcgctgtacttcttttggggttcgttggcttggcgaagcggagagggggaggcggaggaggagagaaggcgggggtcgcggcggccgaagccaagagaaagtggcatgcccgaaccctggaggcggtggtggcggaggacgggggaagacgatgccgcagctccgtaggggacgtaggcgagagcaagcgaggcgagctgggcgccccggccccggcccgctgcggggaggcgcgcgccgctctgaggctccggcctccgcacccccgcgccccgacgctgcgggcgacagggcttggctccagcagccgccgccgtcgccgccgccgccacccggaggacccagcaaaagtttggatctgggggagggcgcggcgctgagcgggattaccaccagggctggaaggagacctcgagaacctttgcaggtaacgcgcgcccccaaccctcttcttccatgccccgccgctgcgctcccgcttcctcccagagcccttcctggccctcgcgggtctggcagaaagtaagagggaggcgaagttcaagatcccggggatgagcaccgagcgctggcagatcactagtcacgttagaggggcagctgtgctgagaggcaaattcccccaggagtgggtgagaaccctcagccccagctggtgcctcatcttgtagctctttggaaatttggaacgtgaatccaggggcttttagtattcttcagtccagagaaatggttcatggatttcacttaccgcacgctccccccttcacactctcacccgtttagcatttttaaaaaatgatttgagcccactccctactctcctgcttcgtttagctggacagcaaatttcaggggtgaaatattgcaagcaaagaggaaaaaatatcctttccccttttgacatccctggaatcctccttccctcccttcaccttctggcatcataaaataggaactttagaagttacattttcaggggtgaggtgaaacgtgttagctattggtgatgtgaatttgccacgactgtccgtatgtgtgtctgtgtgtgtgcgtgtgtttgggggagggggttagtggtgttgcagagaggcggaatttttctcggtggcctgatgcgcagtggtcctaaggtagtgagtggccgcgtgtgcgcattgaggcggcggcagcggagagaagacggtcacgtttcccgaacggcagccttacttaggctaagaaaatagctgcagctcactccaaaagcaaaaagattccagccccaactccccgacgccccctttcccccaactgagtttttagtttcaaagcagctcagcgtttgctgctatctttattatgatcattatttattcgcctggaaactcatcctgtcttctcctgtgaatgggaatcagtcttcaagagcttttgattaattttagtaagagaatctcttgtaaagcttacagttagctaaccaagtgtaaggcacaaatccgtgtaaacgctcgctcaagagtgcaaggtgctgattagatttctttacatgctgcatttgctatgcaaagcctcttctaaatgggagctattgctccccactcagctgggaggctctttaatcacacagggtttcagggcgctttggagcatgtccactcgctcacagacttattgctaaatttattatgtctaatttctcacaaccaaaagctaatctgaaggctagcttccatatcggaccgatattatctgtagacttaaccggtatgaccttaataaatatccaatgaaaagcccccccccaaaaaaaaaaaacaacaacattttgaggtaaatagaatgcagattggcatttgtccagggatatattaggttgttcagtgtgaatgtaaaattttaggtccgtatttgaagtgttagaactagattctcacttgttttcattactgaacaacatgggccagctacttatgacgggcaagccaccagccaccatattagcagagaatcaatctgtaggtaatacgcataccatgaaaagttacttctttctccacagcgttattgcgtctgagaatactacttctcttcctcccctccttgaaagcccgaaacaggatagggttaaaccatttagggattttttaataatcactgaagacagtgcaacaccatactgtcatgttgagttgcaaatatctttgactggaggaggttggaagatgaaatttcaaacattattccatgtctctgccagtagagatacaagaaattgtaaaaagaattgggctagctgtactgtagcagaacctattacaaacctagcatggaaggaatgctgtttttttttttttttttttttttttttttgttgttgttgttgttgttgttgttttaaagcccatgtcttaacacttcagtagtttcattgcagttttagaaattccaggggatgcttttagcagaagaaagtagattcccaaatgacaccatgctgggctaccctggagtccccaaagcagtcctggcttttcctgtatgttaggtttcagatgatgtgatcatatacgagtttgactttgaccggctggatctaatttgaaccttctctgatgcccgttacatttatattctggcctgctggagagtttgatttaggatttagacaactttatattttcccagtttgaagctgtggttttaagaaaggctcaagtatgtacaagtccagaagctttattctgtagagacccagtgtgaacatctgatctagtttgactcttgagctttgtactttacaaggaagaattcctgcttctgggatctgaagcgtctgaagttaaaaaacagcaagggtgccgagcggcttttggttttgctctctgtttagaagattcaaaaaaggtcaaggtgatgtaatatttgtattcaggtcagacttttctggataatcatcttttgatatctttaatttcaattcgagttcctttttcactagattactttaataactttgtgatttctgctacagtgattcaaattcagtccattagtgacctctatctgtgagaagtgaatactcatggttttttttttttttccttctcatcaaagtctgaagatgacgtcagggtgctgggggtgaatcccaacagttctgtagttctttctggatatttcagtttacctaatttgatttttctaatacagagttcaatatggataatgacatttaattacagtaataaaaatgttatggactaatagagaggcaactaaatggttattccatatagcattgacagtgtgatcaacataaataaaacaccagagctatccactgccaatgaagggattgtacagtcaggctgactattgttttgggactcacaatgctgctgaatgtaagtgaaattttattgctcctaagtgcttacataacaagggaaacttgagacgagctcaaaatatgtatgtggtaactagacttcatggtagctgtgtgtatatgtctttaaattctgctgtgcttctactgtgaacttatggtacagatcaaagagtgtgagaagagtatttataaacagatggtccttttaaggagactttaaaaatctgattcctaatccaggtttgtcttgtgagggttttcagatagaaatttcaattttagccgattatttcaaatgctaattgaagacaaagtttactgaatttcttaggtgggtggataccattatctgacattttccagatggtttttgatctagtggtatttggggatatggaatttttaggaggttttctttcttttcccttgggcaatttttacacaaaagacttttttaagactagctattattattattaaagttaaacaaccattatcttacttcagacaactttcttactttttctactctccaaattgcttttgtgcaattatatctttcttctaaaactacatgtcgcgaattgacgtatcagtatacttttactcctttcagtaataaaggacctccaattacgtatctgtttatagtaaaacacacacacacacacacacaacacacacatacatcaagaaccattttaagacagagattcttttcaaggtttgaactatgttccttttttaaaggctatgacacaaatattgtaataaaaatatcctgtgttctgatgaatacagagacttatttcattctcatggaacagtaaaacactgtactagtaaaataatcagtggtattttgagtacatggtcaaaatctgttagaaccttcatgttttgttttttttttttcttccttagcgaatttcacatctactggtgtttttggttttctttgattccttctactgtggctctttgaagtgattcaaaattaaacagtagctactttttcagggaaattcatcatgttgtgttcaggattccagaagagttaatgatgcagaaaaagttctgtaaaacatctttctaaaagaagtccttctcttgcaagcctcccacttactggcctcctgtaccatttgcagtgaattggaactccgttatttatttatttttcaaataccacctctaacttaatttaatgtaggatgtgttcctgcaaaagtgtgcagtgccatgtgccttgagtcacccaaacaaagcagtgtcattgttacatccggatctgttaatcagggaaggtcaaagaaaatattcttatataatttggaaagtcaaaaggacacgttgatgattctcaaacactggtcagttattctgctgatacttactaaggacatactttttctggcagtttaatggttaaagacctcagccatttttgaagcattcacaaagtaactctctggagctactaaccattagatgctcattagaactgagcagtttttccccccactttgttcccaggttacttttaagggaatgtgcaagaaacttggaaaaaggtcttctgttcccttcagttcacatgtcatactgttatatttcagttctctttattagagctttcaagacacagataaaagaatcttccatctgaaccccttaagaacctgagggcttttggatttcaacccactgaaaaaatatcaggtcccaaagtttatagatgatattaggcctcagaacaattgaaaccaccttcagcagggagcaaaagaacagtggctcctaaaattggttcacaaatatactgtccattgaagtcaacagaggtcatatggctgaatggaaaacattagacgcatatcagtcctgaaataggttcacatgctggtgtcactcttagccccagctgcctctacatgtcacgttcatcagaatctagcatctaaacagcctctgtaatgatttcctctcccactttgctcccaaaattggactcaagtacttagacaaaggaaataatgcaaggaattataatattcatcatatctaatagacaaagtggaggtaagaggtttgtttgcgtgcataggggccatagaggttccaggaatctctttttaagattgattttgagagcacattcgtatccaccctcatcactccgggcccttacattttccagttctcacatccaggatttcatttatttctcacaactgcctctgaatttatacaggaaagtcctacctgcctcacttctgattgggtaactggagccagaaagaagttaagggctactaaggctgggcattttacattttatcatacagatgtagaattctgcagatagaattgagaagttccattctttatgaaaccacccaaaatgatgagagttgtttgttttcgttggaacagtaaaaaaaaatcacaagcctagaaatattttgatttaaaataatagcatttcactcttcagcattagattagatgacaagtttacctgttctgaatgagtataatcctatgatgtacgtatttggcactttgtggtggggagtgagaaataaatgagattgctttgggggaaggaaaagaaaacctacattctcatgtcagcatgcttctttctatattcagccttgtatgaattacttaatctcctggagacttaatttcctctctacagagttcaacagagttgttgagaggtcacataagattaatgtgtgtgaaaataccttgataacaatacagtgttatattcctataaagaggcattattcaaattgataacatttatcactgcatgcctgtcttgtgctatgatagactaggttttatataaataaaatggtaaccaagacagagtcctgcctttcaggagctttcgctcttacggcctcaagagatatcatctaaccaatacactggctgctagcccctgcatcatttcttccattcagttaataatggattatctccttttctgagtttgcgctattttgatgaaagtatccattttaaggataaatgataattagggtgagttgagttcaagggtcaaacttttcttttgattttggaaagagaattttgaggattttttttggaaaaataaatcatcaatgttttctgaaatgaggtcgtttctctttttgactggatttacagtttaactatccaggttaccttttgcaaacacacaccaatagaaatacaatgattttttaaaattttgttttgcaaaataaggcaggctagtgcaaaagggacattttgtagtttggcaaacctcctcaacccattaacagtgaatagaaagacaatttattatgaagccaacgtgtattccaaagcttggctttattttgatgttagtgtcattaaaccctgtggaacagttctttacagtgtatttctgcatgttttgttcagttctgtttttactattgtcaaatctgagactcttaattttaaaggttccaagagtgagcatgtttatttctctttgctaaattgtttacatttagacctttgtaaaggttaattcttaattgtttttctgttgcatagttgaaggcttcagaaaacaaatgccttggtgaaatctatatttataaaatacgtggttggatcccgattcttggccaaaatgagtatttctttcggtgatttgaggtatgaagtctgtatccaacaacattcttttcaatctatgatttgctattgtcggagttctgacacttgcttttttaatgttttttttttaaagttgattagtactttagcagtacattgtaaagtatgtggccacagaactgtattttaacatggaaaattacttgcatagttcggcaaaattaatctgaataccttttgtactggcagtgttgaatgatataatatttgaagagagaaaatatttgctactactttaaagaggtctactaataaaatgagaatcatctgtaggtatatatgtggggagttagtacgtgtttatatctctgaaatgcaccaacaaatataagtcttatgtactatggggaggaagtatggttatagcctgaagctaggtagtgccagtttagcacatatgtccttaatatgataaaaatagtgatgtaacccaaatagtttttaattggtgattttctttttccaaataggtcttagggaaactgtaaatgaagaaaagtacaaaatgcaatcagaaaatatatttaagtctgactggcctgatcttcatgaaggagatattcttatggaggtttcaccaaatgaagaaagcttgctcattcattcaggagatgatttttagcactatccatgaactgggcatagagtaagatgggacaggccaaaagtaggtaaggcatgatccctccacttgaggccagctaggctagtgagcagagaggtagacacaaaacctaattgcattgcagttttatacaagattgaagggagtgcagtcaacactaagtatgccagaaactcatagtgttagtgaaaagagctcttcatttggagatggacagtcttactctttgtctccttaagtagaaaatggaggaaaatggaggagtagctctttctactcctagagctattaattttaggattgagataattctttaaaatgtctacctgttctggcacataggagaggcctaatgaatgccgactgtaggtccttctgtctccaaaatgataatgatttcattgtcttaccattaccttctactgacttgtctcagtttggggaatgaactgggtcctaacttggactttatttgttcattgaaagcatagcctttgtggcaattaatgggtttatacccacccccatgccttctacctcacagccatgtgtccttctgccgatgacaccagtgcctgcagcttccaaggagttccatgtctagactatgacactgagctcagtgagccatggttatgtccttgccaaagtacaaagatttttatcaaaatgaattttaacaactttcctcacacaattcactttatacatgactcttggcagagtcatgaaaatattttattgtagaagattagcatgtaaattatcgttatgcttgcttaaggcttattctatccttatagaatgattataccttgctgtgtacattggaatcagaatgatactcttgggctatgagttcattgtggaactatttctttcagaagataattttcaattaagtaaaggaacttcttactgtttctactgcagatacttctgaacaaatagcagtgttcagatgtcctggtaaaaatacatggtactggggttatttttcatttatcattataattgcatgtatgtatagtataatttctgtgttccattcaacatttgagatttgcccctgtttttttcaacactgtgaatccgtaaatttattgatgtaggaaagctatatttaacaagatgttaggcatgccccagacctccaagctaggaaacacataggctttttctgttaagatcacataatatataatgtaatatatacatataattaatcaaattggacctgagagaagcaggcactagagtgtattttgtaagctgttaacatcttagtaagtagcttctgaaccaacattcaacccagcataaaacaaaaagaccttgttttgctactttaggaaatgtaagagagattaaaattctttgggaaatggttttaaaaagtagttttgtactcagataggtaaagaacaagtccagtggtgctgacagcaatggaatttaaaacttgattctaataatctctgagtcccgaaggaatgccacgcagacatccgtttgagtcacgagcttgtaactgaggatttgacaaagattgagtcctcactgtgtgccaggcaccatgctaaattttgtgctaggcacttgggatactctttcagacaagactttgtccctgctcacagagaaatctgataggttggcctatagtcactcttttctaaacttgacctatctacctgaattaaccgaaggagctggttagaaatacagattcctgggccaagaagaagaacctaaagtccaacttcctgtaaccatcaacacatttaaccctgtaagtttagagtttattgtaaccttctcatgccctttgctatactcagtgtgcaaatcatgaagactaaggtggatcctgttttggtggagattctgatgtgttaagtctgtgatgaaacctgggaatgtgagttcttgaaagctcccattattggaaatcactgagctagatagtttttagaattttttttctgaccggagaatcagtgctttttatagttgtctgacttgtagtcacttgtgactttctgaaagtttttctgtgtattttgccacatagaaaatattgctcaatttaactccatctgctagaaaagtaccttcagagaggctagatatcagggctggcttctctcttggtagcggcagtctcctgtctgttctccccaccatcagtgtcccctaaaccattgtactgtttttggtgtccccagaattaattttctaaaaaaaaaaaataaagaaatcacatcatattcctttagaaacctatatctttggataaagcccatcaaaacttgttatcatgccacgcaagatccgtgacaatctagatctcaaaccactcctcagacctcattgttcagcacccatcccctgtaccctcatgccaaacatggtgaggcatggccctcttgatactttgcctttcccatgctgtttaccatttacctagaacattatcgcatactctccatttggcaaactcttcctttaagaggcacgtggatgacactttccctcctggttactcctttctctgggcttctacagagttttgtttgaactttgattggttctctgtttatattgtattataaaatgtgtctgcttacatgtctatctcgctcattagactttaggaactttggcccattcatttcatctctgtggtgctaacagagttgcccagtgtaccgcattctgcaaaaatgtaattgagttagtaaatggaatagcactgaccagacctggaacacaagaagatcttcataatccagtgagaaggactgcttcctcagaagtatttttttattcccatagattgattacccagtggagggggaagtacaaccaccacctttctgccttactctgagcaggtttgtcagacaaatattggctggtaaacccaaccttgatcagcagcaagctttccaaaccacacatgaggcaattcatatgccacactggataggtctgtttaaagaataataatttcgcttgatgatacacctttcttggcactgagtaaaactatcggttacgtagatgttcacacagatgtggttttccacagaatgagaaatttaactcagcattaactttgtgtatctgtcttggcataattaacaagagcaaagcaaaggtcttgtgaaattttgtgcatttgctctcttctttattttttgcttgttattattttgtttatttcatcctaggcccattatttcctgatagaggcctctgaggacccagggctctccagagaagggaaaagaaggctagaaatcacaacgccttaatttggctccacaaaataggatccatctttagtcttcatgatttgcacattgagtacagcacaaagcttgggaaggttacaataaatctaaatttatatggtttaatgtgttgatggttacaggaagttggactttaggttcttcttgttggccaaaagaaaattcaaacaatactttgttaagtttcgcggtagattgccatttgatggacaaagttgacttgcatgcaagtggtgtatttgcaaacacacattaaacacacttcaatcccttcctccccttttttcagcaaaacttttcagtggctgaaaagagtagaagaggatagagcacagtttgatatgccccttcctagcctttggtttcatctgggctgtctgcatgttgggaatacttcccaagccagtgggaaactcgtgaaaaaacacatgagatgatttttgatcagacactaccccttaatactggaggcttataacaccaccccagatcttttcatgttaatttatgagactgtttagaaacaatgtgctctcctggtttcttgaattacaaagagtattggcagggccaacttcttatccagaagtccagtaataacaacagtaacaacaatattaataatgatattgatcgtaaggtttatttagagtgctgtttatgcagttcatgtatattatctcatctaaaccttgtacagtaggttctgttgataaaagttgtgaatagccccattttacacaaagggaaactgaagtagagagagttgcctcagattgcttgttttactttagagttattattaattgtcttaaaagggtagatggacactggataatttccaaaatcaactcaaaatttgtttgtccatggcttaaaaatcaaattcagaggtgattactcactgtccagtaggtataaatgatgagctgctaaccagtggtccaactttctatatttgtcttttcgagtagacaactgcctaagaaatcattagttagtctgccacttttgggtgaaagagattcatgagtctctcaatgtatttctgtaacatggaaatagtgaagaatcattaatttgaaaacaaagcatgacaacttctagcacattttcagtactaaggaaagcttgtggatacatgcctaatgattaggggctatatttattgtagagaacactctccattttttccccttacccttttaccagcactgctaaatggattgatttgagattcacctctttttccctgtggaggtgataatggacaacggaatgaccagagggaagataatagcataaagtgtgtggcctctgagagggcctgggaaaaatggagaattgactgtgttattaataggtcagcttcactggttttcaaaatctatgtaattgctcaggcggtaagcttttattgggtgaaaaaatgatgagagatgggctcggaaaggcttgttccacattgatgaatggaaaataagcacagtatgtgcttgcaaatctttacactattgaattagatttttgaccatccctcgctttttgcactttctgtggttgcactcatctctacatgtatgaaagttgtgttttttgaattctagggttgtaattaagacccttcagttatttgtccatggtatttctctgtaaatattattaatactgtcgaaattatgtgatccattccttaattccttcacttccctttaagtagctagactgtggcttctgtcacttctgtgttcttttgtcaccatctgctcattatctgtcaagaggggactgtgaattatttctgccctgggccagtctaatggaatccttggtggggctgtttagggaagtaggtactacttaggtgtggtagcagttaggtgaatggctccacaggcagccagctccattaccacatgaaagcaccagcagcatttggcttcctggtgaattctgtggtgtttcttctgtctatggaagtgcaaatttagctgaattgggtagaaccgaaacgcttgccctctgcaatttgctcctgaaaaatgatcaggccctataaaggaaaccttaacataccaatgtctctgctgctagaaatggcttccttgtttgtctggactacatgcatccgtcaagaatcagcctatggcatggtgtccctcttccttccctccaagtgctgaactcacttgggttttccactggacttcagtgtcactgtgttttagaatgaactaaacattcccaataaagtcctacttgtgctgaattaacatttctttattaaacaaaatatgctgcctagaatcagtagtttgagtcttctttgattactgtcttttattcatcgtcacgtgttctgtcactagtcttaggcacttaaaacaaatttctgttttgattatcctggggtcattgtaattaagcccatatttctccttccctttcatctttcctttcctgacctgcacaccaattacattactcttcctcattcttgtgctgacaatattactctccattgtttagaggatcaagtctaaactccccagtttgactttcaaggtccctctttctcaaactttccctagtctttccaaagaaagttattcttcccttctgacctaaatttaggatgtgtccccatttttatctgcatagtagccccaatgtgatgtaaaattttaccaaatactttgtctttcttttctttctttctttttttttttttttgagatggagtttcgctctttcgcccaggctggagtgcagtagcgtgatcttgggcttactacatcctctgccttccagtttcaagcgattcccctgcctcagcttcccgagtagctgggattacaggtgcctgccaccacacccggctaacttttctatttttagtagagatggggtttcaccacgttggccaggctggtctcgaactcctgacattgtgatccgcccgccttgacctcccaaagtgctgggattataggcttgagccaccttgctcggccgctttgtctttattttctgagggtaagctcatctagggtatgaaccccacaagtctgagacaggtctcaagtaatttagaaagtttattttgccagggttgaggatgtgcacccatgacacagcctcaggaggtcctgaggacgtgtgccagggtaataggggcacagcttggtttgtgtacattttagggagacataagacatcagtcaatatgtgtaagatgtacattggttcagtccagaaaggtgggacaacttgaagcagggagggggctttcagatcataggtagatgagaggaaaatagttgcattcttttgagtttctgattagcttctccaaatgaagcaatcagatatgcatttatctcagtgagcagagtggtgactgaatagaatgagagccaagtttgcccaagcagttcctagctggacttttccctttagcttagtgattttggggccccaggatttattttcctttcacaagggtgaagataatgctgaataaatgtttgaggcattgaattgaactcaggtgtgtggcctcaacctacttctgtgaaacttccatagagtaccactctgtctacctcatgtatgctacttcccattagatttaaatattggataaattaatatttaccaagtttgcacaaataactctgatatatatgaattttaaaattatctcatagaagaagcttcctttgttctctccatggaatcttttccaaagcagtgcagcctcttgctttgaaaataggaaggtagaatattccaaatgcatcataagtcctctgtttatatttttaaaacctgtactctttccaagcctctaggcaagaacaaatagaaataatcagaggccttagaacttgattatgttgaattgaattattaagctgaggcttgatagccaaattaattgtgctatagtttatattgaagagatgcttgtgatattgcaaaaccatagactagcttgctggaatcttcgaagacatctggatgttttggaaaatacaacaatcacatgctttttattatctccatgattgtattctttttaaaaaggagctgtgtaaatgatacaaacaggaagcagggaaatactgggtagaagaagtgtggtccctggcgagagccacaccctcaagcctggacccatggcccaaagtgagaacatgcatttctgttttccccacccgaatgttgccttttccaaaaccatactggcctgccctgtcccccatcctgtgcccataaaaaccacaggccccaccagcagagcagcagagcagctgagaaagacagaagagaagaagtagctggacgttggagaaaagcagcttgacttcagagggacagcttgacagtgggaccttggagaagagtttgaccagggatggccaaactccaggggaagaccaccttcccactccatcccctttccagctcttcattccactgagatccacttccatcagcaataaaatcctctgggtttaccatcttcaattcatttgtgtgacctgattccccctggatgccagacagtgacccaggtacgggtgcaagagactgtcacactgaccctccactgagctgtctaacacttaagccatccatggatggcaaaactaaaagagtacactgtaacacagggcctctgggactctgggggcttgtgggcaactcctagatgctgccatgggcctgcacggagttttgcttctgcccagttgcccagaagctcttgtcctggcctctgcacctgctcacctgtgtgctaccctgcccatgaggggttgagagctgtgggctgagtaaatgagccaaccccttcacgagtcttgcaaagagtctgaggggaatatcccatttcataaagatatagagtgaacatagagagaaggtcatggagtttggaatcagacagactagatttgaatcctggttctgtctcaagcaactaggatgacttcagcatgtttcttggtgcttgtgtttgtggctacttcctcaatttttcagtagagaaaaaataatactcataggaccactctggtgaattgttgaatagattgtgtgttatctgccacacttcaagtactagcatgcattaaaatccctatccctttgccctccaatgtaaaatgatatgaattctgtggcttacacatagctattttttttttttttttttggcctgcatagataaggcaattccgtaaggctgtgttaccattctcctaaagggcctccctgtggggccacagtacatcttgcctaatttctttttaacaatatttatttctgtggtcaagaagaagataaggtaccttagaagtagtcactgttctatctcaatttggatatgcttgttgaagaactcttacaaccacttatttctgggaaaaaaaaaaaagaaatattttcagccatctcttcacctcaaaaacagcaggcatcgtggattattggaagggaattacccagagaaagtgctcttaaaaacaactgcatgtagaggaggctggcttatcaacaggcaaaaaaggagatttttttctactaaatttcagcttgtcactataaacgagaaaatagccacattcgtaatatattctatggggacagtgctgtgagtgtttctactggtggaattctcaagtacgagattctaagaatgagcatttactcttagaaaaccctagggaatggctgttaggaatcaggtaaacaatgaaatgagagccctttcaaacagggaagcaaaaaaaggcagatcaggtaaatgagttcactgtagaccacattgtggaaaatgtgacgtgatatgagacacatttcatttagcatggataactaatgtaattacaatcagctaatgagttttgtttctttttctgcataatattaacatcatccaaagttaagaaggtatttttttccgatgaaaaccctaaagtcatgcaaaattatgtggacttcctttctgattcttggagagaagttagggttgttttagcctttacctacatttcagtttaaggcttatccacaatctagaaatgcaatgttaaaagataaagaaggatctatagaacacattttttttaacttaaaacatggatattagaacttatatttgattatatttttctttgtgctgaaggattgatctccttgtctaacacacgttgaaaatctggagggggtttcattggaaaattgtagcatttcctttattagcgacccttaaaaataacaagaataattaatctgctggtttagcttaaatttggtcttatgacaggcatgcacacgagctggcttttcattaccctatcctcctccatgattctgtcttgtgaaatcatgaatggaatttctatgaaaatatatagcaaataggttcctgacaaaattactattcacataattcatcatccttaagtgacagagatttgtaaataatgaaatctagtgagaaatctttaatttcatttagctagtagcttagaagtgattctgattccacctgtttaccagaactcctaaagagaaaatgaagaaatttaaacttcaaatcccatttccttttctttttgaaattaaaagcaccttgttgatggaggagcagtgattggtatctgtgcaaggtggtatgtgggaccatttgatcataactgatatgatgtaaggaatggggttgcctggaaaaattaggaaatgggaggggtgggagagaaatttaagaaaggcacaggcatgccactggtggaaattaccttctagtatctccttttctgtttacagtagctcttacctttctccaagggatatgtattgagtattcacaaagaaagtaaaatggctccagtgttacctccatttgtcctgtttattgttgtggctatgatgtttttggctaattatcattgtatcctaaattctttactaaatggatggatgaatgcatgcatacatggaaggatggacacatggaaaggatgaatatatataggggtttcgccctgaaataccttaagatttattgtattttagattttaatggacccgactgagattactgatgacttaattcacttcttgccagtgagaaaaggtagccatgtggtgagaaacttgaaggtgagaaccattttccataatcttttccatgtttgtaactcacatattttttatttcttaaagtttccattttgattatcatttcacttctatatctcctgtggtaggtaaggcatatgtatttatccctgtttctagatttccagagaggaaaatgaactaccaaaggtcatgtccctttctgttttgtgcatccatgtagcagatggacaccttatcaacaactcttgccatgaattggactgtcaagcaatgggggatactcaaaatatcaataggatagtgagcaggagcattaaattctaggttttatgttgcccctaaaaaaatctgtgacttctgtcaatttactgaaccttggaggcacagtttcttcatctgtacaaggccgggcagttctagtaattctctgattctcagaatctagggagcttgtcttagtggttagaatttggctctgggtttagtctacttgggtttgtaggtaccttcgctgcttcatagctttgttaccttggcaaagtacttaacctatataatcctcacttttctcatctgcatagtggggatagcagtaataaaaccccttgaagagttgccatgaggattaaataagataatccacaggaggcattttgcatagtgcctgatgcaattaagtgctcaatagattagcagatcttctactgtggcttattcagaaaaagttaaggtgagtatcactgatgtttttagaaagcagttgatattaacaggttcctatatgactgatccaactgcctgaatcatgcccaaatcattaaagctttctaaagggcagagccatcataactaatcccacaatgtcccacaggcctcttcaaagagaaaaatggcccctctgggagctcagcaattgtttcaggatgataatgttgataattccgtcgcatcattgggttttctggtgcagacaggtaagacacggagacctttgggttgatggcaagatttggagggctgattatggcgcctttgatgtgaggaggtattcctgcaatccttccgagacacctaagctgctgtaagtaatgacttttgttgctcatgtatctgatgcttctgccactgtgttgtctctgaaaaatttgccagcctgacacccaggatctagttgtagaacactgcaggagtaatggtattttttcatgtggtgctcaacatacaactcctacattgaattttaactatgggatttttgtgaattaaagactttcaggtaaaatagatacagtgaataaggtggggaatacctaagagagcagccccctttcacccattggcccttttcttttgatttggttaagattctgtgaatatctgcattagttattgttatgaaatgcgtacccagctcttctttgtagccttcagaaagagcaaataatttagtgttgtgcagcattaaggtttattggccacaaaacacagataaagactgtgatgataaaattttagaatgcagacagggagtttagtagtggccaacttttaaattcctgtgcccagtaatccacgtgctctctcagtgaggctatgctgctgggaccatctaaggtaagggtgtccaatcttttggcttcctggggccatattggaagaagaagaattgtctggggccacacatgaaacacaatgatagctgatgagctagaaaaaaaatcacaaaaattcttatgttttaagaacatttatgaattttgttggcccatgggctgtgggttggacaagcttgatctaagggttatttcttttgttgaatcctgtggggactacggacattagattcacacttttatcgccagatccaagcactgattagttatcaagtcaggagttaacaaatatttgtggaaggaaagggtgaggacggaaaggaaaaattgagggagaaagagaaagggaaaaagattagagcctacctccaataggtgactataaatattttgttgttgtttttagttttcattctgcattgtcactttgggtaaggatagagtgtttttgtgctgttgaagaaatagcattaacagatgagttttcaggtgtcttaaaactgaactctgcctataagatggacacagttgtccaaactactttaaaaaacaatagattcagttttatactcattcacttaaagggtagggtagatacttgtcaaatgtggttttgagggtttacactggaaagaaaaatctcatcaaaaatatgaagcaaggcctcccttctcttttcattctcatttggaagaaaggggagaacatcttattttagtcttttttaaagagcataacttattcaaaggctttgttacactctgcaggacactacccgtatttaagttaaaaaaaaggattcatgagtgagccagcaatcaacaagtatttactgaagcctcatataccagaaagttcaaagtgctagtttaaatggtcttcctaaggtatttaacaaagtcatgtcacaaaatacattgtagaagataaacatttatcagtgagtcatcacagaccacaagtgcccttacaacagagtggacgtatgtgcttcattttctgatatattagtaaatctgagaaatattgtccaggttgtataggatgtacagtattttcattgtctttaagtgccagcggactacagatggctctcagatccccttggatcacttctgtgtggtttgtgtacctattttgaatcctctagtcttttcctgaatcgaaacctcacattccaattaaaattgcttagaaattcagctcacctgatagggttgagaatattttcttctcaagttgtggtttctacttgatcccttatttgtaaaattgaattcactgactttgatctaaatagttagggttgtgaatattagtctaggttttaatctaatccaaggaatggttacttctctttagtttttcctttctgattataaaaatagagagttgtgctatgaatttcaataaacagcctggttgggagaacaattctgtctgtatcattacaggatgcccattaagagttgactcaaaggtcccttttccctgtggctgaaggtggtagtttgccgtcctgcagagtcagtggtggcatctgtcacatgccacttccgcagaatgcactgatgtggattaaagatctataacatcatctaataatgcctatctattggagataggcatcactttgatagtataactttgggccttagagatgtggtatgcaagttagaaatttgattgtactatgtgtataaaagctgtttttaaagaaagagctaaaatctaaggtggtagcatactaaagcttagtttcttactttaaatatcacagtagattcagatcctgacttatgaggccaaaaaggttagcagtcctgataaccttgctgtacatttagaaatgaactagtcagtatgtgagaatatgcatagattcctagaagatgttacacatcagcagatcagcagtgtattagtctgttttcatgctgctgataaagactacctgagactgggtaatttataaagaaaaagaggcttaatggactctcagttccatgtggctggggaagcctcacaatcatagtggaaggcgaaaagcacatcctacatggcagcagacaagagagaatgagaactaagcaaaaggggtttccccttataaaaccatcagatctcatgagacttacttattcactaccatgagaacagtatgggggaaaccaccccatgattcaattatctcccaccaggtccctcccataaccggtggtaattataggagctacaattcaagatgaggtttgggtgggcacacagcctaaccgtatcaagcagtttaactatttctctcttatctgaaatctattttattttattttattttattttattttattttattttatttttttagagatgaggtctcaccctgtggcccaggctgatctcaaactcctggcctcaagtgatcctcttgcctcagcctcccaagtagttgggattacaggtgtgaggccctgtgcctggcctctctctgagatcttaaaatgaatctggtgaggaaagaagaaaattggaagaaagccaactattaaaaactagaaaacacttttaaggacttgaggaagaaataagcattaagacgtatacatgtttctaatttctagcaatgagatgttagtatagtacagacggaaggcatgtaattaagaaatttaccattaagttgggaaatcctatcccatgaatacagatgttttaggcttgcataaaactacatggaatatcttcaatgcaataataataagcagtgctgtctggacatttaaaacttttttaaaaagtttggtatcctagagacaactatatagattttgcgagaaaatgcccactgggtcattgaaaaataagcttataggggtatatgcatggcacagtaatttcattggtaggagatttcttttagatttttagcttgcctttaatgggctctatcctacatcccaaataccttcttttcttttcctccatttcccatacaagtagtgatgtgttaatttcaaaatgttagtgataaaatactgttgctaaaaatatttcagcttgcctgggcttgatctggggaggacacatgtttctgggagagaagccacattcaaccctgtaatgttgtgtatatgctactctgcagggcgcacctatgccaagaggcagttggagaaaatggctaagctggttgtggaggcagactccctgggttcaaagtctcatttttctacacactggctaactgtagacaagttacttatttctctgtactgtagttttctcatgtagagcctggagataagaccaactttataaagttcttgaggaattaaatgagttaatacatagaatagtgcttggcacatggtatatacacaataagtattaactgttgctattagttgtcagtaatgccttgctagcacaatttctgtaccttttgtgatattagtctgttttcacgccgctaataaagacatacccaagactgggaagaaaaagaggtttaattgggcttacagttccacatggctggggaggcctcagaatcatggcgggaggcaaaaggcacttcttacatggcagcggcaagagaaaatgaggaagacccagaagcagaaacccctgataaaaccatcagagctcatgaaacttattcactaccacaagaacagtatgggggaaactgcccccatgattcaaattatcttccactgggtccctcccacaacacatgggaattatgggaatatgattcaagatgagatttgggtggggacacagagtcaaaccatatcagatgttatgaataaacctgcaaaacacagagaccctcttactaaggtagaagcttaaaaaacatgactaatttccagtgtttttttttttctgaagctttttttaattagccagctaccttactagtttgcaaatgccttaagagcaaggttcatatcatattcatcttgtaatacctctgccgcacctaaccgagtattgaagtgttgaattaataaatcttctggaatttcttgtttcttcaggttacattaggaatatgaagtattatgaatggggcacctagattttcaaaaaggagatagaatagatggcatctccactaggcccagatagagtataaaaacaaaagcacggcaaggcgcggtggctcacgcctgtaatcccagcactttgggaggctgaggcaggtggatcaccagaggtcaggagttcgagaccagcctgaccaatatgatgaaactaaaatttagtctctactgaaaatacaaaaattagccgggtgtggtggcatgtgcctgtaatcccagctacttgggaggctgagacaggagaattgcttgaagccaggaggtagaggttgcagtgagccgagattgcaccactgcactctgcctgggcaacaagagtaaaactccatttcaataaataaataaattaattaattaattaattaacaaaagcaaactaaaaagacacttctcagagctactttgcttatgtcgctagttcatggtagaaggaaaatggtgactgtagaaatggtcaaactgggatctttttcaggaaatgaaacacgtaatgtagacttctgtggaaagcatccatagacttatgtggaaagcatccatagacttccgtagaaagcatctgtagacttccgcagaaagcatccgtagacttccgtagaaagcactgatgatgttgtataaacagaccataaggagattgaagccctccatgtattctgtttgcccttggaatatatgtgcatgtgcatgtgcttgtgtgtttattttcatttgggtttatgccctatttttaatttgtaagcagaacaagaggcaaagggctctcatatgcccgtagaattatatagtcaggcttttcaggaattttttttttaatccttcaacatttatctttgcatcaaaaataaattttttaaaaaaagtaaataaggataaaagaaaaaccgagtaggtgggagagaaggaggaatttggagtcatgggaatgggcaggtgttcaggtgatttaaaaggagaagtaaaggcatgttcctggataaatgtcgatatgcattattaaatgaaacagtggtaaaatatagactgtcagaagcatttttcttccagagacatgaggagaattgaaatgcagtttcaaaggaggagtctctttcggtgtttcttcaatcatttttttgtttgaagctttaattacagtgctccttgctacctaatgctttcagtttaaaatgacatcacaaaagagaggggaagatgtaattgctcagatgaagggcagccatcacagcagcattgaggtatttactcaccagggagttcctgctacatgattcttttctagatcaacattttgtttttggaatgcttttgtatcatgcatatttgacatggtttgtctttagagtgattgctctgatactgctattgccagagcagataataaccttcgggaaataatgtattctgaaataaaggaactagttatttgcatagttttctctggattggataatgtgtacaggtggctagtggcttcctaaacgtttagtgttctaatcaaataaacttgtatttaaatacattaacacagaccaatacacgcacatagaagcacatgtgtacacatagataggtgcacatgcatgtgtacacatacatcactgtcatagctcttcatgcagaatactttgctattcagccccatcaacacatactttttgaaaatatgctcagcagaggggtacaagcatacagaggactcagaccccagtctcaacttcttcacagtctgatggggacagacttgggagcagagatgctatgatgggggaggctgtgtacattgcagcctgaaaacagagtagaagaggggccctttctccttcgggcccctgggaagactccaggaggtgatggatgaactttgagctggtcattggtgaaagaacatggattagctgagcagaaaagaagaaggaatactggatgcagtaagtaaccactttgggactaaatttacaccaaaatgagtattagttcctttggttccaaatggttcagatgttctttaaaggcactgttcttactgcccagaggaaagagagtgagctgaaccatacatgcttgtagtaaagattgtatgtatgtcatatatgtatatctatatataatatatctacccatgattatacgttgtctataaagccccttcacacttttttttaacctcatagcagctcagcaggtcagtttaatatgatcattatttttcagctaaggaaagggaggctcacagagatacatggcccagtttccctccaatgatgttctgggactcactgctcttactcaggtctgtgctgcccattacctccgtgaggttagatcacaggttacaagttagatctctgatatccggatctcctgatggcattagcagcgtttagtcagtgactttcctgggcctgcctggatcactctcacttcatgtggatgatctctctcaggaagccatagattttgagcaaaaatgcagacttcccagaggctttgccgggtcctccatctcactcccctcaagaatttcaacaaatctgttaatgctattttgtcatttctgtacttcaaagtgtttctgccaggcataccttgtctgtcccagctctgactctttggggctgagtaggtttacttgtttattttttggttcttacatgtctccaactccatgtggatttacatcctactgggtgaggttttgtttttccttgtgtctataggtgagaagatgtgaacatacagttaattgaaactaagtctagaatcatgaagccagaaggagaaatgtattagaattagaaatgacatcacaggccgggcgcagtggctcatgactgtaatcccagcactttgggaggctgaggagggcggatcacgaggtcaagttcaagaccagcctggccaacatggtgaaaccccgtctctactaaaaatacaaaaattatcagggcatggtggcacgtggctgtaatctcagctacttgggaagctgaaggaggagaattgcttgaactgggactcgggaggcggaggttgcagtgagccgagatcgcaccactgcactccagcctgggctgcagagcgagactccatctcaaaaataaataaataaataaaagaaataaataaaaaataaagaaaaaaaagaaatgacatcacaaaaaagggctggctcctcataaagcagtcttcacacacagaatgtatgctgtgtgaccaggaatttgtagcagctgagaaaccatagttgttcataagaaaaaaaaaaaaattagaaggcacaatatgccagtatggctagcctgcctgcgttagggtctcagtgatgctggtgggaaacctaaaaaaaaaatgtgaaaaattttcttttcttcttttcgtgcaattagatcttcttgactaagaaaaaatgcagacaagcaattactccgttactttaattactctcctaattataacgataaccttgtcacattatcataattccccaaacagaaaaacgcatgctccaaattgcaccaatatttgataattttaccttgttaacggctcactgtcagtatgtagagcactacattttttccccattacctttctattgcacagtctatatttctttgcctcagaaaatgataatacattctgtacaacatgtttgtgttgcacaaccccgtgatttgaatatggctttttaacgtctcgcagtttcagaagctatctcctgagcagtgtgtaattctctcctggctgtttgatggtaatgggagctgtacatgtatctggagagaggagaaccagcctgggggtaagaaagtagctatttatcaaggtatcttacaatctcagtttatgttgttgtaaaatgttattgtgcacgttccctgagattatatccgctagacatttgtcagccattgtcaacatactgtaaggaataagcatgtgtattattccagtcaacttaattttattctgcatttctttgccctcattttcaaagagactgactactggggacccttgcttaatggtgccatctgctaggttatgaattgtacagaacgaatgttggaaatgttctagaacactcacagcaccctggcaggtagatggcaaggcatcctgatgcacggctcctgccatcatggaaattctccctccgttattacagcaaatgatactgttgacagccaataaagttacagaatgactgcctagaatacaatgataaagtaggaacgagataaaatagaatcgtaccagaagcctttcccactagaatgtcaaattgcccttttttaaaaatgtatcataaagtaaccttgaaaatcattagttctttagatagccccggtctttggtaaaattatgaaattctattgctgtcattgtctttgtattttgttgttgttgtggctgttgtttggttttagtgcccctaaaattccagagcttctcatcctcacatctatgtgacacttctgtcacttccatggacacattccctcatttcttttctgtccttaagctttcttaccaattgaaactggtctcaagataagttgaagactctttcccgctacagggaatatgactaataccaatgcttagtgttagttttctgacagtttttacactttaaagctatgagtaaaaccttggactaaatgcaggcatctgagaaagtaagtaacaatgccgtggaaggaaaggcatcacttgtttacacacctggtcaccttctttagtccatgggactcactcatgtttccaagagaatatttcatttccacacagacatagacatttctgacagttaaatccaaagtaactcaaatgctacataacatttttacattgttttgtgtgtttcttgggtgtgtggcatttggcatcaagaagacccgtgtttcaatgcaatctctgccacattttggctgtgaagaccaaatgcaggttatttgacttttgggaaactcagtctcctcctctgagaattgaggtttgtaataccaactcatgaactcattctaaggatcagatgagataatagatcagaaagagtaggtgggtctataatgttagttacttgaagctggttcccaaatctcctcctaacccacctttctttctttcttttttttttttttgaatctagactcaagatatattaaagactatgctcatggacatcaattctttcctgtcctttagggcagtattcaggccacacggttcaataacgggaaagaatgtcgtcacatgattgcatcatgttcttcaaaatgaaatctattgaacagtataaacaacaaagaacatcatttgtcagaatgacctgggggaaatagtccagtgaaactaagcaaagggaactttataccgtgagggaaaatcaatggattgtaacagaaccctgcaagaagagacatagctttcaagttccagagacctagaggtgactgagaagcaggatgtaccagaaactgggcttcttgttctacttatctagcgcccttttcacagtgttgtatatgtaaataaataataaagcagtgtgatttttaattttttttttttttacttatgtaaagttagacatcaaaaagcatctgttggacctccactccttaaaaggaacacatactaagtttgagaattatggttctctgggcattgctgcctggcaattacagaagcctagggaagtaggggttatcacagttgttcccaggtaatatcacagtagttacccctgtcaccagggccttacaaccacttcctaatggtgagattggaatgagactggatgtgtctgactccatggtctatgttgtttaacaaatgccagatacattgagtcccacacaccttgtgttagtttgttctcacactgctgtaataagctacctgaaactgggtaatttatgaataaaagaggtttaattgactcacagttcctcaggctgcacagaaagcatggctggggaggcctcaggaaacttacagttgtggaagaagggcgaaggggaagcaggcaccttcttcacatggtggagcaggaggaagaaagagaagagggaagtgccacatacttttaaaaaaccagatctcccaagaactcattcactatcatgagaacagcaagggggaagtccacctacatgattcaatcacctccttccaggccccttctccaatgtggggattacaattcaacatgagatttgggtgcggacacagcaaaaccatgacttggctcagatctcttacctccaaaccctagtactttatgtaatcttaaaatagaaaaacagacaaacaaaaaaatagataaagttgacttttctctcaagaaaagtgaaatgttctatttcctcttaggtggagaccatgagtatgtctgctatttgtacataactcaatggatgataattgatctaaattccagggaagacatgagagtttaaagggagacactcatgtagaagccctagtgtgaaagggcccctacatttgacacttacgtggacagccagaagtcagggcacttgtcctcttcctacatagatgaacttattaagggaaggagagggtggacagagcgttttgcttttctatggccctgttttgaatgttgacatggcagaacaccaaagtggcacttggctacctgctcttctctgcctgtacatagggaatatttcagccaaatggcattgttttctcataacccacgaattgatttggccagtgactatgtattactcgaatatgtattgcttggattggcttcaattgcctatatcagtttagaagctttaacaatgtttaacccatatgttgagtaaaatttgggagtattaaaagaaacactggtttacctcattttagtacaaatgaatcgtcttagagaaatagaaagcaatcaaaaattaaacaagtaaatacaatcaccagtaacccgggttaaaaatatatttaggtaattaaaagcctaagtcattacatttccactggaccaaccaagattgttccaaatgtattcgtggaagatttattaaaggatattttgacattggcaaaagggctagttttctggtgggttatgaggctctcagataacatcaaaaggcagtatttgaaagtaagattctgtcatgcacaccgttttctgtgtcttttgaagacgtgggtaactctattacagaaaaatactactatacctagcatgattgaaacaaactgtatgtaatgtaatgtaatagttcttaaactgtgcagcttcgcatcctctgcaaatcagctcctacatctggacgatgagaattgtaatagcactgatctcaaaggggtttttggttgtgatgtgagatagataagatttatcatgtgatcactagttttatcaagtgaaggagataagagactcatcctatgatcactagttatcttggctctctgccttaccatttctatgatagcaagaaaagagcaacaaagttatgaactctgccagtcttggtatgcaatttgtaagatagtatgtataacagtcagtggtacaaagccacagaaatcctaaagtgttattttaaaccagatttccattttcgtcacctccattcctttcagggatcttgggaaagggaatgaactactttactttgaaaaacagttttgttttgttttattttctgaacgaagataatgaaagccttcctgacccaaatagcatatgcagcctggagtgtcatatattgtttttgcataggagtgatattaataacctgagtatgtatgcagtcatcaaaatagcttttgtcataacatcacttgtgtgctgctatttgtctcataagtaatctgtcacattcattttaagttgaagtgtggatatgtgacaggtggaatctacaattgttttattgggctggatgtaaaaataatgaccttgatgttgctattcagaatattatgtggcatctgggaccccgatagtttcccaatattattaatagtgatattactacctctccattacatgcatggttagtgatcaaaattttttttatttatttaaatttttgaatgattttagaaaccatatgcatggagatgtattaagatatataagcttcttgtggtgaggttattggttttaaaatacacatcgttagcttttaaaataaaagttggcatttcgagttgtcatgcttgaaagactcttggaagtagcattaaaagaatcctagattgaaagctaatttaggtcaagagggaaaatgtgcttgatgtgacactgataacttcataccaattgaatccatggggccttggaacctgaaatggaatttatgataaaatacccaccatgaggtcttatcttaatggagaaaacacattgctttgttagtcctccagacagaaacttcattgtttggggaatgatttcagtagaggatgaaaggatgaataagcaaaatacaccgatttttttgtcaactgccacccctcccaccccgatgttcccaccaatcattagaataagaaacatgagtctttgtcctctgccaaatctaagccatgccaacaagtaaacctgtataggaaaatgacacaattagggaaatttgcaagtgctattatgccagcagtagttttttccatgaagtaatctgatgattcatacactggagatcaggagacaaaacagattctacctggttagagacccactatcacaatgatacttggcctaattcattttggttgagggcctgatgagccacacatgcgtgggtcagggaagatggttttcaccggatgcctgttgagtctgattgtagagactttcaagagaggattttattgaggaaaaaaagaagcaaacataacaaagtattattctgctttagactgaaatcagggactgttttctgagaataaaatgacttcataaaggaatcaagaaaattatcttgatgctcagcctgtaagataatcaaaggtaaattctcaagttgaatcctaaaggaacactcagtcctcttaacttccatggttgtgtgtgtgtgtgtgtgtgtgtgtgtgcaagatagaaatttctgcagctatttaggtgaaagcactttggaaaatgcaatatttcgtattcttcagtagttgatccaaatacatacggtggaatatacaaggtttatattcctggcctggttgcaggggaagaaagtgtcatctcgtggctgaaaaatagtctcagtgttggatactatgaaatcttcagcatgaaaaaaaaaaaaagaacatatcccttctatgtattagcttcccaggaatgaagcaaacataaatatttttcagtttggtcatttgtgaattagtcatgatgaaaaagccttccgtttctgccagatgaagagtaatacagcacagaactttgaggcagtattaatatttctgttgtgcctaaaaagtaatcaacatagtttccatgggtcacacaaaatttctcatgattgaaacagtgtcattgaaagttgggggaaggacacatcggttagaacatatttaaatgaaaaatgtatttatgctttcacttcaaggtaattttatcagaggggctgggtttgggggaagatacctgcaaacacgtgcataaagtttgggcttcatgaaagtgggtgaaagcatcatatttgagctgccacatttgacatgtccccctcagaatcccatggacactggacagtttcctgaacgctgtggtttccccatccctggtgggtgtctgcttgtaatagaagctccaaagatacctggaatctcgaagcttccttcggcatcttcctttattagaccaacttgaggctttctagaaaagcatacactctgtgtttgcaatgtgtgtgtgtgcccagttgccacattatgctggttaagagcatggattctggagccagactgcattggcttatatcttagctctgccacttcttcaggagcgtaagtttctgcatcaccctgcctcagtatctttctgtacaatgcacatagttagagtacctgctgttagggtgtttgtgaggattgaaagagttagtattgtgaaaggcttagaagagggcctagcacacgggaagtgacttacatttttttttttttttttttttttgagacggagtctcactctgtcacccaggctggagtgcagtggcacgatctctactcactgcaacctccgccttctgggttcaagtgattcttccgcctcagccctccgagtagctgggattacaggggcgcgccaccatggccggctactttttgtatttttagtagagacggggttccaccatattgaccaggctggtctcgaactcctgaccttgtgatcctcccacctcggcctcccaaagtgcgggattataagcgtgagccaccgcgcaaggcctgatttttatttttttctatagagatcaggggaatgttaacttcccctagaaacagcatgacttgccgtcctctcagcaggtgagttacagaaggcctgtagagtaccacaagaaagaggcctgactacttatttggaaattagctgtttttgttctgcttgtggagggttccttgagaatttggccctttccctgttttataaggggacaaataaagatgagatagggaagtaggggtaggcattgcctttgttcatgggaccttgctgatctgcggggggatgattgctgggggaagatcatggggcttggaggcagagcgcatagttttggctccagttctgccctaggtaagtcattcagtgtctcgctgaatgggctgagttttgctttcctgcttctgcacttgaaatgcttattgtaaggagagtgaacatggaaatcataaaatgattggacaggctcaaggaccatgtgtaaggcgttaataccaagtcagtggtcattgctaggtatgtttctgaatgaatttaattttttttctggtataacctgcagttggggattttagttaaaaaatgtgctcacattcaagaagcctggaccagctctggaccaaattgcacaagaggtggtgtttgggcttcaaatccagttcctgcttttttgttgttgttgttgttctttttctctttgttttcatgaacttcttcagggactcaatggcctgatcctgcactcttcgccccacaattaatgaggccacttcactatggagcccaaccttggctgctctctctccctatttctgggatctttacctttcttctctcacctacttaacttttggaaacccagttttactacgtgtaacctggagatgccattacggacttcagaagttaacatatgtggtatgtaaatcatctagcacagtgcctggtgtatatcagccgcctctctctgcctctcactcattccgtctgtctcctcttttccctcgtctcccttctcttaaggatttgcctgccaatctatcttttattttagaaatcccaacggtggtactgatggatcagtaaaccctttcatgatacatagtagcagtttcctagtgactgcaactcttcactgaaacaaagacttcacaggtggtggatttttaggctttgtgacaaactcgtgagggctctttggggacaaaggaggacattttagccactccagattaccatttttgcctttgagcattgttctttaatttctcctagaaagaaaagaggaatctgcctgaagcagctctgccatccgccgacacccttggcagttgaacactgattgtcaagcccaccgtgggcaatgcaggtttccttttgccagcctggcatggagtgaaggggaagtttgtgctcctctggttgcctcagctgaccaggaaaccgtaccaggagcagcagggagggcagagtctagtggagtcctctgtgctgggactgtgggaccaggacagggcaaggacagcaggaaggaaagaccaactcatgcagcaaacaccacccacactggatgcattcaactcagtccttagagataaatgttagagacaaaggcaccattaggaaccaggacactggacgtgtactttagagttctcataaagtctgcagacagtcacagtgaggaatgcgctgtaagaatttcagatgaggtttattttgtcccctagccctttggttatcacggtttgttttggttttagcagagctaataaaaaatacatttatcttgctacacagtgatgagacaatagcagaataccaaccctgaaatcacgttattaaagcattttctttttctgtgcttttggagggattttgcattagccaaaaaaatgatgacaagtgttgtcatgaccaaactttcttttaaaagttttggccagattgaattgtaggatcacgttaacatgacagtgggtcttagtggtatttgtaagatgttggtatggccattttgtctaccacagtgttctttaaacagcctttctccaaatgggcatatcgtctttcagccttacagaaatcaaaaacagaaagtgacaagctttcacaccaaataagactgtgtatctccaccattctgttctccagcttctgatattaacagccatcacccaagagggtagagctgttattttgacacataaattgtaccctgggctcctttgaaaatgttctctggttccttgtcaagtttgcattgaatattaaagatagaagaccttggtttttataggcatcacattccaactccaaattagattctatgtgaggatattgtaaataactcagtaaacacatatgaaaattgaacatgtaacaattcaacttccttttcattttaggaattagaattcatagtcttactttcttaccttaatctgattacagtattagaagtatccaaatgactttacatttagctatcaattattattttttaaaacattgcataggtgtgcttcagtttgtacagttaatgaaagagcaaagagtgaagtgcatagttttacagacttttttaggtttgtatttccctttaaattctccttatttttatttattttatttatttatttatttatttatttatttatttattgagacagaatctcactctgtcgcccaggctggagtgcagtggaatgatcttggctcactgcaagctctgcctcctgggttcatgccattctcctgcctcagcctcccgagtagctgggactccaggcacccgccaccatgcctggctaattttttgtatttttttttagtagagacggggtttcaccttgttagccaggatgttctcgaactcctgacctcatgatccgcccgcctcggcctcccaaggtgctgggattacaggcgtgagccaccacgcccggccaaattccccttattttttaaaaaaacaactctggtggcttaatgtattccattatacttgccttttctttgcactttactgagtcaagagtttagattttaaagcttctgttacttaaagtttatggttttcagtagtgttgcatttggatgatggtaggtggtgacagtagatctagggtcctggtaacattctgaagatttgggactcggggcttttcttcatctgctttgctcaagactgagatggtttcaatggatatactttacttcagccctggatgatatctgtgaatgtgtttctgtagaaaacgatgtcatcttaagaatcccatcatgttaacttagggtctgctatcatgtttttatattctggaatttctttgagaatagaaattatcaccttatataatagtttcagaaattttaacaaactataaaaaaaagttgtggggtggggagaatattgaattattaggtggtcaaataatgtataatatgacattttcacttaactgttgacaattggcagcatgaagagtgtaaccagtggatggggtgattgatgtagacataaggaagaagaaatggtttgtataatctctgctgttcccttcgattgacatgctcaaaggctgcctataccaaagattgattccaagaattagaattaaatgtaatcattgttagtccagtactgaatatttcctcgatgtgcttaccatggtggagtgggaggaatcttatttaggtgggctgtggtgggtcagcatggggacagagccaaagggaggcacagcttctctgatttcctgtgtatttgatatccaaagaacacagttaggacctttttcgctcatcaagtgtctcatgatgtggtgtgtcaaagctctcagtggctcttgtttctcactacggtgacctaaaccatttgtcaagagataccattgttttgcattcagtgaaatagaaaggtgaacatgtgtgtatgtgttttggaaggatgggatagtgccagtttactagcaatttcctgtaatctgcaaccagtcttacctatgcaaccccaaatattttggggtccagagccttgagaacgatcactattattatctgacagctgcataggggtgagacaaaccataaaatgttgagaacccccagcctagacagctatggcctcactgttgtgtctggcattcactgctacaaacaacacaaatcatgtactttatatcttgaagttgtcactcagccctgtgttttctcatttctgtgtctttacttagatcataaacctaggatttccttttctctgcttatctaagtcctactcctctttcaaggccaatcttaagtggcttatcttccatgaagaattcccagactgttttaactcacggtggttccctttttctgggagctcatagtcattatcagttataccactttgggctattcatcaggagctgccgtgtgtacttttatgttcttttgtagttgttatttaactgtcattttcattaacttctcaagcaggtatgcgttatctcctcaacccagacatggggagcaggacagtatatccagtaattttttgtactgtctgcataattattcacgtcccgtattcatggcaggggttgttattaagcatgtgttggctaactgattataagacagttatgtgcagacagtaggcctcgctattcttttatagctcatttttcctgcatgttgctaggcacagagtaagttttgtgctttagtccctgtaagtatatggtgactggctgacccactgggtccacagaaacacacattcatgcttctcattcaatacatttcgtgtgtgccttgtgccctgcttgtggaagatagttcaaacatgttaattgacttactcttcatagtagccccttgagttagctgctgttatttatattttacagatggctaagggacttagagagtttgagtagcctgtccagatcttatggcctgtggaacctggatttgaacacaagtctgagtaactctctcaagagagagtttttgtcactcactactttccactctactgaattcttactacatacatgccacacttcagttttttagtcattcctatctctgattagtcacagttttgtgtgcatacatttctttgtgagtcatcattttgggcatagaactgggttgaaactcatagtcagcaacccagatttgtctatcatatcctccatcagaggaaagttcctatcaatgtaaatagagggatgggtggcaagttattttaaaaagctgatatatcacagagaaaaaaatcctgctaagagagggagaccctccctctcccaccccttcactcctaccccacacatcacactcacacatcacacatatcacatacatcacactcacacatctctctctctctctctcacatacacacacatctttgggagcaaaaagtaattgagttttatttttaggtcagtgcaattagatttttctttactcgcttttaatattatattagctttctctgataaaatgaagaagcagtttacgcctgttgaggtaatttctgaatcagatgtgggtttctttatgctccaccatgattggccagttgctttgtaatgaaggagtttgcacttcagctaagcctggaaaaatgtctcagctccttctactgggtgtgccaaccctttcagctgttcaagacacaggatgtgaggaggaattgtttaacggtgacagcatggagtaaattctgacatcaggtgtcaggggttctattcttggttttgtttctggactgctaatttagggtgagaatgattttcccctcagcgtcctcatctgggtagtgaagtagtccaggacagtatttttgcagccattatttgggtttacatgatctccttttgacattctcaagtaaaccctgctttaagttttaagacttttataccacatctaaaggctcagtggagtgagttgagccatcagagaaatctggcttgttgtgtcttcctcatttcttttgattagtctgagttgccagatcattttcaaatggctgtgcatcaaggctcacctgggagcttgtaaacatagtggtgcttggcccgtaagaggccggatccacaggggaaggtcccagtagttcagattttcagagttcttcccaggaaaccgtgaagcatactagtgataagggcatctgggctgcaccattaaccagctcaaaaatagttcattcagaatttccccatgactatttcattattttgttattagggttgatagttttaatacataaaaatagaggataaatgataatattttatatataaataaaaaacatatatgtataatagtatatttaatacataagaatagaagataaataataaataaaaataggtatatttgaatttctgataatgcatattcttgcatgcatatgtcccacgcaatattcgaatcttgttttatcttgtttggcaatgcttcatgccatagagccaggaaaatctcaattctttcacaaaaactaatgcagagaggtcacaaaggaccttgagacagagggtttgtagaggctttggtactgcccattaaaatgtattgagtccttttgagaaccattatactggaaatttggagacgccttttcaatttttggttccttttcttctctttctgttgcattttgccagtgcagcattcacttttatttcttaaataaattgaagattttttttttagagtgttaaggaatttaaccacatggctcctattaagccatcattgcatacagaaatttgttacaatctttctcatgtggatactgccaccttctcctaaactgcagagtatcttgatgtgaggtgtgtaagaaatctaagacctcctcactggccaatttgttgtcttcacaaatagttattctttcaaatagaatatttcttactgtagttaaattgtacttctttaggctcctttggaaaaaatttacccaggacataccaaacaaggtaggaaaccaaggcattggccattgttcaagagcaaaccaggtcagcaccaacaaagtcgggattcatttctattgaaactgatctctgggtaccacccacagttattacaaactgactcagcaaaaaaggcctgtggccattcgaaaagcaaatatttttgctttggcttttatttaataagttttcaaatgtgattttctaggcccctaataggcacacttatcttgtgaatatggcagatactagcacagagcctgcaatgggggttgtgattgtcaaggatctgctgcttctgggtgctttggggtggaatgtgggtggatggagtaagggcttctgtgactgagaaccacattcctctctgtctgcaggtgaggacagtttgattagttcttacaacatttttttttttgcaaactcaaaaatatctactaatacttctgattttccaccttaaaatattgttgtcgaaggaattaaggagttctgcagctcaaaaacaaagtgttcccaaatttacttacctttttggtaagcacatgttaggttggacctggggaaataaaacagttgtctgtgttgggtcagacacagtggtgatcccaggcaaagggtagtcagtggggaaatgagatgaacagtttccttccctgaggccccaaaccactgttttgtaaaaggagcattggaaatccttccctcaactgcacttttttttccatagggcaaatggactaatgaataaagaacaatgggcagcaatttaaacctctagaagagctgcagagagtgaaagtgtttaggagggaagacagaatgagcctggctttgttgcccttcacccagctcctgaagccctagtctacagctaaatgccttcacgtctgtgtgtcaaatattcatctgtaaagaagtgataatgccacttacttggctgggctatggagaagattaaagaaagtaatatatgttaagtgcctagcacaatgcctgggaggggtatagcttttaaggagttcagaaaaccttaattccctcttgcctttaaaactccatttgtgagggtatattctagaattagaaagggtacttattgcactaactcgttaagagattgttcatggacttgtttatttatatgctgtgttttctctgattaataacctactttggagctcaccacgaccaagcatgaggtaaaatgatcttcctttactcaaaatgtgtgctatatttgaaattctggctgaccgtggccgcctcaaaaactcatgacctcagttatccgggtttccttcagctctagtgctgttttaattataagtatttacttttttttgtttttctttcgtggcaagagctgtgtatttccattaccatggttatcttctgatgcctcaaagtatttggctgttttcctttatttaggcataaaggcagagacattgtaatttgtccaaaagtatttgctgtctccaaacagtagacagaatggcatacatttatgaagtgctaaaccattaccattgttttgtgtttggtgcttgcaaactgggagctttacatgttattaaaagctttcaacaccttcttctcctcctttgaaaaataatcagcatattgcttgcctccagcattcttttaaggaaagccaaagacagtgtttttcaatttccgaaaatctaattccaaatgcaatggcagtacacactggttggaccttttaggggtaagttaacaagctgtttgtcctatttgttttcaaacccatttcagatttgcagctctccatattaaaactagttgcttgtttggtggtggaaatattctattgcattggagaaaaggtattgtagacacaccttgaaagtattccaaatgtacctgaaagagcattgacattcagccatcagaggggagcagaaattctgctggcagaccccaaatctttgacatgaaattcacaaaatgtgcacacgttttgtatttctatttagaaaaagtggaaagccagctctgcccatgtgtgctcctgatcttaaatactgttattcttctaaatatagttcaggacatttgtcagtgaactgtgaagctattgttaaaaataaaatggaaattcaaacctcaaaataaacgatgagcgatttgtaatgcattaccacttgcggttttcgcttggggttggtaaatctgaggcccatggaatcccattttgggggaaccctatttaaatactgtagtaaaaggcttttgaatcttataattctggtggctacttttgcatttgagtagaaaactacaaagctggattgatttttcaaaaatgtatttttatattttgtcaatatatataaaaatggaggagaggaagtgaaatgattcattttagatgacaaatgaatccattttcccctgcagtgctcttacaaaattcctgttgacattcaagttaagcacatgcatgaagaggagaattctagtcacaagctcactgctgctgtctctaaaaggagatgcatggatttttgttaattccctgcagccatgctccctttcaagactctgttttctaggcagtctcctctcttttagtctggctattagcctctgaggactatgccctaccttccatgtgtgttttcctgattattttttttttttcttttgagacagggtctcaccgtgttgcccaggtcagagtacagtggtgccgtcatagcttgctgtaatctggaactcctgggcacaagtggtcctcctgcctcagtctctcgagtagctaagactacaggagtgcaacactgcacctggctaaggttttttgtagacatggagtctcacagtgttgcccaggctggcctcaaactcctgtcctcaagcgatcctctggccttggtctcccaaggcactgggattacaggtgtgagctaccacactagggcctgatttacttttttattttttttcactgtcaataggacttgcgcgagaaggtcgtgagcagactttggcctttattcaggaaatggctatcactgtctctggagattgtgtcaaactgagttgagcaggaaagggcccaatgtttctaatgttgcatccactgccacctttttgttgtcacctatgcacaaaaggacacccagtttgttgtttaaagtatatatatatttatatatataaaaatatctgtatatatatatttatatatataaaaatatctttatatataaaaatatctttatatatatttatatatatttatatataaatatacgtatatatatttatatattttttatgtatatatataggcacctgtgttttagcccctagttctccatgtagacatttagaaatttgctaaatattctcctgcaacagtttttgtgtgacttgtgccagaccaaaaaaaatcacaggctcactatattaactaggcagtgtaaaagcatattgcaaacattattatcagaagagaacaactttgtaagtctataatcattttgaatactaatggcagcaataacaatggtaactgatgggtgataaaccgaggacggatggctaagtgctgtctcggagaagtcagcttataaatcagaggcagagcacagggaaggaggacaggcctgacctcaggacaaagctttcaaccctgacacaggcaaagaaaatagtcatcgtagcatcgtggggagatacgggttgagtgatataataaacctcttttaaggaactttctgattttttccgcatatttactttacgtacctcaacccagggggcattctttcaccaaaggagtattgcttcaaattgaataaatgcacacacaaaaaaatcacaggcagctctactggatggtgaaatatggctgccttgtcatgagaggagttaactgagtctcattgagacctggatggccatccctgctcctcaaaccagaaggcactccaaaggctggagatgtcttgcaaacttgggaaatatttgagcagcagaaacacatctctcccagttggagtctcaaccttctgatccaccccagcacccctgatagaaatcagctttgggaaaacactttgaattcttgttttgagacgactggtgtctgcagtgaatctctgttcctctcccaccctcccttctggataaggtcctcctttctgccagccctgttggacttttgtttctccttcccccgggagctgcctttgaagtcagtgggagctgtgcagtgggctggtgagagtgggaggctggagtgggggaaccaggcccagatgcaatctatgctgcttactgggattatgggtttctccttctccttcctttttatgtatttatttttattttgaaatgtgtgtcttctcttggctaaaataaagaccgggggaattggtctggctttaaagaaccctctggagccagcttattcatacagagttaactgtgacaagtagccgccaccaaagccacaagtaccaggatttggaaattggacataaacccatttcatttatgcttaggttatttgggaggggtggggaagggctggaaagtgtcggaaaatttataaatgaatcctgttgtcctctcttttctagtatctcgttttccagccacttggagcaaattaatttgcctctcagaaccccaattttccgtatctataaaatggaaataaaattcttagcccatggggttgttttgaagatgcaaacactgatattcttaagcactttacatagtttctggttcattttaactgattaataatttgaattctttgtcattatcaagactgtatttatgagatggcaagtttctactgaatatgtaataagggcttacagggcaaaaatgacagggctgtctttaaaagcgatgccactgggatactagtgaatacttctttgtgaatatatccaccaatactctagattgggtcaggggtggtcattccatgcacagggtattagaatttttttttttttttttttttttaaataagtggttatccaaaggggttgatgcctgggtcatttggagatttgtccttgaacattctccagtctggcttgggttgtctcagttttgtcactcagatttgcatcttgtctttctttctgtttttagttgcttggatttctcccaaagtatttgtggctgaaattccttttggactctgagctgccttttttacataagctttggattggaatcaatagaatgtcaagatgccaggcacattcagcctaatagcaggtgggtgtctgctggacagtgtgcctggtttgcctgacagtagcaaatttaggccagaattaatgagccagggaaggtactgttggtgttgcaagatttttgcagttttcagaagtaattttgtttttcctttttaatgggattttcagaagttttcagaagtaattttgtttttcctttttaatgggattacatttgcaaaagaagtttgtgttcatatatgtgcgagtgcatgcatgcccctttattataatacctttatgatggcatcgaggcaatttatttttagaaaatagtattcacacatacctaaaaatctggttcataaaccttaatagagtttcgttaaagttaacggtttgtcttagtctgtttaatgttcaaagagaagaaaacacccaaaagtggagtgaattgctgaagtttcttgtgtacacttattaggacatattcctgctatatgatgagctatcatcagaaaacagtcagcagaagccaggtcatgtgggctggtgaggaaaggaaatgggtgtagagcaagcgttcctgtgtttctagcggattgagaaaaatgcctgccttttgattttctttttcctctggggttttacttatatatcaaggagtaaaaaaagaaatccctcatttatctaggtgcttttaaagaataaatgtggaaatgcaagtaaagtacctggtgtacatcctaggcattccaaaaatagtggcgttctggctaatccgaagagattagatgagaagtccatagtgatgattcaggtttctttcatgttttatatattagctggcctttttgtttttcttattctttatcttgcaacaggcattcgcttatttcggcttttaatttctaacataaactcaactctgaaacccatgccttctaattgttgaccacagatacccttgaaatttgcgcgaccgcccacagtgggatggtattaaaacattctgatctagatttgggcagaggatgaataaaatggaaatgaggcttatgcaaattagcttcccatttgtttgaagatggtcgagggcagcagcagtccttgagtcttccagattttagaacagagcaagcagtgctctgaatgacaagcccttggcttcacgtggctcataacaggataccacttacccccagagaagactgacctctatatttagtggtcaaagaaaggaaaagaattgttggatgctaccattgagtcctagttcaaacagtttagaaaactaccacatctccacttcttggagcaatatggcggttgttcccttcccctaggttcacagcctgagtcttcgtgggccttcatagcacaagtaaaagaatattaatgttagaagttgactccagaatggagacttccattttcttctggaataaaagattaaattatctctataaagtagtaacattatatacattcttacaaagtttgttttacagtattattttaaatttatagaaatggattgtatataatgaaattatttatttttattcagggaaaatgtgtatttatttatggggcttatgagattggtgccccaaagttcttgacccacgtttcatttgagtaaagcttggtgtaaggtttggaatcattttgtagtgttatttcttaagatctttccacccacagttaggacatgtgacacatgtgattctatgtcatttcatttcaacttgggtcttacttagcctttgaaaggatgaaatcctgactctggttgacagctgtgtctgtaaacatgaatgcagtttggtattaacttttatctttccatacagtgaggggcatggaacagtaccactaacaatgggaggtgcttacataatgttaactaccactctacaatctgtgtgatataggaggttgaatccatatgtagatcctgctcttagatcctgtagattgatggtaaagcaaaaacaaatggagcgttgatagaattctgttgagtagccatatgagcattattctgatacatatgaaatacaaccttgtgattatatgatatatgtgtttgtatatgcatgcagggtgtagttgtggtttgtttcaatttaggaacctctgtgaaagtgacggaaagcttgaatggagaccctaaggaagaggtagaaattacttgttcaataactcttagaggtctttttcaatactactaattgattgtgatttgtacttagtgtttgtttgaggcattgtggcaaagtggtcaagaagtctagaattaggccagtcagagtttaaatcctagcatttattagcatagattttgggtgcattatttatcctctctgggatcagtttcttcatctgtgtaatgggagtaactggagcatcgaccttataatcctactgtgtgaattaaatgaagacatctcaaataaggtgcctggtacgtagttaggcactcagtaaaccatagctattgccattataatcattactataatatgtataatgggaataataattagtctatcttatggactaatatagtccttgtatggattacatatctagctgtttttattattaatttaggatgacagcacctaattttgagtgttgttaagtagcggctagcagaaaggacctcattttataagattctgtgtaggttggagatatatacatatatatccaactatatatatatatagtttttactatatatttctataattttctgcctcattgtttgatttcacagctctggaggttaaagctaagctacctctccactctcctgtccctgcccttatctaaaatagaaagccatctgaaagaaaagaacctagggaaaattcccatgtgagaaatgaaattgtccttgtgaagggttaggactctaggaactgtgtgcagaaaatcgttgaaagataatctttataggatgctgaaaattactggcagggatcaactctgaaggttaaattgtctctgccagtgcctctaacaggaaatacaagggagatttatttatttataatgtccaccttcattttgtatactgtgttgtaatacttagagaaataaaggtaatggaaaagaataggtaaagtacattcattttgttaaatcagaaattcaacaaacagtcttaacccattcagaagccttgcagctggtgtgctgaagtggccagatttttcctagttgtagttgtcaaggagttaatccattgagcaactgatgagcactctgtcccatgaacagaattcaaatgtggattaaagcaatgaattttaggaacagaacgctcctattttggcaacagttacttgagccccaagtacttccagaattaagcagtagatgctgtggagagacgctcctagcacagccctggactcctacaggataaagtcaggatcagagctcctggtccgcttaaagaatattccctcaaggcattgtgcacggaaggagatataatttactttacataacgtggagtgctgcatgttgattgccatgccctagaaagagcagaggcagaagcctcctgaaaatcaggcagaaggaagagaaaatgggctcttcttaaactaatcagaatctgaaagtggatatatggatgttttaagaataggtggtggctgaatgcaaaggtgcgcctgtaatcccagctacttgggggcctgagctgggaggatcccttgagcccaggagtttgaagccagcctgggcaatgtagcaagacactgtttctttaaaaaaaaaaaaaaaagactaggtagtgattggcattagtgtttggatctgcctctgtggttgcagtagaccgtctttattcttgcaataggatttatttatttatccctcagagaatatgggctgcctcacttcctcaccagtgagtttgcaggctcaggaaagctctacaattaaattgctctattgttttaacctctctgtttaagcactggtgaactagggctccttagctacttgcctagcaaaatgaacaagttgattaatatttgcacaggactagaaaatgccttttttgaatgagatgggcacatatggctgcatagtattgactcaggacattgcacttatttccttgtttaaataattagcaaaagaaatcatattaaaaaatgctgaaaggtataaagagaaaaatgtgatggccaatcaaagctgtgaacggcctttcttatgctgtgtcttaattctgtatttctgtaaagcagtaggtattgaatgcctagatggagtggctcaatacagtcagattttgaggcttttccttagacattctgcagttctttctcctcttggtgtctttcaggacatgacagtatgccccccagagccacagaggacagacatccttctctgggcctccatgcctgctcctctgcaaacagggcaggtcctgcccgggctgagcagagaatcgcttcctgtgcagttgctggccgcccctgcagatgcagaaccctgacacagggttctaagtggtactgaaagctgctttatgagccttgcagaggcggtgtgcatgtgtgcagctgcacatctgcgagaatactggtgggttcaggcaacgctggccctaccttagccaagccttctgtgtgggagctatatgaggcttttgtactcttgcttagttttcattgcaaatggggccgtatccaaaaggcatagagtgggggtgggaggtgggtggcagggcggggggaaggtagaaatgatggataaagatgtaagaaggataaggagagaccagatgcagtcgagggcttttgtggcatgaggaaaggatatttaacttggcaccaagaaatggggtggcattctaatgctgctcctgacctcctgtgtgaccttgagctccagtttccctctttgtaaaatggtggccctgatgactacctacaaggttggaggtgggaataagggacctaatgcatgtccagtcatctgtcatcaacactcaataagccttttcctttcgtggccatccatcttcaggtttgacggaagtgaggatctgccctcagggttgaaaggtcaagatggtttgctcaaatattttatttctctcataaatctcttgcaggtttggttcatcccagactattctttttcagggcagtatttatattgtcactgcgttcaggctgccttccccatttgatggggcccagcagtgttcagttatactgataataccaaaattatcttcattttaaaaaatgtaaacctttttatttctgatcattaatgtaaggtaagtatattgttgataatttggaaaatccaaagttaaaggataaaattactactaattgtaatctcagcacacagaaagaatcatgtgtgtgtgtgtattatatgcatgtgcgtgtgtatagagggcattctatttgtattgtatttctttattatttagggttgttgatactgtaaaataaatgattttttttgagaatgaagatgggtgaaccttgtttttctcatatttaactaaatctaaatgacaggatatttggtaaaaggagatataaagctacaagggcccttgcggcacctgccatgaggtctgtctaggtgaagagctggggaaccaaagatgagcagctgaattttctgttcttgatgttctgcgggagtaatgatgcaccagatgataatgatagaagatattttgataatttacttctttgatattggctctacatgcttttaattaagtatatatatttttagttaaatatgtaaatatatttcattaaaagcatatattttaatgaaatatatatttaattaaaatatatattatacttaagtgatataagctatatacagtttttatatagtcagtgtatatttattatattttatataatcagtgtttatataatatatataatacacatatgtatatatattacatattaatataaatatgattaattctaacaactccatgattttatctttatcattttatcttcattttacagaagaggaaaagaagccacagagaggttagtgaagtaacttgtccataagtcacacagcagtaaacactggagtcaggcttcaatcccagagcactctggagcctgagttttcttacgtactctgcttactgcactgacaatactgatataagaaacaatgttcaatcaataacatacagtttcagctatggaaaatgaataagttccagagatttgctgtacaacattgtgcctatagttgagagtactgtattaaacacttaatttgttaagatggtagacagcatattaaatgttcttactataataaaatgaacacttaaaaaaagaatacttacaattgatgctttataatcgtgataaaactcactcatatttatgtgccaattcttacacagtttaggaattgaaaatacggtattttgatatatataggtaaatatatgaagtaaatatatatgtacacacacacacacacacacatatctcaaagtaaaaaggaaaaaataaaaaaggtctttgtttaggtttctgttttagcaactgaaattttaacgccattcaggcaaattctcatgggcatggtagatatagaatcagtttagtcgtgatcctgtcatttgtacagtggggtcatgctatttctcaaagtcagaagaaagaagttcacatacaaaaggttgacgtggaaagataagctggttttcattgagcttaggtggagctggttttcctttatagaccagtatatattctcctgcttggccatagggaaattacatgctattttatacacaattatatattactttctacaaccagtatctaacttgatatttagcccttggctctatctaagacaaaggtattgcaattgcccattttaccatcaaacgaggaagctttgttgtacttcgctttcaaaatgatccttgaaaacctacacacatacacacaccagcacttacattcttttagtatttcaggaagtgggcatgagtaggtttgagccttgaaactgctttgtcatccagtttgtagctggctaaggaatggaaaaaaaaaaaaaaaaaagaagaaagcagagctcatcttgatcattgtaattggcactgacagcaaacaccagtgtgccaatagcgccaaagaattcctacgcaaaagctacttcagctgtccgagattttcctgatttgttttgtttgtgcatttgatgtataatcttgtggtttggccctcctcaccacctaaaacagaaaaagcatattcagttcctaggtcattttaactggaacttgatcttcaagttccaactatgtcaacaaattaaaggacttgaccatgaattttttttttttctaagtgaacactttgccattcctcaaaccctaccgcaggttcagcagacacatgtaagcggcctctttagatgtggtcaccgttgacagctcaaaagaacaaaatcaaaaccctgaagactttacataaaaactcatcgttggaagaagagctcgtatttcaaagatgatattaatatgagaatattttttaacatcctcttttagcataaatttctcatgattaaaatattacccacaatgctgtattgtctaatcacctggttagtaagatgtctggaactgtggcatggtgaatgatgaggaaatgttctgggggactgcttttatttcagcttcttttttgtttgttttttttttgagatggagtcttgctctgtctcccaggctggagtgcagtggcgcaatctcagctcaccgcaatctcggcctcccgggttcatgccattctcctgcctcagcctcccgagtgatatttcagcttctttcttattgatgatgatgatgggattagacaaaaatattgcagaacgaaacaagtgtcactatttgagtcccgaatcttattttcttcatactattatacacttaaaattagtgcctatttttgtctcctcttatagcttcttctcctcacatcttgttaagtgaaagacagacgggccttaatattactaagaataataaaaatacttccaattcaataaacatttcagtaactggatgaaggtctttgcttgaattgtctctcgtggtaccctcatctacccttcaaggcaggtatgctgtgttaatgatagtattactcaaataagacttggccttctagaaattaaatgacttgatccagttcctatcactagctcagtttttttttttttttaatttttactttttttgggtacatagtaggtgtatatatttatgaggtacataagatgttttgatacaggcatgcaatgtgaaataaccacatcatgagaatggggtatccatcctcttaaggatttatcttttgtgttacaaacaacccagttatactctttgagttactttaaaatgtacggttaagttattattcatcatagtcaccccgttgtgctgtcaaataggtcttatttgttccttttattttttttctacccattaacgatacttacttttcccccaccccagcccctcagtacccttccagcctctggtaaccatctttctattctatatgtctatgaattcaattgttttgatttttagatttcacaaacaaatgagaacatgtgatgtttgtctttctgtgcctgctttatttcacttaacatagtgatctccagttccattcatgttggatgggtgataggatctcattcttttttgtggctgaatagtgctccattttctttattcattcatctgttgatggacacttaggttctttccaaatcttggctattgtgaacagtgctgcaacaaacatggggatgcagatatctctttgatatacagatggccaacattttctttctttggggtatatatccagtaatgcaattgctggattatatggtagcttaatttttagtattttgaggagcctccaaactgttctccacagtggttatgctaacctgcattcccaccagcagggtacaaaagttcccttttctctgcatacttgccagcattttttattgcctctcttctgcatataaggtatttttactggggtgtgatgatatctcaatgtagttttaatttgcatttctctattggtcagtggtgttgagcaccttttcatatgcctgattgccatttgtgtttcttcttttgagaaatgtctgtccaaatcttttgcccgtgttttgattggattattagcttttttcctatagtcgtttgatctctttatatcttcttgttattaagccctggtcaaatagatagtttgtaaatattttctcccattctgtgggtatgtctcttcaccttgtggattgtttcctttgctgtgcagaagctttttaacttgtgatcccatttgtccatttttgctttggctgcctgtgcttgtggggtattgatcaagaaatttttgcccataccaatgtcctggagattttcccctaggttttcttatggtagtttaattctttgaggtcttagatttaagtctttgatagattttgatttgatttttgtatatggcaagggatacaggtctattttcactcttctgcctatggatatcaagttttcctggtaccatttattgaagagactgtcttttccccagcatatgttcttggcacttttgtcaaaagtggatgcgctgtaggtgagtggattctctattctgttccattggtctctgtgtcagtttttatgccagtaccacgctgttttggttactatagctctgtagtataatttgagggtaatgtgattcctccagttttgttgtttttgctcagatttttttttttttttaaacataacattatagaccttttgagctctttgttgtaggatgctgagctgtgcatcatatgggattttgcagcattcatggtctctccccaccaaatgtcagtagcatccccagtcaagactatcaaaaatgtctccaacgttgccaaatttccttggggtgggggcagtgaggcaaaactgccccctttagaatgactttgctagccgtgtgacagagcctgggaatgccctagacgaatttccttcctcttaacccatgtgctgtacaatacctgtcttcttgtcccttctgttttttcatctgagcataagagtttagaacttgaaaagcaaatcactaatgtctgctttttcatctcaatgataggtgaagtgcattgatgaatacttccttttctctttgtgggtatagtaaattaaatcttgtatagagatccatgtattgtgaaggcagtagtatttgcacagtatcatgcatatggagaagggatagagtaaggatatttattttattttatttttatttttatttcatttttttgagacagagtctcgctctttcgcccaggctggagtgcagtggtgcggtctcggctcactgcaacctctgcctccccggttcaagcaattctctgtctcagcctcccgatagctgggactacaggtgcccaccaccatgcctggctaatttttgtatttttagtagagatggggtttcaccatattggtcaggctggcctcaaactcctgacctcaggtgatccacctaccttggcctcctgaagtgctgggattacaggcttgagccatagcattttttaaattgctcacctctctttcctaattgtgtgcttgggatacatgttcactgagtcagacttctaatcactctttcctctgaatttctgtgtggccttgagtgagtcactaaatcatttgtatttcttctttatcttttttgggaaagcaaacaccatcttctactgtaatacttttacttttgactttggagggtagcatgatagtaactgcaaaactctttgaaaggaattccaagacatccaattcattgaaaagcaaatataatttttggaaaaagaaagcattgttcattggaattaattttgcagatgaattagttcatttatcagccatcaatcaatatttaaaatacggtaagaagaaagccaggaggtagtaacacaaccccttcccaggccgttttctcagggataggccctttctcaagccttggagtcactgaggattgggtaaatacaaaaccactgtagaaaaactgaatgaaagcacgcatcagtagtgactggatgttggtatcatccactcatttcatagaagctgaggacacatcttgcccttttccagtatagatatgtttgaagtacattgtcttgtgggaatgccttttcccaattagaaatttggcaatggaaaaaaagatttggcctctgaagttctgaagatgcataggcaggggacacaccacagccctgcctcttgcttgaggaagttacagagcaggttgtaattaagcacttgaaatgtaacaggtgaatccttaggtgactgggaatcccatcacctcaaccctgcaaaatagccatcaaattgcttttgccaattagtacatgaaacagctgaaaatataacaaatctccatttatctagggcggtaggcaactaaatgtttcttcttaactgctcttgatttattgagtgaagtgaggtggtgttttgtctggtgaatacatagcatttttactgcttaataaatatttcatgagctaagccctgactcttatggatgtggagaataaagaggcattatgcttatatagaatgctatataattttaatatgcatttatgtcattgttttaaacacataaacagtcaagaaatgaataactccatgaagttgaaattaacaaagtaaattacaaattgactttaaaagtgtcacattaaatacttttttccatagttgctgattttaccctgcctgcagtgggtcgttaaaacagatgtgacaggaagaaaacaaaaaaaatattttataagttttttttaagtgataggataaagttggttttcttgtgatggtagaaaagaaaatagaaaaataagaaagtgtccccagagaaagaaggtggtagctcccctttcttctgctcgttacatcccgaaaaccacatcctggttcctctccttatctggcagcaattgggctgcaaattgtgggacacgtggtaaatgggaacctccactcacctttcttttttttatcaggtagatagaactgatagaccatcctgtttggtggtaaatatacgtcaactctaagaacaaatggggtctggaatttgcaaagaagtatcaccattacttgccaggtgaaaatctggaatcagccgggtgcagtggcgcaacggctgtaatcccagcactttgggaggccaaggtgagcagatcacctgaggtcaggagtttgagaccaccctggccaacatggtgaaaccctatctctactaaaaatacaaaaattagtcgagcatcaggttgggcacctgtaatcccagctactcaggaggctgaggcaggagaatcgcctgaacccaggaggcgaaggttgcagcgagccgagatcgtcccattgcactccagcctgggtgacaggagcgaaactccgtctcaaaaaaaaaaaaaaaaaagaaaaaaaagaaaacctggaaccgcatgaattctgtacctgttcatacaggataccatgcagagtataatggaatatttggagctggagaacattctacattgttggctccatgtgcacagggctttctttgtagtcattctataatattttcaaattacatacatgtttaacacaatattttcaagtaatagtttcaaatcagtggattgaaaatgtagaaaagataccttcatctactgtacactaatctcaattcacatttggatatgggtaacatttccttttcttcttaggctaagtaattgccaccaggttatactgttttttaagaacatttaggttaactacaaaagagaaaaggaaacagacattttgctagatgtttatataattttcctagattaacttttaattttttttgaagcatgggttgctttcaaatggttaattttaggcttttcctaaaattttcagattttcctacaatgtctgtgtgtccagttctgtgtgacttttgaaagtccatgaaattaaccactatctcttgcacataatgttcaaactctttttctcagacctcaccttctggctgcagggccagtaaggttaatttagagcatgtcatacctttcacagggctcttccttacatatgattgaaactctgttgattgaaaatgtgttgagcccaaatctgtgagtgccagtagggttttcaatgtcatgtactttctgaggataagaaccaaggtattgttgggtatttaaagtctatctcagagccaatgaataatgttttacaaattcttcactctttacaacattgccaaccttctactgtttcttttggctatttagcattgttcgtgtgacagttacctgggcatttttttcccctttaattgaaacaattttataactagctctgagcattaaagatacttagcatctgatatttaaaaattatgtttttgtgtaattccagaactctgggagttcaaggcaggcggatcacttgaggtcaggaggttgagactagcctggccaacatggtgaaaccccatctttactaaaaatataaaaattagccaggtgtggtggtacatacctgtaatcccagctactccagaggctgaggcaggagaattgcttgaatccaggaggcagaggttgcagtgagccgagatcatgccactgcactgcagtctaggtgacagagcaagactctgtctcaaaaacaaaacaaaacaaaacaaaacatatatatatgtatttaaaattcctagtcatcttatatattgtggatcccatcatatgtctacttatttagaatattcaggtccaattatttgttaataatttgtttttaaattcattaaaataagttttgtttagtaatgttaaacatacactaagcatataatatttaactgttattgcttaaatattaaacactctcagttaagggacaggaggaaaaaattgtgtaggccttgatcagtatggctgggaaggcctggggatttgtgttgtgtgtggaatgtgtgtacacgtctttgagtttggttttgtgtgagtgagtaaaacttcatcaaatagccactcccagagatgtgtgtgtgccgctccctcatacctgtaagtctcaactcacataccctaggtgcggcttagcttgactgtgactatttaaaccttggccctccaccacaaactctaaatctctcttaccccagtaggtgctcaataaacagttgagaactttctccctgagctctgaaagaatgagggtctttggagttgttttaatctcactcatttgcagttgagaaacacatgttttggtacttttgaatctaaacccgtctcctattcaattttcctataatcctcataaaaactaaagtttacttaatggagttgactcttgaaaaatgctggagttaggaacacggaccctctgcacagttgaaaaatctgccgttaccttttgactcccccagaatttaactactaatagcctattgttgagtggaagcctcaccaataacacagtcgattaacacatactttgtattttatatgtattattgacagtattcttacaataaactagagaaaagaaaatgttattaaggaaattgtaaggaaaatacatttacttaagtaaatgtattaagtggaaatggatcatgataaagttctttatcctcatcttcttcacattaataggctgagggggaggaggaagaggaggggttggtcttgctatctcagggtggcagaggtggaagagatgaagggtgaaggggaagcaagagaggcaggtacacttggtgctacttttattcaaagaaatccacatataagtggacctgcatggttcaaacccatgttgttctagtgccaagtatacttccataatgcccaaagtcattaattaataagagatgtgttttataagttagaaagaccctggctttgggagtcatataatcctaggatcaagtgctgatgtttacagtctgtgtaaatttaagcaaatgaatttacttaactttagttttaagataaatctcacaaatgggctagtaataatgacctacaagaattttgtgacaattagcagtaagatgtgaaaaaaaaaaaaaaaaatgcccgacaaggtgcttggcattgagaaggtgctcagtaactgatttgcatacatttcaagtatatatatgtgcttgtttgttacatatgtgtatatgcacacagctatgagaaatcatggattcctttcaaaaatgtggaagaaagaaccctttgaagtctatatgaaaagagcttaggaattaatgtcctgcttttatccacggtataactgcctaccatgttcaaagggcatcgatagaattaatattcaaaattttctttgaagccctgatacagaaggacccggaagtaaaacccatagctatttctataggggaataagttctcaatatcaagtaacagacccagtgggaaaactaggccatttctggtttgctatgttttcttgacttcacatatatattttcttggttctgtgaagaagatttggaagggttcacttggcgggcaagaagtgatcgtgtttctttgtctgttggttggagttgagctgtacaagtcccctggggcaggtttggaggtctttgagatttctgcaattgggattggactggttttcattccgattcagatgggctgtggctgcatctctcaggaaattacggttcactttttgaccgtccaggaagagccttttaaaatagtgatgcccaaaaaacaaacaatgactccctgcatagggcaaggaggctgcatctcacccaggggccaggaaacaggcgcccctgaacctttgccgttgtttgttttcacacgttatcttctcttccagatctggagactgacatagaaactgtcctcgcggatttaggtgcggtccattgaattaccaccaatactcatcttcacaagaatcttaaatagaatcaggcgtttctgtaaatattgaaacaactggacatacacttttcatgtcgctctgttttcctttctgaggagctccagcacatttgttagctatttgtcatgttacgccttttacaatcatggaccaaaacagagattagacactaatgtaagacagtctttgttgtcgttgttgttgttgttgttgtttaaatgtggaaaaaggattttaatgtgggaatttattttctggaattgtccaatgtacaaatagataaaataatttcagaggtagagattctaaagtaattgaacccatcgtcttgctaaagacttttttaaaaaaaacattttcattatttaaactctcttagcctatcatgatggtacctgggagaattcagagtttcacaggtgagcagttactgtgcatctggcacagatgagaacatgctagttgcgccttgttatggggtgtgttgactttcaattgattttaagcacacttgaaatggtaatgagaatactgagctgggagagagcatatggccttaacgatttgattctcagaaaacaagcaaacatttaaaaatgatagagttttctgagcgtcaaagtcaaggtgaaagctgggtgtttgaatgacagaaacgatttattctttattatctttagctgtgcctttattatattttattgcgttgagatgaaaaaaatagagaggaacaccagcatttgctatccaagtttggatcaaattaaatatgacataaggctttgctcaaaaggtatgacaactttggcgcttttgaactcaaatcatcctttcaaacaaaatttaatatgaaaaagtcaattaaaatataataaggaaaaatgtagctcaaggagctggaaaatgagagaatatatatcaggccatgagagaaagatgaagagaaatataagctgttagggcatgaactacatttatatatacaatactccatacatattctcttattaactaagacaggtatgtgagaaaaggagatgggcgatttagagaacgttgatttctttatgagaaaatacatcctattacaaacatacgtggtaagtttgtctttttatttgttctacctgattttgctggctgccattaccagctaaatggcaaagtctgtgagcttatttttttcttaagttgctctattttcttgattagaagcttgatactggaagtaacaagatgtggtcaactttatatatatatttacttaagatggagttttgctcttgttgcccaatccagagtgcaatggcacgatctcgactcactgcaacgtctgcctcccaggttcaagggattctcctgcctcagcgtcctgagtagctgggattacaggcatatgccaccttgccccgctaaggatgcggccaactttaagacatttatttggtttaaacaacttgtgaggagtccagtctgttcagagacacaattacttctacttctgtggaaatctaaaaacatgagtgaattatgtggaaacgtgtggcttcaaattgtatactgatagatgttccagctgagtgggactgctgagatgatatattctgttggcatgcctttatacccacaaagtggtttatttacagtcagaaacataattgtctgcagttgggaactcatctgagctgatctcagttttcaaactctttttcttatggcttgcctacacttgtcactatttccttcagttgtttcactcaaaactgtcaatctagtcacttcatatagacacatcccacatctaatgatgaaaataatcattgccatttattgagcacttactctattcaggccatttactaagtaaaaactttgcataagtaggctcatttaatctttataagcttgttgcaaggagattttggatcggagttgttacacgatttgctgcatgtttgtccagcactcattaatgacagaggaagtgttgggacatacaagtctgtctgactgcatttcagagaaaagggaatgatggagtgggattgggtgaactgtgtttcattcatcctggaattaaacagatttcacaactgaataaagccattatacgggaattctaaacttagattttcaagtgattttggggtgcagtgcacaagtgacaccagatactgggagcagattcagaaaaccaagtcttctctatcatccttatcagccctttatgtccactgaattcatcgtagggcttggcttctgatggtgatgttctgatgctctgagaagttctttagaagtttgtgtgatcacagagctgcttctaagttggacctcataggattttcgagctgaaggaaaccttagatgttataaaattcctcttcttcctgttacggttttaatatgcaatcctagataaatgaagtgacaacacttcccgttagtgacagaactaagacaaagatgtaggtcttcggaattcaatttacctccttctcctattcagacagcctctctttaaaaagctgtgttgtgtgataggtttgatgatgtgcaacttattttatatagctatacattaagatgaaataagagaaatgggatggtttttttttttttttttttgagacggagtctcgctctgtcgcccaggctggagtgcagtggcacagtcttggctcactgcaagctccgcctcctggattcaacccattgtcctgcctcagcctcccgagtagctgggactacaggctcccgtcatcatgcccggctaatttctttttgtatttttagtagagacaggttttcactgtgttagccaggatgatcttgatctcctgacctcgtgatctgcccgcctcggcctcccaaagtgctgggattacaggcgtgagccgctgcgcctggcctttttttttttttttttttttcaaggtgacaagtattgcaaacagcttttgatcctatgaatcactattaactcaataggctaaaagtatttgcaaggtcagaaatggccatattttggctgctgcctctgtaaaccactgtgaagaacaatcttataagtagggcgctaccaaagatacaacatatttctcttcctaattcttaaagcaaccatgtaaagtaggcattgttattcatatgtaccaggagaaaactgtgacctagtgaagttaaattactttccagtaatttcagaatattcaggcattgaacactggtttctctaatgtgttttcctctataccacattggattgaagaaagaagttttaagttagtcagacagcgccatgtacaactaaacaaacttaagttgtaccttagccattaattaatctttaatcagttcaattactctttctccttctctctcttttctttcctccccccgtctttccttctttcctccttttctttctttctttcttccctttatcagttgattaacaaattatacgtgtattttacaggtgaagaaaccaggccacaggaagattaaataacttccccaaggtcacatagctaggaagtgttagatctgggatttaaatccaagatccgaataaaaaggctgcatacagccatggaaatgttaaatattattgtcacaggcagtagaaataaaagttgttaataggacagtatatgatgggcacaatgataccttcagaatatcatctgtaagtaattgatggtgtttagagactggagacaaagagatgtgacgcaagtgcagttcagctcatttatgggggtagctataaataaaggaggagaggcatgtgagcgatgttgtaaaagaagaattgacctcactaatgattcatttgggcgataagaggaagtagtaggaggcagcataggcctctttactgtaacaaaagatgttgatgccattggtcaaaatggagaagtcagaaaaagagcttgaaagatttggtttgaagttccagatggacgtgtgtggctgtcggtatccatgggtttggaaatgcagggctaaatttctgatcagaatgttctaattgggttaaagatttggtatccagacttctaagattaaagtggtagcatttaatcatgtacatttaatctgtgtactgaggaagaggtgcttggaaatagaactatgaggactgcccacgtttatgtgcagggaagaaaacaggcatggtcagaaaaaggaagactctgacaggacatcagagaaactgatggaggttagagcttggggaaaataaacgtggtcaagagaatctaatccttgcagagaagtcaaggcaaaggaaaattgaaagagaccattagattttctattatgaaattatattgtggactttttttgcaatttcaaaagtatttcaggagagtataagctggattataaggaaccagggagtaagaaatagagacaatataatttacatggaagcaaaaataaaggtggagtgggagcttggggaacttccagtgctgggaaagagtttttggaatagtgaagacctgatcctctttctcatcagagaagacctggttgggggtcgagtctgtgacttatgtgttatgctgcacagagtgttatccattctaactgcttaatagatgttcgttgaatgacaagtttagtctttatcaagccaggagatagataggactttcatttcatattgtgtaaaaaatagaaataaataagccattggaagtcgtgtcctacagtaacaggagggtgagagggagattggatgaggggcacaagctgaacctcagaaaggagaatgttcagctgaccagggagggactaaggtacaggaagcagtgaagatgtagggatggaagctgaagtgctgtaggtagtgtaggatgagatagaagggagatgcagcatggaagaaaccaagtgaaataatgttgccctgggcaggcggtaaactatgagtccaagccatcagggccgggttgaactcaccatggactagtggaccattgttgagccattttttaagcattgcttacaagcctctttgaactttaaatgacacagcatgatcctaataaagaggttctggaacacagccagacttccaggactaaaattatgcccaacatcaccagttccctggggaggccacaggcctctggataatggaagacagcaggctgtcctagcagctggtgaatggcaagctgcaatggattaatggcttagggagcaaagccctgaagaccttcccagcccataggaaaaagcacaactctggagtcagaatacttgggtttgaaccccatctttgctacttgctaactggacaagcttgagcaaagtcctgctactccctgagcctcagtttggtcgcttataaaatgagactaatgataatacttgccttagagagatgtgaggatcaaacaagatgcatcagagaaaactttgtaaattctatgcaaatattagattttaaataattataattattactggtaaagtcacagagatgtggatagctaagaaagagtactagcagaaggatttccctgtgtctgacatactcagctcaaaaatgggaaactttcccttgaggtcaccgtggaatgttttgaatatcaggttctagaaatagttgcttctggaagtcaggtgggagtgttcattgtctaccaccaacaatgattattgatctgtatgaaggagcagccattttcacaatagagaattgctttttaaccatatctaagcctgtgaatacaatttgttattatttatttataatgaagggtagtaaagtgtctgcttagatatatagtgacttataaatgcatttgcacatatgtatttacatatgcactcttatacatacgtacaccctgtaaatgcatgcataaatatgcatgtatattacacaaaaatacacatgtacctacttgattttctttactgtctcctgacaaagcaatctattcaaattcagtttctcaaagtaaccattttgctaccacaaccttagaatagtccctttgctccgacttggagttgtcactgcagaattattcctggtacactactggctttgctccctgcccagcttctcaattggaaggcgagatggcacttccgattttattaaagcacgctggagctcaaagaacaaattggagaaatcaggattgattacgttatgtgctctctttgtcttcctccgggtttgttcaaagccaagtgtgagctttcaaagccagagtagctgaatggagttctatgctcagcacagggaactatgatttggcaaatgttccaattatgaagagtgaaatggaaagagtgggcgtaattttgctttaggaactgcaccttcacatcagtgatttttgccctgttaactgaatagatctggcaacttattaggaaacaagttgctggagtgtcacaaacggatggtgtcttctttgatgcatgtgaattctttgtgtaggggacccttcatttctgtttaaaatggaacaaataaaccatttggaagaggtattacatagaaatctactataaccccagaataatgattacctctgttttagggtttcgggtttttttgctttgttttgttttgttttgcttttggagaatgggggcatttgagcgcataacttccttctttacatctgatggggaatgtgaaaagtataaatgaagtttatcttaaatgccctgttctcttcaaatctttcaaatattccatttaaataggatctttctcttttgtgtctgggtataattttgttgatacctctttggcatttatgaccatctgccttaaattattaattgggctttcatccttgccgtcctctctcctaaataatgtgcaagcaaggactttaactgatttatttctgaattccctgaaggtacttggtacaagctgcaacagagaacaacgcctgtagagctatctacagagaacagtagatagaggcccctttgtgtctatgggaaagaggaaagttgaggttccgggcatcgattatgaaggagaaaaaaaaagatgtgtcatgatgctttctagaataataggattgactgaataactgatagcttcaaaaccagcatataaagaatagctgtgtctgactgctcattgctgagtgaggttttctgataaggatgagataaggtcaggtaaataacttctgataatagatgatgggatttccttttcattcttacctttctttcttttctgtcacatcttgttaggtaattaagacctggattgagaccaggcacggtggctcacccctgtaatcccagcattttgggaggctgggcgggcagatcacctgaggtcaggagtttgagaccagtctggccaacatggcgaaaccccactctaccaaaaatacaaaaatctgccaggcatagtagtatgcacctgtagtccctgctacttgggaggctgaggcacaagaatcaattgaacccaggaggtggagattgcagcgagccgaggtctcttgccactgcactccagcctgggcgacagagcgagactcaatcttgaaacctggattgagaatggagaacagatccgaaattaaatgtatgcatgtttctggataacataaggtaacttttccttgtgtcttgagagtgccatttttactgtgttaaaacatggctgctttaacagaaatggaagcccatttctgttgctttcttcaatatcattttgatgcactgaagaacttcaggaagccatcctacctaaatctatcccaacctgtcttactagttagtgaaaacatttttgtggagtatcttgagggtgggatgggttggaaattgtcacatattttaagattgaaaaggagcttaactataatctgctttgtctcctttcatgctggtgggtggcatgacgcctaggaaaggtaagtgatgtgtctgccttagcggaacattcaggagtaaaatcatgacttcctgagtcttatccagatcttcctttacttatgcctatttcctctgttttcaacatttatatattgcctggtaatcgccaatgtgctcattttatttacgtgactagattaccaatttactaagcactcgaatcatatctttgacttcttttgagctcccaccatctagcccaagtctttgaacatcataattcacagtagtattgttcactttaaggattaatgattgctgtgggctgcatttgttttcataaattgctctgggtgaagaaattgagagagagttggaaaactccaccaagaaagaaaaaaaaaatcagaagcatttaaaataaataagcctaggactgtttttaaaactgagaagatttttttttgttgttgttcttattgtttttgaaattggactaatggtagagggaataaaaggatccagataaactaaattgctctaaatagctgtagttcagagcagtgctaaagaaataccttcaaagagtgcttagaaaatggggaagaaattagtctttcctgctgtgtgtgttggcagaggggtgaagtgggtgggggttaggaaggaaaataggaagacatttggtcctcccagcctagtctggctgtcactcctgttagtgccgacatgattctttgacacagagagttcagaatcatcacaggtcacagagaagatgccagtaagaattcatagcccttttggggcctaactgcagtgaacctggtaaataattcaggcagtcagaagtgcctgggtatggaagactttaactgagcgttttcatcttttcttttaatatcatctcaggcctttccagctaatttgattaaaacctacatttccccacaccccctcttcctattgtcaagaaagaccatttagggagcccagagttttgttttctctcagctacattgtgcttttgataacttggaaatataattggagattgggaacatcattaagccagtactggcagctctctcctgtgaatggtgctcaacacttttgcttgagttttgcctcaaaaagtcatagattttccagattttaaggctgatagaaccatgatatacatttgaaaacttatatagtgtacatgttacctaatatcagacataattgggacagttacttcagttaaattaagaaatcataaagatatttaataataacttgtggctgggcacggtggctcacgcctgtaatcccagcactttgggaggccgaggcggacagatcacaaggtcaggagatcgagaccatcctggctaacacggtgaaaccccgtctctactaaaaatacaaaaaattagctgggcgtggtggcgggcacctgtagtcccagctactcgggaggctgaagcaggagaatggcatgaactggagctcgcagtgagccaggatcacaccactgcactccatccagcctgggcaacagagcaagactccatctcaaaaataaaaataaataaataaaataaaataacttgtacacagaaacatcaaattggacattaattggccaatcttttgacgtacagctcagttttcatctatatatttccatagcaccgattgaattcatattattttctcccccaaatatgtcaaccctgacttccagtttgctttattatattgagatgaaagatttgtaagattctcttttccctacttccccctcccccgcatataccagcaactttagctagcattcatgattttttctgaaccattcaagtaagttttcacaccatgagtaactcctttttgtactcctaatattgcccaaccaaatatttctttatattatataattacagttaaaaggtataagtggcatcacatacttagggactcttggtgagcgcacagctcaatggttaagagtactgtgtggaggtattagaagaatattgtagcaaccgctaacactcagtatgtcatgggctggtgtattttgttgagggtgtgagaacacagtgttttctatgattaaatggaatattggtaggaaattttctgctacatatatcccacctacctgtaatcttgggaaagttacttaaacacttgacgtcccagtttctgcatccctaaaatggcaatgtaatatttactacacagtgtggccatcagaattaggtagcaaatctcaagcacgtggcttggtgcattacacgttacatgttacatgttagctgttactcttttttttttttttttttttttgagagggagtgctgctctgttgccagactggagtgcggtggtgcgatctcagctcacagcagcctccgactccctagttcaagcgattctcctgcctcagcctgccgagtagcttggattacaggcacgcaccaccacgcccagctaatttttgtatttttagtggagacagggtttcaccatgttggtcaggatggtctccatctcctgacctcgtcatctgcttgcctcagcctcccaaagtgctgggattacagcttgagccaccgcacccggccgttagctgttactcttatttccatgcttggtagtctatgatagtgtctctcaaacttcttgcattattacacccccttcccccacaccccctgccaccatccgaaggagattgcctagatttttttttttctaaagattgccttccctcatgacattttaatactacagatctactgtatatctatggatgtactgtagccacctggagggacacaaattctcataatagctaaggtttttttaaatctcttttccacaagaaccagtttttatcccgctggagaagacgccatatgctcattgggaatgcatgatctattgggttatagatgattgcgtttttgctcaacccaagccatcagagcaccatgttagaagagggttgactttctaatgggggattgagcaagttttgacccaagagtcatgctccctcctctcctggaagttttcctgccgagatggaagcttagatttgggagccaatggtgcagagggtacagtaagggattgatgcacatcagtgatttttagagtctgggaaagcaattagagttaggcgatatgacttttcttaataaccacttagcagcagttttcatttttgttaatggattgtcattgaagattcaaagtcattattcattgaacagaaaagtagggagtcagtggattcttgcaacagctaggggtgggatcacagcaccagggaaaagaaagttttcggctccaggaagaaatgtttttggggaggcctggaagctgagattgaattcagtgtgaatgtccagaagaaggacttgccttcagtttacaaacaagtttttgctttgcagtccttctatgagagttggttgtaagtgagctgtttcttaatcaccttgtgttgtaattagttgtggcatgcttgtcttatgtattatgcattttatgtgctttctactgtattaagaaatcaagcgtctctgtatgagtcagctcatactgcccgaacaaagtaccacagactgcacagactggatgacttgaacaacagaaatgtattttctcacaattctggtggctaggagttcaagctgtcggcagggctggtttcttcctaggcttttctcctcagattgtattaatagatagccatcttctcttctcttgggtcctcacatggtcttccctctgtgtatgtctgtttcctaatctcctcttcctgtacagacaccagtcatattggattaggccccaccttaattactttattttaactcgatgctccccttaaagactctgtctccaaatatagtcacattctgagatactgggggttaggacttcaacatatgagttttgggtgggaacagtttagtccattaacagtccactgcctctcatgtgtttgcttgataaatgatttttttttttttcttttttgagacagagtctcactctgttgcccaggctggagtgcagtggtgttatctcggctcactgcagcctccacctcccgggttcaagcaattcttctgcctcagccttccaagcagctgggattgcaagagcgagcctgccaccatgcctggctaaattttgtatttttagtagagactgggtttcgccattttgaccaggctggtcttgaactcctgacctctagtgatccacccgcctcggcttcccaaagtgctaggattacaggcatgagccaccttgcccagctgataaatgattattgaataagtgaatgaacagatgaatggatggatggatttttatttaattgtggtaaatctgttgaattagtaactctagcaatattcgtgagttaagtcataatgtttcttaaagtttttgtgtttcttccaccctgaagatatgcttaacagatgacattcttcagcaatgtttctatttattcaggaagtatgcacgacccttctcttcttggaggcaggtctgctcgtcatgtgaagagccactgccctcaacaggcccacgcaaacatttgccagcgtcctgagcaagaacatggggagaggcctgctttagatctaattgttcaaaagctacaaatctcattagcaagttgtttaaaaagtgtaggcactttgcctattgtgacccatctggcttccagaatatcctggaaggccaggcagatttgaccttagaattctcaaactctaccaaatacagaacagaaagtggcagtgcagggataactggtccaaagtctcttcctttcccactgaggttccgtcctgaaacccaagaggctttgcacacagacaccccagctctgcactcctccttcccaatccgaacaagcttagaagtgtcataacctcaggaggacagacccagtggagaggtcctccagggccctgtgagaaagttggagccaggaaattctggaatctgggcacccaagatggaacctagaaggagcaatacaggctttggatggtcatatccctttgaccctgtgcgttccttaccctgataggaggggtgttggttgtaggtctaaggttggtactgtggtcaatttcagctttttcaggaactctcactggttttgagattattcccatattctgaattccctgcagaatggtcaagagagttggggagatagaacatttggagaaaacactagagtcagagcgtagccacctgcaaaggtagttaatggaggtggctgtttcaccgggaatttgtttcatttagtcttgacctcttgaccctgaatacctagtttctgcacctgtgagtccccccaaaagacaaagtaactccgttaggagacttggttctagaaacatatgagcatatttcaggaagaaccagagcatgagtgggcacctgcacgccttaaatggggcctgccctctgcagtgagccatgagctgggggagcagccccgcacctctattctcaggtgagacagggtcacctctcgtgagtcacacagcccaggcagccttctagaaacgtgtcaaactctattgcactagtaacttttttattgctagggtcactaaaagccactttttcaaattatcggaggttgtttgccaggctgtgcacagaacttcagaagaaggaaaaaagccaatggttttcttcaccacacatagaataatttataggtagggaccaatttacttgctagggaacagtgggtggcctgtgccttccccagtggaagggacattatgctaagcagggtggcaggcttcagtgctcatgatagaagtcaagagacccttctaattaattacatggctgtctttacccagcatgggttcctcactttctcatcaaagaccttgtttagtcaaagctgtatttcttttatttatttattatttatacttcctctctttctaaagagaatttgagacaggtggaaaaaaaaaagtgtggggatgttcgcgagaagagactctctgaaatgggacatttgaagagagaattctgacagaagttcagagcatacttttcttctccaggctcttgttcttgataaaatttcctgttctacttcatcattacttctcaagaacttctttcagctctttattggctagatccaggtagcgtctttgatctttaccttctcaccataccttccctgcaggcttttcattgccgtgagaatagaatctaaatggattaccaaagccataaagatttgcctgtttaagtccattaaaactcttggccctatttctgcactttgccttctcatttctcataaaatttctgagacacaccagtctttcagttcctgccagagctaaggctctcccttccttgtatccttgtgcctgctcttgcctagacctggacttacttattggcctctcttctcctgagcaccatcattctgcaccctgaatcccccatccttagcaaatcctcattctttaggaatcccattttctaagttgccatctgtgactgccatatttaaatctacctgacacacaccattatcatcgtctatgacacttctttatttccttcatgacgttgcttacaattttatcttttctaatctcaagttttgtagttttaattaatgaattttttttgagacagagtgtcactttgttgcccaggctggagtgcagtggtgcaatctcggctcactgcatcttctgcctactgggttcaagtgaatctcctgcctcagcttccaaagtaactgggattacaggcacctggcaccacacccagctagtttttgtatttttagtagagacagggtttcaccatgttggccaggctggtctcgaactcctgacctcagatgatccacctgccttggcctcccaaattgctgggattacgggccttcttgctttctaaacatagcaccttcctgactgtagggactttatctgtcttgctcacctgtgcgtcacacgggcctcctgcttcatcagacacagtggccactcaacaattgcctgatgaataaatgcatgagaaatactagttttaaagaaaggtctgatacacttcacttggtttggaatgtttaccaaaaacctttgcttttctagagagggttgcgggctaatccaaaagaattggtttataattatgaaattttaaaaagcgtcagagaaccaacaaggaaagatttttgaggaaatggaggctcatcaggaaagcacaacatgtgaagttgttgcccactcacatgtctttttccttgacctgtttctagaatgtgttgtctcagacagctgacctgtcttggagatgtagtactttataagatgaaccaagtatgatcctcccaaggaccagggcctacagtccagtcaagcttgggagtgtagctaagggaggaatgaataacccactgtcatttcaagcgtaggattctctcatcactctcactgttttaaatcttctttatcatcacagattttacattattcccttatgtatgaatgttatttttattgaccattgaagattggaacttttttctggaaaaacatcacatggttgagtcaaggatgaaaagtcaaaactaccttttcatgtgaggggagagagagagagagcgcgcgtgcgcgaaagcgtgtgtgtgtgtgtgtgtgtgtgtgtgtgtgtgtgtgtgtgtgtgtattgggaccacctttcagctgtgttgcctccctctggtggccattatatgcacaaggcctgggtgacatggactgagtcagaatgtaacttacttttcaaaaaaaaaaaaaaaaaaaaaaagactaagtcattgtgtgcacctgagtttttaaaattattattggtgggaactctttaaaaaaagaaaaaaaaaaacacagttaagtggttgaaattgattagcactacaaaaatatgagctttttgcctttggggtagagtttgaaagctgccatggccttcaatgaaagcagcattctggttgtgtataaacctgtaaaaggatctgcctgtatgtttaaattcttctgtgtttggagaacacatctcagaattcattcacataatcaaggccaccactatagattattttaaaggtagcttttaaaacctgttgtgtattttcaatattctccttcaaattattccttaagagtattgtgcaaccacagtggatatgatattgaggcagcttatctgggttttatttaaagctttagaatgactcgatttgatcttaacccatttctagtcatgttcttggggtgggttggggggaaatgtccttgaaagaaggagagggtcaaggataataagcaatactaattttcttctgtttcttatcccctcttgttcctcaaatccagaaatagtctcctgaacatagcctgacacctcagcatgacaggtgttctgaagatgagaaggcacattgtaaaaacctatttattcagtgaggaaattttataccatttacattcagagccatctctatgataccaaaataggcttaagcaatgaatttttcattttttagactcaaaaccagataactcacctggaaatacacactatgtaatttcatttcatgggcctaatcaatatcttcgaccgaaatgtgtattcctcttgtgaaggagacataagattttctgttttgttatgtatattacatatgtgcaatattagggtagggaagtaggccttgtttatatttttggattgagtttatttttttcataagcttttttatagctctcaaagatattggcctattttacgttgattctaactgtgtggaatggtaaagtagtatgcaattaaagttcggttgaactgtcacattgaatttatataaatatttaaaatatattgttattatataagtaaaaattcatattttttgtgatagatcacgaatacttagttgatttcaggtcacagccatcatagaactgaactgttaggtacatacatgcctctgaacaaaccaagtatgttatgtttctgagtgaccctatttctgcagtactataagtcaataagagcatggaatttgatgttatttggttaaaacaaatatagtgctgtagtaattgcaactatttcctagttgcatgttctatgccttttacaaaggtcatctagtttctttatgcccagggactattcatccatcgctctatctatccctcaatctttccagatagctttaggtagcttaaaactcttgaaagctattctgaaatattatctcactgattccttatgggacctcagattgaagatgtcaaagagtttttgcagactaccttttcaaacaaagtaatcatctgaaggtcgttctttgactcgttcatttgtgttacaaacagatcttgaatgcctgccacgtatggctgtaggctctggggaaataacggtgagcgaaagcagaccagcctgtctgcctagagcttacagagaagcaggacagaggttaggagcaggccctgcagcccattcctgagttcaagtcctagccctgtcacttactcactgatcaacttcataaatgtctgcacttattttcaggattgatggaaggaagatgtatatgtatattaccaaaggaaagaactatgatcaatgaatgaacaaggaaagtaaaagttgatggattcagtacaaccaactctctaccaaattagggacaaatgctccccggcacaggagcttttgttgttgtttaaagctaatcttaggaatgaccaacataaagagtgtgtgttttccacatgttaggcaatgttctaagtgatttacagccctctaacaaccgtgaaatattaatactattattttctccattttatatgaattaactgggacatagagaagtgacgcagtgtgcccaagttaacacaactgggaagtggaaaagctgttcaggtcctctgtctccagagcccagctcttgctcataacaccttttctacctctcttaaaccagtttattgagtgcctaattggtcctcttagttactttatatgatttatatctaatcctcccaacaatttcctaagcacagctgattatcccctttgaaattaaaaaaaaaaggtaaaattcagagaggttaagtcaggtgccctttgtcatgctgttagggaatggaagtgctgagataagaaactaaattctgactgactccaaaccctcaactatttccacaacatcagatcagacccggaagagagaaggaccagttgtttcaattccctgaaagcaattcctgatagggagcggctgggtggtcaaacgttagtgactaatcatcagccccacttgggaaagttgacaaattgcacctgacccacctcctttgcagacctatgaaaccacaatctgcaggggtggggcccagaaaccttcatttctcatcactttcccctagtgtttttaatgaccctcaggtttggggaaccactgtaccaagtgatgagggggaaatatttttcccaaaggttactgtctaaaaaatcagttattttctctgaaacataagatggttggtatctgtttgagcaaatgaatgaatgttatgaatgaactgaattatattcctttgaaatggattgaaagtacatagacattcactgtagaagatacatctgttatggaccatatacttttatatcttattagtactctctcaatttatttgcctcctgaaattctgctctaccagcttccttttactaccggggaccaactacccaaccagttgctatcaggaatagctttcagagcatcaagacagttggctattcttctagatccaaacaccgtgcaggcagtagttgacgtggaaagaggccacccagtcctgcagttccagattttaaagggagccagggatgatcagtgggatctccctcccagtgggctgagagaggcaggtagcagtagtgaaagtgtcttcaatttcatccatttgaatttataacactggttatttgttctcaagttacccccattactccaaccaattggaaaccatgtgagaacaacgcttcaaatgtattagaatattttgtgtttgccaagagcatagcttttcctttttggtctgattttaatgttttcaattttagactgactggagcctggaaatggccaactgtttaaacaaagtgtttcttttcttttcttccctcctcccctccctctctccttctttctcctttcccttgtttctttctctttatctcagtaaagagaaatatctgcctaatgatcaacttccgggggcttggttgaagtttagtgaatgagatagaaaaatggtttcaggctacggggtggctattgatatatgtttccctaaattcctttgctaatccccacaccttggtcagctaactataggactctcctgattattgtgcaaacagtagagaattcctcttcagtatagctttctcattgtatcacttcatgcactgtgctgccttgtcacaattcagccagtgctgaaaccattaagattttattaggtttgtccttgtcattctattacgcgattggcaatgcttattgacaattcttattttctgtactatgatttttatagttttagtttattaagtgctcctggaatacaggctcctggaattaattagaaaaagaaaaaaccttcttaggcagcactaggagagaaacactgagcagaaagctatagcatgactttcgtgctttgagtctcagttcctatgaaaagagttaaattacaataaagtagcctggaatagctgctggtttttactgtcatctttaagagactggcaaggacgggttcttgctgcccccaaagagcattttttttgcatgttgatttatactcaggcttttgaagctatggtctcctttaaatgagaatttctgtttttacctagcacctgccattaagccattctttataatttctagtttcctggagaggaagcaacatattcaatacagtattcacacaaacagggaaatatttaaaagacaaaaaaaaaaaaaacccttttccttttgatatttgaaattcatcttgtaaagcaactatttttatcaccaacatttagacttataggtgacatgcccaatgattttgaaacatgagttcgtttaatatcttctagaagcacgactacctcagtgagaagcggacagagagttgggagaaagtattgtgcagttaacatttttttccttctctcagttgagctgggattcatctctggcttcacattacaagcagcttggatctgtgtgcagaacttacatttcttccctggcttgggcctctctatccttccgattttcacagagccatcctttgcctgcagtgtttttcctgatacctcatgggctagggtagaactctttccacaggaccatgattacctgatgctctagggttaagaactctttacatagaaccctaattccctgcctactcatttttctcccctcacttaacttttaagcctcatgagccaaaaactacatcagctctgcatacagctgtatcctcgttctagtgctcaataagtattggttcaataaatgaatggaaagtatattacattttcatgctttttgatgtccatgggagaagtatttttaggttatgtttattagaaatttatcttaattttctctagaaaattgtggcaataaagccaactttctaaagcacttgtaagaaggtgtgtgtagatcatcggttctcaacagttggcgattttcccactccaggggacatatatatggcaacatctggagacatttttggatgtacaccacagccccaaagcacagaattatctggcacaaaatgtcagtagtgcttaggctgagaaactggggtagttggaagtgcataaagcttggcaggtcaaagctgattttattttgttctacacagtggaattcagctctttggatatcattaataataacaattacatagagaacaatcagcattattatgttcttgccatgtacagacataagcttttcacaagtattattttgtttaaccctgtcaactgtgctgtgagttaggaactattattatcatttttcagataaggagactaagacttgaaaagagaaatgtgtactcaagatcctgctgctacttggtgatagaagtaggatgagaactcaggatctatgcttggtgaccattatacattctttctctgtaaatatggtccccaacttaaagtctaaaaggatcgctgccttcattattcagtaggaaccacagctggaaatgcaaagaaaatttaaatttaaaaatttaaatgtagaaaatcattatggcttaggtggttgtaattttaccaatatgtatactgattgaaacaaaaatagagtgcattcactgataggtgtaagctgctgttgatacacggaacagaacaaatctgctacatgctgttattttgtgggattcccaagaaggtcaaagaaagccctgagagtttgttttcattcaaaattgaacttgtcatagccgatcaacacattgtggtctagatgggacttttctcctattaaggtatatgaacagtgacagtttgccccatgtaatcttattaggagctttcttcagaaccacatcatcttcttatataattacaaaagagccactcatgagtaaaatatgcctgcaagagagcaaggcctgggggcaaagggttggctgatgggggcctgttctctccttgcagaggacacagttcaggaaatggaaaatttacgatctggatgcataataatagtttctaggcccatccctgagtacttggtttgctcccagtgttaatgtccttgaggctgttagttgatgaactctaagcaaacaccatcatcctcaagtattgatttgtttcttagcccctaatacttggcctataagacaatgtagaagtatctattctttttacatatgaacttagagaccctggtgctgctgtttttctctcctaggacattcttttcagtggttgcttctatcacactttgaagatgccagtagaatacttaaaaacattacattttattctttagtctcactttcctatctcttgtggaagtaattattaatagcaccaaactgttttttattcttaaatgttttacaaaagtgggctccggtgatgacaagtaactctttaatgtcctactaggcattagtacttgtcatctagataaacattttctgttaaggccaagtgtcgtacatagtcattgcactgctccacccagaagatgtaatttacatataagatgttatttgagactgtctcccggggacaaaagtgattagtatgccttatctcttctcaaaagagtcatgtaacatgctcttgcatctattttacatttaataaattaaaacatgaatgattaaataagatgttcatagtgcttcacaaatttgaatgcgcccatcccaggctctcgctaacattctgggcctgaggtttagcttttctaccatcttgccaggttaggctcatgctgctggaccaaggaccacacttgagtaccaagatgttagggaacattaagatggtttgaaacctgagctaaggatgccatcaggctgatagcattaaactcatttttcctatgccacctcagttatataaattattctttaagtttatagagaggtttcttttggaaggaatggcatccttttcagcagcaaaatgtatattaggttttgtaaaaaattaaataatgcttgactttttttttttttttttctttttgaggcaggttcttgctctgtcacccaggctggactgcaacagcatgatcttggctcacctccgcctcccaggctctggcaatcctcccacctcagccttcagagtggcagagactacaggctcataccaccgcacctggctaatttttctaatttttaatagaaatggggtttcactatattgcccaagctggtctcgaactcctgggctcaagctatatgcctgcctcagcctcccaaagtgctgagattacaggtgtaagccaccacatgaaatcaagcccggccatgcttgatttttaataaagcatcgtatctctctattttacctgaaaaaagatcccctcccacccaccttatatttccgaaacaataaaaaatgagttttaccttttctggtcatcgaaggcattttttgagatggcttaacaatcttttaaattatagaacacatttacaacatccttgacacttaaataacatttccagtgttctttttttcttttttaattatatttctaaagatagctaagagaacaatttcaaatagttcctctatgcttttagatgtaagttgtttcaatctccatgtattggtgagaattaagagacttgcagttcgccatgtcctgtcatgttagcttattttgtagggaaatcaaatctggcacctttcaattaacttctttacctctctaatctaaaaacagatagaatacattctggagcaagaaggcatgattactatctgtggattgccttgacttcctcaactgtgtcttctgtcatttcgaaatttgctaaaagacctcctataaaagcaggaaagcacagacggaaggaaggtggtgctgttgaaaaataatttacccctagtcgtgagcttggcaactcttcaagggatcacaatggtgtatctcatctggacctagaggtctcgaaggaggagataagtggaaatgttttgtgggctggagcttagtcattctcctcggtgacttgaggtgcaagctattttggaggaagataaagaggaagggagacaagaagtgggaaagaaaaaagtctctctgccttcatacatgcttctgttcactacgtttatactacttttttttctttgaaaaattttttctttgaatttcttttttttctttgaatgattgttttaaatcatgtggtaatgtggtcatgacatatgttaggtaacaaaaagaaaaataatgattccaattttgttaagtatatgtatagaaaaaaggaaagtaagcaaatcgatcagttatctttgagtgataatataatgaataatctttatcaccttcatactgtgttctttatattttattctctaaaattttccattaagcatgaataaggttttgtatcagagttttaaaatacattttaaaaggaaatggcaacttattcagctacagcttttttataacatagtatatgaaagttcatatctagtaaatgtatttggaaatataatacatttggaataacttttctgtaaggatgcatctttttaagtgactttattagtctccatgttgcatttttaaatatataactctgcagggcttcacattttccccttcacttttgctagctgtcagtcatcacctctaccttgaaactagtctatgaccagtaggatttgtagataattatcattaactgattgagtggattcagcagtgtgcctgttgtaattaagtgtttggatatgcaaatagataaagaatagataaaagagaaggtactgattaggatgttaaattcacaatatgatggttgatagtgacaggtaatagcatgatgtccttttgaagatactatattaattatttcttgaataccttttcaagtaagttactgttatttgaaattccacttaatgccagccctggcccctcaacatttcatcccaatctcgttgtttttgaaaggctcagagtcatattgggcacttctttcattactgcctttaactgaccatttcctcttttctttcctgcaacagattgcagattgagcttaaccaagaagttcgtaggctaatcaaggctggcttgacctacaaaagaagaagagagttctgcctgcccacttgggcttgtgttgacacggctgataacttgccatcacctgttgccagtgtggaaaaattctccctgttgaattttttgcacatggaggacagcagcaaagagggcaacacaggctgataagaccagagacagcagggagattattttaccatacgccctcaggacgttccctctagctggagttctggacttcaacagaaccccatccagtcattttgattttgctgtttattttttttttctttttctttttcccaccacattgtattttatttccgtacttcagaaatgggcctacagaccacaaagtggcccagccatggggcttttttcctgaagtcttggcttatcatttccctggggctctactcacaggtgtccaaactcctggcctgccctagtgtgtgccgctgcgacaggaactttgtctactgtaatgagcgaagcttgacctcagtgcctcttgggatcccggagggcgtaactgtactctacctccacaacaaccaaattaataatgctggatttcctgcagaactgcacaatgtacagtcggtgcacacggtctacctgtatggcaaccaactggacgaattccccatgaaccttcccaagaatgtcagagttctccatttgcaggaaaacaatattcagaccatttcacgggctgctcttgcccagctcttgaagcttgaagagctgcacctggatgacaactccatatccacagtgggggtggaagacggggccttccgggaggctattagcctcaaattgttgtttttgtctaagaatcacctgagcagtgtgcctgttgggcttcctgtggacttgcaagagctgagagtggatgaaaatcgaattgctgtcatatccgacatggccttccagaatctcacgagcttggagcgtcttattgtggacgggaacctcctgaccaacaagggtatcgccgagggcaccttcagccatctcaccaagctcaaggaattttcaattgtacgtaattcgctgtcccaccctcctcccgatctcccaggtacgcatctgatcaggctctatttgcaggacaaccagataaaccacattcctttgacagccttctcaaatctgcgtaagctggaacggctggatatatccaacaaccaactgcggatgctgactcaaggggtttttgataatctctccaacctgaagcagctcactgctcggaataacccttggttttgtgactgcagtattaaatgggtcacagaatggctcaaatatatcccttcatctctcaacgtgcggggtttcatgtgccaaggtcctgaacaagtccgggggatggccgtcagggaattaaatatgaatcttttgtcctgtcccaccacgacccccggcctgcctctcttcaccccagccccaagtacagcttctccgaccactcagcctcccaccctctctattccaaaccctagcagaagctacacgcctccaactcctaccacatcgaaacttcccacgattcctgactgggatggcagagaaagagtgaccccacctatttctgaacggatccagctctctatccattttgtgaatgatacttccattcaagtcagctggctctctctcttcaccgtgatggcatacaaactcacatgggtgaaaatgggccacagtttagtagggggcatcgttcaggagcgcatagtcagcggtgagaagcaacacctgagcctggttaacttagagccccgatccacctatcggatttgtttagtgccactggatgcttttaactaccgcgcggtagaagacaccatttgttcagaggccaccacccatgcctcctatctgaacaacggcagcaacacagcgtccagccatgagcagacgacgtcccacagcatgggctccccctttctgctggcgggcttgatcgggggcgcggtgatatttgtgctggtggtcttgctcagcgtcttttgctggcatatgcacaaaaaggggcgctacacctcccagaagtggaaatacaaccggggccggcggaaagatgattattgcgaggcaggcaccaagaaggacaactccatcctggagatgacagaaaccagttttcagatcgtctccttaaataacgatcaactccttaaaggagatttcagactgcagcccatttacaccccaaatgggggcattaattacacagactgccatatccccaacaacatgcgatactgcaacagcagcgtgccagacctggagcactgccatacgtgacagccagaggcccagcgttatcaaggcggacaattagactcttgagaacacactcgtgtgtgcacataaagacacgcagattacatttgataaatgttacacagatgcatttgtgcatttgaatactctgtaatttatacggtgtactatataatgggatttaaaaaaagtgctatcttttctatttcaagttaattacaaacagttttgtaactctttgctttttaaatcttaaaaaaaaaaaagttgctgaagtactgtacagggttgtacaatgagaacccaatgccaaggcaaaaagaacgagtgatttttccttaggatacacatcaaccactttgctgttgaagctgtcagaataaattcctggtggtcagatgaaagggcagattaaatggactcatcagggtaagaggaataatatgggtaaaacaagaaatggcccgatagtttcacactattcctatacctccaggtccggaagacaggtaaaaaattctataatgtaagaatggaggtagttaccctgatttgaccctgtgtgggaaatgctgaaagcaccaggaggaagccggttcccgtgagataagttaacccggcctgacagaatcaagaaaattgagatgagatttgaaaggacccgaaaatgcaggggttggctttctgactgggaacttaaaaatcactcttcatgcttccctggtcctatgtgataacagagttagagacttgagtctgatttcagtcatcttcagggaccagtctgatgttgtagcaagaagactccctttaaaagtgttactgttcaaatcatatatcaggttgaatcacattcaacagagatatattctagaatacttttttagaagaggctaataaagggaagaattatattgaatggaattatttttgataatgagaattatttgggtagattcactgaggctatgtcaacatgatatttagaccaacaggtgatcaatgtttggaaaatacaacaatgacttatttaaaaattacccttcctgctatttagacaaaaacaactgatcagtggttctgttatgtcagctgactttgttagtatcatgttgaaatagcttgaagtaatatcttttatccccttgcaaattcttgtcttccaatcatctcccatatattttcataattagttgtttatgacacctttgtttttctccctctgttcagtatttcaaggaaaattatggatgccagtcttggctgcacaagatatccattacgtacttatacattttaaaatgagtactaattttcactgctaataattctgtaaggacacatcaaagctggccaaaataatgaattttttttaaaaagcaatacctggtttccaccttggactgactttgatcctgttccacttttgaaattttatttgttccttttccatcgtggatgttcctctactttggcaattgtggagggctaatcaatcttatgttagcaggacaacccatgaaaaacaagtcagagagtgaaggctttttcccctaatcctggcagagcagggcgtagaaaagagaggatgtccgtgcttaattctagatacttttgagacaacaccttcagaaaacacataatttaatctttgccatccttagatagagaagggctatagatcacatacgttatcaaaaactactcccttggaaaaaatatctttcgaaaatcaaatttaaacatttcactctgtgctgcatatttcttttaccattgaccattattatagggacccatgaagtaaatgtcacaatcatcttactagctctctctctctcagcaaaataaaactgtgatgtgtcttctttgtaaaagtttaggtataaaatgctatgcaactttttctttatagtaagagctttattttctttaataatatagcccaacttatatgttttaatctcccttgtccctcagaataagcagaaaatataactgcagctgtatgtcgtagacacaagaattgaaactgtgcagtcagtagagctgaacttagctatgaattaatttaaattaattctaaagtgactctggtttccattttagtctattagctagagggttttggctgttgctttttttaaagttaggtccacacagtgaagggaaaagagtctgtgaaggtgatcagtgtagcagtaagacatctaaaatcaagacaatgacatgggggctttgtgtacttagctggataattcccttctactgtcctcttccccttggctgtgtagataaaattgtgcattcaaatgatggtactttgacttttgagggtttttatttctgttattcacaaaatactcattctcatttatgtatattgtatgtttaacccccagtgggatttctggctgctgaaaccactttgggccaggaagaacaaggatgaagaggttcctgtcatttcttatggggttcacagaattatttggggcttaaatggtacaatggagacagtcatgtgcaatgcttaagatggtctgacagggtcccttttgctggaggtgttcctgaagagattgaacctagtaacaggctttattttcaccttgtgtacaacatggcaaagactgctaagattaaaatccgtctcccatttgttacagcctcacctgcaccaggatagaaagcacgtgatggaatctgtgatgtctaatgtgtcttatgaaaattgccaaacaactgtccctggggattctgctttgattggcatttttagtcatgggaatgtatatttgctgatatatctgctctgtgtttgggcctctcttgctgtcattatgatgtattttgagatgattagtcaagagtcaaggttgcgagtacaggccaagaccatgggaaaaaaagccatgctcactggccaataaagagcttgatgctgcctggccaaatgaggtgactcagatagaatctgatcccattcagagcttggtaaatgtcactgtacagaagacattgaaaaggaagaggcatagtcatgatcaaaaggatatattgacagttatctatagccagggtagttgttaatacctgcttgtttggggagatatgtttgattatagagagactctgggccaccctcaaacaccgtcagatgcattagcagcccactgcatgggacaatcgcaggcagatacgaggaatgtatcccctgcctattttccttgtgtaacaaatggaaaacattctcccctgtgagaaataatgcaatttctaattatctggatgttcgttgaaaatatattagacattctccctgaggttaaaaacaaaaagtacgtgaccagtctggtaagaagtattaatgaagtagctaatattacagcttcattttctactagcacctatcataatggtcttagtcatttcacacaaatcagaacttccttccccaccagggaggacaacatcttcatgctgtgattgaagcatccattcagaacacgaggcaatattgcagtccacagggaatggatgcttcacttgatctccggaccttggctgcagaggccatcgcagcttttgaaaagtgaaggggttaattcccattggtgtctttgcttatagcatttttctctaacctataacaaggagacattacattttactttagaacatgagaatagcagttttgctcatgacttaccattccagctgcatgggaaagcaaagcagaaaacagtgccccaaatggaaaaaagatactcacacagaacaaaacagttcttggtcttgttcttggtcttgtcaaaccttgcctgatgctctttctaaagtcaaaatatgaatgctaagaaggcataacctacatccttctctgatttcttcagcagggtcaaaagacagttactagcaatggggaatgcttgtcactgtggagaaagagttttgtatatgtctgataccgttgttataacaaaacaaatttttttactatagttttttgttttctacctgcacacccaccagaagagcacaaagcaaggccattgcaacaggcatttaaaaattattatcaaacatgcacatgcttgtacacacacacacacacacacacaaacaggggcatttgtaaaggtgtccctggaatgtaagatttataatgtttaaggcaaggtgaaggcattgccaagtgtgtgtcgctcataggactagtgtatattcactgaaagttaacctgatgatttgttattgtttgaaccatatgctgatttgcttctggtttctgtttagtgtgttctctctgataaggggctgaaagattctgcatcacacatcctctgagacctaccatgtcgcacactttgttaatgacaaacttcactctacactatacagtaccttgttgatatattcagtaaagtcttattttaaaag

SEQ ID NO: 36586 - DNA, 8516 bp, Homo sapiens
agtagggaagtagctatggcagtgcctgatacaaaataaactccaaatgtgtatttattagatggttggatggaagttatttgcgtgtgaaagcgcgttttacccgaaggcgctctgtgagggccagcgggtccccttcggccctggagccggggtcacacgctccccaccgcgtgcggtcacgagacgcccccaagggagtatcctggtacccggaagccgcgactcctggccctgagcccgggcttagccttcgggtccacgtggccggaggccggcagctgattggacgcgggccgccccaccccctggccgtcgcgggacccgcaggactgagaccatggaggcggtggcggtggccgcggcggtgggggtccttctcctggccggggccgggggcgcggcaggcgacgaggcccgggaggcggcggccgtgcgggcgctcgtggcccggctgctggggccaggccccgcggccgacttctccgtgtcggtggagcgcgctctggctgccaagccgggcttggacacctacagcctgggcggcggcggcgcggcgcgcgtgcgggtgcgcggctccacgggcgtggcggccgccgcggggctgcaccgctacctgcgcgacttctgtggctgccacgtggcctggtccggctctcagctgcgcctgccgcggccactgccagccgtgccgggggagctgaccgaggccacgcccaacaggtaccgccccgaagcttccccgcgtccgcccgaggcgcttaccccctcccggagccgctgccacccaaatcgggaggctgagcggggagcgctggccggaaggcccagctgcgccgcctccagcagctgtgtggccttgagccagccactctgcctttcagagcctcggctggcccacctgaaaaacggaaagaagacgcctaccgtgcagtgttattgtgaggatttgcacgatgatgggcatagaatttgtggtgcacaattggtgatgagtgaattttcttgccttcctcccccaccttctctttgaacctgcggactgaggaaggacgcctccatcccccaccctacaggcctgtgttccagcgcctgccacactatggagtgatgtgttcacacagctgtcctcccctgcccatctgttagactgtgggggcagggattccccgttccaggaaaacaccgtgcagaggaggggctctggcagtgtggcatgaaagtggaatatgccacccaaatacccgccaggctagagggccctgggagagtgcaggggacgagtgcctcagaagcccagccccggtacctggtctcagctccacctggggtgggtcccagtgtgcagcagaagggccgagtttggagcccctcccctctcctctaggtgggggatgggggatttgttccagggccgtggaccctccagggtgggatgcgcccctgctcatgacactgcccgcaggtaccgctattaccagaatgtgtgcacgcaaagctactctttcgtgtggtgggactgggcccgctgggagcgagagatagactggatggcgctgaatggcatcaacctggcactggcctggagcggccaggaggccatctggcagcgggtgcgtgcccactgtcccttccccaccctcctctatggcgggagccaccgtaggtgttttcacccgccccccagcatgggcgcagtgtctctctctagaagtgctttcagcgtgcacagtggcttgggcctcctaaaaactgaggcttccggccgggcgcggtggctcacgcctgtcatcccagcacttcgggaggcctaggcgggcggatcaggagttcaggagatcgagaccatcctggccaacattgtgaaaccccgtctctactaaaatacaaagaaatagcaacctgggcaacagagcgagactctgtctaaaaaaaaaaaaaaaaaaaactgaggcttccagtttgaggagtggggctccttcccccatctcccctatgcagccaatcacctggtcccttggatccaactcatgggcagctctagatctgcctccctggaagcttctgtgctgcaatggctgctccaggctctgcttaagctcttcacacagttgccctgcccttccatctggcactcttgctccatgaagccttctaaggccttcctgttgggggaaagcccctttgtgccccatctcctcacccatgcgacaaaggcaacacagtgaactcacctactcacaggtctctttcctctgggctgtgggctccttgatggcagcgttcggattttgtctcagtagccctagcacccagcacaaagaagcaatgagtgaatggttgttgaatgaatgaatgaatgaatgaagatgaatatatttctatgtgtgggcccttcttcctcaggtgtacctggccttgggcctgacccaggcagagatcaatgagttctttactggtcctgccttcctggcctgggggcgaatgggcaacctgcacacctgggatggccccctgcccccctcctggcacatcaagcagctttacctgcaggtaaaaggatggaaaagggaaggggcagaatcggtgatagatggtcatgggcccaggaagggtggtattaggccggccccagggctcttaactgaggcggggggctgcgtgtatcctgggagatgagggccttctcataggacagcagtggccatgctcaccacccttccttctgttcctccagcaccgggtcctggaccagatgcgctccttcggcatgaccccagtgctgcctgcattcgcggggcatgttcccgaggctgtcaccaggtgaggttccgctcaccccctccacttagctcagagagggaattttattcccttctagaacatgacttaaaaacttaagctctgggccgggcgcagtggctcacgcctgtaatcccagcactttgggaggccgagttgggcggatcacctgaggtcaggagttcgagaccagcctggccaacatggtgaaaccctgtctctactaaaaatataaaaattagctgggcatggtggcacgcgcctgtaatcccatctacttaggaggctgagacaggagaattgcttaaacctgggaggcagacgttgcagtgagtcaagatcacgccattgcactccagcctgggtgacgagcgaaactctgtctcaaacaaacaaacaagctctggacgtaggcctgggtttgatttctgactctgctactaattagctgtgtgacttcgggcagatgacatgactgctctgtgcctcagtttccttacttgtaaaatgggatctctacccacttcgctgtagggtttgtaattatctctcgatctatctgtgactttgcacagagtgctagcaaatggcagcccttgggagtggcagcaggggtgctccagtgtcccttgtccctcctgttcctctgtgcttcccagccatcctctcacatgtggttgggaaaagtcttcaaggctcacctgagacctcccctccttcaggaagccttgctagtgccccgcatgacctcctttgcacctgctaatgtctggctcccatactctcgtaggacttaatgcatgccagtggcctccctgcccgcctctttgcccccatcaccaggtggcaggaaactcactcattcattcaataaacttggtccagctgtctgaggctgccagaactggctgtgctgggtcctgggaggcggcaagaaaggtgcccaagggcttacccctgataggagagatatgttggctgaaggatacaatgtggggacaaggacaggaatatatgtgggttccgctctcctctgccgggagagaggggcaggaagggctcagggcagagcccagccttgaaaaatgagtgttgcttggacggacgcttggctaatgcttgtaatcctagcgttttgggaggctgaggcgtatggatcacctgcggtcaggagttaaagaccagcctggccaacatggcgaaaccccatctctactaaaagtacaaaaattagccaggcgtggtggcgggctcctgtaatcccagctactcggtaggctgaggcatgagaatctcttgaagccaggggccagagactgcagtgagccgagatcacaccacttcactccagcctgggtgacagagtgagactccgtctcaaaaaaaaaaaaaaaaaaaggaaagaaaattaaacacctcatgttctcactcatagtgggagttgaacaatgagaacaacatggacacaggaaggggaacatcacacaccggggcctttcgcggtgtgggggtcaaggggaggagtagcattgggacagatacttaatgcatgcggggctgaaaacctagatgatgggttgatgggtgcagcaaaccaccatggcacatgtatacctatgcaacaaacctgcatgttctgcacagaactgaactgaaagtataattaaaaaaaaaaaaaaaagctgggtgcggtggcccacacctgtaatcccagcactttgggaggccgagacgggcggatcacaaggtcagcagatcgagaccatcctggctaacacagtgaaactcagtctctactaaaaatacaaaaaattagccgggtgtggtggcgggcacctgtagtcccagctactagggaggctgaggcaggagaatggcatgaacctgggaggcagagcttgcagtgagctgagaatgcgccactgcactccagcctgggggacagagtgagactctgcctcaaaaaaaaaaaaaaaaagaaagaaaaaggagcgttgcttgtttcaggccacaggaaggggagagatagtgaaagtttttcagagaaggtggccagggaaggagaagaaaggactgtaggcagagagcatagcctgtacaaagccatagaggcaagagaaaccaggagctgtagagaagttggcaaggctgttgaacactatggtgaacactatggcggcttccatgaaatatctgagcttttgctccccactagggtgttccctcaggtcaatgtcacgaagatgggcagttggggccactttaactgttcctactcctgctccttccttctggctccggaagaccccatattccccatcatcgggagcctcttcctgcgagagctgatcaaagagtttggcacagaccacatctatggggccgacactttcaatgagatgcagccaccttcctcagagccctcctaccttgccgcagccaccactgccgtctatgaggccatgactgcaggtacagtgcctgggtggggtgggagagccccccagaccctcaaaaagaagggagtagcagatgtcagtaggggtaggcagagggactggaataatgcctcgccataacacacagtacttcatagtttaccaagcacgtgtacacatgcgttgtctcagtgaatcccactgtggttgagaggtgagctctggaagccaacaacctgggtcacacctcgcgctcctatttcctggccgtgtgacttatgactcatgacctccttcccagtgtctcgtttgcttttcctgtaaactgggactacctcataggtagaataacgcctggcccagagcaaaggccactaagagctagctatgaacaaggattttgtttcatctctgcgtggttgctgaagtaggcactgcaggcaggaggtgagtggatgtgcctaaaggcactaagtgcgcatcctgctacaaaactgtgaagccagggctccttcctgccacttaaaggaggagtggagcagagggcgcccaagtcaggaatgacttagtggagaggcgtctgtgttggccaggaagggaacagatcagctcagcctttcttgagcagtactgctccaagtgtgacccaaaaccagcagcagcagcagcagcagcccgagctgtgagatggcaaattctcaggccctacccaagacctgaaggagaagctacattttttttttttttgagacagatttcactctgttgctgaggctggagcacagtggcacaatctcatctcactgcaaccttcgtctcctaggttcaagcgattctcctgcctcagcctcccgagtagctgggactataggcacccgccaccacgcccggcaatttttgtttgttttgagatagagtctcgctctgtcacccaggctggagtgcagtggcacgatctcagttcactgcaacctctgcttcctgagttcaagcgattctcctgcctcagcctcctgagtagctgggattacaggcgccccccaaccacactcggctaatttttgtatttttagtagagacggggtttcgctatgtaggtcaagctggtttcaaactcctgacctcaaatgattcgcccacttcagcctcccaaagtgctgggattacaggtgtgagccaccttgcctggccaatttttgtatttttagtagaaacaggtttcaccatggtggccagactggtctcaaactcctgacctcaggtgaactgcccacctcagcctcccaaagtactggtattacaggcgtgatccactgcgactggccttgattttgtttttgagacagaatcttactctgtcgcccagactggagtgcagtggcacaatctcagctcactgcaacttctgcctcatgggttcaagtgattcttgtgcctctacctcccgagtagccgggattacaggcacctgccattacgctaggctaatttttgtatttttagtatagacagggtttccccacattggccaggctggtctggaactcctgggctcaagtgatccacctgcttcagcccctcagagtactgggattataggtgtgggccaccacgcccattcagaaacctccatgttttaaggagccctctgggtaactctcatgttcacccaagctgctgaaccctgtcctggagttttcagagggacgcgtatgtgccacagagcgtcccgctggtgggggtcatgggaagccatgacctgggatagacagtcgtctgtagagtggggtgaacattccctgggccctctgtttcatcactcctcttctctgttccccctacctcctgtccacagtggatactgaggctgtgtggctgctccaaggctggctcttccagcaccagccgcagttctgggggcccgcccagatcagggctgtgctgggagctgtgccccgtggccgcctcctggttctggacctgtttgctgagagccagcctgtgtatacccgcactgcctccttccagggccagcccttcatctggtgcatgctgcacaactttgggggaaaccatggtctttttggagccctagaggctgtgaacggaggcccagaagctgcccgcctcttccccaactccaccatggtaggcacgggcatggcccccgagggcatcagccagaacgaagtggtctattccctcatggctgagctgggctggcgaaaggacccagtgccagatttggcagcctgggtgaccagctttgccgcccggcggtatggggtctcccacccggacgcaggggcagcgtggaggctactgctccggagtgtgtacaactgctccggggaggcctgcaggggccacaatcgtagcccgctggtcaggcggccgtccctacagatgaataccagcatctggtacaaccgatctgatgtgtttgaggcctggcggctgctgctcacatctgctccctccctggccaccagccccgccttccgctacgacctgctggacctcactcggcaggcagtgcaggagctggtcagcttgtactatgaggaggcaagaagcgcctacctgagcaaggagctggcctccctgttgagggctggaggcgtcctggcctatgagctgctgccggcactggacgaggtgctggctagtgacagccgcttcttgctgggcagctggctagagcaggcccgagcagcggcagtcagtgaggccgaggccgatttctacgagcagaacagccgctaccagctgaccttgtgggggccagaaggcaacatcctggactatgccaacaagcagctggcggggttggtggccaactactacacccctcgctggcggcttttcctggaggcgctggttgacagtgtggcccagggcatccctttccaacagcaccagtttgacaaaaatgtcttccaactggagcaggccttcgttctcagcaagcagaggtaccccagccagccgcgaggagacactgtggacctggccaagaagatcttcctcaaatattacccccgctgggtggccggctcttggtgatagattcgccaccactgggccttgttttccgctaattccagggcagattccagggcccagagctggacagacatcacaggataacccaggcctgggaggaggccccacggcctgctggtggggtctgacctggggggattggagggaaatgacctgccctccaccaccacccaaagtgtgggattaaagtactgttttctttccacttaa

SEQ ID NO: 36587 - DNA, 123656 bp, Homo sapiens
aacgccgggcagggcggcgggcgcgctcagtctggcggcggctgccgtgagctgactgacgttccgggaacgccgcagcagcccgcgccgcccgcagcctagccgagccgcgccgcccgggcctcgcccgcccgcctgcccgccatggtgtcatggatcatctccaggctggtggtgtaagtggccttctcccccgcgcccctccgtcccctccctccccgcccccggccccgggctgcgcgcgcccctacagcgcccggtcccagtggctcgggctattaatacccggcgcagctaaatttagcaggtacagtagccgccgaggacgcctgcgggcggacgggcggcgcaggacgcggctgctgcccaggaggcagccggcgccggcggccgcttgcggggggctgggccgggacggcgagggctggggcgctcgggggttccgtgggggctgcgtctcgccgcgcgctggccgctttgttcctcagctcggtcgatttgcagaggccccgaatgggcgcaccgcggacacgcgtctctctcctttggcagaaatgtgaggtcgcccggcgccgcgccccgccgccccagcttttgtcaggtggaaaggacagcgcagacgaaccaggggcgctgcctggagggtcagcgcggaacgggtggagaggcagaggcggggctcccagtggggttggaaaaatcctcctttttaggtgtctgcatcgacagcggcaaaggcagctgggacatgggaagacgcatgtgaatcttggagtaaacgcctggagcccccggctccgactccttttgcaggggattgagagacaggggcaggtacctccaggaatgcacgggaaattttcaagtgacagccacccgcatggtggcgatgacacctcccaggccttgcaggagagcgcagagtcatctagggtgaggtctgtgtgaagtcattgggggtgggcgtgggggccgattttctccttcaagccccaggacctgtaggcgtttgaagagcttccccggtggatttattctcctttggagatagacgtggctgttccaagtccctgttcttccctaaccatcctggcctgagtcagaacagatttgccacctgctgtagctagcaggggctgaaatgggtgtggggagtctaaggcggggaggagggtggcaggcacctcgggctttttctttgtctgagaacacggggctctggaccccagtgattgtgcaccatcactccccacgttttgaaacaccacccatctcccttcccttctttactgattttcccttccgaagtggatctcagcattgtctcccgccaccattcagggctttcctcccaaagccagtgtctgtgcctctcagcccccaagtcattccgtgaaggcctctccacagctgttcctgactgcggggtgtttgcgctgcaccttgaggtggcatgttaaatatttagaagatttctgctggcagagccgacatgaataatacaggaaagtggctgacacgccttgcccagcctcatgcctgaccaacactgtcttgccttcagggtggtgtttcctctctgggatcgatattgccagtggcttctgggaagccctcagggtggggctggagagttgagctggcctggctggtgggctctctgtaggtcctgctgggctgggagtgagggcatctgatcctgggtcatgtgactatcattagttttattagcactgggtcatgtgactatcattagttttattagcacctccctcacccctgccctttttttttttttttttttgagaccgagtctcgctctgtcgcccaggctggagagtgcagtggcacagtctcggctcactgaagcctccgcctcctgggttcaagcgattctcctgcctcagcctcccgagtagctgggattacaagcgcctgccaccacgcccagctaatttttgtatttttagtagagacggggtttcaccatgttggccagcctggtcttgaactcctgacctagtgatccgcccgcttcggcctcccaaagttctgggattacaggcgtgagctaccacgcccggctcctcccccttttttacaatgagcaactgatgggggtggagaggagaggcatatatttgggaggtgtctcagggatgtgctgttgctttctaaaacaaccacactccctagaaccgagacttcagagaatttaaatgaacagcattatgtggcccaaggagagttgatgggatttgggattgttacttccactatcaagtccaaaaggtcagggataccacttatcccccagtccctaattccctgtagaaacctagcataagcatattgattatgagttatgaacatcatttttaataagcaatacctgtttcatgaagacaatatttgttaattacaggaaaattagaaaagataaactgaaaatcatccacatttccaccacacagagataactaataataatgatggagggcatattcttcaagaaattttcctgtattgcatatatgtacatatatttgtaattcaaggatattattgattcagcccaatattctacactccacataccttgaggaacttcttatcaaggggaggaatactgtgtttggagtcagaacgcccatggttcaaatcccagttttgcctcttgccagaagatcccagttcacaactcagatcagagcagatgctagtccacagctagttaacctcatgttgctgttgcaaagatttccatgacacttgatatataaattgccaagcaccacggagagcactaaatcaatgatgagtccctccttctgtcctccccgggaaccctatgagaggggctctcagacttaatttactcctgtggttttcaaactgggttccctgagggccacccagcctgagcagatgggctctgggctcctcatccctgattcaacccaagcagttccctttttgtttgtcttatatattggggttctagataaaatacaattcagaaaaatatatgtgttttactgctaataaaaacaactgatctagtcctccccctcatctgtaaaactgcagaggaaatatgccttgctcagggacacaagatgagctggtgaagaaaacaggctctggatttttagtccagtccagtgctttttccaccttcactccccactgagaaaaacatctctttcaagctccctagacctctggtatgggagcatcctatggttttatccgcgagtcacgttttgtataagtaatcttttcatggttttgtaagcctctgtcacatcaaagaacatgtaaggaagacctatcactgtgttgtgaggatagagagggagtgtcttcctgtctttgtgtggtcccaaccatccgaccagaggtatcacaacaagctgatggcctccagggacagccagccagtgctcgtggttgtctctgctgctactggccgtgagcattttgaagaaagcaattgtggcttgtttccctttacaaccgctttatccctgccatgggtctttcacaaagtatctggcacctgaatgcactgagtgaaggttggttgtgttgaaggaaatcctaggccctggggacaagcagagtggctggctactgctgtcccctggggacggaggtcagcaggcatcaagacaggcttgtgcccacgggcaaggctcttagagtgaggaccagtttgagatgcttatttcttgccagctctctttctcctaacttccttggctcagcctgtaaagaattaaggaagagatactcagtgcaatagcactcagaaccaggttgataccttcatgggacacaggggcttatttaggacttgcctgcttgcctcctttcattttctttacatacaactcaaggcctaggcatgaatgaatttcaaactggggagagcatgtttttgtgcacccttttggaggggggataccaacgttgctctgtgacttcttggaagaatatgccattttgaagcattattctaaggagcaggtattgcctcattgtcttggccaaggcccagaatgttggctgaacggatcaagagcttctcaccccttatgggattagtagactaaaaccccagctcactacatgggggaaagagagttctaagtccacagaattttctgaataactaatggctgtgcagaaaacattttatttccacattgcacattttaaaaaatactagtttttagaaaatacagtgtgatgatcaagacagagtcttagtttgatggctgaagatctggctaagttccaggactgggatttggagcatgaagtctgtcctgggtcagggatgtgcaaatggatggagctgggaggaatgtggattgtcctcaagatgttccccaactgttgcaaaacaaatggaaaaaaaagaaaatatcgtaaatccttaaatataagctagcttttctttggggcctgcttttaaaatgtggcatgcaggaaactgattcagttaatggagggttccagttggttgaggattgatttcctggcactgtgctgtagtacactgtgggagctgggtaaatgtttcggttgaattgtgaaaggaaagatgttaggctagtaggcagcagacatgggttctagtcccagtgctggtctgactcactatcacagtcctaagggcaactcccacccacctgggccagctccctgtctaagagacaggtttttggccacagtcaccttgcaggtcctaagagctccaagagtcagtgttcctctaggtcccttccttccccagctggcctgtatgcatcacatttatttataaacaggaggagtatcctcaaggaagtgaaaaatactagcttagatttctccgctgttgagctgccctgtttctttgtttgctaatcctgcctgtctgctgagaagtagctttcatgcacttcttcccactgtgtcttatttgaggttagctgacaagtgagggtctcacctagttattactgggtcagtctccccacttccttctgaagcccgctatcttttttggagggtgtattatgtcgggggaggaggagccctggggagaatgagggaagggggactcaggtcctctttggccatttagtgaggctgctgttttgtgtacgtatgagtgtatgtgagtgaacgtgtgtgtgtgtgtgtgtgtgtgtgtgtgtgtgtgtgtttccaggaaagttagggaggctagggaaaggagagatatggcagtgcagcagccatagcacgtggcacctttagaatttcactgccagggatgagccacacacatgcccagctggttaccagaattcttagtctgggggagtttttccaacccccgaaaagaagtaaggagaggggggtgcacttgggcactaaggatgttctcctctcgattctgggccttgggaagggaattgggattcttgaggaactggaagttggatcattatattcagagtatttattctgaattttcagatctcatctgtctttatacagaagcacattattttcactttgggatttttaagtcacactggggcttccctgggaatacagggaaaaaggaaatatagatcaaggaccaactattgggcacacagtagggatttcagaaggaatcttgaaaggtaatttggtataggccttcaagcatgcgtgggtacccagaccaggatggcaagtgaggctgcctaggacactgtcttgaggagcaagaagctgagttaggctcagtggggaaggagtcccaagagtgctttatgcagggaagatggcaatggggcacatgggttggttcagtatttgctcttccacacttagctcattcctgatcagaaaaggtctgccccattgtcagatttactagattagtaaacagagagcatctgttatttgagttaacatctcctcctgacatcctatctctccctctccccgtggccttgtcagtcacctggcagttctaggacaaaggtgcctcctgttcccactctaggtagctgtccagcctagaggctgtcttgccctgcttctctttcctcttaggactatcctgcgtatctatactacattccccgcccccccaccttttttttttcctttcactgatcacagctcaaagtctgccttaggcattctcctgcatacttaggtgtgtatatcctttccccctctttgtaggggactctggatagtactttgggctgcaaaactagttttccattcccttctggtagcatgctgcatcctgcctcccttcactcagccacagaagtcagcatgtgacccaggcctagatatgcatttccctgggcacagacattggtccagaggtgggcaggtgacccaaactgagatccttccccagggtttcttgatttggagctgagggagaatagccttgcctatgggttccagagttgggaagatatgaagttagggctgaggcatctaaagcccctggcatacgtggagaaagtccataagtaaaagtgaagaatacaacaaagcaaaaataaatggagatgagacttgggtgagagaaagaggctggcacaagagaatcttggttctggttgctcgggccccagttcctgcagctgcttttttgatgccatgaactgtccgatatcctagaatgaaaactttaaatgctgcttataatccattaaatatttgttgttcggatggactggggtatgctgcaggaacaactcccaaatcccagtggctcaagaaaacaaaggtttatttcttgctttctgctgcctgttactgtgggttggcaggggtactctgctcatcgcattcactgagagtcccaggctgactggatttcctttgtcttatcgttataagacatcaggattctggctgggcacggtggctgaccgtgtaatcccagcactttgggaggcagaggtggacagatcacttgagcccaggaatttgagaccagcctgggcaacatggcaaaaccccatctctacaaaaaaaatacaaaaattagctgggcatggtggtgtgcacctgtggtcccagctacttggaggatgaggtgggaggatcacttgagcctgggagctggaggttgcagtgagccgagatcatgccactgcactgagcctgagcaacagagtgagaccctgtcttaacacacacacacacacacacacacacacacacacacacacacacacaccaggattcactgtggtagggagagtcacatactagctcataagtacctgcacctggagatgataacatgccatttctgctcacatgtcattggccaaacctgaattcaagtggttacactcctcactaaagaacagccctaatgaccagcatatatgttgaatgaatgactcctaaccagctttgcaaacctagaaatgtccttggcataatatggtattgtgcaactgggagaatcctgacatactccttcaatctctacactagaaatatctttctcacttcccttttagtccctttattctgttcgtgagtcaagaaaggaggtcttaagtctgaggagaaattagcaattacaaagaaccgatgccattccatagctaaagccttggaaggtgccctctggctttcactacactctccatacatgtctctacctttctccatgaagcctctcctaggtcccctaaccaagaaagatttctgtcctctgggtctccagagtggcattgtcactttgttcctggtgctatagtggtctgtgcgttgatatccccttacagaccacatctgcttcgtctcccttatagtttctcatatgcagtaggtgcccagcgagtgcgtgttgggtggtgaatgagtcaggacctcactcctcagagtgtggtctgtgcaccagcagcattggcattactggaatagttaggaatgcagagtcccaggcctggtgaatctgcattttaacaagatccccataaagcctgagaagggctgagtcaggagacagggtgccatcatgtcccctgtgaattgaaaagagatggacttgcctgaggttttcattattgtctgtggaccttggacctgggattcaattgcaagccaccatttgtgctagactgtcattcatgctttctggttctgagaggttctgaccccaagtttttatgatgagttctaaatagcatatctagactctgtcaacccagtgcccagccaagaaccttttgatatggacaggaggcagggaaacactggatagaagagggcagttccctggcaaaggccccaccctcaagcctggaaactgcggccctaaatgagaacagttatccctgttttcctgcccaaatattgctttttccaaaaccactctggctcgccacaccccgcatcctgtatccataaaaaccccaaactccactggcagagaagcagagtggcatggcagaggagagaagagaagcatctgaacgttgagaggagtttggccagggatggccgcactccaggggaagattatcttcccactgtatcccctttccagctccccatctcactgagaaccacctccatcactcaataaaatctctgcattcaccatccttcaagtctgtgtgacctgattcttccaggatgccgggttcttcctggaacccgggtaccaagagggcagggtataaaagactgtcaccctgactctccactgagctggttaacagccatctgcagacggcaactgctaaaacagcattaattgtaacacacccctagacgctgccacgggaccagagcccaaaagtgctcaccccagccctggcacctgctcacctgcatgcttcccctcctgcaaggggtttgagcactgcaggccgagtaagcaagccacacccctgtcacaagtcccacagaggggtcaaggcagccctcctgtctcactttcttttttttcttttttaagatggattcttactctgtcgccaggctggagtgcagtggcaccatcttggctcactgcagtctccacctcctgggttcaagcaattcccctgcctcagcctcccgagtagccgggactacaggtgcccgccaccacgcccagctaattttttgtattttagtagagacggggtttcaccatgttggccaggatggtctcgatctcctgacctcgtgattcctcaccttggcctcccaaagtgctggaattacaggcatgagccactgggcctggcctcctttcttactttcacagattggctgcctaattgtgatcagtgtaaaatttagtcttgtcacaactagggcttagactgccaaagctatgcctgtgagacagaatattgggctgagtgggtcacgctgctcagaggagagggaatacaacccaccttgagaaagaggctagtgagcctggccagctgatgctggagattcacgttggatttccaagaacatgcaaggactttttctcatgagcacctgaagctgagaaccacgagtccacacgtgcccctcctgagggagttgcaggatccagcaggatctgtgcacacttcaggctgcgtgttgtggaatccaggctctcagcaagttctcctagctctgccttcaaaatactcgcctgtctacccatgactcccacctccaccactgccaccctgctccaaccaaatactgttgctctcctggaccattgaaaaccctcctgactgttttctctgcttctattcctgtccctccggtgatctcattaaaatgtaagatagggccaggcacggtggctcatgcctgtaatcccagcactttgggaggccgaggcgggcagatcatgagatcaggagatccagaccatcctggctaacacggtgaaatcccgtctgcactaaaaatacaaaaaattagccggatgtggaggcgggtgcctgtagtcccagctactcaggaggctgaggcaggagaatggcgtgaacctgggaggcagagcttgcagtgagccgagatcacgccactgtactccagcctgggcggcagagcgaggccccatctccaaaaaaaaaaaaaaaagtaagatagaccatctttcccctgctgtttaaaaactgctccatctcactaagagtaaaactcaaagtccttaccattgtcaacaacactcaccaaggtctggctcctgcccacgctctgaccttaccttgcagtggcctcccctctctcactcagctgcagcctcctcactattcttagaaggtggcaagcttgtcccatccagcaccctttgcacatacatatattaataatatatattatttctataatagagctaccagttagagaccttagaataagtcttttttaaaatgaaaaaacaaataaagcaaagaagtgaaaatataagaaaacagcatatcctgggggagggaaataagcccatgtggaaaagaagcacttctggaagtaaaaaataaagtgttgacattaaaaatccaatgactaggttaaaacagtgaaggattgaatgccaagaaggtagtgtttttcacactgcatcttagagctagaaggagtcttggtgatgtcatgcccttgttcgacagacaaggaagatggggacccacagagataggtgatctgtcaaaatcactagcccgattggctaggccaagagttaaggccaggtgtccatgttctgaaaatgttttaatgtgggaaagagagtaagcttgttttatatgggtagagaattggactagaacctgtgggtggctagaagataaatctttggcttgctggaaggaaaaggtttccagtagttggcactgacagcactgggctgccttgtgaggcagggagctcctggcttccaaccctaaaactgtccaaccctaaaactttatgattttttattttttattttttttttgagatggagttttactcttgtcgcccaggctggagtgcaatggcatgatcttggctcactgcaacctccgcctcccgggttcaggcgattctcctccctcagcctcctaagtagctgggattacaggcatgcaccaccatgcctggctaattttgtatttttagtagagacggggtttcaccattttggtcaggctggtcttgaactcctgacatcaggtgatctgcccgccttggcaccccaaagtgctgggattacaggcgtgagccaccatgcctgaccaaaactttatgattttaatctttttccttatactggttaaggaagagagagagaagaaccactaaaaatatttcctttttcagtgattggacttctgtccttgctcaagactgattgattgattcatagcttggtcaatttattcattgatgtactgctcatttttttgaccatttgatgcatgccagccaccagggatataaagatgaataagttctgattccatctttgagaagtttatgaggtcacataaccagtcactgggaaactgggacttgaattcaagtgtccctctgcctgcccagtgctgtttccattgggtggatattttgtgggtgtgtgtgaatgacttgtctggctttggttggaaattgtagggataagtcctttcagcaggggaagtggtacatctcacatatgaaggaattaaaccactgctttgtcttcctaccggggggacactgtagcatccaatgttggagagaagagaaggcagaggacagggtgtgctaagtgggaaacaatctgagacgaagaggtgggtgaagtcaagcatcctttcccactgttttagtctatgattgctgctgtaacaggtaaccatgaatttagtggtttaaaacaacagaggtttcttctcttgcagttctggaagtcagaagtctgaaatgactcttttggggctaaaatcaagatgttggcaaggctggttccttgtggaagttccaggggacactccattccttgcttcttccagcttctggtggctgccggcattcctcgtggctgcattactgtagtctctgcttctgtgatcacactgtcttctgttctgcccttacatcttcctcttaggacacttgtgattacatttaatcacatttaatcacaaatcaaatagggcccacttgaataatccaggataatctccccatctcaaaatccttaatttaattctacctgcaaagtcccttttaccttataaggtaacattcacgggttttaggaattaggacctggatatctttgcaggccattactcagctgaccacacccaagatcacaggccttactgcctccaggctgaggggagttcatctaagaacaacctaaagaaaggggaaacacacaagggaacactttgatgttctaacgtctttatcttttttaaaattttttttaaaagacaggatctcactctattgcccagattggagtacagtggtgagatcacagctcacttcagccttgaattcctgtcttccagcaatcctcttacctcagcctcccaagttgctgggattataggtgtgagccactgcacctggcttctaacatcttattttgtctccgtttttgggctctccttgatttgcaaaaagtaattaatgaggcaatagaaaagactatttataaagaaatggtggtgaggggataatggataatagtacagtgaaccctcatttactcatcgccagtttaagaactagaacactacctttattgtatgaatataccataatgtacttatcaagcaaactgttgatgaatgtttaggttgttctagatttttcttttgcactctctcagaaagagcgctgcagtgagcattcttgtgtgtttcctggtatacctttgcacaggttttgttagggttagtctggctgaggcagaggacagttgcatcttctacttgataacataaattaagtttccatagaaaagggggcctatcctggggctttttatcctgtgtcattgatcactttgactgaccctgcaccaacaccacactgttgtaattacgtggcgtgatgaaaattcttgatgtccggcttggcaagtgctccaccatttgttcttcataaactgttctccaaacccgttttctttcagcagtgggtgcgattccatttgcacagtgtctttaccatcacttgatactctcacacttagaatttttgccattctgatgggtaccaagtgtaatctctttatggatttaatttgcattttctgaacactcatgagactgagcatcttttcatatgtttattggccattcatgttctctcttctgtgaagcgcctgctcaagtcttgccagtttttctcttgtccttatcttattgatttgtaggagttctttaactcttctggatgctaaacttctgtcatttatgtgttacaaatgtcttctcccagtctgtgatttattttatcattttttatagtctacattgataatcagaagttcttaatattaatgcaatagacagcattttttttttcgtttatagtttttgctttttgtgtcctaggaaaataaaattgtgaaattattcttccatattgctcctagcagttttctagtttttctgttcacatttaatttcttactctaccttgagttgatttttatatatgatgtgaagcagcagtctaattttttttctttttttcttttttcttcacatgaaaagccagttttcctggctctatttattcaaaagtttatgctttctcttcagacctgcagtgccctgccctgtcataaagtgagtttctataatgtgcaggcctgtttctgggcccttcattctgtaccattgaatagttcgtctgcctgccacagtgccacgctgtgttagtaccagaactttatgaaaagtcttgatgtctggcgtggcaagttccccaccttgttctccttaaagagtgccttagtgcagtggtccccagcctttttggcaccaaggactagtttcatagaagacagtttttccatggatgggggttggggggcagttttaggatgaaactgttccacctcagatcatcaggcattcgttaaattctcataaggagctgtgcaacctaagtctctcacatgcgcaattcacaataggattcgtgctcccatgagaatctaatgccgctgctgatctgacaggaggcggagttcaggtggtaatgctgctgctcacctcctgctgtgcagccaggttcctaacagaccacagaccagtctccgtccttgtctgcagcccaggggttgggggccctgccttagtgctttcttctcccataatacatgtttagaattagcttagagttatgtgttacagcacatacacaaacacacaaatctgttgtcatttttattggactagcatttaatgtacgaaacaatagaatattgatgttctttatttatttttaatttttggagacagagtctggctctgttgccaaggctggagtgcagtggcacaatcatggcacactgcagtcttgacctcctgggtgcaagaggttctcctgccctggctcagcctcccaagtagctgggaccacaggtgtacgccactgtgcttggctaatttttgaattttgtgtagagacattgtctcactgtgttctcactattttgcccatgctagtcttgaactcctgaccttaagcaattctcccacctctgcctggcctcccaggtgtgaggccttttatttttttagagacaacatctcactctgttgcccaggctgaagtgcagtggggaagtgtactgcagcctcagactcctgagcttaagggatccttctggtctcagcctctcgagtagttaggactataggtgtgcaccaccacgcccagataattaaaaaaaaaattgggggccaggtgcagtgactaatgcctgtaatcctagcacttcgggaggctgaggcaggtggattccttgagcccagaagtttgagaccagcctggacaacatgctgaaaacctgtctctaccaaaataaatacaaaaattagccaggcatggtggcacacacctgtggtcccagttacttgggaggctgagccagggcaggagaatctcttgcacccaggaggtcaagagtagctgtggtcccagctactcaggaggctgaggttgaaagatgcttaaactcaggaagtcaaggctgcagtgagctgtgatggtgccactgcattccagcctgggtgacagagcaagactctgtcaaaaaaacaatcttttatttttagagataggttctatctcttttgcccaggctggtcttgaactcctggcctcaagcaatccccccacctcggcctcccaaagtgctggggttaccaacatgagccaccatgcctggctgatattgatgttcttaatatgtttgttgcactccatgtatatggtatctacctttatttatttgggtcttctttaatgactttcaataaaattttataattttgctataaatgtcatacacatcatttgttagatttattcccaggtatttgatatttgttgatgccagtgtatttagtatcttaataaaatttcatcttccaactgttggaagaatacaaccttgcttacctgtagattctttttggttttccagataaatagtcatgtcatttgagaacagtgtggcgttgtgcctttctggtcattattcttttttatttccccattttaccctggttaggattcccagtgcatgatgactaaaattggtgaggcagacactcttgtcttgttcctgacttaaaaagggatgcttcaacattttcccataaagtatcatgcttgctgtagggttttcagaaatatattttgtcactctcaagtgatagtttgctaagagttttcataatgaatgatattatattttatctaacactttcattgagacaatgtgatttctttttggtctttagtctaagtggtaaattgcattaattaattttaccattaaaccaaacttgccttcctggataaacccaatttggtcatgaagttgttttttcttttttctagttaaaatgatcctggaggcgatttgctaatatttaggattttttttaagctatgtttgtgagtggtattggctatgttatttttgtatggttttggtatcaagattgtgctagcctcataaactaagctgggggtgtctcatctttttctgtactctgagatagtgtgtgtaatattggatgtctttcttaaatggttagtagaatttgccagtaaactgctcagagccaggggctttttcaacaggaagattttaaactactgattcaatgtatttaatagttataggtttatttgatcttttcagatcaatattattttaggacttaattcatttctgtaatttttcaaatttatttagttaacaatattgcttctgcaccctattccttctcccctcttcttctagcactctcattagacatgtgttagatgttcctactctgtctttcaagtctcttcattttggccgggtgcggtgtctcacacctgtaatcccagcacttctttgggaggccaaggtgggcagatcacctgaggtcaggagttcaagaccagcctggtcaacatggcaaaaccccatctctacaaaatagaaaaattagccagacttggtggcgggcacctgtaatcccagctactcaggaggctgaggcaggagaatcgcttgaacccaggaggcggaggttgccgtgagccgagatcgtgccattgcactccagcctgggcaacaagagtgaaactttctcaaaaagtctcttcatttcttatttctgatttatttttctgtcactgctgcattatgaataattgtgtgcacatctgtctcctcagccatgtctaatcagctgctaaacatatccgttgatttacaattttttaattattagattctagaaattctatttagttctgtttcaaaactggccatattttatgatgtctgttccttctacatattttaaattcctttttattcctttaaacatattaaacatatttatgttatgttcggagtctgataattctagcatctaaactatttttcaggggcaatttagatctctttttttctggtggctcccaatcaaggtgcgttatgtgtcttgtaattttttcttttctttcactgtgagcttgtattccttggaatttcatctgtaggagttctttaggcctgggtcaaaggtgaattcctccagggaagatttgcatttgcttcggttaggtgtctagggacactaccaatattggactactgaaaagtaatttcttgagattttaaaattttgaccacgttggtagtgtaaatttgggctgcaaacttatgtgaggatgaggttagtggttacaagttttcaggggaaatacggtttcctcttcacctgctgctatgactagagaatgggtgtttttactttaacctttagtgattgcagcaggcttctctctcttcacccttttactgatgttgtagtgctttggggtctgaattagtttcctagtgctgctggcacacagtgccacaaactgagtggcttaaactgacaaaaatttattctctcacagttctgcagactagaagtctgaaatcagggtgtactatgctttctctgaaagctgtagagaagaatctgttccctgcctttctcttatcttctggaggttgtcagcaagcctcgcccttctttggcttgtaaatgcgtcactttaatctctgcctccattgtcacatgctgttctcctgtgtctgtcttttttcctcttttataaggacactagtcatattggattaggggccaccctaacctaatgacctcaccttagcttggttatatctgcaaagacccttttctttttcttttcttctttttttttcgttcttttcttctttggcagagtctcactctgtcgcccaggctggagtgcagtggcagaaccttggctcactgcaaccattgcctcctaggttcaagtgattctcatgcctcagcctcccaagtagctgaaaccagaggtgcacaccaccatgcccagctaatttttgtatttttagtagagacggggttttgccatgttggccaggctggtctcgaattcctggcctcaagtgctgggggtacaggcgtgagtgagccactctgccccgccaagaccctatttttaagtaagatcacattcacagttattggggtttaggacttcaacatatctttttgagcaacaatttaatgcataccatggtccaagctttatagaaggatgccctgggtcagttttactcaaaatgtggtctggggaccatcccattacctcacctaggagtttaatagaactgtaaattctcagcctcgccccctccagacctactgaatgagaatacctgaggttagggcccaggaatctgtgtgttaatacactctccaggctatcttatgcaggctgaagtttaagaagcattgccctcaactatgtctcctgtgcgtgacactctgtcaagccctgtaatgtgaaattcagtgcttcagttagcaagcgcccttaatttacctttctggggctccgcttttactttgcttttggcctctaaagcattttacactgatatcgaatatcaatgtttacaaatattatttatattgattacacttttgattttgtttggaaacctgtataaaagttgaaagaacagtacgaaaaatacttccattattcttaccttggcacatccgctccatctttttttatataaatacaaacatttccctcttgtctaaccatctgaaaggaggctgcagacatcatgctacctcaccccaaatactaaagtatggcgctcaaggacaagattactctcctataccagtggttctcaaacttgttggtctcggccgggtgcagtggctcacgcctgtaatcccagcactttggaacgccaaggcaagtggatcacctgaggtcaggagatcgagaccagcctggctaacatggtgaaaccccgtctctactaaaaatacaaaaattagccgggattggtggcatggacctgtagtcccagctactcgggaggctgaggcagagaattgcttgaacccgggaggcggaggttgcagtgggccgagatcataccactgcactccagcctgggtgacagagcaagactctatctcaaaaaaaaaaaaaaaagaaaagaaaagaaaagaaaactactttttccagaaaaaaagcaaaataatgtcaagaagagagtactgtacatttttgtaagtcttttttgtatcaaggttaatttcaatgtggaatctgaaaccttattagtggtggttggtctgtcttacagtttgagtggatcttttctgtatgatttttaacattatgcattggtcatttggaaacttggttcaccaaatagatgcagatcttcaaatgttgacacattttattgtataatatccaaaatccatatgcattaatatcactgttgatttcatcagaaacgccttcaagtattgggatactgttaagttaatggtaggataaaaatgtccaaaattctaatttttgcttaaaatatcaaatctcatcattggtaacaaatactatttgttttttctgatgagatcaatcatttttctagaaaaggattacaagatacccaggtctgaataaccggagttcatcagtcattcaagtaactggtgttccatgaaaaaaagcggataattcagcacacaactcagtgacacaagtgcttttcctctagacaatcattatactttagtatgcagcagaaacactgtatgagtgctacttatttcatcacagaatgataagaacatccatactcaagggtctggatttaatgaaagtgatgatttttactatatcatctatgacattcttaaatggaacaggattttgttttccctattgtattgtggtgaagaacacagtggtgacaggtggagtttggtgctactgccatgattcatgcaaagtactagcggcagttttacctttcattggttttgcaccatcagtgcaaattcaacacagcgaaaaggcaaatgtcttggtaatattgttgaaattgttttgacctcatggaccctctgaaggggttttagggatcccctgaaaggttcttgagatcccctaggagtctgtagatgatacagagaatcactcactgttctgtacagtaaaaaaccattaccaccctaagaaattcaactctaattccacacctttatccagcatgaggtccatactcagattaacccaaatttgtcaaaaaaaatcctttattggtgtttttttttcctgtttctatttggatgcaattagagttcacacactgaatttggctgttatgtcttttgaccaacctagaacagttgccccgatttattgaagagtccgggtcggctgtgtggagagtgttctgcatgtgtcggactcatcctaatgattagacccaggtctgacaattgtggcaacaccaccacattgatgaggaggtgcaccctcgaccgcctcctgtcaggaggtcagagtgtcagactgtctcacaattggtgatggcaaactcaaccacttggtaaaagatttacaatttctttgaatccagaattttttactgttttcagtgggacagtaagtcagggtatcttgtctgatactgcccgaaaccatggtctccttttgattattattattatttttttgagatggagtttcactcttgtcccccaggctggagtgcgatggcacgatctcggcccactgcaacctctgcctcctgggttcaagtgattctcctgcttcagcctcctgagtaactggaattacaggcatgcaccaccacgcccagctagtttttatatttttagtagagatagggtttcaccatgttggccaggctggtctcgaactcctgacctcaggtgatctgcccacctcggcctcccaaagtgctgggattacaggcatgagccaccacgcctggcccttttgatttttttttttttttttttttgagacagagtttcgttcttgttgcctgggctggagtgcaatggcacgatctcggctcactgcaacctctgcctgccaggttcaagtgattctcctacctcagcctcccaaatagctgatattacaggcacccaccaccacacccggctaatttttttttgttttgtatttttagtagagatgaggtttcatcatgttggctaggctggtcttgaacttctgacctcaggtgatccgtctgcctcagcctcccaaagtgctaggattacaggcgtgaaccaccgcacctggcccctttagattattttttaggtttgcaggtatatcagttaaaattcttttggttttagaaaaagtaatacaactgaggctggctcacacatcttaaaagtctagaatggtgctgatttcaagtgaggcttgatctggcagctcaagattgtcaccagagcatcaggttttctggtgtctcgtctgtactctttggttggtgcctgtttcagattaagcctggctcccctggctgctggcggcttctaggagccttgaagccctcttgtgtgtccagcagaaagaaggcatctctcccagagagagagcatctcctatgggagacaaggaagcttttcctctgaagtccctagcaagcctttagctctcctgattttggtcacatacttgtcattgagccactccctatggcatgggcatgggatgtgtttgactgaaaccagccaggacccaccctggatctgggaataagatcagttgtccaagcacatggcactgggatggtgacccagagagcatctgggtcctcttaccaatactaaagccaactggacctgtgggctatccaaaaccaccaacatccaccaaagagttttggtatccatgagggtataaaacactttactgagtaccccctgtgcagcagctgttgtgccatgccgttctttattcactcagcaggtgcactctatcatctggtcttgagtgagctggcactgtgagccagatgtgggtcaccactgagggaaacaactggagttttgcctcacagcatttctcatgtaaggctctaataatttaattaatgcagcagtcgtacaggtggacattacttgtctcttccccagatgataaaattgtaagctggagctaggcaggctgtgcaggttacccagcaagccaggggctggagccagacaaacgagagcaccatagtgccagcaacactatctggccccggactggatgtgacttgggggtgtcactcagcccttgctgagctgagtgaccttggctacgggactgtgcttcccagggtccttggagcagggaggggctcaccctcctggcaggcagcttccctgattgttcataccatcccatcttctacgtctctaagagtcccggctactctgagctagatacaccctcttagaccctccagggtctcaagggccctgcagggtctttgatgtttatggtgaagagctcatgaggacaggagaccaaggaggaaagaggccagagccttaagaactgcctccaggtcgggcacagtggctcatgcctataatcctagcacttcgggagacggaggtgagtggatagcttgagttcaggagtttgagaccaggctgggcaacacagtgagacctcatctctagaaaaaatagaaaaattagctgggtatggtggcgcatgcctgtagtcccagctactcagcaggctgaggtgggaagattgattgagcatctgcttgttgggctcaatcaatcctcccacctcagcctcctgagccaagatcgcgccactgcactccggcctgggcaacagagcaagatcctgtttcaaaaaaaaaagaaaaaactgcctccccaaaagcacactggggaagaagaggaggtgaggagtgcagaattggctggtccgttcctgtggcttctacctgcccagacctaagagagtacctttaaggagtggctggagaggctcttttccatcttcttttgtaacagtctagccctgtcgctaggcctcctgtcctagctggctcaccccagccagcctgctcaccccacctgggcctgccttagctcaagagaggctgggatccaaactctgaggtcagtctgagccagcccagccctgcagtgccttccagggtgagactgaggctcagcatgttcctggaggcaactcatccagtttaatgagactccaggtggggaggtggtttccctatagggcatgggcaaatttctcagctgacagccaggcatccaagctgctgccactgggctggcagcaggatgagatcagctgtggttgtggccttcctggcaggaggtaaggcactgtggggcttggtgaagtcactcaggtgggagcactgctcccgggagaatttgcagaagcttcctgggtagatagatcattccagtcactgtgggtcagccttttcttcccattagtctgctacttggcagtttgcaaatggcttcacatctgtggttggatacaaagtcacaaacgtggtggctcctggctgaaatcagcctgcatgttgcttgtttagcttgtggtgttttaaatttgaatctacttaaatagagagatgtggcaccaaaattcaaattttgggcttctcttgaagagtcagaagatctggcactgcaggatgattccatcagggcagcatcagccaagctgaggggtggctgctcccagggcctgtgctccctgatctgcctagccccacctggcccagttactgcaggctgtggtggtgaccatgtctcatctcacacctggtcttttccatcactggcctggcccttgattctgtattttcaaagcaaactggggaggtgggcattagtatctctgttttgccagagaggaaaccgaggctcaaactggtttcaatatgtcatgtaggaaagtagtcatggcccgattcaatcatggctctgccatttaacagctctgtgacactgggtgagtcacttgccctgtctgggtcccagcctttccattcataaaacaaagaggttgagggctagctaggtagcaaacttctcagtataagaaacagatggaatccagagaagctgggagaggagaaggaaacaaaggagaggtgatggcccaacaacttagcagaaagacattttaaaaggatctctagccttagtaacatagcaagaccttgtctctacacaccaaaaaaaaaaaaaagaaaagaaaagaaaaaccagccaggcatggtggtacatgcctgtagtcccagctactcagggtgtagggagcctgaggcgggaggatcacttgagcccaggtggttgaggctgcagtgagctgtgattgtgccactgcactccagcctgggtgacggagcaagactctgtctcagaataaaagaaaataaaataatttctgatattcttttaatccatttgcttttctgtgatataaacttgctctgtgtcccagaattttaagcaaaattggctgttcacactaaaaaagaaaaaaaaagcagaagaagaaggatggtagctaaatgctctctggggttcccgtctgaactgatgtctgtcactctgagtagtcattggcagtgtgctgctaggtgccagaggaacacaggatctgtgccttgattcccagacctaaaggcaaaacttagatccatttaccataataaaaataagtatgtttgttgacacataatttacaagtatgctttatgtcagatgttgcattgaaagtctgcatacattatttctcttaaccctgactgtagccccatggggtaggtactattatttccattttacagataagcaatcagaggtttagaaagggtaaggaatttgcccagctcttttttctttttttggagacagggtctcactttgtcatccaggctggagtgcagtggcatgatcagcactcactgcagcctcaaactcctgttgttcagttcttaaacattacatattagagccgtgaagcaaattcaaatctgtctgattttacagctcttgtgttgtctttgcctaagtgttgctgcagccccatctccatgaatggatcatttatagtgcagggcaatgagattagggtccagtgcttctgcaagcaggaagaatcgttgaaacgcagaagtgctgtgggctggactggctggtccagggagggtgcatggaaggggagtaaatggtcttccaaacacagtttggattcccttctgcagccagtatgaagttatgtgtgatggtgagattgtgccacttgaaggaccagactggcctgaaaattagtgtcatcttaggagttcaggtggtaaaggtagatgttgaggtcaaaatacagaactttgctttcaggcaggggtgagctggtgagggtttgtcaggaggagtgatgtgaaagcagtgtgtctgtgtcaagttggaagcaacaagggctgaacccgagtcttggcggtgagaatgaaaagagagggctgcattggcaaatcagtagaatgggaacaatcggcaggacttgaaccacacatgtgcaaatcagaaggaattttagaagtcatctagttccgtcttgtcccagcacagggactcctccattggtgacctctgtgatagctgtgcatcaagtcactgccagtgcaggatggtagaacgggatcttacatggcaggtagcttctaaggccagcacataggggtgacagatactcagtgtctacattgggttgaataatgtctctccaaaattcatgtccacctggaaccttagaatgtgaccttatttggaaatagagtctttgcaaatgtaatcaagttgggatgagttcatactggattagggttagtcccaatccagtgattggtatccttataaaaagaaaatctggacacagattgagacatgcagaatactgtgtgacaattgagccagattggagtgatgcccgtccaggccgaggaactccagggattgacagcagctgtgagaacctaggaaaaggcaaggaaaatcctcccctagatcctccagagggaacgtggccctcatgatactttgattttagacttctagactgcagaatgatgagagaaacaatttctgttgttttaagctaggaaatttatggtactttgttactgcagccctaggaaactaatgcagtgtccactacctttaaaaacccatcggcccctgctggcccccctgttgcaggaggaaataagggcagcctggcaccatgcgggcagaacctggcaggactggtgcaggctcccggtatttttctctttcctttctagtgctcacaattattttaataattccatctagaagtttgcattggtgttcagtcaccccataatttagtcctaggggaacttcagttcctatgactattcctgatttccgtgaattggcttgaatcatcactaccctctccagagtgccatctctcctccctcccttagctgtatctatctactttttcttccctagacccttctagactgaagtagattctttgttctgccacctcaaagcacacactgctagcaccaattattggacaatgacctacatagctgtccagaggtatcatgtgtgtttttgtatttcttaactcatagatttgtttcttttaacttcaccagtgtttatgtcttgcctcttaagtttatatcatagtcctttgaaggcacacagcctgtcttttgcttccttttatcctctatacaccgtacattgttattactacacatacacacacacacatacacagagagagagagagagagagaaaggggaggagagagaagtaatgatggaggataattttcctcatctaggaaagattagaaaggttgaaggttgacttgaaggagaatcttgatctttagggtggaaagcatgctctggcccctagaaggtgatgatatgtctatatacagttatgcattgcttaataataggggtatgttctgagaactgtgtcactagatgattttttcattgtgtgaacatcatagagtgtacttacacaaacctaggtggtaccgcctgctacccatctaggctacatggtatggcctattgctcctaggctgcaaacctgcacagcatgctactatactgaatactgtaggcagttgtaacacagtggtatttgtgtatctaaacatagaagacatacagtaaaaatgcagtattataattatggggccactgttgtatgtgccgtccattgttgaaacatcattatgctctgagcaagtccagcctcatttgtctgtaaaaggacaacagagccattgagcatcatgcatgtgcccagttctgtgatggaccatggggaggcgatgctgaataagacagacatgacccttatccagtgcttagttttgtggggaaaacgggaagtaactacttcttgacctgattccctgtggcttttcattatggtggcaaggtacagacatgcttggtgatcatggtaggcccccggcagccttgtttgtgctgcacgacctgccctctccacttggctatggctggttggatcacacatggacacctgacccaagctgagccaattatattttccccctcctggaaacacagacgttagattcagaggcagccaattgcccccccaaattcgtattttgaagttctgattcccaatgtgatggtatttggagatgcggcctttgggagatagttaagtttagatgggatcatgagggtagggcttttatgatgggattagtatccttagaggaagagacactagagagctttcctgcctctcttttcccaccatgtgaggacacagccaaaagctggctgtctgcaagctaggaagagagccctcaccagaacctgaccatgctggcacccgatcacagacctccagcttccagtgctgtgggaaaatggatttctgttgtttaagccatcccgtctgtagtgttttttgttatggcagcctgagctgacgaattcaagaggcaggagctgtaaagagtaagagtcaagaggtgtgaaggccgtgtttggccgtgtggattgaagagcagtttacatgaagagcacgtgtgttgtgatttctttcaaagttggtcttcaggtctctcctgagagtggctgtaagccaagatagccttgaccagggggaagttaggtttgggtctgccagtcaggtgaaatacagtgaggaggtgaaaccaaaatgtgtgaaagagaagacatttattacttacaggtccagagaggttaggggtgctgacgggaggccgaggggaagtttggaagtggcagggagctcacccagggagtgacaggagcgggctggagagagagaaatgtaattcccccacagcgaggggtatttttaactaggccaaaggtgacagagtgctactgtgtttcagataactcatgtcaggcctaaaggtggatgccaaggcagcacctatattaaacaaattcatgacagtgtgggaggtgggtcagcagaggaggaggagtgatggagacactggagaatgccgaggtggcagacacatggcctggccttccaggactctccagtccctagttctagactgttacaaggcccagctgccttggggtttgtatgctaaaccctccctgcacccgtgtcctccccacaaattctctttactgcttatgccagtttgagtccatttctgttacttataaccaaaagaacctctaccaagacacttcccactttacaagtgaggaacagaagagcagagaggctgagtgactgcccagggtccactggtgagtgacagcgctcaagcctcactccagctcttcagaccagttccctgctgtacatgcccttccagttgtcacggcaagctccttagggaagcagacccagggcggttctgaaaccacaaggagaaatcctagttgttactcctctaccactccctctgttgcccaggctggagtgcagtggtgcaacctcagctcactgcaaccttcgcctgccatgctcaagcgatcgtcccacctcagcctcctgaatagctgagactgctgggactacaggcgtgcactaccacgcccagctaatttttttttgtatttttagtagaaatggagtttcaccatgttgcctagtctgggcatcaaccttttaaaacatggtctgtgttctgtcatattaaaagtgccattcacacatcaaatatgcttgcccccttttttctgtaatgctgtcaaatggaatagctcagcctttaccacttgcattattgcctttggatcttgcatctaagagattcttagcagtgtgcactggctgatggccaggatcttcccatgcctccgtgagttctttgcatttatcttccttttgttctagtgatctgacccatatttatatctcaaggacaggtgattttctctgagctgtatgatagggaatgcctgacaacccctgtttagtttctatatttattttaagacatgttttttaaatgagccaattaattggaaaatatttatatggaaaggaaatgttatcactctttccatcatcctaccacaactgccaataacattgtagagaatctttcttctagttttctatttgtcaacttaatttgtaaaaatatattattgtaattatacatattaagaattttgtatttcacttctcttggtaacgtaatagaaagtcttctgtttcaaacattttgtaaatagcatttttttcttttcttgtctttttttttttgagacggagtcttgctctgtagcccagacctggagtgcagtggcgccatcacggctcatggcagcctcaacctcctgcaaagctgggactacagacatgtgccaccacgcccagctgatttttacattttttgtagagacagggtctcactcttgcccaggcgggtctcaaacgtttgggctcaagtgatcctcctgtcttggcctcccaaagtattgggattagaggcatgagccactgcacccagccctaaatatcattcttaatggctgtatccattctagtaagttgaacacaatttacttaagtgtatcataaatccttttgggcacaaatggacaataaataaataaaggaaatgtaagagccatgcctctatttgttagacatttaggttgtttctgattttgtgtgtgtgactataggtaatggtatggtctactcatttgttttttggggtcttttccttatgctagattccataaagtagaacatggataaataggtgtgacttttttttttttttttgacacagtattgctgtgttgcccaggctggagtacaatggcgtgatctcggctcactgcaacctccacctcccaggttcaagcgattctcctgcctcagcacccgagtagctgggactacaggcggtcaccaccatgcccggctaatttttatatttttagtaaagatggggtttcaccatgttgaccaggctggtctcgaactcctgatctcaggtgatccgcccacctcagcctcccaaagtgctgggattccaggcatgagccactgtgcctggccaggtgtggcttttcaaaagggtttttttttttttcttttggctcccaacaggaaactatcaaaggacttttggtacatgccatcatgttgcttttcacacagagtactgatttattccccctaccatggggaccagcagtgtgaggcctgtaagaatctctgccctggcctctgaataagtaatgtgtaagagtaaatacatgtgttctattagggtctttgagatctgttaggagaactactaccaaacaccaatttgtagatcagataacgctcatcagaggacagggaaatgcattttgttctttcatttgataaggttacagtaactgcttgtccccagcctctggaaaaatgttgcttattgcagtactgtagatagttttacataaaatccttccattgtctttgtgtttttttctgatggatgagtaaagactaggtaacagtttgagcaaactgggagtattttattattatcatactttttcaagaaaagggtgggatggagagctagattatcttgactcaaatatttttgtgtattctgtgttttgggaagaggagcctttgtgtttttaggctagggtggtggagaaggtctcacagaagagagacctgatttgggatttcagaagggttaagagagaatgaggacacagcatgaacatactgaagactgggttagaatttatgtggtatgttggttttggctggatcagcaggtatgggctggattgcaagatgttggaaagtcaagccccggaatctggaaaaaatttaatagtccatatggtgtcattcaaaggtgatggggagggagggaatgaaatggtacagccacttaaaaaaaagtttggcagttttaaaattaggttaaatatatacttatcctctttcatagcaaaatgaaaacatatgtccacataagactttactccaatattcttagcagcctttttcgtaatagccaaaggttacgagcaggcgagtggcccgaggagaactgtacctcaggcagaggaatctggcagtgaggcgctaggtgagccaaaatgggaggaaagctggttagaagtttctcgagtcctccgggcatgcaatgaggagggctggagttgtgagagtaataaggaagggctgaggagaaaagttcctacagaggaaaagtccaaagcctggagcctgctggctgcaggtgccaagggagggaaggaagaggcaaatctgagtggcagatggtggtacagagggcaggggtcttcagtgggggaccaggggcacttggtagaagggcagatgttcaggccccacctcagacctgctgaatcagacattttgggggtgggcctggcaatctgtgttttaacaagcccacctggtgattttcatgcctctcaagtttgagagctcctggaatagggaaattggcttaaggcaaggatatgtgatccaagaggaaatctcccacaggctgttagagacaggagagcagctgggctgatgtggatgctgagcttgctcagctggtgcagaccagagtgcaggggcttgccctgagggaggaaacgggtacacagaaaggcagagggctggggccaaacttggggatgtctcagggagattcctttggatgcaagtaacagaagcctgcttcacaccagcttgagcaagcgaggacatttatgggaaggatactggcccagctcctggactgttaagactagagggaccatctgggcctcatgagggcgcagaacccacacagcttctgtgtctgtctgtctctctctcctttcccccttttaattcatttaaccaatatctgtatatctgttgaacatctaacaaggtacctcgtctaggtaccaatggtaagcttaaaaaaaaaaaatgaagacttgactttgcccatagagcctgtctgcctgtctgtcttagcatgaagtgtctctgcttctgtctgtttcaatcttctctctggagacatccgtctctcttctggtgagcatttggccagatgtggccaccccatagctgcttaagtttacagtctttgttttaagtaacctgcagacatctcagccatgattctatattcctggggaaaaaaatctgagagcattttgggcccaactttggtcacatcacctctagctggagacagagtcctgtggtgggtgcccaggggtgggggtgaaggtgggtggtctttataacagagggattgggcagcatagctatgccaaacaggttgtgtttcaggggcattgttttcatccttgatgtaagctggagcagggagatggtctttgtttgcttaacttcttaacaagcactccagcaatgatagcggctttgggaggggaatgcgggtttgtgtctgctaaatgaaaattagaagggaggagcttgtggatgcaaaggattgaagcattgcttttttcttttagggggtaggtagataagctttaaagtccccctcccaccctgagagtctgcgattggaaataaaacaacagagttcgggcagctgaacctgaaggaagggaattgtggtggcatccgtagtctttccccttatccagagtagactcatcttttatctagttactgctgtgacaaatttggatacattcatctttcttcactgtgaaatcgagggcttggttgctaatggttttacagaaattgttcctttgttttgctggaatattgatgagtcctgggagaccataagagcacctgtgcgaatggctcttcacccaccttccttagaggggatcttcaactctctggttcccttcacagcctgggttgtaaactgcttttgtaacctctgtgctgtaccttcaccactcgtacattcattcaatcattcctatttactacatatctaccaagtgtcgcaccctgtgctagtaggtcggcttcatattttcagtcaccagcctagccaccttcctcttcagtttttcctcctcttctcaccctttggatggatgctgtcagatgtgctctgggggtgattcctcccctcagcctagcttctgcctgacccagctgcactgagccatttgtagctgcaaacccaccatgctctctcatgtttctggggtttattcatgctgttctcccctcctgaaatgcctcccctaccctaccttcttccagaacctaccaaatccctgctcacctttcaagatctgctggaacatctcctgcccttagaagttgctgatttggaagtccagccttaggcctggtgtggggctcacacctgtaacactagcactttgggaggccaaggcaggaggatcactttagcccaggagtttgagaccagcctgggaaacatagcaagaccccatctctatacaatttttttttttaattagccaggcagccaggcgtggtggctcatgtctgtaatcacaaaactttgggaggctgaattgggaggatcacttgaggccaggaatttgagaccagcttggccaacatggtgaaaccctgtctctactaaaaatacaaaaaaaattagccaggctggtgatgcaggcctgtagtctgagctgcttaggagcctgaggcacgagaatcacttgaacctgggaggcggagcttgcagtgagccgagatcatgccactgcactccagcctgggcaacagagcgagactctgtccaaaaaaaaaaaaaaaaaaaaaaacaattagccgggcatcgtggtgtactcctgtagtcctagctactcaggaggctgaggtcagaggatcacgtgagcctaggaattcgaaggtacagtgagctaagaaggtgccactgcactgcagcctgggtgacagagcaagaccccatttctaaaaaataaaaatatttttttaaaaagcaattcagcttcagccttcagagcattcattatgggtgtgatgatctgctcgagtggaccgtagctacacttgaactcagtgagatgcaggactgtcccactcatctttgtatcatgacagtacaaaggatctgtcatggatgaagggtcaaatgctactgtggtcaataggatggggaagaaaaggaaaggataaagaagaaaataaaaattactcataattccattacctggagatacattttggaggggtccttaagactttttgaatacaaaaagtttatgattgaagttactgtgtatcttgcatttccacttaacattaatatattaatactttattgcccacaagagtcctaagataagattttagtgaccttttaatgttttatagccaattctttctttattgttggatgtttatatcattttcagctttggacataagaacaccatggaacatatttatgtgttaatctttgtttgcctctgatgatttcttttggatagattcccagaagtgcaattactggatcagaggatagcaacactgttaaggtttgagaaataatgccaaattgtctccccagactgtgccagtctctactctcatcctcagtttttgatggatgggtttgtgaattctttaaagagatagaagcaaaaaaccgaagcaccaatggcttcattggctgttgtttccatttggaggaaacggcagcttttcttgtgataggagccaggttgtagagaaaaacctgtcccattgcagccctagaggctgggaggttggccctcagtgacaagggcccgtgttctcagcctccctgtccttttccaggctggagtctgggacccgggagcctcctgaagagactgcacagctttctggaataggggagggaaggaagctgcttggtgacctttgggcacaagctgcaggcagcactccattagctgcacatccattaatgaggaagtcaagcttcaggaagctgggctggctttataaagcctatggggaattaaaggaaaagggagtgtggatgaagcatttgttgctgtcatggtggggggaggtcatgactgggcattcatctgcatggggcctcctggccagttaatcccagcagcaaatgtgggttttaagaggttagtcatctgcctacagggaattggacctgcctgggaaccaaacttgcagcctcttggacaggtgcatctgttgaagtgttaagtatactctcgcttatttttgctgacttcgacatttatggaattgatgcaacttagaggacactttgaaaaataaagtgagccctaatcaagttgttattttccaactgatcatatgtggtgaggatgctctctcataaatgatattttaaaattgacattacattgtcatttagtaaattttgaaaatgaatgaaagagtttaatataaacatgacgagagataggaaactagtatttctggtattgtcacgctggtctcttgaaaactcttgtttcatttaatcctcaaaataggaattgttgttagttatttttatagatgaggggactgaatcttagagaagttcagtaacttaatcaaagtcataaagctaatacgtggtagaaatgagatgagaatctatgtctgactgcaaagcccatgccctgcccggtatgcagggagttgttttgcccctgaccctggcaggaactggaaggaagaccttgcaagctggctgccattatctgctcctagggaagtgggggctgtatgcccatggaaaagcctgctgtggtttccgctggtgctgtgatcagctctgagaagcacttagagcccgctccaaggagcttcaaagagaatgcggatgaaggagttggacagctcccagcttctctggtctcacatcttcactgtgggtgcttgtatttagttggtgtgatgtgactttttacgcaaacatacacgtttggtggtcacctcattcacatctggatactgcttaattggattcttggctctgacagcttctgaattggatcctcaccttttggtgccagcgcaacctgggtttgtcagtggtacccagaggcgtgaagggctttgtacacagagatgcatgatttttcatcagaggggacttggccagccccagtggatgcaagttcaagatggagagaaggctaaggggacccaagttttagggcatccattgtcagaggttttgagggctgtatctgagtcaagtcctctttaagcttttttggttttggttacatgaaccaagatagataaaaccaactggccttagcatgagccaaaacaacaactctttattgtaaagaggcagggagttgcagctgagtcatgcggccctgggacctggaaggcagttgggaagccttccctgggccctggtctcacttatctgtttctttggccacatctgctcgactctctctgtgtgtctggtactctctctgactctctctcaccctagacttctacttttcatgtgtatatggccaagcacggccatgcacagttgcagtccccactcttgagtttatattcctttagttcaagtatccagcaggaattactcaagtttctcagtaccaatgccaattcctgtgagacagaacctgactgttgagggcctggaagcgttgtgtggtatgaaactggcttctggggcccatcctagtggatgagaggcacagttctcagcgcagaggaaggagggcaggacctgtcgatgggaaatagagagagtggaccgatttggctaaagaggcagaatttggactggaccaaggagtgaaatcccaggtaacaaattttaagtcagtaaaacaaagagctccttagggtggcccaagctggaccagcctgcgtgggatgatagcaagttcctgtatgtgcagaggttcaaacagtccagaacagcattctaaagcagatccaagcatctgctggggtggacaagatggctctcatggtcccccctggccatgtcagtctggccctgggctgctgcctctgctgcagatattttccttggattctccactcacagaaggaagattggagggtattttactggtgtacttgtattagagggccatattcagtctaccagtattttaactactgttgttgctgggtgttggattgtggatgattttgatttttgttttattttttacatattttaaaatttttctacaatcaacatagatgagttgtgcttatgttaacagtaagaagttaaaccatagtttattagtagccaataactactttattagtagccaataaatagtagccaatattaattgctactctagatggtgttgtggcttgtataagatgaacgcagtattgtccttgctcttaaggaacttgtagcctaatgaggaaggtatgatataaccacataatgcaagctggaagaaggctagttaagtgctaatagaacattaccaagtgtgtagaaggcacacatataacccttgttctaaggagctcaggaaaaggttttataaaaagaatagccctggatctaggcatagaacagtggttctcaagcaggggctgttttgctctgagaggacattcggtggtgtctggagatgtttttggttgccacacttggagtggggtcatctaatagttaaagcccagggataatgctgaggacagcccctcacaacaaagaattgtctggccccaaatgtcagtagtgccaaggcttctagtccaatgcattagaagaatgcataggattttggcagacagagttgggggcagagcactgcaggccaagagaatgatgactgagcacagtggcagaaatgcatgagtagacaggaattagcagagggcccaaggagctggtgggacacctgcagctaggtggcagaggcccttgatatcaacataagcagcttggacgtttttctttgggcagtagggaacaatggtatcttttgagctctatcaagaatagagtcagttcttaacatcccagctttgcttcattgattgctcatctgcacagccacaaagatgaaaacacacccgttttcctgtttttctccccagcctatccactctttgttttccaccatccagaggaaagctcggtcagcactctgccttgctgacccaggattcccatctgctggtgacaaagggatacagcaaaaagcgatccccttttgaccattctccttcctgctgcaatttccaggaatgtaccatggcaagggtgactgtccatgactattctgctggccccataacagctttgctctgcgcaccgttgtttgagtgtttactaacatcctcacactatctctggatgcagggtggagggtagagggcccagttcatgctcaaagcgtccacacggtagaaacagcccagcagaggccagggctggacctgggtccgactgcaggcatggggataaacaatgcttgagctgtggaggggagggcaccccagaactcgacacggtgctctcttcatgtgttcactcctgcctcaccagcaatagaacagtgttacacacccatactggtaggcactaggtgaatgttttctgaatgaaagaatgaagagacagatccagggagcgggtgtgatggcctaagattacccagcctgttgggatcagagctgaacctggaaccaggattcctgacccccagttgggagcccatccctgtgccacatctgcccttccatgcccagggacctggtgctatcatcctgggtcctggccaggcacctttagccagcaccctgttctccaaacttctcccattccttgaattccaccattccccaaaccaaccaatccatcaacccagggaaacagcctagcatgcccttccctacctgctgccagtggccacagagctgttaaactactctacactaaaatgttggagactgctagttagttactgtggttatccacttcccccaggatgtctctgacgatgcctcaactcaggcatttcttaatggaccagttggggtgggaagtggggcatgcgaccctatatggtgctgaagtttttgccaaattatactatttatagtaaggccttcttggctcaaacacatctagggaaagggaacagtgtgaacttgtcagttgttttctctttttattttgagagggacccaggctggaccttaggcatcctctgagatcccccagagtcttctgggaagaggcatttccctcacacccagaaccagtgaatgaggaggtaggttgcttttatgattccactgagacagtgacgctcctccccatggcttcagaaaacatccaccttggaaaagtaagtgttctcttcctccctccaacccccggggagaatctctcttgcaggtagtggctgttcttggtctcccagctaggtggcatccctgcatcttttaggtaccagggcttgtaccaactccaccccaggactgggtaaatgactcccatgatggctcctatgtcagcccttccagtggtgggacaccatagtccatggtcctctggtcagagcttcccttgtaggaaaagcatttttgcaagtctgtgcagcatttccattttcaagtatcataacgtatattatcccatttgacaccacattttgcagaggagataaaacaagtgaggcttctgggctcttgtccatgaacccatgtctagtaagtggtatagcaaagaccagcaccaaggtccccaagctccaagctctcctgggtggtccctccttccatggtgcagcttggagtggcttcacagccaggcagaacaggggccacaccctcgtcacaagtgctggccagctctctgggcaggggaagcctctggatgttgagtatggaaggagaccatgtgggtggttggtagcacagtgcctgcctggagtaggccctcagcaaggggctctgggtctgcatgcctgacgtgcacaacgtggcacatgttctggtgggagatgctgagggagggggtagatccacgacatggagggagcaacacggtccctcgctgttttgattgttttcagcagaacccaagttgtgttacaatttgcatgaggcttgttaaatgaactgatgtattagacaatctaattttttttcttttttgagacggagtttcactcttgttgcacaggctggagtgcagtggcgtgatctcatctcactgcaacctccacctccccagttcaagcaattctcttgcctcagcctcctgagtagctgggattacaggtgcctgccatcactcctggctaatttttgtatttttagtaaagacagggttttgccacattggccaggctggtttcaaactcctgacctcaggtgatccgcctgcctcagcctcccaaagtgctgggattacaggcatgagccactatgcccggccttagacaatccaattttaaaccagtcctcatgatgacttaaaagtatttcctcagcaaagccaaggacttgtggtaatacaaatacatgtgatcaaaatattttactaattttgtgcgatcaaagaagttggagcatccatggtttagtacctaagctttgaaatctcacattctagttctggctctgctacaaacttggtgtgtgaccttagtccaactatttaacttctctgatccacatttccagtctgtgaaacggaaattataatcatgtctacttcgtagagtttttgtatgtgcaaatggatataaactgctaaaagctgtgtacagagcgtgcattgtattgtaaccagtgctaattactgaggagtgctatactggtaactttttttccccaaagtgtgaagctttcctttttagtcttgattcctggataataggacattcttcacttggactttcccttatggtcacctatgattgtggccatttgaggctcataaatggaaagaatgtatattgttttcattctgaagcaaataaaacttcttacatttccatgctcagagctacctctttctgttattgtcttggaatttttttctccttagtgacctagttttatctattctcttcagatctgcaaaagcaaatggcacagttgttaaagaggaattctcattctgtggtagttgagagaaatatctttattttctaaacaaagcagctgtgggctgggcgcggtggctcacgcctgtaatcctagcaccttgggaggccaaggcgggcggatcacgaggtcaggagatcgagaccatcctggctaacacggtgaaaccccgtctctactaaaaacacaaaaaattagctgggcgtggtggtgggcgcctgtagtcccagctactcgggaggctgaggcaggtgaattgcttgaatccgggaggcggagcttgcagaggcggagcttgcagtgagtggagatcacaccgaagcactccagcctgggtgacagagcaagactccgtctcaaaacaaaaacaaaacacaaagcagctgtttgttatattttaactttttaactattgtgcagtattccaccatactttttagagcattaccgaggattgcccttcaaagcatcaaacataaaaaattgttatccaaaggaggacctcaccttccttacacagggtctgtattgcacatggtggccagggcccttggagctgtgcagccagcagtggctctcctaagtcatctgcagggcaggtgtgcgagaggtacatacggtgggttcccgccccagtctctctgcttccttcttccccaggttggccaactcgggagcaaggtccagaacttccagccagaagcgcactttagcagctgcgagctgcatttgttccctgattgtcctgactcactcataattaagacacgtgctgaaaattctctcagaatttaaattttgctcattgaagtaaagctgctgttttccagcttgctttttttcttttcttttctttttttttaaaataggttttgtgttctaatcagggtgccatgctggacctgagccaaacatcctttgtttcacacaatccttgttcttctgtgggcaggtgggacatagtcccaccctccccttctagtgaggtaacaaccgtgcttttgttagcagttctgagcccttctgctgccagacaaacccagtggcctggaatcatggtaatttcttatgagccacacaattatttataaccaagccatctcagatcctttctggaacaagttagaaacctatctatctatctatctatctatctatctatctatctatctatctaaaatataaatctcagaaacattttaatagtgtaacttcttaatagaacataatatacagcaatgttttttcctctacaaccagaaccagtaaaaaatatatttacttgcattacttgttaattttcactcatcttaaatgtcattacaatggattgaataaattgagatgtttgaaaattttagtaaattttacaaaatagcattgtcgcatcaaacagatataaattgaaagattatatattctgttttcttataacttttttagaagtaatcttttatggattaaatgaactaatgacctatactaagtaaattctgtttttataaaatttttaactatggatgattttgaacaaatattcatgcagatatttttttggttcctaaatgtcatgaatttattttattttaattgtgataaaagcacatgacataaaatttaccatcttaaccatttttaaatgtacagtcagtagtgtatatttattgcacattgttgtacaaccaatctccagaagcttccatcttgcaaaactgaaaattataactccacacccattatcaactccctatatccccccagcctgtggcaaccaccattctactttctatttttatgagttttacttatctagttaaggagttgagttatctagagtagtccacttataaatgtaatcactcagtatttgcctttttgtgattggcccatttaacttagcataatatactcatagttcatccatcttagcaagtgtcagcgttttcttcctttgaaaggatgaataatattcattatttattcatctgttgatggtcacttggattgcttccatcttttggctattgtgagtaatgctgccatgaacatgggtatgcaaatatctttttgagacataaccattctactctgttaacttggctgattttaacagatggggaaatcagtaactaaacgtataagaccagcctcacttggcagtgtttgttcacatggtgtcataggactataaacagaagcgatgcagcctcagtacagctgagtgagggggctggaaaaacctgaactttcctgtataatttgaattcaaatcttgattttcctgattaaattttctgtataaattcctaataatttgcacacagtgaaattcaccctttttactgtatagttttgtgagctttgacaagtgcatacagtcatgtaatcacaaccacagtgtaaatatagaacaggttcattgcctccaaaacttcctccatgcccctttgtagtcatcatcttcttctaccccactgccagcctctggcagctcatctgttttctatctccgtagttttgcccatcatcatttgtctttccttccatacttagcacacgcagctttgcctgccacctttcttgttctgatacacctggcaccccggccatgttgtgacttccctgaagataaaacctctgactttgaggtatcaagttggattagaagagcagagtttgaagccagatagagcatttgaatccagctcattcagttagcagctctgtgaccttgtgttggcctcagaatctgacacagagtagggactgaataaatgtctgttggatgaacgaacaaacaaatgaatgaatgaatgaatgaatgaatgaatttaacctcttaatgtcccaggtccctcctgtgtaagagggaatggatagtagttgcctcacctgacttctgtggggatcagtgccttgtacagtgcctggtgggcattagtaaaggtttgtcctgttcccatggccttccccagggcttttgataccctctgccagaccgacacatgcactcaaagttggctgggccctggcagaggacatcagtacctgctgtgtgagagcgaggagggcaccagctgagcagacaagtccccagaaaaccccacagatacccgctgaccacctgccagtcaatctcaaagagctcctcactctttccccccacccctttttcatggtgcacataggaaggcccagcagtccttttctcagcctaaatatataccatgtagggggctttagatgaagcccaccagaaggagaaaaccataacccttcagcacagaaccctctggctgggggtcaggtctctggctctgaggtctggggaggggagcataagctgggaaataggcaaccacaggacagtcattgtaagtgaatcttctctcttcttcaaaacagactcagcaggactcatcacaattattgtgatgacaataaccagttatttgtataattatctgcttgctgcctgcctttcctatcagatggcccagggcacacagtaggtgctcagcacatatttaatgattgaatgaaaaacattttgtggttaaaagaattggcatttgcagttactgtttctgtagaagggaggggaactgatatttgtcattcatctagagtgtctctggtaagttaaatttgtacctacagtctcctcatttaatctgcatagtggctgttgaaagtaggtgtttttggtctctgtactcaaggaaactggttcagagtagttaagaagcatgcttgccactccacagctagtcagggttggagctggattcaaactcaggtctgaagtcaaagcccagcctctttctaccacacacaataaagctgggttgcttaagaataggaatctctacaattaagacttaaaaacaaacaaaaacaacagatttaggcagacatttgtggttgagggatttgtgtggattggattgtggagtggaacagtatcaattggaaatttacagaatgtttgttcctgcttgcatcagacttttctgttttgtgctttcctaagttgggtttgggagcataaaaatccaacttaaaatgggatttttgcagcacacattacagacagctttaaataagtaatgcaactgcctcttcatgctaagaaaggcagtatggaacggggaatggccagggacgtggagacaggaggcctgggtttgcgtcttgttggataggagaagggctttggaatatccctcaactactctgaggctcagttttttttatttgtaaactgggaaagtaatcccattgtctcggaggggtacagtgcagatcagatgaggaaataagcaaatgagatgtttgtgaggtgggttacccaaggaagagttgtgtatgtgttcactctctcaaatctgcagagaggagcagggtctgaagccaactgggaaaggaaagactacagagaggctggcagaatcacatgccaaggtgaaaaagaagaacatgtctcgtttctgttttcccaagatcagctcaggtcgggagagaacctcgtttatgtgaacagtttatgtgcttgaaaccctaaaattatactgtcacctgttgtcagtaaatctataattcagggccagagtggaatttcattaggcaacgaagcaggcagcagtcttcctcccactctcctactcctcattcattcattcagagaccagctgcagactctcagccatgtactgcagagtcaggaaggcagtgtgtcatagcagtgaggagatgggcagtggagttagacatgtgtttgactttggcctcctcccctaattgtgagactcaattatttattttcactaaacctgttttctcattattatgaggaaaatgataatacctgtctcacatgaaggttaaaagtgagcactcaaaaataaatggcttataagtcacaataatacagtctttagggaaccaaaatgcatagtgggccagttctgctgttttcctattttctccctccagcctgttagaaagtcactgtgagtaagcagaagcccaggggttgggacccatggcaaccaaagcccaagtggtttgctgtgctatgggaacctgagctgtgtgctcagacggaggatctcttttcccagattaagcttctagagaaccatcgtgagtgacgatgttccctggggcagtatggtaaaggtcagagtttctcaagcacttagatcccaggcccacagcgtatctgagacagtcctttcagggctagaggatcagtgggtcttggagatggattatggttttgggaaggcttgttttgccacacatggaccttctgacatcaggaaggtactgattgtctcagagcttggaggctgatgctcaggtcaacttgatccacttttggagagccacgacacacctcacttgtgagtgtgaattcctctgaatgctttggtttttttaaaggtcaggtgtatagtggtgaaattggtaaaattcactctttttagtgtgggttttaattctgagtttgggcaaacttatacagttgtgtaaacagcactacagtcaggtatgcagcagctccatccctccccaaaattccttcacattcttggagtcaacctcccacctccccatctaaccctggcaacgacttatctggtttttctccctgtaaacttccctttttcagaagagtgtataccagcctggccaacatagtgaatccccgtctccactaaaaatacaaaaatcagctgggcgtggtggtgcacgcctgtaatcccagctactcaggagactgaggcaggaaaatagcttgaacccaggagatggaggttgcagtgagctgagattgtgccgctgcactccagcctgggtgacagagtgagactccatctcaaaaaacaaaaaaagaaagaaagagcatataaatggagtcattaacacatgtcaccctttgagtttgctgctttcactcaccataatgcatttgagactccaaatgcttttgaccacagaaaggttagtggttctgagagcagcctggaaagtcagtagcattcctatataccatgaataaccactcgaaaatctaattttaaaaatccacaatgccaccaaaaaaacccccaaaacctaaagtgcctagcagtaagacaaaacatgtacaagatctttatggagaaatttacaacatataataaaaagacattaaagaagacatgaggaaatggaggccaccatgttcacaaagaggaaacttgaaaccataaagatggtgattcttctagtaaattttatgaatacagtgaaattccaatcaaaatctaaataaggttttatgtgggacttgacaaactatcatgaaatttatatagaaaaacaaagggtcaagaatagccaagattctacattgaaatttctaataaaaaaaaagaatggccaagacaattttaagaatatcaggattcattataaagtcatggttgttaatattatggttattataaagacaccgtggtataggtgcatggttagacagtagatcagtcaaatagagagctgaaaataatacctatgcctattggaaactttatgtatgacgggtagcactgcaaatcagtgggatgggacaattgggatccatatagaaaagaataaaattgaattcctaactcacatcatacataaagatcaattccaaatgaatgaaaatctagtattgaaaaagcaaaagtttaaaactcttgtaagaaaatatacgtgaccaggattttctcaacaagatagaaaaaatctggaaaagactgatatatttgtctatataaaatttaaagctagaaagcaagaaaatgcaccacaaaccaagttaagagagcttatattgaggaaaaacatttgtaatgcatatgtccgagaaaggatttatacccaaaattcacaaagaattcctaaaaatcactaagaacaagataaactaatggagggatataaacagggtagttaagcagcccaaatggccaaaaggcataaaaagttgcttgacttcacctgccactgaggaaatgcaaattgaaacaaacatgggataccattttacacccatacccatcacagtggcaaaaatctaacagtctgactatataagtttggcaagaatggggagtattaaaatcttagacacttgcaggaaggagtataaattggtacagtcattctggcaagtggttttgcattatctggtggaagatgctgtaaattctgacccagcagttccacactatgtagataccctagagaaggtctcaaatgtgcccaaggagacatgtataataatgttcatcacagccctgtttgtaaaggggaaaaataaggaacctaagtatgcatcaacagaataaactataatatgttcatatagtaaagtggtacacagtagttaaaaagaatctaaaaaaactggatgcaggtggcacatacctgtaatcccagctacttggaaggttgaggtgggaaatcagtgaatccaggagttcgggaccagcctgggcaatgtagcgagaccctgtgtcaatacaaataaataattttaggctgggtgctgtggctcacgcctgtaatcctagcatttgggaggccgaggcaggtggatcacctgaggtcaggagttcaagaccagcttggccagcatggtgaaactccatctttactaaaaatacaaatattagccaggcatggtggctcacgcctgtaatcccagctactcaggaggttgaggaaggagaatcccttgaacctgggaggtggaggttgtagtgagctgagattgtgccactgcactccagcctgcacaatgggagcgagactccatctcaaaaaaataataaaaataaaataaataattttaaaaaatgatctagaaagacaagtgtcaacatggattgaatttcaaaaacataagtttgaatgaaaaaacatatcacagtggaatacatctagtgtgattccatttgtagaagatgtaaacaggtataaacactttttttctgtttatgcatggctcatgtagttaataaaaacatagtgagaatgataaacaccaaattcaggatagtggtgagttttggggaggaggaaaaggattgtatcaggaaagtacatataggggatttcaaatatatctgctgtgtgttacagttttctccagattaagaattatagcatatttattggaatgccaaaaggagctgaagaaccaaggagcattcttctgttagacagcgaaaacagtcttggagattaatgctcataaaaagtgataaaaatggatttatatgtttttagaaagtatcttcagaaaacataattcaaaattatatttttattaagaacacaaagcacaaaacatagtgtaaattttaatacattttaatgctcagatgaaacactgtgccttcatgaattggaagactgtgcaaatttattttcttgggtactgtacatcatttttaaaaattatgaaataaggctgggtgcagtggctcatgtctttaattccagcactttgagaagctgaggcgggtggatcacttgaggccaggtgttcaagaccagcctcgacaatgtggagaaaccctggctctactaaaaatacaaaaattagccagatgtggtgatgcacacctgtaatcccagctactcaggaggccgagcaggagaatcacttgaacctgggaggcagaggttgcagtgagcagagatcatgctactgcaccctagcctgggtgacagagtgagactttgtctcaaaaaaaaattatgaaataagatgtgtacagttttatatatatttgtcattataaagcaagtgctcaggtcaagaaacacagcattccagaagcccttgtgtgacatacaatttcttcagtgtgatttgttttttaatggtataaagagctgtataaatacacttgttattcctcttacattttaaaaaattaatcttagaaaaatatattgccagcattgatttttaaatttttagcacaatttgggattgggacatgttggtgcaactctaggatgcctgagaagactgtggaaaatactagtttgtttcatggtttgcagaggacttggctacggtcagcaacagcagtgccacagcttgtagttatgccctaggtcagcaatctctctcttctggccagagctccaggaagttgataagcaacttcagagctgtgttttcgctgacattggccagcaggctacgtatgtggtctttaccatttggggccatcccccactatcagagcatttacagtttttcttgggacactggacattttttgagctcttggggttcaaaaaaatgaaccttggggttcaaaaaatgacccttgatggtctagtgaagagtccatggcccaaagaccaggaaacagcacactagtctagaaactagggtttctcagcagtggcacaattgacattttggaatggatgattctttgttgagaggggctgtcctgtgcatgataggatgtttcgcagcatccctggcctctactcactggctgccagtagcaccctctcagacaaccagagtgtctctagacattgcccagattaccctgggaaacgagatcaccccagtggggaaccactgcatcagagtgtagtattcacacgaggctcatgctcccttctcgatgccacagctgtggaggaggtgggtggggaggcaacctgaatgaagacccctaacttggagcaagaggaggagtgaagggcaaagataagggaaatgctgcaggcagatccatggagcctttacacagagtcggggcttcagggtaacagttaatgacagtggggggaagagagggtgggcgcagagctgtgaggtgcaagctccgttcagagataaccgagagaagtgtgttagtgcagagcctggtctctctggaggatggcactccagccttccatcttccctctgcttgagcccagcttgagcattaaaggagctttagaccctcttatcttaccacattttttctgacttcctagaaagttacgtgagtctagcaagtgggctgagttccttggagacagattgaaattgcttgttactcaacagacatttcaagcacccacttaaagggggaggtgctgtgccaggcacgagggaccctcctgattgcccaggactatatgatctgactagggagacagactcagccagcacaggcagccccgggagaaggcaggctctgttgtcaggctgcctgggttcagatcccagctctgcacctggctgatgtgtctccttgggtaagtaatgatgctaagcctcggtgtcccagtctgtaaaatggggtagtaagaattctttttccctatgtatttgagaggattaattgaaagagtgagtacagcttgtagaacagtgcctggcattagtgaacactcaatgatataataatattattttaaatgttttattattgctgctactacataaggcctgtcacaggcttaaatagtatcaagaaaactgagggggcagtaaccaaaggcttcacagaagaagtggcatttctgagatgggtcttaaaggattagtggcgctttatcaggaaaaacaaaagagttgtgggattgggaaagatcctgtgctaacattcagacagaagaaagagcagccagaaagtcacagattgcaagtgaatgtggcttaatcaggggacagctgctggctctgtgaacccaaggctgagggaggggtgggaagcaaggccagtgaggccggtggagaagggccgtgtaggggtacttggtctgaaggagcagaagtaccaagcccttttggcttgagcctgcttccttcattattccttatttccaaaataggttaagaagaactgaccattttcatcccatttccccttccccagggcagtgagatgctaagtgttactgagcttttagaaaccgaaaagcaaacttgtgtgtagggaccttgtgctataacacaggagccaggcggaggatgctggcaaccagctcactccagaagagtccagctgacctagcacaggccttcctgtcttgccttccctgctctgtgaccattcagagggtgtcacgacccacgggttcacggggatcccatcaatcagctcctgggtagcgctgtacttcccacctgtctctcctctgctgctcacatgctgtcccagggcaggggctggaaaccatcctggcagacatgggtaataaccatggcacctgtgcctgaggagtggtgtatttatttccccccagtccatggcgttgtgcccgaggctttgctgaatcagcctggtgctgtctggcgtccacctcgctaccgagacctcagtcccaaggtcacgagcgttccctggatggtgctggctttggcttccccattctgatacttcacacagtgaacacgtacttactgagcccttcctgctgtgcagggcacaggggtgtgttatgaatgagggacaccatctctggctttgtggaacacagtcttgtgggagagacgcaccctgagctgaccaagtggatacagtggacaagagctaagaaaggggcaggtacaggagctaaaaacggagaggagcccaatcgtcagggggggtgaccaggtcaggaaaggcctccccgaggaagtgaggctcctggatacctgagaatgcttaggagggggcaggcaaggaggcagtgtggaggagtgtggggaccttcctcaccaagggggcgatgaccaaacccagcaggcttccccagccacctcccccttggcctgcctgctgtctttggcactaccctctcttaaatgtttccccctcacccccaggcctactttttccccttccttccactactctctcatccccccagtggctcatcctgctcttcacacaggtcatttcagccttcctggagggtgggctgctccccaaggtagtgcacagtgatcgcaagaagccaggcttggaggaggctggcctggctgggctccagcacctgccttacccttcactggtcatgaggccttagacaagtaagtgactggctgctccgtgcattggagtcctgtctgtaaaaggggttcccttggacaaggcagtctaagtgggataaagctctaaagcacttcgcacaaggtatgtgtgagtcaagagttaacagccctctccctttcagtgccagaaacggacttggttcagttaactttgttttccctggaaacctgatgattgtggaatgtcagggtgttccctggcaacagtgctcatggtaaagctgacccctgcttggtaaattgcttctggactaggagttctctcaatacccagtgaactacagctttgggtttcttcagtgtggtgtcttctgtaactaggctggctctttgcagggactctgaaagctccgtctgtggggttgtcacaggagatgtcagctcatatagtacctgggccaggcccactcctgcacctagtcagcttggccttaagttggcacctggggtgacctcatctgtcaggtgaaaagattaaacctccagctcgattcatttatttaaaaatacctgttgagggcctactatggggtaggttctgggaacacagtgttgagcaaaacagatccattatctgccctcaaggcacttacagtgctgtggaaagagggctgtcaatcaaaacattacacaaacaacaataaaagaacaccctgataataggtacactgtgctatgagtgtagtggggaggtttgagctagttagggaggccagggaagaagtcatattggagctgggatatgatggatgaacaggcattaaccagataaagaagggggaaggaagactccagaaggagagaacagcacaggcaaaggctttctgggtgggggatagtgcatggtggagagaatgagggcaggtggaactctgccgttcaggtcctgagaggcagggctgagcacaagatcatttagtgacccaacgcagccctgagcatagatcagtgagagctgctgcccaaacagtgtcacattgctggtatttttgcttcttcatcttaagagcaatgagaaacaggctaatgcaagatgggatgtattggtgggaggagggcttggcctgattggatttacaatatgaaatgtgaagagtttattctagctgcaggatgctgagatcaagtccaaggggagtgaaatttgaggggaaaggttttgatggagaaagaagcctgaggtgtttgcaggcttaacagagcttcagaggggggttagcagcaggagaggaaaggcagcctttaatttcaggggtcttggtgccttcacatccccatttttggcttccatgacccccaaccacccttccatgttgccagaccacaggttgaagggaggtgggtgtgggctttaacagaagatagaggtgcccaaggatgccccagccacgagcagaacaccttcagggcattcataaaaataaatcaagccccacagcagcactttctgtagcttagagagttgctcttggcattgaagacagacattttccattaaataagataaatgaaaaatcgtatttatttttgtctctcttccctccaggcttatatttggcaccctttaccctgcgtattattcctacaaggctgtgaaatcaaaggacattaaggaatatgtaagtagcactgtgtattttcgagcgggttggctggagtcaggtcaggtgtgaaatgttgggagaaggggatgccctccgtgctatgggcactggaagcagggaaaaggagttccttcatcacagttctcatgagacatctcaggagtcctcttttctgtctagaccttcccctgcctagacctagagcgttgaggtgagaaaagcagggagatacggcaagaggctgtggcatctggaattggaggtttctcagctgtgccacaagccacaggtgacttcacctctctcagccttgatttatttgtctggaaaacactctgtagaccttaaagcaccgtgatggagaaaaagtccagcatcgcaggcaggagcacaggttttagagtctggcagacctgggtttggttcctggttctgcagctctgcccccattccatttctttcattccaaatccacaattcaggctgtgttgctctataaccttctgaaggcagaggatttttatcatcctatatctgttttcatagttttgttttttgagccggagtctcactctgttgcctgggctggagagcagtggcacaacctcggctcactgcaacctccgcctcccgggttcaagagattctccagcctcagcctcccaagtagcttggattacaggtgtgtgccaccacgcccagctaatttttgtgtttttagtagggacagggtttcgtcatgttggccaggctggtctcgaactcctgacctcgtgatctgcctgcctcggcctcccaaaaagcggggattataggcgtgccacagtgcccggcccctatatctgtttcctgtagcacattgcagaaggtgagcacataggaaggggatctgggaggacttactggtcagaggataatctcaattactgttggatgatctgggtgccctagtcaccagttctgaatgtgttgggcaccttcaggcaggagaaccattagaccaccgctgactgagaaagacctgctgggtgggtggtgagggaagggtgtccttccccacacaggacacaaactcaaaatgcaaaaggtgtggattttggcatcagaagaccgaggttggtcaagtcctggctctgacatttgaatgatgcagtgctggtctaagtagcttaaacttccgagagcctaagtgtcctcatctgaacagtggggtgggtaatagccatgcctttgcctcttttactcagatgtctcttggcaggtttggcgaaggtaaagaaacaattcaaggtgggcttagaaagtcagtattttttttctcagatttcccaagaagtctttatgatgaaaccaaccatctctagatcaactgcaaccagaactcaccccccaccccaccccgcaatctcccactttcccagaacaacttgcctgggcttgcaccttgctgttcgtaagcagggagttccagaggggagcgatttttcttctggagactgggtctgtggtatatgtgagggaatctcagaatgcacgctataaatagctgttaaattgcaagcacagaacctcctgattctcaattgacttggcacagggcaaagcattaagcagcttctcctagccctccctctcccaaccctttcccgcctgcaatctgtgccagagaaggaggccttaccaggatcactgtggtataaggtctaatccttcactttgcaggggcgaaaacaactctgtcagctcttctgagagagatcaaaccctggtaaattgttttgctctgactaaactcacagaagcctggtttatgactagaatggcaattcattaatttagagtgaaaaccataattgatgagcagagcagctgtttgtgttggctgctgagcacatgcttttcccagtagggaacgtgcaagagtttagattaggtttcttggtaaaaaaggaatctgaagaaacaagccgagtagtatcaggagggaactgcctttctctgcactcacactcctgtgtttccttcctgcagtcctttcgactaatgcgcccattttgttcaagagagaaacctgcgagtttccttaacacacccacacccacgccccacccagttggtgaccatgtcccttcatccctgtcgcctgaataatcttccaaaccaggtctgtcgtccttctctgctgccactctcagaaatgagattctcactattttccctagaaggttacagtagcctcctatattagttttttattgtcaccattacaaattaccgtgaacttagtggcttaaaacacctgtgtactattttataattctgaaggtcagaagtccaatgagtcccacttggttaaaatcaagcagggctgtgctccgtttagtggctccaggggagaggctgtgtccttgccttttccagttcctagaggccattcctggattcttaggcttgtgcccctttctcttcctccttcagagccagcaacattgcatctctctggctgttcttccataaccatatctccctcaggctcactgggaaaggttctccactttaaggattcatgtgattacatggggcccacctgggtcatccaggatactcttcccatctgaaggtccttaatttaataatgctacacagtcccatttgccatatggggattaggacatggacatctttggggagccattgttgtgcctatcacacctcctaactggttctcctgcctcctgtccctgctttcccactctgttgccacatgacatccagtgccatttaaaaatgaaagtctatttatttcactcccctgggtcatttaatggctgcttatcacctgcaagatcaagcacaaacttcattacagcatttaacacccttctcaatcttgctcttccctacttcccagtcgcttctctacacgtcttcagcgctgtaatctcaacacccaaggtgtggttggtggccagcattatctgcatcacctgggaacttgcttgaattgaagactcaggcttgtctttctgtggaaggcacagaaacggttatcatgaaggagtttttgacacacattcccctagaagtaggaggcatggcatgccatgtagggccacacaggggaaccaccagggctggtcaggaagcagagggagctctcctaaataaaaatgggcatttttcacaggatctccaatttagaaacattgctcaagacatttatagctgcttatgtctttccaaccaaacttactgtacctggattcaaggttttgggatgaaaacttaaacagaaaggaatttacgggaatttatagaattaactaggtagcaggagaaagatacccaggaactggggaggatccaaggaggctgggtggtgctgacggcccagctcacaccataggaaagtgtgtgattaggaagcctctgccaaagtcacatcttgggcactggctgcttgtgcttttgaggcatcccctgacagtgcacagtcctggataggggcccaaataacaggactttcctcccacaaagatgctcatgttgggagatgtctcccaattttagaaggctttggatgctgagtagtcatggaaaaaaaataaccaatacagctgcctcttaggctaccccaaactacatccacatccattcctttacccacatttcggcttaaaaacaagcttccaacaagaattctatacaactcactcacttgtcaaatccagattccgtaagttgctgagtccagctccaggcccagtatccctgggcaaagtcttctcctcctctggttctgacaagacccaaccttaatattcagcattccgaacactgaattgttaagtgaacggtcaccaatgcagctcacatactattttagtggggagagaaagaattaaaatataattacttaaaatattaaaatctatacttagaaaggaggaaaatatggatagaagatacagtccatattcatgcaactggtcatgagttcatagctgtatttgtgtcttttgttaaaagaaaaaagtttttagagggtggaatcatgactcttgtatgaatataaaatgaacacatgttgaagattttgcttaacttatgaactaatgagggaaccagtaaggtgttcaaaggagaccccaaataacagacatatgtaggcaatcagaaatgttgaaatggatttgttaataaatattaaactgattacttggagggtgggatggggagatcagttgtatctctgctggacaaaatttatttgcacctctgtgggtgaaactatatgcattgcaatcagttttaacttataaagttgtaaaatagctcaaagacattgaaaagcaggacacctgcagaatcaagataattcagaaggacatgctggacacctagcattccacaggatacccattctgaagtctttctcaggttttcctgaggctttcctcttccgccatccaattcatgctcccgttgctttcagctagagctttagtgggatttgttcctcatcctgtgatggggcccaaatctttattcctgaggaatctgaggtcttggcagttttgcctctgtagggctgtagtaatgacccattgactttttttttttttttttgatacagagtctcgctctatcacccaggctggagtgcagtggcacgatctcggctcactgcaacctctgcctcctgggttcaagtgattctcctgcctcagcctccccagtagcaggaattacaggcatgcagcaccatgcctggctaatttttgcatttttgtagagatgggggtttcaccatgttggccaggctggtcttgaactcctgacctcaggcaatccacacaccttggcctgctaaagtgctgggattacaggtgtgagccaccacgccaagcaacccattgacttttacccctgaacaagacagtactaggaggcccccccaaggctgtttgacttccatctgctcttctttctgcctcattgtgtagcagcagtcctggttccccttgataattaggatcagttagcacctcaaagcccataagcccctttatcatctatttcctactggcgtgagtatcgtgaagccaccaggagacaatataagtctctgcttccacttcattgaaaccattttgtatcccctgttggaagcatccatccctcaagtaccaaagtcattaagaagcagagatcagaggtctgaggatgagaagcaaaaatgttgtgagtgcgttagagcagtgattctcaaactttaacatgcatatgaatgaacaggggatctccttaaaagcagattatgatccagtaggtctgggatggggtctgagattctgcatttctaacaggctcccagatgatgccaacagtgctggtccacggacctcactttgattgcaaggagctggcatcaggcttaatcatagattaaggaaccctcatttccttggttcctgcacctttagattctggctaagaagcaccaccatatgttggtcactggttcagaggagaaactgcaccctccaggactgcacaccaatctcataaaatgctgactcccaccttggttgctttcggaaccctccaatgccaggtagcactgtataaggccagccaccgcagggcattgggtgcataagatcaatgactccccaaagcatcagcctattgccttatttcttttgctataaaggagggtccttgatgagaagcagtattgtgtgggatgcatcaaaaggaaaagggtaatccctgagtccacagcttgctgtgtggctgccagaagcagagcagtaggaaaagcaagtccacatgcagaaaaaatgaatattccagaaaagaccctatgccgcccactccatgagggaaggggcctggtggaatgaacctgcttccagaaggctggctggtgccttgtgatatggtatcagcctggagatgcttggtcattgctgctggcaacatggtctctgagcagtggttgtggccaggtcagccttggtgagagggattccacattgctgagcctgtatgctacctctgtcacttccacttggctgtttggtacatgagcccattgaacatgcactatcaagcctgaggaaggaggctggccgacatccacagacctggccatctcatgcacttggtcactaggagcctcctctgctgtgggacctgttggtgagcataagcgttgggccaacaatgtattcattctctgggcccattcacctcattcccagaccacctcaacaggagtctctcagcctcacttcttccaagaacctcatcctctagacagagctttagctggtgtttgaaaatgtgcccgggatttgttttactcagggatggaaagtcacaaagacgtggaaatgactgtcatgaaggaagaagtctagaagtaggagagtcacatgctttgtagggccacatggggaagcaccaggccagtcaggaggctgacggagagtgggaaacgtgggcagtggccttcattgtggtttctgtgagaaaggtaaggcaagacagggtaaacagatttcagattggctaggtggaatcatttcagcaggctccaaggtgtgggcgctgcctctagttgtctgggacctggctctggggtggttatggttggggaatattgcccaacctgtgggagctccataaaggaagtaatttagagtatagactctggattggttagtttgcatatgaaaggtgtgctggggcaaggctagccctggaagggcagtccctctgtaatcattgaggccccagatgccagagcatcaagaatatagaaaataagaaaatggagttcatatacccggtgacagtgcgtgaacattaacttagggcatttctccctccaggctaagtgccctgctcaaagtcctgcctgcaggggaatttcactttcccgctctcctagggtcacccctgactatatagccatccacggtgagcagatggtgcagagtcatctgtaaagcaggcttgaattttttctttctgtcatatggcacagggaattccctgtgaggctgaagcgcagggcccagatgcaagagggtgtgaaaggcttgagaaattgaatgtgcctggttagagcagagtccaaaggtgaggtgaggctaaagaagtagctaagcctgctcctctgcagcccatagggaggcctttggcaggctgccagaagctctggcagtggggtagaatggaccagggaatttcagccagctgctgtggctcatggaaagtctccaggccgcttcctaccctgagctctggagcttcttgctgtggctgagggtcacagcatctttcccatctcttcactcctagatcctgctcctgaccagtttagagagactccccagtcatactgtcaacgttccatttgtccaggagagttactcctgaatattacctctcaaattggccatagctccctctctctattctgactgaaggcccacccaggctcctcatccctatcttgcagggaggtttggatagaatctttcaaacatggaaaattatatttcaaaccttggggaaaataactgtcatttgatttccacgaggaatgatggggaagaccatttcctagtaattttagatggctatggtttccatctctgagtcaccagtgttccgttgaccttgttagcctcaatgagtcattctcagatccttctttctgcatgaaagtatttcaaaggagtgcatcatgggaacttcttcaggagaatgcattaagtcccctctctgccatggctgcagcatctctgtccatagcctcaacctccttcctgagctttggtcttgcttttctaggaatccgttgggcaatcttcttggctgccctgagccacataaagctcaaactcttctgcctaaattggctctttctttactttcttgttggtgcaagtggccccataattatcagtctctgatgtcctgacttcaacaggtgcctttcttcctatgtttatgcagtcatcaactcagtaggcactcatagggagcatctgttgcctcacaagttgtctaattctgtcttttcttctcaaaaagccatctagacagtatttctcaaagtatactctttcttaaccttttgaaaccattctttctgtcccattcacagtgccagcattctaatccggtcatttgaaacatactcattcagtacctattatatgtcaggaattgttttgggtactagagatataaagatgtataaggagaactggtctccaccctcagggagcttacaatgtattaggaaaagcaggggaataaacaggtactttcaaagcagtgtgataaatgttatgacagggaatgtgtgtggtactgtaaagaaagacaaggagagggtatttacccaaacttcgggtatgtcctagaggaggtcacgtttttgctgagatctgagggctgaaatcagacgcaaaaaaagatgctttgttgagaactgaaagactcatatggttggagtggaaaatgtgagagggtaggggtgtggatgagcttttgatgaaaataattaggggccagtttgcgggtgtggtggatcaagcctgtaatcccagcactttgggagactgaggcaggtggattgcttgagctcaagagttcaaggccagcctgggcaacatggtgagaccctgtctctacaaaaaatacaaaaaaactggccagccttggtggcatgcacctatagtcccagctactcaagacgctgagtgggagaatcacttgagcccagcaggtcgagactgcagtgagctgtgtttgcaccacagcacttcagcttggatgacaagcgagaccctgtccccctcaaaaaaaaaaaaaaaaaggtaggggccagttcatgctaggcctcataagccaatgtaaggaatttgggctttatcttaacaacagtaaggaactattgaaggctataaactaggaaagaaagtcacccgctttaggtttaagaatttttttttttttttgagacagggtcttgttctgttgccaaggctggagtacagtggtataatcacagagctgtgattatacacagcactgcagccttgacctccccaggttcaggtgatccttctgccttagccaccctggtagctgtgactacaggtgtgcatcaccatgcccagctaatttttgtgtttttttatagagacggggtttcaccgcatttcccaggctggtctcaaactcctgggctcaagtgatccacctgcctcagcctcccaaagtgcggggattactggcatgagccaccatgactggccttaagaaaatcattttggctggaatttggaggatggattgtgaaggggacagaggtgtaaagaccagcataaagttgtaactattctaaacaggagatggtggtgttctgaagtaaggaaatggcagaggagaatggagaaaataagacaggttcaagaaaaatacaagagggtggaagtgacagaacttggggattggttacctgtgttaggtgaggaatgtacagttttccctagggacagtgtctagtctagagttagaagcagatgtctagaacagagctctagggaggaaatgaagacactgagaagaagtggcaagaaaagcaattgggaaaccaggacaattgtagtgttgggagagcttttcagtatgtgattgtttcactactagccaaaaagtcaagcaagccaagtaaaaactgaaaagaggtttcttacacttccttgaagtatgttacaaagtggaggccccagtgagagcaattttgatgtaatggatgcactgcagtgagcaagtgaggaatgagaaagtagatcttgcaagtatagatgactcactggagaagtttgtagctaagggttgcatcaaggaaagggatttttaaaaaattttctgagatggagtttcactcttgttgcccaggctggagtgcagtggcgtgctcttggctcactgtaacctccacttcccggattcaagcaattctcctgcctcagcctcctgagtagctaggattacaagtgcgtacaccacacctggctattttttgtatttttagcagagacggggtttcaccatgttggtcaggctagtctcaaactcctgacctcaggtgatctgcccgccccagcctcccaaagtgctggcgttacaggcgtgacccaccacgcctggccaaggagagggatttttaaaattgttatcattgtccttttgctctaattgaagacccaaaacatgaattgactactaaaaagaaaaaacctataaagaaggaattcaggctcctgacaatgtgtctggatactgatgttgagaattcccagatcctgagccccagcaggctatagactttaccactggacaaaacctcatttgccccctgctaaggagtcagtgctgctacagacaacctggcagtgtgcagtgtctcagacagtagttatttgatggactaaacctaccttgtttttctgatagagaagatctgtaagtaatccattgagaaacatgttttagagtcacaaagacaacatggattcaccagaacagctttcattttttgaaagatatttttgctgggtatagaattctaggttgacattttttttccttttagcactttaaagatgttattccattttctctgatagtcattttttccaatgaaaagtcagctatcattcttattctcattctcttgtgtgtaatgtatctttgcatcctctctgcttttaagattttctgtatggtaatgatttttctttttttctcttcttttctttctttttttttttttaagcagttttactatgacttgcctaggtatggttttctttttctttgtatttatcttgcttgggattcactgagcttcctggttctttgggtttgttggtttgtttatttgtttatttttttgtttgagacagaatcttgctctgttgcccaggctggagtgcagtggcatgatctcagctcactgtaacctttgcctcccgggttcaagcaattcttgtgcctcagcctcccaagtaactgggactacaggcactcaccaccatgcccagctaattattatatttttagtagagacagggtattgccaagttgcccaggctggtctagaactcctggcctcaagcgatccacctgcctcagcctcccaaagtgttcccatcacacctgatcagggtttgttattttttttttaatcaaattttagaactttgtagccagtattcttcaagtgtttttttttgttctccattctcatgtttctttccttctggaattcctattacatgtatgttagactgcctgatgcagtccaacacatattgagcctctcagtgttgttttccaatctaggctttagtctgcatggctttagtctggatttgtcttcaaatacacagatcttttcttttgttgtatccaatatgctgttaattctgtcatactgtttcatttcagatattgtgcttttgaattctaggatatcatttgtttcttttttaagagtttccttctttctcttgaaatcccccatctctccactcattgtattcacattttcttttagattctttaacatatttatactttttaaagaaaaatatggctgggcacggtggctcacacctgtaatcccagcactttggaaggccaagtgggtggatcacctgaggtcagcagtttgagaccagcctgaccaacatggagaaaccctgtctctactaaaaatacaaaattagccaggcgtggtggcgcatgcctgtagtcccagctactcgggaggctgaggcaggagaatcacttgagcctgggaggaggaggttacggagaactgagatcgtgccattgcactccagcctgggcaacaagagcaaaactccatctcaacaaacaaacaaacaaacaaacaaacaaacaaacaaacaaaagaaaaatgatactgaacgcatccttttcctcctaggataagtatcttgttatgtggtgacaaaacaaaagtttagttttcataataaaagttttgttaataagttgctgtatatctgtatatcttctttgtggagtgtctgttcagatcttttgcccattttttaattgggttgtttgttttcttattgttgagttttaagagttctttgtatatgttgaatacaagtcctgtatcagatatatatcttgcaaaatattttctcccaatctgtgggagaaaattgagttgtttgttttcttattgttgagttttaagagttttttttttatattttaaatataagtgctttatcagatatgtgttttataaatattttctcccagtctccttgttctctaaatgttacctgtgcagagcggaagtttttaattttattattattttttcctgaccacctattaccatcatgtcctgcactagtgtttcaggtttatttttaaatgtcctttgctgggaggaaggggccattcagttggttgggagcttagaattttatttttggcttataatccagtatgtagatggtttgctggtagcctaagaatcaaaagagcaatgcaaaattgatactttggcttagttagaattcctcacccacagggacttcagacctcactggacaaattgtaatttgtcaaaccgaagtaaaatatttaggacatttgtcactgaatgccataaagtgttataatctaggagttagctaattttgcagatgaaatggcaacaacaaatataacttagacaatttgggggactagtaggatattttccacagtggagttcagggtcaaaggcaaaattacaacaaatttagtttaaatacctcagttgactttattatgagcctagaattgggcaacacttcattctataaaatagaacaagtgttctaacaagctgagctgaagggattggctttatagacagaagggatgaagaaaaaaggttttgaattttaatgaagtccaacttaacgatttttttctttcatagatcataccattgatgttgtatccaaaaactcagtgccaaagcccgaggtctttagattttcttatatgttgtcttctagaagttttttagtcttgtgctttgcatttagacctatgatccattttgagttaatctttgtgaaagatgtaaggtcagtgcctagatccatttttcattgttgttattgcatgtgaatgtccagttttcccagcatcatttgttaaaaagaccatcttttctctactgaattgcttttgctcctttgtcaaggatcaaatcactatacttgcgtgggtctatttctgggatctgtgttctgttccatttatctatttgtttatttttttaccagttgcacatggtcttgattattttagctttacattaagttttgaaatctgatagctttagtctttcaatgttgttcttcttttgtattatattaattgttctggtcttttacctttccatataaactttataatcggtttgttgatatccataagaaacttgctgggattgtgattggggttgcattgaatctatagatcaagttgggaagagctgacatcttgacaatattgagttctcctatatatgaacatgaaatatttctccatttatttagatctttgatttctatcatttgtatagtttcctttatatagactttttacatatcctgtttgatacatttctaagttattcatttttagatggtactaacataagtagcatttgtgttttaatttcaagttccagttattatgtaggaaagcaatggacttttatacattaaccttgtatcctgcaaccttgctctaatcatttattaatcccaggaggatttttttggtgagttccttgggattttctacgtagacagttacaccatctatgaggaaaaatggttttatctctttcttcccagtctgtatatgttttctgtttcttgtcttattgcattatctaggacttccattatgatataggagtgatggaagagaataactttgccctttttctgatcttaggaggaaatcatctattttctcaccagtaagtctaatgttagctgtagggttttaaaaaaaatatgttctttatcaagttgaggagcttcccttctatttctactttgctaaggttttttttttttaagtcacaaatgagtgttggatttttttcattactgattcagtttcttaaatagactatgggccctttgcacgtttttaactgggttatgtacccttttattgttgagttataagagttttttatatatttagatataagtaccttatcagatgaatgatgtgcaaatattttctaccattttgtgggttgtgtttttactttctcgatggtgtcctttgaagcaaaacagtttttaattttgatgaagtctaatttgtcttctttttgaggtaggatcttgctctgttgccctggctgaagggcagtgacatgatcatagcttactgcagccttgaactcctgggctcaagccatcctcctgcctcagcctcccaaatagctagctaggactacaggtgtgtgacaccatgcctggctactttttgagttttttagtggagacagtgtgtattagtctgttttcacactgctataaagaacttccctgagactgggtaatttataaatgaggtttaattgactcacagttctgcatggctagggaggcctcagggaacttacaatcatggtggaacgtgaaggggaagcaggcaccttcttcacaaggtggcaggacagagagagacagcaaaggaaactacctgttataaaaccatcagatcttgtgagaactcactcaccatcatgagaaccacatgggggaaaccgcccccatgaaccaatcacctcccaccaagtccctcctctgacatgtggggattaaaattggattacaatttgagaagagatttaagtggggacacaaccacacatccaaaccatatcatgggctctcactatgttgccctggctgatctcaaattcctggcctcaagcaattctctcatcttggcctcccagtaaattttttagtttggttgtttttttttgttttttttttcccctgagacagagtcttgctctgtcacccaggctggagtgcagtagcccaatctcagctcactgcaacctcttccccctgggttcatgccattctcctacctcagcctcctgagtagctgggactacaggtgcccaccaccatgcccggctaattttttgcatttttagtggagacggggtttcatcgtgttagccaggatggtctcgatctcctgacctcgtgatccacccacctcggcctcccaaagtgctgggattacaggcgtgagccaccacgcctggccttttagtttgtttttttgtgtgtgtgcttttggtagtatatctttatttatttatttatttattttattttttttatttttatttttatttttattttttgagatggagtctcgctctgtcgcccaggccggactgcggactgcagtggcgcaatctcggctcactgcaagctccgcttcccgggttcacgccattctcctgcctcagcctcccgagtagctgggactacaggcgccggccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcccttttggtagtacatctaagaaagcattgcctgatccaaggtcagaaatatttaattatatgtttttcttgtaagtgttttatagttttaactcttacatttaggactctgatccatttgaagttaatttttgtatatggtatgaagttgttcaactttattattttacatgtggatatctagttaactcaaaacgtattgataccttttaaagcccttgtctgctaattctaatatcgaagtcatctgtggatctgtttctattgaccaatttttctcctaaccatggattatattttcctattccctcacgtgtagtattttattgtatacagaaccttgtgtgtgattcattgtggaaaccacagatattttatacatttttcttatttttttgtgtttatagctttagggggtacaagtgcaggtttgttacgtggatatattacatagtgatgaagtctgggcttttagtgtaaccatcacccaagtagtctaaattgtacccattcggtagtttctcatccctcatcccctcctaccttcccaccttttcaagtctccaaagtctattattccactctctatgtccatgtgtacacattatttagctcctatttataagtgagaacatgcagtatttggctttctgtttctgagttattctacttatgataatggactccagttccatctatattgctgcaaaagacatgattttttattatggttgggtagtattccattgtgcatatatatatatgtatgtatatacaccccattttctttattcagtcatccattgatagacttaggttgtagatttttttttgccttcttgtgaagaatgttgagtgttgttctagcaggcagttaaattcaggcagatcaccttgaccctgtggcagctagatacgttttgtttgggcaggtatatttaaattttgctcttagtcatagagttaatctcttagtgttaggatgtaatttttattgctaagatgtggtcttccaggtgtttcactggaaattccaaatgcttaccaaacccctctaactttgcatgacttgaattccaaactttgtttccccaacagtgggcagaagctaaatctctgctcaactctgagcttttcagctttccagctgtttatatctacatttatatctatatgtatttatatctatattattatacagacttcttcgcttggagtcttacctgcttctgtgcatttcagggacctgccaagtttttgaagagaatttatatgtagatttttggggtgcccctttatggcttccctaattctgagatttttctctgtccacttccagcatctctggcagtctcaaactgcattctccttttctttggacaaataagactctggatttgagattgagttctctctgccccatgatgtgcagagtgaggactgtcctcagccgcactgacttgtactaacccagtgtggttcccgtgctccaaagcttgaaccccttccagtctctgtctgctttttatattgctctccagggccttcaaacagttgttttgaaatattttgtttggtgtttattatcattattagtaggagccttagttcaatataagctacctcacttttgccagaagccagaaggagtagactaaggaatctggacttgattctgcaggctgggatattttaaatggggtgatagtctgatgagtttatacttttgggagaatagtacaggggtggcttggtattaggatgggttgctgaggggaaagtcaggaaacaagggaagtaggagtagttcaagagagaggggacaaaggccttaggggagaaaggcagtagaaattgaaaaggatggtcacatgggagagataaaaggaagatcagaattcctagattactaccatgccatcccagagagtgtggcccagttacacttcattccagggtgtgtttgtgtagaggcctagagcattttctcccctgatgttctgaaaaatgacctgattgaatcctgggtcactcttggtccgcaggtctccccggctcactttagggccatatgaccttcagcctgagtcagttgtggaacagcccatttgcttccagcttcaagatctggagcagaactggacataagctggggaaggatagggagaaggctacaaatgcaggctgcaccacctggacgtgcctccgtatctgccgccggggcctgttcttcctggtgttgggcagtgtttttcctggaccttttctaccagctgtgttgctttctgtttcaacaggtcaaatggatgatgtactggattatatttgcacttttcaccacagcagagacattcacagacatcttcctttgttggtaagtactccaggagttgggatgtttctaaggacaattttgcttagtgtcactcagggggaggtgggaaagggctgaacccagcctcaaacctcacctcaggccagagacgcaagagcagggatgttaactggagcatttttaatagattagtccacaaagttgttcttcaagtaaatatttattgaatgaccttataaagagcagttattattctaagccctggggatatagtcatggacaggacagatacacatcctcaattaatggagttggtaaagaagcattcgtacgttaaaaaagtaaaggaacaaaagaaacaatgcacaaaaatgcacaggaaaaactgagtttccttctcactcaattcatggtcaacataatcactactcacagttgtgtatcctcttaaaaaactaatatatggcctaggtgtggtggctcatgcctgtaatcccagcactttgggaggccgaggtgggtggatcacctgaggtcaggattttgagaccagcctggctaacatggcgaaaccccatctctgctaaaaaaaaatacaaaaaaataattagccgggcatggtggtgcacacctgtagtcccagctacttgggaggctgaggcaggagaatcacttgaacccaggaggtggaggttgcagtaagccaagatcgcatcattgcactccagcctgggtgacagagcaagactgtgtctcaaaacaaacaaacaaacaaacaaaaactaatatatgtgtgtgtgtatacacacattttacacacacttcttttttttaaaagcagtattatagtatacatgagagttctcactttgcttattaaatttattttggaaatacttttatatgagcataaatacatctacctaatttttaatggctacataatatttcatggcatagatggagcataatttatttgtcatccccttttgatgggcatttaagttgatacccatatttttctcttatcagcaatgcagctatttccagcaatgaagcaattaaaaaacaagctagatctttgtattgctgtattgtgccttcttaggcgaaagaagctgtaaataatatatcgatttctgtttgtatttaaagagttgagtgtgtgcacatgtgaatgtgtattaaaagtagtgtggaaaatatagttaacgagggttatttctacgacttgggatcatggggttggttttgcatttgctgtgttgtacgaatgttttaaccatggtgaagtgtgatcagagaaagtaatcaagatatttccactttggagaaaacaggttcttacccaaaaaggatcagtatgaaattaccctctgggacgtcctaggccaaggaatagacctgaatagcactctctgaatcctgttttgagtcaatggccttaattatcttagcatgtacttttccccacaacatagctttcacctccactgagagaagtagatgtcccagccattgtagcctcaagctgtagtgaaggagtatggatttcctaattcaatatgcttgtgccttcgcaccctgcactgtgcacaggtagtgcagcagactctggatgaagctgagtctccttaagtgggacagagctctctgctgagccatcccttgtctccccgagaccttgaggctggccctggaagtcaggccattttgtacagagctgcatcaggaaatgaaggggtgggttgcctctccacacctgtgggtgtttctcgttaggtggaacgagagacttggaaaagaaaaagacacagagacaaagtatagagaaaaaaatagggggacccagggaaccagcgttcggcatatggaggatcccgccagcttctgagttcccttagtatttattgatcattcgtgggtgtttctccgagagggggatgtgtcagggtcgcaagacaatagtggggagagggtcagcagacaaacacgtgaacaaaggtctttgcatcatagacaaggtagagaatcaagtgctgtgcttttagatatgcatacacataaacatctcaatgctttacaaagcagtattgctgcccgcatgtcccacctccagccctaaggcggtttttccctatctcagtagatggaacgtacaatcgggttttataccgagacattccattgcccagggatgggcgggagacagatgccttcctcttgtctcaactgcaaaaggcatgccttcctcttatactaatcctcctcagcacagaccctttacaggtgtcgggctgggggacggtcaggtctttcccttcccatgaggccatatttcagactatcacatggggagaaaccttggacaatacctggctttcctaggcagaggtccctgcgggcttccacagtttttgtgtccctgggtacttgagattagggagtggtgatgactcttaaagagcgtgctgccttcaagcatctgtttaacaaagcagatcttgcacagcccttaatccatttaaccctgagtttgacacagcacatgtttcagagagcacggggttgggggtaaggttatagattaacagaatctcaaggcagaagaatttctcttagtacagaacaaaatggagtctcctatgtctacttctttctacacagacacagtaacaatctgatctctcttgcttttccccacaaggaaactcctgtctgattcacaaagatgagagtagaggccggcccagtcaagactgtgtagtcaattaaatagcacctcctgccatccagcctttcctccttaaccaggccttctgtgtggtgctaggggcctcttctgtcctcccgtgttagtctcatgagcccattcctggggatatcagcatttcagcctcactgctttttgctgggtggaaatcctatctaatgatggctgtgttcctcctgggtagctggaatatgcccttacctgtggccctggaattttagagtttcatatctagtaagtgctcaacaactatttctggaattgatttcattttgattttgggaggcatattagttttctattgctgccataacaaattaccacaaatttaacagcttaaaacagtacaaatgtgtgattccacagcttctgtaagtcggaagtacaggtggaatcatcctctgcttagaatctcacaagaccagaatcaaggtgtgggccagcctggtcttttatctgaaggctctggagaagattccccttccaggcccattcaggttgttggcagaattcagttccttatgattgtaggactgaggtctccgttttcttgacacatgccaccaccttcatcttcaagccaatgatggcctgtcgagtcctgcccatgctttgactctgtgtctgcttctgccaccagttagggaggatctctgcttttgttttaagggctcttgtgattagattaggcctaccccaataatcccatataatctccctgtcttaaagtcgtctgatcagtaaccttcattacatcttggccaaaactctgcctaccacagggggatgtttgatgcctggtgtgtttggagcatgtatgcaggtatgggtagaatccccctctcttcctgacccatgtggaggcctcttctgctcccttatttggtctcttagctgggggtgtccaggcagtttgtgggtgggaagtgagggtcctttgctcttctcctggtggcctgagttctgcttctgcagggaagaggctccttaggaacctttctgcctgctttatcccacagcctgatcatgtcctcaccctgctttctctttttctcccaacctccaggtgtcatagatcctagtcttcttctgggagggtcctctctctccttccttcctctcaccctgagaacaggcacaggatgggcccatcagggaatgtaggaattttgcttcacttccaagcacatgggcaccatctccgcagctctgagcattctttactattcaaaaaggttagggggagagtttctgtcctaaaatatgtcttttgtcttcctagaagcacctttaacttttgttctcttccagaattggagccacttgtatggaccttcttttcctcactcttcgctcacccccattcccctcttcccacttctcccctagggcggatcccttttcatggttaactttgtaaaactttccatcttgatgaaaacaacaattatttatggtcccagaatagataagatggtggcttgtttcacaggttgtagaggtgatttcatttagtttttttttttagttataaaataatacaggctgggcgtggtggctcatgcctgtaatcccagcactttgggaggccgaggcgagcagatcacttgaggccaggagttcgagaccaacctggcaaacatggtgaaaccccgtttctactaaaaaatacaaaaattagctgggtgtggtggtgcagcacctgttgtcccagctattcaggaggctgaggcaggagaatcacttgaacccgggaggcggaggttgcagtgagctaagatcgcaccactgcactccagcctggcgacagagtgaaactctgtctcaaaaaaataaaaataaaaataaaaataaaataatacatacataaggaaaaatgaaatagaaacaatacactgaagagtaagtgtctctcttctcccagacccacagtctccctccctagaagtaccactgtttttttttttagacagagtgcagtggtgcgatcttggctcactgcaatctctgcctccgaggttcaagtgcttctcctgcctcagcctcctgagtagctgggactacaggcacgtgccaccatgcctggctaattttttgtattttcaccatgttagccaggatggtctcgatctcctgaacttgtgatccgcccacctcggcctcccaaagtgctgggattacaggcatgagccaccgtgcctggcctggctagtaacactgttaaaagttacttgtgttttcttttcttccagaaatgctctatacacatttattgcatgtattttggacagtttcatcccatgtctaaccctcttagaacacatctgtccctctagagtgtctgggtgttatatggggagagtggggagaggacaactgccctgtgctccagtgctgtacatatgccttggaaaagatggaggaaatgtggtgggtgcctctggccttttcaaatacatctcagaggtcagggctcttcaaggagttctcattacaaaatgagtagggcctttctctgtctctcgaggtaggctggaagaagacttggcggggattgtgttggtagagccaagggaccccaaggcctctaggagacacagggtctgagtggatcagcctggattatcttgtgatgcctggcaaggacctggttttgtatgtgatgattccagaggcagcaggactgttcccctccatcccacgcccctacacttcagtgacagagattttaaggctttatgtggggagggcctggctttaaatccggagtcagcatacttttttttgtaaagggccagatagtaaatgttttgagctttcaggccatatgatctttattgcaactactcaactctgccattagcatgaaaggaaccatagacaattaataaatcattgtgcataacagtgttctaataaaactttatttataaaaacagatgacaagctggatttggcccatgggccagggttattgggacccctggatccattctagcaagcaacagagacccctctgacagactcaaggaaaagaaaacaatgacgctctgttggtagatgctgaagtaattcacagaataaaaggaaaagctgaaacactaagactctggaaagggaggagccagagtgcctcaggaaccctagcactgaagcgctgatagttactcccctcagcaccgttcacaaagaggttcccttgtagctcggctgaagtaggtaaagatcataaccatcgtaaatatccattcatgggggcctgagccggtgctcatacactcgtatgcagccattaagatgagtgagataggccgggcgcggtggctcatgcttgtaatcccaggcgggcggatcacctgaggtcaggagttcaagaccagcctggccaacatggtgaaacccccgtctctactaaaaatacaaaaattagctgggcattgtggtgcacgcctgtaatcccagctacttgggaggccaaggcaggagaattgcttgaacccagaaggtggaggttgcagtgagctgagaccgtgccactgcatttgcagcctgcgcagcagagtgaaactctgtctcaaaaaaaaaaaaaaaaaagatgagtgaggtagctatccctgtggtggtatgagatagtccccaaggcatactgttgattgtatgtatgtgctgggagaagcaagatgtagtaacgggtgtatagaatgcttctgtgtgttgggggcaactcagggagtcatatatacctgcatgatgtatccctcgccctagtctacctctggaaggatatgcaagtaactgataatgtttttgcttttagaaaagggactaggggttaggcgggggaaggagactcttcgttgtatactcctttggacttttagaattttttttaactatatgcatgcatgacctattttttttaaaagacatcttttatgtaataaataaaagagctgcagtgcgacagattatttatgtgtcttgtgttggtgtctgagcttgctggattcatttcctttccccttggggctggtgaatacttgttttcaaaacagaagttcctccgttattaatcaccagagtattcaaatatgggagaatcacacctctgttcttcagcctctctcttttctggctgtgaaacattaaacaatcttgccatgaaagtgcccactaattgctgaggaaatattcaggaagcacccaccagaggcagaaggcagggggccaggagaccttggtgaggaaaggaggcgtgggtaaggctactgactgggggataggggtgtctgtgtgagagttaagggccctccagtgacttgctgtttttgattttctgatcgtttatctggggaggatgcctggaaaggactttctgatctctaagactaggacaggtgactgtctcatctcatagcatcaggttttaaggatacctgggatttgttttaagcgagtgtgggtaagacatagacatggaaataattgtcacgaagggagaagtttctttgctcacagattcctagaaacagaggcacagcacaccatgcagagccatgttgggggccactcagggtccgtcaggagaagagggagaaactggggtgagggcctttaacatgttccacattaaaggaaggaaagggcaaagcagggtgggcaggcttgggcttggctggtttgaataatctcagtaggctctggggtatatggggctatctctggttgtctagccctggccctgggatgattggggcaggtggatggtggcctggaatgtgagagtccatcagaggcagtggctggagcctgggcccatggattggttggtttgcatatgaaaggtgtgttgcaggtgaagttctttttttttttttttttttgagatggaatcttgctctgtcgcccaggctagagtgcagtggcgcgatctcggctcactgcaacctccaactcctgggttcgagcaattctcctgcctcagccccctgagtagctgggattacaggtgcccgccaccatgcccagctaatttttgtattttttagtagagacggagtttcaccatattggtcaggctggtctcgaacccctgaccttgtgatccacccacctcttcctcccaaagtgctgggattacaggcatgagccaccgcgcccggccagtgagttctttactatctctagcaattggctcaccttgtgggaggggcagttcctccagagtaagcaaggccccaaagtacatcagaatacagaaaatcaaaaataaaccataaacacatggttactacacctctggactgccaaatatggttgctcgggttgttcacagcacaagatatctggccaagcaggtgaatggggctgaaattcagaccaagctctgtggtatgtggccacagaactgcttccagttgaagaggccagttttcttctaatacattcaaaggcaccacgtgggctagcactatggcacttgtctcaggtttctgttctatattatttgtgattattttataaatctctgtttccctgactggacccttagttccaaggatgccagaatcttgtctgtgttcccagtggaccagaagctccatgagggcaggaatcaggtcttctttgctcaccgttgcctccctgtacctccttatacctggtgctcagtacaagctggcacgtacagggactgggtgcctgcctgtggggggacaaataaatgaacaggcttgagggtatgcaggactgcaaactccagaattatgtgctatctgcaccgtggactcttctgtttcttggcactaagaagatcaaaatctgtttgcctgccattgacttgagtagggtgagtagcattctccttcctgccaagagctgggctcttgtccctgcctctgtttgggccaagaaggcagccaagaaagagaggctttcattctcagtctagagatttttttgtcaactcttccctgctgtaattccccctggtgtttgtcccttcttggatgtgagtgaagagtgagtgactgggtgtacagcgtagaagagatcctctgagcctgtaggctgtggccagaaccctagctccaatctaaatgagcacagcccagcaggaagctccagcctgtgccaggcagggccacgggggtgattgctggagagaacctgtgttcctggtttgctttggcaacaaaagaaaacacgaactggttttcaaagagaggcgttggggttgtactgtgtgtgtgcaagtgtgtgccctcaccttcataggtggaggacagaggaatctgggaaacttgcagccacatgcaagcaggagaggcgtccttgccacccaccgggtctcatccttcaaaagggcagtgttgctgagaacctaacagaacttgtgttttcatctctctctccaggtttccattctattatgaactaaaaatagcatttgtagcctggctgctgtctccctacacaaaaggctccagcctcctgtacaggaagtttgtacatcccacgctatcttcaaaagaaaaggtaatatatgctgccatgtctttcattctttctagcaagtgagaaaataagtaataaataaaaagggatgatcttattgcaggagacttctcatttggctctcatttgcctccagcaagtcattcctcctaatcgttttttttaagtgtatttctgagacgtgtttagaaatagtggtgaagttctctaaaagatgttatttgtcattatttactggaaaacatttccataaattgaaacaaaagaaagaaaaaattcactcaatttaaccacgcaaagtgaatttccttccttttgtcatgcttagcccctgtccttttatagacatgatttttacatagactattttaaatcttacctggaagccaggtgtggtggtgcatgcctgtaattccagctactcaggggtataaggtgggagaatcacttgagcccagaagttcaaagccagcctgggcaacctagagagtccccatctcttaaaaaaagaaagaaagattaaaattttatgtagaatttttttaaaaaaatgatttaaaaacttaaataaaatgtttgtatcctgagattttaaatgtgtttgcacacaaatccatttctacttggtcttcgtaatacccatgatgatgttcccttactgctagatatttagattatctctaccttttcctgatatagatagttctgcagtgagcactaccattcctggagtttagttgcttcctttaattgtcttagaattaattcccaagagcaggattattaagtcaaacgattccaacattgtatcattcgttaactgtattacttactaagctgattgtgtagtggggtttcttaactaaaataggagcattataggtggcttgacagattaatgtctattgtttctgaaagttgaattccttggactagaaaggggaaggctttgggaaacatatccgttggatgagcaggctactgtacaagtttcggaaaatctctttaggaactcggaccgcagcacttcctgtctcagaagggtggattttgaggaacggatccctgtcttgacctggttatcaaatccctactcgtcttacttccctttccccaaatgctgggcttcccctgaagctgccaatgtaacttccattgaagtgaaggtgactgactcttaagagttgccaagaatcacttccaaaggggtggtggtgggggacaggcaggtcacagttagagggcctgctgctatgacttcctggggaagccttccacagggaatccagcaggaggttgctgacccacttgcacacctcaaagcaatggaaatacactaatgcacagaacttgactaaggccaaatgtcattgtcttaccgaactctgaaatgagcagctgtcatgaaaaacagcctttttttggggggtggggggcgcggaatcttgctctgttgcccaggctggagtgcagtggcacgatctcggctcactgcaacctctgcctcctgggctccagcaattctcctgcctcagcctcccaggtagctgggactataggcacgtgccaccatgcctgactcattttgtatttttagaggagatggggttttaccatgttggccaggctggtctcgaactcttgacctcaggtgatacgcccaccttggcctcccaaagtgctgggattacaggcgtgagccactgcacccggccgacaaacagccattttcttaaaacaatgacaacaacaaaacactcccaaacaaacaaaaataatacaccaaagttaatccaaatttgaactaaaccaatattgtacttggctttggtccctgaagaagacctcaatcctgttttccatctcacctttaccttgttgcatgacactggatgacttctaatttctgattttatttgaatatgtgtaaaacaatctcccttatccagtaatactcatttctttcagctttgtaatccctcccatcgatatacaaatggggtgatatttgattttagaattaaataactatagaataacagaattttagaactgcaagggctcaaccctgtcaagataaggaagatgacatggttatcatttattgaaactagccactgtgttagatgttttactggaattacctcatttaatcctcaccatgctccgcaagttgggtattatcattatcctcgtttttcagaagactaaaactgtgtgtagagaggcttgccaaggtctggcagtcagttggtggcaggtctgaggctagaagctcggttctgggcactctctccaccctgggtgctttcagtgtctggtgagtggctgtgtgtagaatggcaggcaaggctgtccatatccagaacctcctggagcctcctggaaggtcagagggctttagaaacaatctcagggcatcgctggatccgtaagttgcagtgttttcagagttcccttttctactctcctgtatctctgctctcccctctgcacgcacaccttcaaagtgcctacagcttttcaggcccagcaagaacaaggattgggcaagctgccaagcccaatgctcagaggaaaggaaagaaaacagagatgtgtttgaaccttccagctcagtgtgcctctgtttttcctttgacaggaaatcgatgattgtctggtccaagcaaaagaccgaagttacgatgcccttgtgcacttcgggaagcggggcttgaacgtggccgccacagcggctgtgatggctgcttccaaggtactgtgctggaagtaccacaactacatgagtctcagtccctctagtgtgccctgctcatcacctgtgcgaccacacagaacaggctaaggaccaatcagtggtttttcatcttttaggggtccttttgaaaatctgatggaaaaaaatgctgaatcttgccccagaaaattctcaccccccaacacacatgcccacatacttgcaatatcaagaggttcccagagcccctgaagctcatctgtgcgtcccaggttaagaatttctaacttatccaaccccactggaaacaagaaaataatagaatttctaacttacttggcacttaggcctgggagaaacagaagagggcaggggagagagggagagagtgcttctctgcagtttcctagggtgcactgggagagtcgcctaaatgcagtggacaggtggagagactacctgagcaagcgggtggactcactcacgatcatgtggcccagcagatccaggggaaggaacccaggtcctagaataagttgagtggtccagacatggaggtcagtaatgtgccaagccataacaactgaagtggaggaggtttgaaataaacaccagtctgtgggatgttgtggtgtgagcattacttctttctctattctctccagcccttttcaaaactgtgtttcttcctagcatcttctcatatcaccctcttgttgtcgtcaatttgtcattatttacgtagatctgaaaagttaaattggtcagatatttcctctcatgtgaaatcagcagatcatcctagtgttccccagggacaagcccttccccaacaaccatgtgtggagtagggacctacattcggctggtggtggagggaaggcagttatgctgatgattggaaagacacagtggttgggaggtgagttgtattagcataaggaagtttgtcccttgtggtgatgtgagggttttggggaaggaggcgatggggcttaaaaggtttgcaagaagatgattagtacagatcttggtgctctatgaacattgtgcggatggcaggatggagggtgctgagagccagtttcaagagactgagctgggttttccttgccctgaaccaaagagaagcacattaggatcatttctggaagagactcagcacactgggccgggtagttgcttgaaaagtacctttcaggaagccaaggaattctgcagacaaagcctggacaagagggaaggggaaccaaaaatgaatgattcctctttcagacaagaccagctccatctataacacagaattgtagctaggtatcccgccactccatgtggcagatctcggggttgggggtccagggggtctctgcccctttactataatagctgctggcaaaatgagggatcccagtgagtatctttggaagggaaattctgctttggtttcccaagatcaatcaggatttatgaacagcaataaattccaagaaccttctatttgagatgcaaccattttatgctttaatctttaagctgaaacaaaagagaactcagaattgctaaattctgaattcatcaggccaacctggcaacgtaaagctacggaaaccctgtctcagcctctctctaccccatctgttctgcctctgaagcctgaggaaaacaggctgctgctctttcctccattcattcctggagtataaacgtgctatatctgtcagggtggttcagtgtgcgtcacctggtggcacagctgcgtgcatgtagatttcattctgacaataacttctgcaggccatccttttctgggtctgcctcaagatggagcctccagagtcttcctatcatcctggccagtcactgcctgtcccctaaccacccgggaagcccgtgagcccgtcttctccatccaggcaccttatagcagctgaaacctaaaagaagcgccagacagtctgaaagttgcctcaggaaataactgctcattagttctttccagctggactaacgtagtgagggacatctgctttctgttgaatttggtttcagatgagaaaattttctgccttgtggggctttgctttttctctctaaatataaatatctggagagagaaaacacatattctcttctaaaaataatgccctctatttttgaaacagatgtgtacttaaaaaaaaaataaaagaagaagtaaaatccaaaaatccaatctagctgaggtgtacatcagtggtttccatagcaacagtggatcacttcaggccttggtcaaaggatgatgactcaccagtgggtccaaatctggcttgcatgcccaagccacctggagagctttgctttttattttttttttaatagattctcagatgtgctgaatcagaatctcaggcagtgggcccatgaatctctatttttaacaagttccccagatgatttttaaacagccagctctgtacaagtcactgcctgagaccccatacagaaccatagggggcacaggtgatgagggttaaagcagttaatttcagtaacattcctggaatgcagattcacctccttggaagccttaaccttgagaatgaggaaagcagtggcgtgtgtgtgggaaccgggcagcggggagggggaggccggtgtttatttctccaaaatttactgccagttgagaaatactatgatgggactacaaattctcccactttttttttttttgagatgtagtcttgctctgtcgcctaggctggagtatagtggtacaatctcagctcactgcaacctctgcctcccgggttcaagcaattctccctgcctcagcctcctgagtagctgggattataggcgcctgccaccatgcctgtctaatttttatatttttagtagagactgggttttgccatgttggccaggctagtcttgaactcctgacctcaggtgatccgcccgcctcagcctcccaaagtgctgggattacaggcatcccacctcttttgtagtgctcccaagagcctagcacagtgcctcgcacctggctgagcccttatcaatcttgttgattacccaaggggaataattagagcaactgtctgaaaaaaagacacgctgcaaagtcacccatagctggggtgactatataatttattgttcaaaccaggacacatttgagaatgtaaagcatgcttataataattactctgaaacaacaggtctaaactaggcctgtttggccagtcatggtggctcacacctataatcccagcactttgggaggccgaggtgggagaactgcttgagctcaggagttagagaccagcttgggtaacatagtgagaccctgtctctacaaaaaattaaaaattagccaggcatggtggcatgtgcctatagtcccagctacctgggaggcagaggcaggaggatcatcgcttgagcccgggaggtagaaactgcagtgaaccatgatcacgccactgcactctagcctaggtgacagagcaagaccttgtctcaataaataaataaataagtaaaataaaataaataaataaataaataaaataaactaggcctgtcccaaggaaaccaggatttatgatcaggtgactcctggcttcattttaaatttcttggacctgcctgtcttctcctcccacaaaacaccctcaacttacaaatcagttctcactctcagtatctactgcatttagtgaaagggatgcaagagagagtgttgcatggtgagaatactcttccttaggatcattcctggaagagactcagcacactgggctggaattacaggccaggatacagattagttctgacagattaaatggaggctgggataaaacgatgggatgaaagagtaattcctccttctgtcttcttttttccatacttcagtgactttctaggaggaaactatggagcttaaactgaagaatgaaaaatcttttgactacacttttagttaatcctttcaaaaataatgttgagccctgtgtcctttctctaataaaattaatgtttgcaggagtgttttttgtatcatcatgaattgtggaaaaaatttgtaaaccacattattatataaatagaagtcctggccaggcatggtggctcattcctataatcccaacactttgagaggtcgaggcaggcagatcacttgaagccaggagttcgagactagcctgggcaacatgatgaaaccccgtctctcctaaaaatacaaaaattagcctggtgtggtggcatgcacctgtaatcccagctactcggaaggctgaggcaggagaatcacttgaacccgggaggtggaggttgcagtgagccactgcactccagcctgggcggcagagtgagtgagactctgtctaaacaaacaaacaaaaaacaacaacaacaacaacaacaaaaggaagttcttattaatttttgtttatataaggtctttctatgttgcttaggctgaccttgtattccttggttcaagtgatcctcctacctcagcattccaagtagctgggattataggtgtgcaccaccatgcccagcttattaatgttaatattactgttttgtcttagaactggaagagctaaaacaaacaaaaaacatcaggcatgagaaatttcttccagggaatttaacccctatcccaccctcaatttcctacaaggctaacccctatccccgggaagtgttgatgcatctttctttgagtgaaaactgctgtgcgtccttcctgaggaaacacttctcaagaaccctctgtctcagcattcctagtctctgctggctctgctcctacatggtacctgtctcctaactggtaattccatccagagggaaaactgaaccccagatctttttaagactagaaatgaaaagtctctctcttaaaaaaaaaaataatgctctagaaatttatttgttaagcaaaacatattctcacatgaaaaataaaccataggctggccgtggtggctcacgcctgtaatcccagcactttgggaggccaagacgggcagatcacctgaggttgggtgtttgaaaccagcctgaccaacatggagaaaccctgtctccactgaaaatacaaaattagccgggcgtggtggtgcatgcctgtaatcctagctactcggaaggctgagacaggagaatctcttgaactcaggaggtggaggtcgcggtaagccgagatcacaccattgcacttcagcctgggcaacaagagtgaaactctgtcaaaaaaaaaaaagaaaaaagaaaaaaaaagaaagagagaaagaaaaagaaaccatagtgagacgaaccactgaacaaaaattttaaaaccatggggtctccaggctaccttacttcccttgcagtttgaaccacatactaggtttcttctgcctgctgaattctcagacctggtaaaccaacattcatttttcacttgtctcataactcgaaaaataatgttttagttcccccggagatcttgtctccagaacatttccagtagtaccaatactattactatagtccacctattgaagaaagctgctctaagtaaaaccagcattctgtgaattagggattcttctcttgcagtttgttttcagagttgtgtttgtgtgtatatggctccatcctcccccatccccaaatctggtattgtaagcttcttgagatgaggggctctggcttcttttcctttgtttcttgcttagaaaataaacaaaaacagaacaatgctttgttatttagtgctttgcactcatagctattcattaaaccttgttgattgatttgaagtatatacctttttgattcctctaaccctgccctgtctaatatggtatccacttgccacatgtagctgtttaaatttaaattaattaaaattgagtataccggctgggcacaatggctcatgcctgtaatcccagcactttgggaggccaaggcgggcggatcacgaggtcaggagatcgagaccatcctggctaacatggtgaaaccccgtctctactaaaaatacaaaaaattagccgggcgtggtggcgggcgcctgtagtcccagctactcgggaggctgaggcaggagaatggcgtgaaccagggaggcggagcttgcagtgagccaagatagcaccactgcactccagcctgggagacggagtgagactctgtctcaaaaaaaaaaaaaaaaaattgagtatatgttggggaccagcctcaacaccacccatagggtagctgaagtccggtggcgacaaaggaatgagaagagacaggttaagagttcctaaaggtgggagccagggggccagttgcaaaatggaggctgcaaaaggcccagagttctggtctccacactatttattgagtacaatcacttagatctaagaagcagatgttcagggcaaaacagtgaaaaggaggcagtgcgtcataggtgcaatctatagcagtagtggtttaaatgaatctcctttgtgctcaaacagcatatctttaacttatcggagagtagctagtgggagcgggcttaaccaggagcctgcacgtctgtccacattccagtgtttcaaaggagtgtccttctccttgaacacagtgtttacagataagagagcaggtctcgctctgagcatgggaacatgatggcagttaggaggctttcctccttagaggcctcttgtggctttccacaacttattgtcccatatttttgtggccagtttatacaggcaccccacaagcccttttcccaacagtatacctaaaattgaattcctcagttgtactagccccccaccccctttgtttttgagacggtgtctcactcttgcccaggctggagtgcagtggcacaatctcagctcactgcaacctctgcctcccaggttcaagcaattctccctgcctcagcctcccgagtagctgggattacaggtgcctgcccccacgcctggctagtttttgtattgtttagtagagacagggtttcgccatgttggccaggctggtcttgaactcctgacctcaggtgatctgcaggcctcagcctcccaaagtgctgggataacaggcatgagccaccgcacctggctgtactagccccatttcaagtcctcatttgccagtatggctgatagcacatttccattattgaagaaagttcttttggacagcactgccccaagccctttgttaaccctccagggttctcctttgcctgtttttcacccctttgcccacagttgctctggcttcaaaaggacacccacccctccttacctactcagctccttggggcctctgtatataaggttcaccaggagctggaaactcagcctatagcagcacccatgctgtagctcttatttcttcttcctctttactggtctggcccgctttcacaccatgacctctgctttcctgacttgctctctaaaactcaggcacttggcctgcaattatagtcagcggccaacaggcgatagccaagcgttggttatagcccttagcatctgaacagccaggcacaatccactgagagttatattattttgtttttctacttaaaaaaaattttcccactctttccttaaaaagaaaaagaagatctacaaaacagtcagcacaatagaaaaaaaaaagccctctcccacatatccttatcttttatccatcagtgctctatctaaatgtctggcttgaataaaatactgcttttaaatcaccatgaaactatttttggaatcaaaagctcatttgaggaagttcataagcccagtgatttggggtttctgacctgactggagtcagttgccttgcctttgttttgctttctagcaaaaaaaactacctgttaacaattagtcagagggcaggcattgattttctttttataaaacctccctgtgtcagctcatacttaggagatatttccaaggacggagaagagatgactgctgtcccctaaccagatctgtatgtttcacctctctggctttagtctctaccatctattgaatcaaagagggtaaggattccagaaagccctatgtttgtctcttcatccctcagaggagcatttcctggccactgtgctagctcacatcaagttagccttctttcttcattttttagccaaggactatgtgacatgaagttaatatttagaattcaccacggcaaccatttttaaacaccaagattatctaaactgtatggacaaactgctgaaaaagtttggaagtattccctaccctccagtctcccaaatattagtcaactcgtacccaagtttcactctcaaaatgtgtcgaagcagaaccaagcaagactttttaccagtgtgctggattccggctctcccagtgtttctacctggagtgttacctcacctcacactgctccatgcatagtgaagtggattcaaatgaatgaaacacccacatcacactcagctgaagaggaagggccaggaattcacacggagttggcggtccgacattacttacctgctctgttctgtggctacctgtggagattgtgcagcctgatgcctcaagggtccaagaggaaagagggaagcctgcctgcctgacctcacagggcctggtggaacctagaggtctgaggaaatatttgaggatcatgcgtgagtgggaagggctgtctcttggctgtggtgacatggcacctcctcgttctcctcttctctctgattcccctctcatgtttgcctcctccctcctttcctcacgcctcagtgttagatgaatttctctgggccccacctttctctcctctctctcctagcaccatctcatcctgtccctcaccttccgctgtcacctgatgacctggttcccagatgggcttctctgcccagggctcaatccaagtgttcctggttctctgctgaatatctcccttgtttccttcatactttagttgacagtcctgtaactccaaatctgcccttccgtgtgtcccaccattctgatgataatgaaattaccatcttgtcaggcacccaagctccaaatctctgtcacctttgatgccccaccttcctcccacttactcttcaagccctaaccatttgacatcccttctctgcatttgggccttcctccacacccttccttctagcttggactcttgcagtagctacccaaatggtcgactgctctctcccttcctgtttaagtcctgtacagtccgaccctgatcctagcctttcagtcttgtctctccttacctctctggctcttgtgataactgcattcacagaactgccttctgtactgttctggaaatagcaactctgagcgctgtttccagaattttctctttcttgcctctgcctttgctcatgttggtgcttcatctgcctctgtttctacctctttgaaatcctccccactcttccaggttaatgccatctcctccaggttaatgccgtctcctccatgaagcctcctctgatcccaggtagaactggcctctcactcctgggtcctctgcactaatgtcatcatgtatatgtgtcttacctgcatctccataggtgctcagtaaatgttaaaggaatgaaagactgttgtgcatatttttagctgccatgaccaacagagcaatacttagaatcaaggatatccaaagttgggctttggagataagcagaccaggtttaaaagtcccagctccctgcttactgctgcacctctgtgaacctcgcttcttcacctgcaaacagggatgatcatagtacctgccacaggagttatgaggcagtgtaaagacttcacagaatgcagagtttataataaatgtttaataaaggttgcctgttatttgctcatatgtcagtttgatctcaggctgattatgatcttctctttcctcactgttgaacagaataaaaaaaaaaaagtcaggccctggcattgggacgttatttacaaggcaggctcttctgcacaggaggctgacttgcctgccttgtcctggcccacctcgcatgtgctgtgtcttcctgcgcaagccacgctcccctgggctcagggttccccactgttctgggcctgacttttcataggggtgcttcttcttcctcttccaccctgaggtgtagcttatgacacatgagcacctgccacctgccaagacaggaggaaggtcaaacgtgggctgctggagcagctggaaccctcacttcagggaggaaaccaagcaggggtttgagtgacttgcccaaggtcatgcagctgttagttgttgagctgtgatcggcaccagggtctctagttcctccagtgtccttgcatcactccaagcactccccaccccaacacatacaccctaaactgacacttcctggctgttttgtgcttggattacactaccaggccctggtggctgagtacctggactgtccctcactgaggattttagagtctctcacaccccagggtactgctcttctgatgatcgatcagctctctcttggccttgtggtgaggctgggaaacacttaatgcagggtgaaagaatgaggatcacaagtacctgtcaccgtaagtcacagtttctgtaaagctcgatcacgtgcgatagcgtgggcatgtttgcacaccagtataattagagctcactttgcaccagcggctgggcagatttgtcctgtgggtcccccttcccacccttagtccttcctgccttctcattgtccctttccagcagggcctttgcctctgaaggaggaagtatagatgaggcaaagcttccagctgagacttccacaggcaaggccaggggcagctgctgtatgtggagggtccctcctggtggccctgactccccatcaccgggcaagggcctggctcagatggccgggcttggtctggctacagagacccaactcacctgagcactgtcattggtcagcacaggcctgtctaacctcccaggcttccactcctcacctcccatccagcctgctctgaaccagaagcaccaagcccacctccctcaccagttaatgcttgttcttgcctgctgtctctccttaagggcacttcccagaaaggagactagaaaataccgtctgtattccagataaccacgtgcctgctgcaaagtgagagaaatggggagaacagatactgggtgcaagttcttggtatgtgccacgtggcatatctaggatgttctcatcattcaacatcctgcctccttcacactgctcacctctcaaaaaccttcagtggagtgctcagtttattgtcaaaaaccaagtttaggcagctgaagcccagttctcccaggctggtctccttttactcactggcaccaaagcctcttctccccaggtgggttcactcaccgtttcccaggtgcaccttgggttttcgtccactctcacgccctggcccaaagcacttccccgccagcacgtgccttcccccgcccgcttcagaggatgcagccctcacctcactcctcactcgggttcgaccccttgtgtgagaggatgaggcctctgcacgtgctcagccacggtgacggtgccatcccctgccctgtactctggcatgatgttggtcatctttgtcacttgtggcctggcatgcacttttgtgtcttgatgccccaactagactgtgagctccatgggagcagggaccgtaccatcctcgtctttgttcctctgcggtgcttcacgcagagcttcgtgaacactccagcagcatctgttgcaagtgagtgaataaatgggtgagcgagcgagggagtgatgggaggaaagaggtgaggacatggctcccttcaactccattttattgccttggtgcccatggcttttttctccttttcccctttatcaggtggctcgactctttcattttatcttctctttggacctgagagaagggcaggtaaccctgttgagaggtgtgactaactccaaactgatccagttgggcagcgaggccaggccaccggctctgctcaccagcacgtggtctggatcagaggcaggtgtcccccctgcctcggcacctgcgtgtgcatgtgtgttaatccatgtggggcacacggagccaggccccacttcatcgtctttccagagactcttatggtgtgaatttggtagcatctaacatgtgattaacttacttgggttttttcttttctttgtttaatgcctggagaatggattgaatttgatgatggatgctattgcagtagaaattctccttctctgtttggtttgttaatcccattttgtgtcacagacaagggcctggtcctcatgcagcatgtcattgggagcctgcttggcttggatgtggcgcatgtatggctgtggaggctcactccaccagtgaggcgggcaccccatggggtttggaaggaagtactaactccttctgaattactggtgggaaatgcggttgtgctggtggctttgttatcaatttcctgactcactaaaaccctttgtctttattgttgttgtcctcagtagcaggcattagatattgtgtcaagtgagatgggctaaacttcgtgctttgctggagccttcccctgtgacttggtgtgtccctctggaaaagaggacctcattaagggctcaacactcattcggtttctggagataccatgtgctccttcttagttctgtgttgctgttattgctgttttaattactcctatgtctttttttttttttttttttttttttggtctagatggcattggtcagcatcatgcacactgtatattcacaaaatgaggtcctcagggtgaccttgagtgagtgctgtgggtgttactgaaaattaaattgtactgattttttaaaggtaatgcatgttcttggtgcagaattataaaaggacaaaagagagtgtccagtgaagagtaagtcttactcttacccctgccttctactggcatggttgtttacgaagaaaccacgtagcctttctgcaggcatttccgctattcagatacatccctggccatgaacaaggtataagtggacccccatccccttagcacacaaaactacaaagacctcacttggggtggattgaagtggccgctctcagtggtgacaaatactaacacacattccttctttttctacctggtttctatcttcacctacccaagtcctccacccacccaagttcaagcgcagtctcctctgggatgccttgcctctctgatgtgtgccttctgccctgtgcacccacagccctctgacacttcttatacgctccttgcagacacatctcaaggcttgttcagcaggatcctctttcaggtctgggaccctggctgatgcatcaggctgaggtggggatttcccactgtcacgcttcacccaggcggcagctccataaatggtcatacgttcattcatgcaactccttaaccccaaatatgtatcaagtagagtggcagatgccaaggctgcaatagtgaataaaacagacaatagcaatatttaaatatcattgtgtggagtacaagagagaagtacagctcaaaggctgtagtgacagcatttacagggaactgggatgagtagagaaagctgctctgagaagtgcaaccatatttcattgaatctaaaaagctgtggtttctgagacacatcattatcttatgttccactaagaaagataatattgccaattaaattaggacacaatgttttttcacttagaatgtttatttatttatttattattactatttttgagacagagttttgctcttgttgtccaggctggagtgcaatggcacgatctcggctcacctcaacctctgcctcccgggttcaagcgattctcctgcctcagcctccagagtagctgggattataggcatgcaccaccatgcctggctaattttgtatttttagtagagatggagtttctccatgttggacaggctggtctcaaactcccgacctcaggtgatccactcaccttggccttccaaagtgctgggattacaggcatgagccactgcgcccagccagaatgtttatttcttcttatcaaaaagactcttagacatcttttttttgtcacttttataaatacattaaaaggaacacagctgggcacggtggctcacacctgttccagcactttgggagaccaaggtgggtggatcacctgaggtcaggagttcgagaccagcctgaccaataaggtgaaaccccgtctctactaaaaatacaaaaattagccgggcgtggtggtggccacctgtgatcccagctactcaggagtctgagacagaagaatcttttgaacctgggaggcagaggttgcagtgagccaagattgtgccattgcactccagcctggctgacaagagtgaaactccatctcaaacaaacaacaacaacaacagaaaaaacaaaaagagagaaagaaaataaaaaggaacgcattagcacaataagtggttaagatctctctaacctcactttttcactttcagagtctcccgaatcacttttcagctcggcgtgtcagtatccacttatgaccatgccatatcattctctgttccttctagtgtgttgggtgatgtcgagctgttgtttctgggattttcattcatgccagttttgatgctgccactttcttgatcataccagaaagtgtcagtgagatatgtgttagacaactgagattcatattcctttctcaaacagttcttaaatggtttgttaattaaacactcaggggcttcagttgtccagttatgccagggagaataacaaccaagtatatctatgtgtaggcgttgacaatgatgtcagggcggcagcaattgtaagacccaccccaatttcagagatgaaaaatacgtcttaaaattgatgaaaatctgctgggcgcggtggctcacgcctgtaatcccagcactttgggaggccaaggcgggcggattacgaggtcaggagatcgagaccatcctggctaacacggtgaaaccccgtctctactaaaaatacaaaaaattagccaggcgtggtggcgggcacctgttgtcccagctactctggaggttgaggcaagagaatgcgtgaacgcgggaggcggagttgcagtgagccgagattgcaccactgcactccagcctgggcgacagagtgagactccatctcgaaaaaaaaaaaaaaattgatgaaaatcattttcaagaagtctaggagtaggtgggtgttgtcattattattctggtgacttagcgatgtctttttaaattttaaaaatagaaacgggatctacctatgttgcccgggctggtcttgaactcctgggctccagaaatcctcccccctcatcctccaaagtgctgggattgcaggcatgcaccaccagatgggccttctcagagcttttagtatgataatgtggctcatggaattatggggaatatggtattaatgctttccaaatttagagaatccaaatttatttccccaaagtagggaaaccaattttgcagaataccaatgaacaactcgtggttcttcccagaagacaatggtctagaataacaaagattctgcagagcggagctgaacagacagtgtggaatggggtttgtggaaagtgaataggaatgagattttgtgtagagactgagaagggctgaaaggtttacaaaagagagaggcatgttgattttttttttttttgagatgaagtttttgctcttgttgcccaggctggagtgcaatggcatgatcttggctcactgcaacctccacctcccgggttcaaaagattctcctgcctcagcctcccaagtagctgagattacaggcgtgcaccaccacgcctggctaattttatatttttagtagagatggggtttcaccatgttggtcagcctggtctcaaactcctgacctcaagtgatccacctgcctcggcctcccaaagtgctgggattacaggcgtgaaccaccgcgcccggtcaggcatactgattttaaccatctcagagtgttttgatgggcaagggctaatttgttttcaggagtcttgtatctatgccactataatttcctctgacacaggcctaggttgatactgagctattattatctccctctctttcctaacctctgccactgccagtgtgatattggagctagactggctggcttctgggagttgaatggagcactttgctaaaatgaacgtgtacgatgcctgctgttgctttctctcacatatgttgctgagcgacaatgagcaagaactggcaaactgtgttgagggaattcgtccctggccgtttatttgggcttggggtcatgaagcttaggaagtgaccttttccacctctgctttcaatagcaacctttgtgtcttaggcagctttcaatagctttcaatagcaacctttgtatcttaggcagtagccacagcatcaacatcattatcatcatagttgacatttttgaagactaaatatgcaatgggctatgtgatgggtatcttaaggatgtaatctcattgaatccgcacgagcagccggccatttggatcctcttctgcaaatgaaggtcttgaggtggagagaggttaagatcactcagctgttgaatgacagggctggaatttgaatcaaggcctgactcaagaactgctgttctcaatcttcactttctgtagcttctgctaggatacttctgtgttgtatctgtacatttgtcgttctccgctttctcagaaatcaaactgtatttttggtgtttcatgttagcacctagcaccatgttcttgcccataaaaagtacttggtaattgttgaacaagtaaagtaaacgaagaaatgagaggatgaatgaaagagtgagtcagtgaacagtttgcttgaacactaacctaacattgagttactcacttataattagcagaatattttctcactcatttcagaatcaagttttgttccttagtcatcaaatttcttctaaattctagatgctgcctagaatgtttctgcgtaaaataatcatggatcattggctgctatatttgaaggggttatataatgggtgtctggctggtccagcctccattttgctggcagagaccacccagctgttcctgccaaggacgtgagaccttggacccttgcccaaccatcactctagagcagtgtctgaggcaaccagggtgatttctgtcttttttcatataatatcctccaaatacttcttggcctggacttacaattctttttaaatagttttctttgtgttattgttgttggtttcctggtgacatggtttttatatctttggtaggttgggaacagatctagttcatattttagtgcatcttgcttttagtctggcacttctttctttctttttatttttttgagacagggcctcactctgttgcccagactagagtgcagtggtatgatcccggctcactgcaggctctacctcttgggctcaggcggtcctcccacctcagtgtcccgagtagccggaactacagacatataccaccatgcccagctagtttttaaaattttttgtagatacagggtctcgcttgttgcccaggctggtctcgaactcctggactcaagcaatcctcctgcctcagcctcccaaagtactgggattacaggcatgagccaccacgcctgccctcttctggcgtttcttctaaacctgactgcaagcccctttttttccccctcccctctaatgaactcattttgcgtctgctccttgatcctatctggatttttcacttcagcgaattgctgtgctttgttggttcattttcattattttttatattaagtaaaatgaaaaaaatcttccaaacccttctctcacccctgaaaacctcttactcaactgttttggcccttgcttatttcatcaatcccaccagcagccctcttgtcagcggcttgaattgattttgtgctgatttgttggttctgttatgtctgttgtgcagtattgtccccctgtcccccagatctctgggaccactctttccttcattatccaagtggcatagaaaacctctcccatgccactgcagtgccatgcacccgagggaaccctgcacaccctccaggctttcttctttctgaagatgtctgagttcattcatttgcctggtagttacttgcctgtcacttcttgctccaaatcctagccgattctcaatttccccagtctcctcccactctcaggtttccataacctctctctgcagcccctgaggcacacttaaagcaatgccaccatccctgagccttcactgtgatcattttcactctgacacattctctcatccagacagtgaggagctgctctttcgtaagtaaaatggattgatcttgctttctaaataaaagaacaattccccccgagattaattctctgtctccctcagaatatgaaatggttacaatcagcagggtttttttaaatcatttttttcctttctgattcattaccttttgggtattttatgaagctgaaatgcaccagcagaagtaaatgtgcctcgtagacagtaatatgctatacaaataaaagaaatttctgttgtcaaacatttagaaaaatattgtctgtattttgtgtcctttgaaaataataagaaccaagcacatagaatattaggttttgattgcctgaccagattctcatgtactgagaaaaatggagatacatgtggatttttatttatgcaaagcaagagaagcagcaggtggcctggaaggagtaggagctgcaggcagtagtcacgcccttggccctgggtctgtctgaggctccggatcatcatcgtatcatcgtatcatcatagtggtgtctgagggtagggagggatcctggagccaaaggagcaattactgagccccagaggaggccctggaaaattccgggatttgaccctctctgtgtttccagcagctatgtctgggcacctgcgcctcagagttgatccaggtcttgatttccacctggctgaccatcagagctccctcttggcctttgtcgagtgtgacctgtggagcaggacctctgacgtgtgcccctcctgtgttgtatccagggacagggtgccttatcggagagactgcggagcttcagcatgcaggacctcaccaccatcaggggagacggcgcccctgctccctcgggccccccaccaccggggtctgggcgggccagcggcaaacacggccagcctaagatgtccaggagtgcttctgagagcgctagcagctcaggtaggtgtcactttacttcccctctttcccactccttgggcctcgctttcattgagagaggcccagtccgcagtgtggcatgcagcctggccctggccccacggacctgccaccaacggggtgtccatcagatcatgccaggtcagccaaggggcggagcacccctcaggcccggccaggaaaccagcctggtgactgatcagggacagggctaggtcacctgcaccaaagggtcccctttcctccatatgattgtctggggaattgggggtagttgggggctagtgtctaggcaaagcctggaggcagcaggcacaactggacctgggccccgggagccttctgtgttgtcttctcagactccggggaggcatacctgttgatacctaagtgttgtcttctcacccggggcttactgctctcacgggccctcttccctgcctgaatattgcctgtcctctctctcactctgctgtctccttctcatctctgacctctcatgtacctcacaccacccccagcctctgcataccaagggccatgctagctctgagttcttgttcctgtggtgaccaggaccttacagtaaccacacctctgcctccaatgtctgactctggtgtcacacgcccatcgtgggattgctggtattgggactgacctggggacctcgttaaacatgcaaagtcctgggcccatccgcagaggcttcagtaggtctggggtgagacccagaagtgtgattttcattgagatgcagccgtgtttgggaccccccgacatcggatccaccagcacgggtttcaggctcatggagggtgggggcacacagtttcccaggctgctccttgggaggatgccaggggccttgggtctcaggggctgagcacagcagctgcccaggactgatggtgggggggtgggggacggttctggatcaccacttctgcctcgctgtggtgagaagggtgggaatctatgtccacaatgtctgtctggtgactgcgtggcccttaaatctataaacagagatgtctggccacctgtgactatgcagcctgcaggggacaccttggccataagccccatgtcctgacagaccccatctgatgcccgggggtcttagccatcaacaggaaggcatgaggcctgcggctgcctgggaatggcaactcatgctcagagccaagtgcagctcagggctccgtccatttcctccctctcagcagtgtccccttggcccttcgcaggtcttaagactgtggcttttctgttgggagatgttttaaccctgtcactgctggaagcagggcagggttggggaggtggaggctcggctgtgggggtgatggccacctcagggaggggttaccccccgagggacccccccccaggaatggaatcccaaaaggccagacaggaaatgacctcagggatctttcagtcaaacccagtgattttactggtgaagagacagaggtccagagaaggggactgtgcagggtcacccatgctgggctgcagtagagcgtggccttctgactccggggccagtgcccatggtcactcactcatcaaccatccaggctttgtcaagcatctacagcttctgatctgccggacactgccccagaaatagggatacaaaacagagttaagtctcatctccacactgcatcagctcatcatctaccaagcctcagatgaaagctgccccttagatggaaaaggggcctcaattcagtaaaacccagagggcagagagcaagaaccagtggggtgaagttcgaagggggtagccacttgctcgccgcatgacccgggcgagctatttaccatctctgcaccctagatttcttatctacacaaggaatgacacccctttgtagagttgttgtgaggcttcaaatgaaaccagccatgtgaaagtgcttatggccatgcctggcgccagtgcatagtagctgttatcattgttctttttgtaatttgtctctcctgagaaggcgcattgtcatgctgcaagtgtccaggagcaaaatgggccatcttgggaggtagtgaggtccctgacattggaaggacacaagccaaagctggatggtcaggttcgagggagggattcctgctttggctaggaagcgggcttaggtggccctggcgtccctttgcctctaagagtctgtgttgccattttagaggtgagcccagtggaggaagcaggctcagagaggttgtgcactgggctgaggcccccaggcccagaatccaggcctcctgcctagacctcccctggtgaattattcagggcagcctcagaactgggaatgcaagaagctggcagggtctgcagggagatggcagtgtcttctgggcctggagtatcttcccagcccagcatcaggtagaaaagcatttgggatgatttgctttggcactggctctgccactctccatgagcagaggtgatgacgtcccctgccatgccccagggaggcagtggggagtgttctggctgtcccaggctgagaggaccagctgtgctgcattatgccccagccctcctcactgctggcccccttggcctccgcacctatgaccacagggggcaaagaggaaaggtgcaacccagcagggaggccaaggacagtgtagtgctctttccagctgttctggagcctaaaataaaagccatctcaaaaaggaagacaggagctgggtgtagtggttcacgcctgtaatcccagcactttgggaggctgaggagggtggatcaccagaggtcgggagttcaagaccagcctgaccaacatggagaaaccccgtctctactaaaaacacaaaattagccaggcgtggtggtgcatgcctgtaatcccagctactcatggagtagctgaggcaggagaatcgcttgaatcggggaggcggaggttgcagtgagatgagattgcaccattgcactccagtctgggcaacaagagtgaaactccatctttaaaaaaaaaaaaaaaaaaaaaaaaaaaggaagacaggtgaaagatggcctggggcgtggatatggggcagaatttcctgggtcagaggctcttgggctatcataccctgaagtaaggtcaacatgcctaggaggaagtctggcagaggaagccaatttataccgggctggtgtactctccccagctcagcccccagtgtgggcctcagatgccaggccagatcaggtagcagaaagggccccagaaaaggggaagaggctagacttcatcctggctgggtgatgccgggcctgtgcagacacagcaaatgcagcacagcaaggcatgctccttcctcctgagcctcaattcagcctcagaacttctctcagaacaacccaggcagtcgctaccatagatttggccttggcacagaggacagacctgattccctcaggctttcttctttgtaaaaaagaccgaatagtccctattcagcctatgtcttagggttgtgaggagagcaaaccagagaatttgcaaaccctggacaggtggcaggggttgaagacaacctggagagaggtgggagctgcacctcgtggaattctctgcagctgctggaagcaacagattaagggtgcacacagtggaacttgaaagcatgatgccaggtgaagaaaagtgcaaaacagaatgagattttatctaacaatttatgtaaaaaatatatgcctatcatgcaaagtaacaatacggagtttatatgaagaacatgttcaaacaaaaagttgcacattaaaatattaaaagtgacactccttgaggaggaaggagaatgtgagtggggtgtgggaataaaagtcatgtaaaggcacataaaaagggttgccaggcgcggtgactcacgcctgtaatcccagcactttgggaggccaaggcgggtggatcacctgaggtagagagtttgagaccagcctgaccaacacagagaaaccctgtctctactaaaaatacaaaattagctgggcgtgaaggcgggtgcctgtaatcccagctactcgggaggctgaggctggagaattgcttgaacccgggaggcagaggttgcggtgagctgagatcatgccattgcactccagcctgggcaacaagagtgaaactctgtctcattaaaaaaaaaaaaaaaagtgaaggggatcccatgaaccagtgtggaccatttgctgtgagccaagaagggacatccatgtgacctcctgcatcttgagaaaagggaggaagatgcacacaaacgaggaagggaggaaggggcacaaagactgtccctgcacggtcactcagcgctgcaagctcctggcaggcagacaagggttctgtgcttccctctgtaaatgcctacccaacatactcaccacatgcctggcacacagagacctctgtatgtgcagtgaggacacagggtctaggcgttggagaaggggaaggagagttctttcctgttgctttcagcacccaggatggggctgggcagtgtacttggcctgaccctctctcttgcctggagttttcctctttgcttaaagggtcagggcaggcagggactgacatggccctccctgcagaatgagctggaaggtgtgtagtcagataccatatgctgaatgcctagcactggacaccaggaagtgtacaagaaatgttgaaagaatgatcctggccttccatggacttggagtcactcagtgagcatgtatttagtgagcacctactctattgccaaggcccagatgtgcaccaagaccaatggcgtgtacaaggcagcagccagttaggcctttgcaaatgcccagatgcgaagcactttggggttcagaggtaagtctggggaggtttcctggaggacattctgaactggaaagcaaagagaggaggaggctttgggcaggggtgcttggagttattttccagagggaactttgactctgtctccggccttccctagggctgcagggtgcaaggactgactttgtgtgccaggtgagggtatcttctgcacctgagcagaaactgaatctgagatgactctttccccactttggtgtctctacagagacccaccttcctgggatccctatattgtacacactgggatccccacacctctccagggcctccctgtttgcccggggctggttcctgtccagtgggggatgtcactgatggtgcccctaccccattcccacagtgtgtacctgctgctccacctgcaggacctggaaaggtgagtaagcagccagcctctccgcagcgtgctggactctcactcggaaagagcttctaaccaggagtgggcacctgaccctggggctccctttcagctgcatggtcatagggaggggtcaggaggttaaccctttataacagcaaacacagtagcttacagttcctgtgggctagaaatctgggagcagcttaactgggtggttctagctcagggtctctcaagaggctgcagtcaagatgtcagcctgggctgagttatcggagggcttgacgaaactggagggtccactttcaagatggcactcttatggctgttggctgggcctctccaaggctgcttaagagtccttacaacgtggcaggtggcctggcctagagtgagccattcaagagatagagggcaggcaggaagccagggtaccttttctgtcctaggttttgaagtcacactcatcacttctgccttattctatttgttggaagcaagtcattaagcacagcccacattcaaggggaggagaattaatctccacctcttgaagggaggagtatcaaagaatgtgtggagatatcttaaaaccaccacagggtcactgggcggggtggctcatgcctgtaatcccagaactttgggaggcagaagtgggaggatttcttgagcccaggagttcgagaccaacctgggcaatatagcaagaattaatctctacaattaaaaaaaaaaaaaagccaggtgtgctggtgtgcacctgtagtcccaactacttgagaggctgaggcaggagaattgcttgagcctgggaaatcaaggttgcagtgagccatgatcgtgccattgcactcaagctgggtgacagagcaagaccctgtctcaaaaaaaaaaaaaaaaaaagaaaagaaaaagccacaacagggtcatacttccttgtgctccaggtaaggacacaggaacttcagaggactaaggtcctctgaaatgatgaagtcctgaagttccaggggtttctggtcctggggcagccaagggagccctgttcctgctttgccacttacttgctgtgcaactttgcgtgaatcacctaaccgctgtgagcttcagttcctcctcttaaaacggagatgagatccctgcttcccggcctcactgtgctgttgtgaaagtggctgtgaaagggccataataatcctgggaaggatgatgaggatgatgatgatgatgatggtggtggtggtggtggtgatgatggtggtggtggtggtggtggtggtggtggtggtggtggtgatagcctggagcatccaggagaccccagggagagtggaggtctcccggttctggacagagactcctgttgctgccctcccagcgtgtgagtgatggcttgttggagccacagccacctggtggttgccatgacctgcttctccagttgcctaaccttaagtagacacattagggactagtgagggtcctggactaatccagtgcccctttcacactgcctggctccccatagagaagctgccttaggcttggaaggcaagaggggccgtgcctggcctgcagcctgctggctggtgtcaggggaggaaggaaggcacgcaaggtgcctaatatagcttttgctccagccctggtgccgcggaggcatgacatgcccctcccacatcggcagtgagcaagacaggaaactgcattatgtgacgtgtcctgttttccctgcattgctttatttttaaggctctcagtgctcagctttttaagtcctttatagaagagctggggattaggacaggcgcagtggctcacacctgtaatcccagcactttgggagaccgaggcaggcagatcacttgaggtcgggagttcgagaccagcctgacgaacatggagaaaccccatctctactaaaaatataaaattagccgggtgaggtggcacatgcctgtaatcccagctactcgagaggctgaggcaggacaatcgcttgaatccgggaggcagaggttgcggtgagccgatatcatgccattgcactccagcctgggcaacaagagtgaaactccatctaaaaaaacaaaaaagctggggattctggaggccataaggccaaactgaactgacagaggagtctgagcagggctgcagatggagagaagcgtcccagcccagctctgactaaccctgtgtccctgtggggcctcctggtccaagttggaaatgaaggggctgcgttcagctgtttccagcaccgggcactagacgctggcctggtggacacactagttcatgggaaatgaccctgtggtgccagtggctccaggcaattgcagggatttctgtctattcacactgtagttttgagtctgcaaattctgtgagccattccaaaagcctctaattctgggagattggcacttgggggtcggggagagtggctgccctgtcctccattcttcccctgacactgctctgtgctgctctcagaagcccttccctgccatgacatctggtggtttcatgatcagacacagtgtttccagtgcatttcaatagagctgtggttgattgtaggaactgaatagttctggaaggctgcatgtgcataagagtgtgtccaggattcagtgtccaagttctggttccttatccccgagcaggttggttgctgctgggatgggggttgctggacagcgggaagcaggtgaggcctggtggtggcctcaagacctggaagccgttgtcctagcccttcctttcttggacctccgcctctccaagggcctcttaatacctgtgccctggctctcaggtctgcatgcaaggaaccctttgatgattggcctacaccattccctctgaggccttgggaaagcccctgcactctgcaggcctcagtctccccctccatgaggtgtcccttggtcctcccagctctgacagtctctactggattgtgcagtggtggcagatggtgttgggggaggtctgtcttgcacctggggctataggctgactcttaagcagtaagaggatttcacagttgtcggggacactttcctcctggtcccctgaaatgttgtcacaaggggtgctcactcaggccaaagcctgggaagattcaaattacctctggggccatgcagagccccaggatccctcagcagacaggaacattttctaggagttgtaaattcaggtcttaattcatgatgggggtagggaaaggaggcatttcggaggctgctaagtgccttttagggcagtgacagagcttagaggccccaggggcagcagcctctattctaagctgcacatctcagatgccagaacattcttttcccatctttgctctgttcctgccccatttgtcaactgattccctattgttttctgcatgtctttgtctctctttttctgtgtgtctattattatctctctctctctttttttttttctctgcctacctctatgtcatatagaactgaactctggattactgcctgtgtggttagtcatagaggtgtccctcccccccttttaaaatcaagcatgtaggacataatttttaaaagcagtcatcctttttgtcctctcagagagagagagagagagagagagagaattgcattttgagtgtggcctctgggcagtgtccttctgattatagcaggaggagctgcctgaggtttagagcatgggaagtgagtgagcatgtgtgtgtctacatgtgtgtatgtgagtgtgtctgtgtgtgagtgtgtgtggatggggatgtgtgcatggtgcacacgtgtgagttttagtgccaaagacccttctctaacggaatgttcttttctctctcctcggtgctgttggggacgtggatgtaagtgttccagacaggcgtgctcttctgcagacatttgctgccttccattaatgctcccgctaatgtgtgctgtgtgggatgtttttgctaacctgggggaggttctgctgcactgcaggggtgcggcagccctgggcccactgcaggctacacaggcctttaaagggctgagaggctctgccagtttctccctccctcccttccccacagagagaagaggtggagcctgcagccctggctgctgtagccctgctgacacatttgctaatacagaaacatcagccaaggccacacacccattcccctgctgtggaagacggcagaaaccctgccctttcctagaagcaacccagctttgggcatcatagtggcagctctgcaggctcaaggccgtggccaccatcacctgaggtttgcaagttgttatggccatgaccttgggcgggagaccctcctcccacacacattgtctctgggagccaattagagtactaagatgtggatagcaatactctttcaggcctgttgccaggggtaaggacctgttgggtcaccaatctttagatcttcagggacaagaacatggaggaggcagagcatgggattttctacccagctactcactctcctgctcctcctggtgcccctcttttgggactatgttctgtggggttcatttctccatttatactccttcctgatataaaaaggagttaggtctacttgtggaaatatatctaaagtagcaaatcaaagtaagaaaattgaagcatggggagaagggagtgggcaagtaagatggaatcagtggggagaaggacattttaaatgcataccatcaaggtgtagactgttgagacacctggcttccttgaaaccactgcaaagagggaaatacaattattaagagattcagtccactgtgcaacagccagctagaggcgtggaagcttgtcttatttagaatgtttattctcactggttctgagagtaaggcaaatattatagacaacactcttggcagaaatgctcagcggacacagtgactaggagatgtcttatcttcttaggaggttctctctgtagcttcttcctgaggctattctggctccctcactgcccacactggcctcttttgctcccagcctctgctgagctgagcacttgtttctattcctgcttggatatctgggttgtccttgaaccatcactcctactgggctggagggtcatttcttttctaccctgcaatccttgcagtggagaacatgcacaaagccattttggtttcagtcctgagattatagtgatgatggtgattttggtaagtgtgagttcattgctcagcctcagtgaatccagactggataactagcctgggttgttagatgcctgaggatctcacggtgactttgggccaccttctgacacccacaaccatcagtacagggaaagccctggacctggatgtggagggtacagcatatgcagaggcacagtctcgaaccggtacccaccccacttccatgtcatggagttggctgctggggtggagctggccaggctgcttctgcagtttttgccttggtctgagggcttttggtcttttttccctcctgccaggcaggaggtatctgtgtccagaaggaatttcctggtttggttaatgggggtgtcaagctctgacttgggactagagctgagctctctgagatgacttcaggattctatttagtttagttgatgagtggccactgtgtgcccagccctgggtcaggtgctcagagagactgagggaggatcagccatggccccccagtctcaggatgccttctgttggctgaggcaatgagactgacatgaggaccagggcacccaacacaagctgtgtggcacagcctccaagcactgtcgggtctcagagtggggaggccagggagggtcagagtattcagcgagggctccctggagtcactggtctttgtgctcaacaggatgcagctgattaggacagaggaagggagcagaggacaaactaagcccagagtaaataagctgagggaagtgcagagtagaaataaaataataatagtaatttaaaaatcaaaggaacatcagtgatctcaggactttacttactaaggcccagtctgaaccaatcacaccccagcctaaaattcagctttgcatgttgtgctgcttcctgctggctgttggggagcacagcagtggtaactggtaaagctgcccaagattagggttcagttgtctgtttttttactccacgcctggtggtggtatagtctagcaagtccactgttgatggagagagagcacattcggtggctgaatatgttcttaggagcagggtgtctcaagaagagctgtggtttctatctggaggcctcacggtgattggaccagatgacttgagaaccccttagtcttgcattctgtgattctaggtaaaaacaatagatgcagcatagaaaaatgtgtgtgtgtgataccagataagctgggtaggggcagaagatattttacatctcaactaagaaccgcctagcagatgacatggaatatgtattagcatttaacatttaaaaaatactgtgcgttcaatgagatgaattaattctgaagcttttcccgcagatgtattcaaggcagactgaaacaggaatcttgctatcattttttttggcagaggcatctgtcagattctccttccttaggtttctctgcttctctaggactgggccttcgcaaaaaaaaaaacaaacaaaaaaactatatagctttgtttaaggttatcacttaaggcctcctggcattttatatcctgtctcttacaggatgcttggaattgaatatgcaagtataatatacaatgtcaacatggcttgtatgtacaacatagaaactgctctcccaccccaccccacatcactgctgccatcctctctagaggagattctttccctgagcattcacctggtgtgggatcacaggactgagctgcagggattgatgtgtctcagttaaagccgcttctttcttcacccagggaagtgatgcccccttagtaaatctactgaattactcagaattcagtagattctgagtctgtggttgtttctgtgcacagtgcctggagattcacacaactgcactttcacaatcccagatcccctgtaaggaggcccccaaaacatcagtgcttcctcagaccgaggggcctcagctgtcctcacaggcctggtttgctgtgctgtgtgcctaaccttgcccttccctgctccctgcactgatgcttccttgctataccttgtctcatctgtgtagattgtaaatggacattaagtggttgagggagatgtgaatgagggtggtatgaaggcatgggagccccaccaggtccaaaacccattggcgttttctgacgacgaggaggaagacctgctggatttcatgtacaagtataaagcacctcgaaggatggaattgcccctggaggtacacagtgtctggggctgtgggttggagtgtgtttgtccaaaggctatgccctggagattgggggtcctgggagcagcatctcttggggcaccaacatctcctcaatacctggggtggaaagatctccttccatcaaacaagcagaaccagtcactggatagcatccagctacttgccaaggagaggaaatcctattaatttcatttagaaataggagcgtgagccgggtgcagtggcttatgcctgtaatcccagcactttgggaggccgaggcaggtggatcacctgaggtcaggagttcgagaccagcctggccaacatggcaaaaccccttatctactgaaaatacaaaaattagccgggtgtagtggcgcgcacctgtagtcccagctgcttgggaaactgaggcaggagactcgcttgaacccaggaggaggaggttgcagtgagactgcactgctgcactccagccgggatgacacagcgagactccttctcaaaaaaaaaaaaaaaaagaaaagaaaaacaaataggagagtggtaaagtatctaggtctttattgttttgttttggtttttccaggtattaacaactaccactctaagttgacgtacaagtgaaaaacaacccaaattgactgttttgggggaagaaaactcagaatgtgttatttgaaaagtttttataaataagaacaaggcttgttcatcgctgtatctccaagacacagcatatagtgcctggtataaagtagctattcatgaaatgttagtgaaggggtatagccctttagggttaccaaaaccaatacccttgacatatatgctattttcagttgtaggatgtggatggagttctggcagcaggagggctgagcctggagcctcctgggccttgctctgtgatgtgggtagggagtcaccagtcatgagcacaggtgcagggaccccagtctttctctctgcttcctaaggtctcctctcctattccccatctgctgagtatcacggcctgagaggccatctgaagcaaataggaagtctccgtacagacccttgtgagacttatatggggagatgccttgaaatgttcccttctgcagacactgagcagcctagcattcttatttgttaggactgtaattatgaccacctccatgtgcagttcatcaggttcctttgcaaggtgaggcacacatgcatcccttttaaagttagagggtttgggaaaggatgttctgggcttggacactgctggaggagtctggcctgggcaatctggcctgggcagcctcctgatggggagaggagcccagcctaaagaattctaaggcccaagggtttgtgctgttttgcttttgtttattaaagctgcacaaactgctttactgtttacagttcaccagcctgccaagaggcagattactataaaggtgggttccgttgtttccgttttcagtgtctgtccagaggtggctggtaagcatttcctagtggtaaggctgtagcatgaggactctatgagagggcctgagtcttgttttctggctcattcacttcctgccttgtatgtgcctgcccagcactgagccacttaccaggaaatggtggtgaatgcgacatgggcctgccctcaggaagtccccagtctggtggggagagagtgagcagggcccccacacactcccttcccactgggtgcaaagtcctctgctgggggacatgtacaaaacatgagagaacaaaggaggtgacgatgcctggttgtgcatggctgggcagtggcaggaggggctccgggaaacctttgcagaagtgacttttgagctgggtcctcaagaggcctagaaatatgcaagacagaggagggagggaagggcttccagtcagaaggaatagaggcatgaatgggcacagtgtagagaaagaagttctctgtgtatacagagaagtggacagacacgggggccaagggtaggttggggccagttgtgtgaaccccctcaagtgctgtgccagaaaatgttcccttcactttcattgaaataggaactcctcctgtgatctgtgtatcccatggaaggaggggtctcttgagagtcatttgtgggagagatgaggtggagcccttcatataagttgagcatccctaatcgaaaaatctgaaattctttgagtgtggacaagacgcacaaaggtcatgctcataggagcattttgaatctcagattttcagattggggtgctcaattggaatgtatatgcaaacatcccaaaatctgaaaaaaaaaaaaaaaaaatctgaaatcccaaacacttctgactccaggcatttccggataagggatattcaacctgtacttcaaggtggtgtttgcctttgtggtgtggtgtgctgtacattaagaggtttctcatccagaaaggggactggaaatttgatgatggaaatttgaggcatgtaccaaaacacattaggctggttcccaaaggaaataacaaaagcaaaggaagcatgcggaggtgtctctttctgctgaatcatttaagataattttgctcctcaggcagaaacaagaaagatgtgtcattctgcacaaccgttcccttgggagattgaggagcataatttaagagggaggcatcagcctctcaaagggctcagcttcatgcgatatgtgggatgggactctgatgattgcttcctgttgcggagattcagggagaccccagccctagccagctgcatttggccaaaggagctggaagtctcaacacaatgccttccaggtgctgacctcaaaagatcccacatttacaccaaactgagggacacctttctgttttctctaccaggcaccgcctagaatccttcgatctcgcttcaggaagaaaagtacctcatcctcggccaccgaaaccacgtgagtgagatgagccaacagcaccggatccacagaatgtttcttctctgccttaaagagctattcactaataacatagaaatccgcaagctgggtgtgctttgagtgtgcagcctcacaaacatggccttttctctctccccttccacttttaaggatttatttttttcccccttttctttattttgctggggagaggctaaagggaaaggtagtaggggcgggggtggtgacctttaagtcttctgaggttggtaattttccacaattggattgtcattatagacagcagtgtgttttttagaaagataagagaatcacccctatgctgctgagatgtacatttgtaatttatctgttgcatacttagtttttagtcctgtaaatgcaaacacagcattttttacaactttctttgttcttggtacttatactttgaactatgatgtacatatttatggcttttggcttttaatataatggacttgcaagggctgccagaggttctgatatgtaagaaaactgcaaaaacaaatatagacaaatattttgattctagagaacgtctcagatgtgcttataaagcttccaaatacaactccagtaagacatccctttccctgcaggagtgtggtctatattctttagatagttgtttagtcaaaagaccagacaagttacaaactaagagaaacaatatttcacaacacagtaaagtgtgatgagaggtcaggggaacatcccagtaaaagagaagagtcacaggaagctcatctcctccctggattctggattaggagcttctgaatcttttccagggataggcaggtagctcactcttggtgcaatttcttgaggatgggaacatgtagagctgctggaaggagtaattctgtgcttgacaaaggacgatttctcctttatcgtgaccagtgctgccgatttcctgacagaggagcttacactctgagcaccttgttttagcgaactctagcaaaacttgtttagcttagcaaaaacaaacacacaaaaaactgagaactctgctgtttcagatatgccataacatacatctgaaacacatgtgtaacaatcaaaatggtgggctctagaatggttttggagctcgagatcttcatgggttagacttgctggtcagacccaggagcacctgtggctcacaccttctgttcccctcctggcctgtgcagaatgtaaacagcagactcatactcaatgggcactacaggccttatcagacgttttatacaagcctggattgcttagtaggggaataaggcattctctgagggggctttccacttagattgagaattttatttgaaaagaatctggtttaaatggcattgtggtccgaggtagctgctctccccactgagagctgagccgaaatataagaataatatatttgtgcttcgagttggtgtttctttcagtgtaatgcatgcagtggtcacaacccagttactcataatatttggattgtatttgttcgtagatatgcccagaagactagagaattagtgttatataccatatagaacttactgtcagtcaactataaacaggcccaattaaaaactgttccattactacgcaaacacatattagaggcctttgctgatgacacattagctggatcttagccaccccagaaagggtttgatttgaagctgattgttgccagatatgcatattggaatcccatctacccatagttcctctgaaggtgattttgtaatttgcaaaagggtataggaaaatatacctaaaagcgaatttgtggctgagaggataaacagaagctgtttgctcatgttctgtgccccacacccaccaatacctaaatctgttaaggaagacagaaaatgttttctttgtgctcattgagtagttccagacagaagaagaatatactctttaaaatgtatttacctgttagttggaagtacccagaattatcagaaacgaatgcaaaaaaaaaaaaaaaaaaaaaaagcttacacagcttcttagcaatttttttttttttgccgaaacaataaattgcctttagcagcagtttaaaatcctatcgtgaacaacctatattttcgccattttacaatggagagttgtgacaagtacaggttatcaagtttgcacttaactatgccaaaaaaagtttgaagcgctctattctcagacatgctgtattattacttctcattcaagattgaaaaatataaaggtatccaaactctgtcttaatgtaaatgtaactatttttccttcaagtgttgactagggagtcggtttctctcttaaagacactcactgtacaactgaaagcagctgtcatatttctggcaaaatgtgtttacgtatctgacaagttgtacatttgtgtatgaactgacataaaatgtgaaagcctgtaagtgtacatgtagtggtgtggtgttctgtctagaggatacaactgaatgtttttaatttgctgacttacagacacaggctgtttacaaaatgctagctggaaagtctgtaatgttcatgtcataacttttagttaattgccattgagcacctgttctgaggaggtgagatgtggacttgtgcttataaactggagagtttagtcataatccctcctggctttgtgtgaatagcttgctcactttgctggcctttgaaatgtgttctccgtgataagctatccatgtgtttgtgataagagtgcttgtcaaccatgaccatctttgagccttcctagtcctccacctggcacagtatttgaaatggcaaaggatgtgcttcatcctctaacagtgtacactcccagagctgatattctggattttgactgtgcacatttcctctagttcatgtctgtagtccctatagaatgatctgtaataaaatagtatactggactgtgcatcaaagggatgtaaaattacagtattccaaaggttgaagttctgctgttttgttataatgcctgatacacatcttgaataaagtcttaacatttttctttt

SEQ ID NO: 36588 - DNA, 2847 bp, Homo sapiens
gcagcacccgccctgcgcctcggtggcagccgtccacgccgtcagtgcctggcggttcccgtgggacataccgtccactcgccacgcccctccgcccgcggcgcaccccacgcaccgtgccctggccgcccgcctcacgcaccgctttcctctccgtccagcgctcgctgcagccgggccgtctcgcagtccagcgtgctggccagagaccgcagcttcccgcagaagctccggatagggtccatgctgagcacagcggggaaggactccaggcgtacgcagaccccaccgctcagctcacagcctcccgccactagtttgaatctcggcgccggacgcgtcctcggctctgcgcaggcgcagtcctctctcgcgagagccgaagtctctcgccgaggccccaggagaccccgcgagacgggtgcgcttacgccacggcgtctgctggcggccgcggagacgcagagtcttgagcagcgcggcaggtgagtagctgtgcgaattcggttctctagggagctccttcttcgcctgctggccttacctgggctccccgcttctctggaggggaggcggtgcgggaactcccgtaggcgtgagctggagcgcgcgcccgctgctctctccaggtccggccgcgccagttcgcctccgcaaagcccgtccctctcttccgcaggcaccatgttcctgactgcgctcctctggcgcggccgcattcccggccgtcagtggatcgggaagcaccggcggccgcggttcgtgtcgttgcgcgccaagcagaacatgatccgccgcctggagatcgaggcggagaaccattactggctgagcatgccctacatgacccgggagcaggagcgcggccacgccgcggtgcgcaggagggaggccttcgaggccataaaggcggccgccacttccaagttccccccgcatagattcattgcggaccagctcgaccatctcaatgtcaccaagaaatggtcctaatcctgagtcgtcacccttggattttatggatcacggagctgaccatctttacctggtcctggaactgaaaaactgtagcttgtgtgaaaatgagcctttggaccagtctttattaaaacaaacaaacatgagtagtctgcatatcgaatatctagagctctaaacccccaatacttaaaagtctaattgctgtcctgtggtttcattagtctgataggaagatagggatttcctcagtcacagatgatattttgaaggaaagctgcaataaagccacaatgatttgaggtctttgcttaagtatgagatacttgatgggggctttatcatgcaacattagtttgcttaccttaagaattgcccaaaaatgaaagaaaatatgagcttttcagttaaacatactcctaaaaacattttccgggattttactactaaaattggacatttaagcgaagtaaaagaggccgggtgcggtggctcacgcctgtaatcccaacactttaggagtccaaggcgggcggatcacttgaggtcaggagttcaagaccagcttggccaaggtgataaaacccgtctctactaatacaaaaaaaattagctgggtatgttggtgcaggcttgcaatcccagctacttgggacgctgaggtgggaggatcgcctgaacctcagaggcagaggttgcaatgaagcggaggttgcagtgagccgagagcatgccgctgcactccagcctgggagactgcatctcaaaaaagaaaaataaacgaagtaaaagatatttatcagagctgttacaggaaggtgtattttttagctattttggcagggtgctgtggtgcttgcatgtagtcccagctattcaggaatattgcttgagtccagcttgggcaacatagcgagaccctatctaaaataacaataatatatggccaggcgggatggctcacgcctgtaatcccagcactttgggaggctgaggcgggcagatcacttgaggccaggagttcaagaccagcccaaccaacatggtgaaaccctgtctccactgaaaatacataaaattagccgggtgcagtggtgaggcctgtaatcccagctactcaggaggctgaggcaggagaatcgcttgcacccaggaggtggaggctgcagtaagtcgagattgtgtcactgcactctagcctgggcgacagaaaaagaaaatttaggtggggaaaaaaatcagaattgcgtctgtgggaacaggaataaaggagaaaccactattgactgggaagacacacaaagaactttgtcaaagttgtatggctgaggcccacacggtggctcacttctgtaatcccatcactttgggaggcttaggcagaaggatcacctgagatcaggagttccagaccagcctggccaacatggcgaaaccccatctctactaaaaatacaaaaattagccgggcgtggtggcttacgcctgtaatcccagcactttgggaggccaaggtgggcggatcacaaggtcaggagttcgagaccagcctggccaatatggtgaaaccccatctctactaaaaatataaaaatcagcaaaaaaaatttagccaggcttggtcatgcatgcctgtaatcctagctactgggaaggctgaggaaggagaattgcttgaacccaggtggtggaggttgcagtgagctgagatcgtgccactgctctccagcctgcatgacgggagtgagacaccatctcaaaaaatacatataataatataaataaaaatatcttttttgaaaataatttaatataccatgtaatttaccagttgaagatgttcgctttcagaatataataaaaatagtc

SEQ ID NO: 36589 - DNA, 2847 bp, Homo sapiens; identical to SEQ ID NO: 36588

SEQ ID NO: 36590 - DNA, 125252 bp, Homo sapiens
gacagataccctccttccggccgcgccactcgggaggcggatcccgtgggcctgaggaggcttcccccgcccggtttgctttccctccctcgctggcgctgccgcgagtccaccgagcggcctctgaggagcagccgcaggaggaggaggaggtcgtcgggggcggcgggcggagaccgcgctctcgcttccccggcggcggcaagggcaggacaatggaggtggcggtggagaaggcggtggcggcggcggcagcggcctcggctgcggcctccggggggccctcggcggcgccgagcggggagaacgaggccgagagtcggcagggcccggactcggagcgcggcggcgaggcggcccggctcaacctgttggacacttgcgccgtgtgccaccagaacatccagagccgggcgcccaagctgctgccctgcctgcactctttctgccagcgctgcctgcccgcgccccagcgctacctcatgctgcccgcgcccatgctgggctcggccgagaccccgccacccgtccctgcccccggctcgccggtcagcggctcgtcgccgttcgccacccaaggtgagaaccggccgcggccgctggggagcccggggagagggccaggagggggcgggcgcccttgtgcggcgcgacccgctgtcatgtcgccgccgcccggggtgcgcggcgggggaggggcgagcaggagggtctgtgctggcgacggtgacatggagggcccgcgctctgcggcgtgtcgcgctcggccagcaacttccccgggcgctgtggacttgaccgcgccgccgccgccgccgctgctccgcattctcaacagccgggcggcccctgccactcgcacttttgcagacctctgtcggagtctcctgcagccggaatctcgggttctttgccggctgcagccagttaactgctacccgcccgctgcctccacaaagctttgtccaggtccatatgatcctgatcatctcgtctatactcacgttatttgagctgcaggggagaagggagggatgaagatgaagtgatggtgactttctttgatgattgattgcagatcggatgtcatttatttcttatcttgcatgtttggggctctttaccttaatgagttcccagttctcttccctctcctctgctggggacaaaggaaccaagagacgttgttttgttgtgtgtctctttcaaaggttttattttgagacggcgaagagaaataatacaaagtgatttgggttttctggtattttatagataaagctggaagttactgttctctttgtggtgtttattactgtaaaattagacttttgacaggtgttccattgctaactttgacaggtttgaaacatttaaagtaagtttgagtacagtttcgggtagaacacttggcggtttttaaattttattattgcaaatatttgagcacctcctttttaaaaatacagtgtaactggaaaagcatttttaatactttttagaggaaatagttgatttagtttgaaataaaatgctaattaagtaattatgctaggtcaaggggcgtatgaaatggatacttcaaatagattgtgggctgagactcatttatttgactgcatgttaggagcagtatccacttgtaggagacagttttccgtgggtctccgtttcttcactcttgccagcacccttgccagcgagatactgactgccctttgtttctattttttcacggatattatctaaagagcagccttggaagatagagatagtgtcttccaccagagcaaaaggcggggatacatattatccagtataataagaataacgtctccctctggagcgaaagggtaggcatgcttactgcccatcttaaaagattagggttccctaagcttagggttcctctcctgtagagaaggaactgcctgtgtagatgtcaactggctctctttacgttgtccaatgggaacctggagttctgagaactagtgcaaaaatcttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggccaaaaatcttgatgatgctttggcttatgctgttcctgtgagtaaaaaacaaactgccctgtgtctctgacccttgaatgtcttctgtcaccatccatgaaactggtaaggttatttgttagcttgcaggttggacactctcagatccttcgcagtagtttgctctgaagaggcccacgactggaaagttcgaacaggtgaaagcttaaaccttagttcttatttatttatttatttattttttttttgagacggagtctcgctcttcttgcccaggctggagtgcagtggtgcgatcttggctcaccgcaacctctgcctcctaggttcaagcgattgtcctgtctcagcctcccgagtagctgggattacaggcatgcgccaccacgtccggctaattttgtgttttttttttttttttttttttttttggtagaggcggggttactccatgttggtcaggctggtcttgaactcccgacctcaggtgatccgcccaccttggcttcccaaagtgctgggattacaagtgtgagccaccgcacctggcctgttcttatttcttagacacagtttaaggttggtttttccttccttccttccttctttcctgcgttcttaccttcctaccttcttaccttcctacctcgctttgtcgttcaggctggagtgcagtggcacaatctcagctcactgcaacctctgcctccctggttcaagcgattcttgtgcctcagctgggcgccacacctggctaatttgtgttttgttttagtagagacggagttttgccatgttggccaggctggtctcgaacttctgacctcaggtgatccacctgccacagcctctgtaggtgctgggattacaggtgtgagccaccccacccgtcctcttccatttatattttaaatggttaaacaggcttgtagccaattaagatctgaattgtgcatgattatagaattatgacatattgtttgcctggccatgacatatggacttgaattaatgagaacatgggtcgtaaagttatcatcctcaattctgagacaagtttgtgattccatacttctcaaaatgttctgtgtaattacaatctgaatattttttatctttatgctgtattgtacgcaagagttcaaagaaagcgtttaaattggaagatgtttttgtttttatactaggaaaaacgttttaacaaattgtacttaaaagtacacctaaaaagaattaaagttatctttaaaaaattaaaaatgctatcctgagtcttagtgacttgggtattttgtccctttatctctccttgcatacttattttaatactagctgaagcaaaaatttagactttttttttttttttttttttttgagacggagtctcgctctgtcgcccgggctggagtgcagtggtgcgatctcggctcactgctagctctgcctcccgggttcaggccattctcctgcctcagcctcctgagtagctgggactacaggaacatgccaccacgcccggctaatttttttatattttttagtagagacggggtttcaccgtgttagccaggatggtctcgatctcctgaccttgtgatccgcctgccttggcccccagaagtgctgggattacaggtgtgagccaccgcagccagccaaatttagacattgcttaactaaataacgggttcatttgatcaaaccagttcttcattttcctactgaatttgtgagtacaggcatcacaagtcaagtaatatctattacacaaaggttaaataggtagttgggatggagaactgtgtgagccttggggtaaaatggtaggaaatgatggggagtacaagcaggggggcagactcttcttagctatagcaatttgtcatgtgagtgcagggcaagtattgaaggatcttttatttatttaatgcaaattctgaatctggatttttgaacaaaatttttctagtattagatattgtcaactaattaaaaatgtgtgaatatttatacacataaatatatatacacacacacaattaatttatgggcccatgctataggccaaacaataggtttgttgaggccaaatatgttatatttcatacactttttagatttcaaaaactggagattttcaaactttaacaccactaaactttaacacctaaaaaaaatttagatttttaggcccctccctcctgaaaatctgattctacctaatctggcgtagttgcagaatgctagggtataatacagttacactctagaattgtttctttaatgcaagcagtattctaaaactgtttcagatctagtttccctttctataaaatacttttcatgctctctttgtcatcctaaatgaatttcatggggaaaaaaaatcctaacacatttttcttacaaaagtaaacataatgtttgaactgttttaaaggagaaataaaatgaagcaaataacagcagaaaagtataatttataaatgctcagatacaattacactggccaccaagctcccattgagaacatttgttttaaaacttcggtttaactgtccttttttctcaggctacatgttggaaggaatgagggtgaatgaccacaagttaaaattggatgactccttcagtcttgactgtcattttcttagtatgcagttatatctaggagagaggcaaaactttaggaaatggattttcttttacgtatgttaagaaaacaaactgatcttagagaaatgttataatattgtgtagtattttgtgttgttaacgtactgttcagctaatgagtagcaaactgggagtttgagagcagttttttcctctctacctaaaagacaatattgaagagctatttttaacaaatactgagaacatacttttgaaaggtattatttgtctagagagggttaaaatataagactaaatcccttttccaagatttctttactaactggcagtatacaagatacgtaactattctgggactgatttcttggcaaaaagtataaatcatctcatgagtgcaatctttaatggcaaaggattaatatttaagaatgatctgtgttacctgtcagtcctatatatataaaaatatacatatttttattcacctgttagtaggtatcagtattttttagtttggagctattatgaataaaacttaaaggtatttgtagaaaagtcttggtgtggatacattgtcatttccctgaggaaataacttagaattggaatttcttgtttttatgataaatgtatgtttacactgcttgtactactttatagaccctccagcagttctctccaaagtttgttcacactctccccagttttgggtattgtctttaaaagttttttttgtttttgtttttgagacggagtctcactctgtcgcccaggctggagtgcagtggtgccatcttggctcactgcaacctccacctccagggttcaggcgattctcctgcctcagcctcccaagcagctgggattacactacacctggctaatttttttgtatttttagtagagacagggtttcaccatgttggccaggctggtcttgaactcttgacctcaggtgatccacccgcctcggcctcccgaagtgctgggattacaggcgtgagccactgtgcctggcctgtcagtctgttaaattttaaccattctagtaggtgagaaaagctatctcatggttttggttttcatttctctgatgaataatgatgagcatcttttcttgtgcttagtagtcattcttttttggtgagattttggtttgtcttttgcaaatttcaaaacttaagttgcttttttttttttttttttggagacagcatctcactgtgttgcccatactggagtgcagtggcgccatctcagcccactgcaacctccgccatgttgctcaggctggtctctcaactcctgagctcaagtgatcacccatctcgtctcccaaagtgctgggattatgggcgtgagccaccacgcctggctgggagtttgcctttttattgaaacgtaaagttctttatatatattctatatctaggtcctttgtcagatacatgtattgcaggtattgactctggcttgcatgctcattttcttggtgtcttttgaagagctaaaggtttaaattttgattaagtctggtttatcaatttattttatggttaatgacttttgtgtcctatctaacaattttttgcctaccccaagtttactaagattttctccactttttaacccagcatttttatagttttagctttaaaatataaacctgtaatccattttgtgagttattttttgtgtgaggttgaggttcatttttttaaaaactgtatgttaaaacaccatttattaaagacagtactttttcattatattattttggcatttttatacaaaaatcagccatctgtgtgtggtctgttctttattgatttgtccattcagctaatacataatgttttttgattacagtactcttctcagcaaattttgaaatttgacagtttgttctttttcaaaattcttatgattctttgaagtcatttgcatttctttacattttagaatcagcttttcagtttctacacaaaagtctgtcatggttttgattggaattacattgaatctagatatcaatttgggtaagggggaatgtgttttgttttgttttgttttgttttgtttttttgagatgagtcttgctctgttaccaggctggagtgcagtaatgtgatctctgctcactgcaacctccgcctcccaggttcaagtgattctcctgcctcagcctcctgagtagctgggactataggcatgcgccactacgcccagctgatttttgtattttttagtagagacggggtttcaccatgttggccaggatggtctcgatctcttgacctggtgatctgcccgcctcggcctcccaaagtgctgatattgacaggcgtgagccactgcacccagccataatgttcttaacaatattggttcttccaatctgtgaatatgtgttatctcttaaattctcggcactgtcttgtggttttcattgtagcattcttgtacaatttttgtttacatagtataaatattaaacattttataatgttaaatgatatcgtatatgatatttttaaaattttcatttcaaactgttggtagtatattgaaatacgattattggtttcatcccattatcttgctaaattcgattattaagtatcttttttttttgtttcaaggactccttaggattttctatgtagtctacagggagatagctttacttcttgctttctattcttaataatttatgtcttcttattgcaccagcaaggactccaatacaatattgactagaagttgaatttcagtattaaatgagaaaggatttccttaccttattcctcatcttaggaggaaaacactcaatttttcaccattaatatgttagctgttttctatagatgcccattatcaaaatgaagaagttcccttctatttttaatatgctgagaatttttattatgaatgggtgatgaattttgccatgtacttttcctgtgtctattgaaatggtcatgcaatttgtctcctttttttgttaatgtatgaattacgttgatttttagatgttaaatcaatcttgcattcttgagatatacctcacttggttttgctacaggtattttgaagcttttatgaattgcctgcccttttttaaggtgaaatgttctttgcttcctataatgctatgttatggtctactttgcctgatattaatgccattgtttttttaatctatgtgtttgaatggtatatttttcccatgcttttacttctagctttttaaagtatctcgtagatagcgtatagttgtcttacttttttatcccagcttttaatttttgcttttgtttaatccatttatattttatgtaattgttggtatggcaaggtttaagactgacatctttttatttgttttctctttgttcctgcttggcctccagtatctttgcttctctctcaatcccttagcagctgctctctggtaaacttcccatggacttgctctgcacatgcgtagtagccttcagccaaggacttggcaaaacccttacatagactactggcaccctttctctgttcagctcccttctcccaagtgctttgccctatatattccatctggttcacaatccccgaatctctctggctcctttgctatgttctgcattggctgtagctccatgaaccatgatcacaaaatagtcctcagttagggaatcaagatttagggggcttattcacctgagcttttctttcctcatggatcacagtactgcattgccttttgtccattgtctgaaaagttgcctaaggtatctgtcctggtaatatacagtaattaatgacaggaaagcttgtctcagtactagttactctattcctggtggaaaactgatgtcagaagaatgctttttaatttcattgtacctttttaaatatacccaaatgtgggtaatttgtaaactttcatttttaggtctctagatttctctgtttaatttttcttcaagaagttaaactatcaactagatgcacaagtttttcaaatttctttctgcaatgtaaccttgacccctttctcaatttttttttttttttttgagacagtgtctcgtgcagtggccatcttggctcactgcaacctccacctccccggttcaaacaattctcctgcgtcagcctcccaagtagctgagattacaggcacacaccaccacaccttgctaatttttttgtatttttagtacagacgggattttaccctgttggccttgaactgctgacctcaggtaatccacctgcctcagcctcccaaagtgctgggattacaggtgtgagctgccgagccctttcttaattttactccagcattttgaatacacacttagaccagtagtctccaaaatggcatgactaagtgccattatattttattctgtaatgtggtgtggcacaccacatatgcaataaaatatccattcaggtgagggaagacattagaacttcttttcagaaattgagctttaaagtacttgatatatagtttgtcacagtcacatgaataagcatgtcaaatggctacatttcacatatgctgtatggagtatcctgagagaagggattaaggctgcctcaagcccaaatggtatttgtgtgagttagaaattaagagtcctcttgacatacaggaccaaaggatgtgtgccttaggaagtggaatgtggacccccatttgcctgtaagtctacatttcccctccagtcaggcagttccttgtactgtataacctatcttaactgtacacagctgccctagaggtcatgggatttcgatactgcagactctgttgtttgtttttgcctcctacaagtataattttttttttttttttttttttttttgagatggagtctctctctgtcaccaggctggagtgcagtggtgtgatcttggctcactgcaacctctgcctcctgggttcaggcgatcctcctgcctcagcctcccaagtagctgggagcataggcgtgtgccaccacacccagctagtttttgtgtttttagtagagacagggtttcactatgttggtcaggatggtctcaatctcttgatctgcccacctcggcctcccaaagtgctgggattacagatgcgagccatcgcgcccagtctttgtaacataattttatatgtacttgtaaaaataggtttatgggttttaatatctgtttttaactaaatgtctgtcaaaaaatagaagattatggtaggccattaccaggcctctggcataaaacccttaatctcatttcctagggaagtcccatatggaggctgctcacaaaagccccttaatttcagcagtttgggaagtccctaagttgtaggatatagggtacatgtataataaccttaaaaagtgatcgcttgtttcaattaacgacagagacagttccatttaagtctgtaacttcaccagtgttgtatagatggatgtatacctgtcattcttgggacctgaatatgcaattagctgacaaggggattagctggcaaggagatccctgtcctatagaaagctgtagctgttactgtctcaattttgtgtttcatgttatcagtgtgtggagttgatggagctttaatttttcaccagctttaaattatttgaatcttagaagtcttattttcagttatgataaagatagtactcctttgcaggtagaataacattaaagtggcagagctggcactttataggctcttatcagttttattgtgaggttaacaactgattatctaaccagatctaacaagaagtgggcctaaaagttcaaaattaacaagattactctttgaaattgactgacatcctccattacaaatgatggaccatgcattaagtgtatactgcatctgaaagcattagttgacaatagtgtgaagctatcttgattagcaaaacatttaaaaatatttatttcatcttgattttattccttatatgttttacgctaatatgatttattatgtataggatgtactagcactgtagtatatgtacagtacatgttcaaatatttgtgtctaaaataaacataactattatctgaattgcctcaatatttttgcttttcatctagtctttcaaaacctttttcaaatgccatatcctctttgacattatgaaaccaccttatttctcaaaggactttcttctgattttttttctaatataaataatctataggttctcatctcatagtataataaatttatttttattttatttatttatttatttattttgagacagagtctcactctgtcatccaggctggagtgcagtggtgcaatcttggctcactgcaacctctgtctcctgggttcaagtgattctcatgcctcagcctccccaacagctgggattacaggtgcgcgccaccacagttggctaatttttgtatttttagtagagatggggtttcgccatgttggccaggctggtttcaaactcctcacctcaggtgatccgcctgcctcagcctctcaaagtgctgggattacaggcatgagccaccgcacccggcctggtataatacatttaaaagaaaaatgtcttctataggaattaggaatcctgactaccagaagatctttattttattttgattataggtgaagagtctcccttatatctcttaccaaaggcagcagtgttttacagggtcatgctcctcctgcaaggtcaagtaagagaagactaaaaaaagaaaaaaaaccaaccatggaaaagcatataggtggagagatagatagtgaaagccagattggggtaggttaaacaatgagagggagatgaaaagacatagttggaaagtttagacaactctgaagtggggaggaatgggataaggtaatacttaaggggagaaaaaaaataaaaagttgaggaaggtttctcactttctttttatataaatcaggcttaaaaacatttaaatggacatggaaaggatccacgagaactactgaatttataaaaaaaaaaaaagatttggtgaggcttctgagaaagcagaaaggcattgatctgaggcatgggtagagattggtgactttggataggagacacactttctcttgtgaataggagagaaggtaagaataggtgctaaatacaggtgtgtgtgtcctcaaaatgggtggaatttctgtattctgagccccccactgatttctcccttaaatagaaagtgaggtcgtctgctgagaatgagagggtaacaggagtggaacaaggttgagaagggagttttgaagttgaccaataaaatgtagtgttagtgcaggttgtgttgaggcttgtttggtgctaaagaccatgaattaacaacgatacctatctgtcttcttatagtgctatctagtgcctttttgaagcagggtattttagggcagtgctactcaaggcatgagctgcgaactattagggtctgaaacaagataaggacattgccacagaatgttgaccagtgtactgcttccttcatccagctgaactaaatgtcagctgaactaaatgatcttggttggtttacattctgacacaagctcttaaaaaaattttttttttaaatagaaacagggtctcactttgttagtcaggttgaactcctggactcaagcagttctcctgccttggcctcccattcaatcccttacgatggttaataattccttatgttggctgggtgcgttggctcatgcctgtaatcccaacactttgggaggctgaggcaggcgggttacctgaggtcaggagttcgagaccagtctggccaacatggtgaaaccctgtctctactaaaattacaaaaattaaccaggcgtggtggcatgtgcctgtagttccagctactcgggaggctgaggcaggagaattgcttgaacccaggaggcggaggctgcagttagcctagatcatgccactgcactccagcctgggtgacagaacgagactctgtctcaaaaaaatgataataataattccttaagttaaacttcatttcaaattaatgtgtggtttctctctacttactgtatgcagactgatgcatcattttgggcaacagtgatttgtctttttcaatgccttacattaagaaacacatgattgtctttctgtcccgttgttagtgttggccttgatcacttgtttaaggtggtgactgccagatttctccactctaaagctatctcctcctctccttttgtaattaacaaataaccttttaggagatactttggagtctgtgtgaatattctgttccaaaaaaacttagattggcatccactgatttcttgcctttatcagctattactgtgatagtacaaaatggtttttctatcactgtatgcttactagttgatagtctgctgtatggataaccattttcttttccatttatctatcatggacttatgaaatattttagtcagtatgttatagccattcctttctttacttcttttgacaatcaaattgcccaaatttggacaatagaaacctcttaaagttgacagtcatggctcactacagccttaaccttccaggcctgagccatcctcccacctcagcctcccaagtagctggcaccacaggaatctaccaccatacctggctaatttttatttttattgtagagacgggatctccctacattgctcagtctggtcttggacttctgagctcaagtgatcctcctgccttggcctcccaaagtgctaggattacaggcatgagccatggcacccagttgagcacttttttatttcctggcaaaataagaatttctagatttatcttgtactttttctttttttttttttttgagacggagtcttgctgtatcacccaggctggagtgcagtggcgctatctcagctcactgcaaactctgcctcccgggttcacgccattctcctgcctcagcctcccaagtagctgggactacaggcgtccgctactgcgcccagctaattttttgtatttttagtagagacggggtttcaccatgttagccaggatggtctctatctcctgacctcgtgatctacccgcctcagcctcccaaagtgctgggattacaggtgtgagccaccgcgcccggcctatcttgtactttttctatgccagctctccaaggagccccaattccttattttggtgaaatccagtttatcttttatggattattcttttgtgccatatttaagaaatctttgtctaacacaggtattttatcctgttttcttcttggaagtcccatagttttgaggtttacatttaggtctatgatccattttgagttaatgttggtatgtggtatgagatatggatccaagttcattttatacatggatatgcagtttttctagcattgttgttagaggactgtcctttctccactgcattgtcattgtcaaaaatcagttgtccgtgcatgtctgtgtttatttctggactctcttctgttccattggtctttttgtttatctttacactaatatcatgctgttgagtctgtattaaagccaagagatcttatgtcaggaaaacaatagggaagatgttctgcaggaaatccttgtgtctaactgtagaactaaatttagtgacagagaaaaggggtgacaaagtagtatatacttgttatgcaccctaacaatgtaggtataatacagttattcaagagtataagggatatcatttatgtgaatacttcctgaggaagctgttagagaattaagtttcagacagccaagaaatggtttaataggctcattgattgattgttttataaaacttaaccagggcatcaagagatattactactttaaatagatgctgtgtgttgtggtatgggaatggtgaggggggaagaatggagctaatttctatgttgcttatactagggaatcaaaagatagtatctaacaaagagaggacttaaggatattatataaagataaccattaggacaaaagcccaaacctttctagatagcaaaagaagtattggcagggggaaggaggtggtgggaagggtacagaaaggagagcaaaagaaacaaatacaatgaaattatatattctcactgtgacagaattgagaccatatagtgatattagtaaatgggcttaactggcctattaagagaaaaaatatttttgggttaacatagcaaaatccaactctgtggttttgttttctttcgttgctgttttgagtctgagtcttgctctctcgccctggctatagtgcagtggtgtgatctcactgcaacctccagggttcaggcaattctcctgcctcagcctcccaagcagctgggactacaggagcgatgcaccatacccagctaattttggtattcttggtagagatgacgttttgccatgttggccaagctggtctcgaacacctggcctcagtgatccacccacctcagcatcccaaagtgttggaattacaggcgtgagccactgtgcctagcccaactctgtcttttatataaaagatacatctgcaaaatcgaaaaactcaaagattaggaggttgggcaaagatatgccagacaaatataataaaaaggggttattatagttattttgcgcaaggtaaaactcaggccagaaatcattaaagaggtaggacacattataaataatgctacaagctgcagtctgtaatgaagatacgttattgggtgcatggatattcatgacagctttcatttaaaaaaaagaagcttcaggagagtcattaagagttaggagcatattaataatagaagacctaaaatccatctcagttcaagatagatcaactggacaaaaacttcagtaaggctattgaggacctagattaacacaactgaaaggtagatcttagggtcatctattgcatataagagaatatacatttttgtaaatgcgcatgggatgctcatgaaagatgattattgaggtacaaagaaaactcttaaaaatttctcccaggccgggcgtggtggctcacgcctgtaatcccagcactttgggaggccaaggtgggtggatcatgaggtcaggagtccgagaccagcctgaccaacatggtgaaatcctgtctctactaaaaatacaaaaattagccgggcatggtggcgtgcgcctgtaatcccagttactcaggaggctgaggcaggagaaatgcttgaacctgggaggcggaggttgcagtgagctgagatcatgccactgcactccagcctgggcgacagagcgaggctccgtctcaaaaaaaaaaaaaaaaagaaattcccccaaaataggtacagcattatactttgacattatactttttgggtgaaactgaggaaaggaagataatccattatattgccggtgggaatgcagaatgctaaaactggaagggaatttggtaatatctagtaaaatgcaaatgcatttcctcattgacctggcaatctccacttctaggaatgtatctcagagatacaaatgcaaaataataaagtgaggcgtgcacagtgttatttgtctgtagcactgttgataataataaaagattgatatgaccaccaataaatgactggtggaataaactatggtatattactgtgccgatgtaaaaaaggaatgaaaaagatatgaatactgctgtggagtgaattccatgatgtactgttaagtagaaatcaaggtgcagaagaatgagtattatatgctaccctttgtgtctctgtgtgtgtgtgtgtttcttagctctatccactaaaaggatctaaagcaacagtatctccatgacaataagaaaaagagaaaatatgtgcttatatttacaaataaacaacggaggccaggcatggtggctcacacctgtaatcccacactttgggaggctgaggcaggagaactgcttgaacccaggaggcagaggttgcagtgagcggagatcaggccactgcactccagcctgggagacaaacagagactccacctcaaaaaacaaacaacagaagaataaataattaaaaatgactgctagcgaggcaagaaaaagttgggaaggaattagagaagaaaattagacctctgtaaatgtaactggttcacagtattgactttggaactatgtaaatgttttatgaaactgaacaaatataagtaactctccctgcttccccagcaaacaaaacaaatgaacgttgttctgtatcaaccagatagttttacctacatagtaaaggatttttgaaactgatttttaaatcacaatattgattgtgcattcctagtatgctatattgtaagcacaaaaaaacttatattgcattcagtggtgtgtttttagtggttatgttggtattttgaaactattcaggtttcatgtgaggtaaagcaagcagatacttgtggtaatatcattaggcatagaaattctcaggataatgatgaaggaaagctccaggatggcagcttgcagcaggcttgaaaaggtttggagctggatgaaggacttcatatttcagagaaggatacatttgagggcacaaatgtaaaactgtttgattagctgatatatttgaacatattgaaaagggtttgcagttctgtcggaaagtttgctgctgatttagtgataaatacttaaaaactaagcagatttttaaaatgcaggcaattgataattcgagaatgaaattgcttgagaaaggaaatactgtactatgctctgcacctcagttgtgaatattattaaatgtttataatatataaacatgttttatttatcagatttccaactaaaattataaatttgttggaaaactaatagaaataaatgtcaggaggataaggagggaaagattttttgatggggtcttacctacattttccactgtaaggctggacaggtaagccttgtggtttataaatcttggaatgttgtaatttaaaaagaaattggtttatgtactagtataattaaaggaaactgagaagtatattgattaatattataggtcagggtaaattattttgttttgggcacagtggttcatgcctgtaatcccagcactctggaaggctgaggcaggaggatcgcttgagactaattcaagaccagcctgagcagcatagcaaaaaccctgtctttttatttatttatttatttttgaggcagcatcttactctgcggcccaggctagagtgcagtagtgcaaacacagcttacttcagcctttatcccctgggctgaagtgatcctcctaccttagcctcttgagtagctgggacaacaggtgcatgctaccacacccagctagtttttgtttattttagaactcagggattcatgaatgggcagtatcagttgagcaagtggctcagtgctccaaagaaggggcaggagagggaaactttgataaggtgttcttggcatcaagacagtagaaagtacctagttagaggctagttggcagtttctgattcataaagtcactagaggttagttggtggtttctgattagttaagcttaagttcactttgagtttggtttctttttgcttaaataggaacccaaggtgctgtggccatctcagcatagtggccttccaattcattattttaatagggattaagaagactaaaagttaaggctccatccttgactttttaaaaaagcttaatcttcccttaacaaattctgtcaattctcctttctacatctcagaaatcggttgccttctttttatcttcatttcctgaggtcatttcagctgcttcctaattgtccttcctacctctgagggtgccttctcatttttgttgaagaggtctccccaccatgaactgaaaacttaggatgcttaagcttttcaaaaagtgtgagggaaacacatgtacaattaacatattaagtgaataattatataaccaccacttagatcaagaaacacacatagccagtaaccccaaaagttccttgtctgctatatttttatcactccttccctttcccttagaagttaaccgtttgtccaaccttttttttttcttcttcttcttctttttgacagggtcttgctctgtcacctaggccagagtgtagtggtgcaatcagggatcactgcagcctttatctgccaggttcaaatgatcctccagccgtagactcctgagtagctgggcgtgtgtcaccatgcctgaatgagacggagttttgctcttgttgcccaggctggagtgcagtggcgggatgttggctcaccgcaatctctgcctcctgggttcaagcaattctcctgcctcagcctcccaagtagctgggattacaggcatgtgacgcctggctaattttgtattttttagtagatatggggtttctccatgttggtcaggctggtctcgaactcccgatctcaggtgatctgcctgccttggcctcccaaagtgctgggattacaggcgtgccactgcgcccggcatttattttattttttaattttatttttttttgagacagagttttgctcttgttgcccagactggagtgcaatggtgcgagctcagctcactgcagcttctgcccccgggttcaagcgattctcccacctcagccttccaagcagctgggattacagacatgcgccaacacctccggctaatttttgtgtttttagtagagacagggtttcgccatgttggccaggctggtctcaaactcctgaactcaggtgatccactagcttcagcctcccaaagtgctgggattacaggtgtaagccaccgcacccgggccatgaattaagtttttaaatttttttttgtagtgacgaggtctcacttttacctaggctggtcttgaactcctgaggtcaagcagtcctaccacctcagtctcccaaagttctgggaatacaggcgtgaggcactgcacttggcctgccccacttttatgttaacaattccttcatttacgtaatggtgaatgctgtaacctagctttgtctgttttgggactttgtgtgaaaggaatggtgctggtgtattttatttcttcctatcttcatttaacattgaagggatcatccatgttgttgcatatagctatagtttattcatttttaatgctatataatactttgcacaaatataccacaattaaattttccattctgttattgctgtgtattggaaatgttgcctgttttttgctctttttaaagcaatgaagctattaacattcttgttaatatatcctgctgttcgtatatgtgagtcctgaggttttggtgtgtgggtgtttttttgttttgttttgtttttttaaatacggtaaggcagaattcctgatcatagagaaggtgaacgctcaagttaacttaccaactctcatatacccactagcagttcatgtatgttcctgttggctcagatgtagatgttcactaacattttgtattatcaatctttttattttttggcaacctcgtgggtgtttcctgttaacttattgggatctgagaagcttttcctaagtaccagttaggttgagcactttccatatccatcatttagatttcagctattgtgaagcacttgtttgagtctctcctattttttctttttgttgggttatttaaactttttttttcattttttaaaaagttattattattattattttttaagacagagtttcactcttgttgctcaggctggagtgcaatggtgtgatctcagcttgctgcaacctctgacccccaggttcaagcgattctcctgcctcagcctcccgagtagtagggattacaggcatgcgccactacgcccggctaattttgtatttttagtagagatggggtttctccatgttggtcgggctggtctcaaactcccgagctcagtgattcacctgccttggcctcccaagttattattttttttatgagacttgatcttgttgtgttgtccaggctggtctcaaactcctgggctcaagcaatccttctgcctcagcctcccaaatatctgggatgacaagtatgcgccaccgtgtctggctattttaattttaataggagttattttatattctcgctatcttcttccattctgtttgccttttttatagggtcttttattttttgaatttgaatttttgaattttatgaatctctgtggtaagtactctcgttttaagaatctttctgggctgggcgctgtagctcacacctgtaatcccagtactgtgggaggatcactcgagcccaggagtttgagactagtgtgggcaacatagggagaccttatctcaatacaaacaaacaaacaaacaaaacgagccaggcatggtggcacaagcctgtgatctcaactacttgagaggctaatgtgggaagattgcttggacccaggaggacccagggctgcagtgagccttcatcataccacagcactccagcctgagtaacagagcaagaccctgtctccaaaaaaaaagaaaaaagaaaatattttattttaaaagctctataatttttccttcacatttgggttttcgtttcatctgcagttgatttatgtgtatggtgaggttgcagtccagtttcactttctacctgctatccaagccccattagcggaaaatagtaccattcttttcccagtgctctacaccgccgtgcttataattatgtatgcgtgagtctgtttcttccttagcgtctgatttctctttctcaggcagttttaatctgttgatctatttgttactacctgcaccagggccacacttttttttccttttagaaaaaagggtcttgctatgttgcccaatttggtctcgtactcctgacctcaaattgtcctcctgtcttggtcttgggattacaggcatgaaccactgcttggcccacattctctttacagtagtttttgacagctggcaaagcaagtccttatgtaaccccttaccaatacctgtaattatttttcagaagcatcttctaattgttttttagctatttgaattatcacataagaatccacctgtcaggtttcacaaaaaaacatgataggctattgggattatgagaaattgataaaaaaaatcactttggggagaatattattatgcttcttaatttttttcctttaagtcagatgggtagcgtggtagcatcctaacaaagtttgaaggaggcacatcgtacacatatgcctgaaaacctgatcatcatgcttatgaaccacaaaaggatcttatgctttctttaccgactcgttaagtataattattcccattgagattttgcaagtcttctcttaaagtttttctaggtacttgataggttatgatgctactgtaaatgatattccattttaacttcattctacctttttgttcctggtaaatataaatacaaatgtgtggggttttttttcctttttattattttttgtagtgatggtgtctcactatgttgcccaggtgggtcttgaactcctggactcaagtgatcctctcactttggcctctcaaaatgctgagagcttttggccactgtgcctggcccaaatatgttttatgtcttaatttgtttttgtttttttgagccacagtctccttctgtcacccaggctggagtgcagtggcacagtcagggatcactgcagcctcagcctcctgggctcaagtcatcttcccacctcatcctctcgagtagctgggactacaggcatgtaccaccatgctcagctaatttttcctcatttttgtagcggggggggtctcactttgttgcccaggctggtgtcaaatccctacactcctctggcctcaaatgcctacactcctctggccttggcctcccaaagtgctgggatcctaggcattagccactgtgcctggacccaaatgttaaaaaatttttttttcaataactttgttaaatctttctaattctagtaagttctctgtagctttgtttggcttctcttgtatctaatcatatcatctgtgaataatgacagtgtttattatttccaatctttatgccttttctttttcttgctttatcatgctgcctaaattctccattgttgaataaaagtcaagccagtggaaatttatcttgttcctgatctcagaaaggaagcttcaacattacaccattaaataggaagtttgctgtaggattttatatagatcttttataagcatatagatattcccattggtgagggagggattcctgccataggattatgaggttggcccaatacataacaactgacactgggcagatgaaattgacaacagtttattagtcacatagacttgtatagccctggggaggacactacattgccaggcagggccacatgatggttgcacttgggacggagtaaacaaacagggactgtgggaggtagcctttttatgtagtatcatgaaagtggggtgcccctggttcccacaggaggatgagattggcttgtttgaataattatataggttggcaaggaactgaaactcaatatttaagcataagcagaaattgtgcctggtcgctttgataaagagtatttggttaagggaccctctctgtggaagtagagtggggaggagaacttgtggttaggctgttcaaagtcctcccggttttaccagaatcaaggcagtacataatattgaacctcaattctaggccatatacctccccatttattttctaatattcacagaggcatgtgtgtctgtgagtgtatctttttgatcataaatagattttttttttttttgagacggagtttcgctcttgttgcccaggctggagtgcaatggcgcgatcttgtctcacctcaacctccgcctcccgggttcaagttattctcctgcctcaacctcctgagtagctgggattacaggcatgtgccaccatgcctggctaattttgtatttttagtagagatggtgtttcaccatgttggtcagactggtctggaactcttaccctcaggtgatccacccacctaggcctcccaaagtactgggattataggcatgagccaccacgcctggccttagatttttttttttttaatatactttttcttatgtatctagtgaaagcataattgttcctttaatctgttaggtggtgagttctaagaattgattttctaatagtaaaataaactttcctaggcagaagtctactttgtgatggcatattattcttttcacatgctgtaggatttggtttgctaatactttgtttattacttttatgtttatgaattaccttggcctgtggtttttctttgtaatactgcccttatgaatttttttgtagagttaggcgaacttcataaaatgaattacagagtgctactgatttaatttccctgaaggaatttcatgatacttacaatccctgtgtaagtttggaattaaagtatttcttgaatatatggtagcagtcagggactgggcctttctttgtgggaagattttaactctggattcagttttcgtaaaggtttatctataggactctattctacttgagatactatggtagacagtttctttttttctaggaatttatacattttatataaattttcaattttattgatataggtagttgataataacctcttggtaattctttctctgtgtcatctaacgttatgaattttctttttcattcccagtgctgattttataggccttccctatttctttctctttcctcaatatggattttcaattttattggtttctttgaaaaaatacattaatcgttctgtttcattttattaatttccttttatttgggaatattttactatgccttgtcaatgttttgagtacttttttttacagtagtaaaatatacataacataaaatttactactttaatcatattcaagtatataattctgtggcattaagtacattcatagtgttctgtaactttcactgctatttccagaactttttcatcatcctgagaagaactttttttttttttaattatactttaagttctagggtacatgtgcacaatgtgcaggtttgttacatatatatgcatgtgccatgttggtttgctgcacccattaactcatcatttacattaggtatttctcttaatgctgtgcctcccccatcccctcaccccatgacagtccctggtgtgtgatgttctctgccctgtgtccaagtgttctcattgttcagttcccacctatgagtgagaacatgcagcatttggttttctgtttgctcagaatgatggtttccagcttcatccatgtccctacaaaggacatgaactcatccttttttatggctgcatagtattccatggtgtatatgcgccacattttcttaatccagtctatcactgatggacatttgggttggttccaagtctctcctgttgtcagtagtgccacaataaacatacatgtgcatgtctttatagtagcatgatttataatcctttgggtatatacccagtaatgggatcactgggtcaaatggtatttctagttctagatccttgaggaatcgccacactgtcttccacaatggttaaaccagtttacactcccaccaacagtgtaaaagtgttcctatttctccacatcctctccagcacctgttgtttcctgactttttaatgatcgccattctaactggtgtgagatggtatctcattgtggttttgatttgtatttctctgatgaccagtgatgatgagcatttttcatgtgtccgttggctgcatacatgttttcttttgaaaagtgtctgttcatattctttgcccactttttgatggggttgtttgatttttttcttgtaaatttacattctttgtagattctggatattagccctttgtcagataggtaaattgcaaaaattttttcccattctgtaggttgcctgttcactctaatggcagtttcttttgctgtgcagaagttctttagtttaattagatcccatttgtctattttggcttttgttgccattgcttttggtgttttagtcatgaagtccttgcccatgcctatgtcctgaatggtattgcctaggttttcttctagggtttttatggttttaggtctaacatttaagtctttaatccatcttgaattaatttttgtataaggtgtaaggaagggatccggtttcagctttctacatatggctagccagtgttcccaaaaccatttattaaatagggaatcctttccccatttcttgtttttgtcaggtttgtcgaagatcagatggttatagatgtctgatgttatttctgaggcctgtattctgtcctactggtctgtatctctgttttggtcccagtaccatgctgttttggttactgtagccttgtagtgtactttgaagtcaggtagcatgatgcctccagctttgttctttttgcttaggattgtcttggcaatgcgggctcttttatggttccatatgaactttaaagtagtttttttccagttctgtgaagacagtcattggtaacttgatggggatggcattgaatctataaactaccttgggcagtatggccaatttcacaatattgattcttcctatccatgagcctggaatgttcttccatttgtttgtgtcctcttttattttgttgagcagtggtttgtagttctccttgaagaggtccttcacatcccttgtaagttggattcctaggtattttattctctttgaagcaattgtgaatgggagttcactcatgatttggctctctgtttgtctgttattggcgtataagaatgcttgtgatttttgcaccttgattttgtatcctgagactttgctgaagttgcttatcagcttaaggagattttggactgagacaatggggttttctaaatatacaatcatgtcatctgcaaacagggacaatttgacttcctcttttgctaattgaataccctttatttctttctcttgcctgattgccctggccagaacttccaacactatgttgaacaggagtggtgagagagggcatccctgtcttgtgccaattttcaaagggaatttttcaaaggtcagtttttgcccattcagtatgatattgactgtgggtttgtcataaatagctcttattattttgagatacgttccaccaatacctagtttattgagagtttttagcatgaagggctgttgaattttgtcaaaggccttttctgcatctattgaaataatcatgtagtttttgtctttggttctgtttatgtgatggattacgtttctcaatatgcatatgttgagccagccttgcatcccagggatgaagcccacttgatcttggtgaataagctttttgatatgctgccggatttggtttgccagtattttattgagaattttcacatcgatgttcatcagggatattggtctaaaattctctttttttgttgtgtctctgccagggttggcagatttatgatgctggcctcataaaatgagatagggaggattccctgtttttctgttgattggaatagtttcaaaaggaatggtaccagctcctctttctacctctggtagaattggctgtgaatatgtctggtcctggactttttttcgttggtaggctcttaattattgcctcaatttcagagactgttattggtctattcagggattcaacttcttcctggtttagtcttgggagtgtgtatgtgtccaggaatttatccatttcttctagattttctagcttatttctgtagaggtgttaatagtattctctgatggtagtttgtatttctgtgggatcggtggtgatatcccctttgtcattttttattgcatctatttgattcttctcttttttcttctttattagtcttggtagtgttctatctattttgttgatcttttcaaaaaaaaaacagctcctgaattcatgaattttttgaaggggttttttgtgtctctatctccttcagttctgctctgatcttagttatttcttgccttctgctagcttttgaatttgtttgctcttgcatctctagttcctttaattgtaatgttagggtgtcagttttagatctttcctgctttctcttgtgggcatttagtgctataaatttccctcctcacactgctttaaatgtgtcccagagattctggtacgttgtgtctttgttctcattggtttcaaagaacatctttatttctgccttcattttgttatgtacccagtaatcatttaggagcaggttgttcagttttcatgtagttgtgcggttttaagtgagtttcttagtcctgagttctaatttgattgcacagtggtctgtgagacagtttgttgtgatttctgttcttttacatttactgaggagtgctttacttccaactatgtggtcagttttggaataactgcagtgtggtgctgagaagaatgtatattctgttgatttggggtggagagttctgtagatgtctcttaggtctgcttggtgcaaagctgagttcaagtcttggatatccttgttaaacttctgtctcattgatttgtctaatgttgacagtggggtgttaaagtctcccattattattgtgtgggagtctaagtctctttgtaggtctctaaggacttgctgtatgaatctgggtgctcctgtattgggtgcatatatattcaggttagttagcttttcttgttgaattgatccctttgccattatgtattggccttctttgtctcctttgatctttgttggtttaaagtctgttttatcagagactaggattgcaacctctgctatttttgctttccatttgcttggtagatcttcctccatccctttattttgagcctatgtgtgtctgtgcacgtgagatgggtctcccgaatatagcacactgatgggtcttgactctcgatccaatttgccagtctttgtcttttaattggggcatttagcccatttacatttaaggttaatattgttatgtgtgaatttgatcctgtcattatgatgttagccggttattttgcccgttagttgatgcagtttcttcctagcatcgatggtctttacaatttggcatgtttttgcagtggctggtctcagttgttcctttccatgtttagtgcttcctttaggagctcttgtaaggcaggcctggtggtgacaaaaatctctcagcattttcttgtctataaaggattttatttctccttcacttatcaagcttggtttgactggatgtgaaattctgggttgaaaattcttttctttaagagtgttgaatattggccctcactctcttggcttgtagagtttctgccgagagatccactgttagtctgatgggcttccctttgtgggtaggtaacctgacctttctttctggccgcgcttaacgttttttccttcatttcaactttggtgaatctgacaattatgtgtcttggagttgctcttctcgaggagtatctttgtggtgttctctgtatttcctgaatttgaacgttggcctgccttgctaggttggagaagttctcctggataatatcccgaagagtgttttccagcttggttccattctccccatcactttcaggtataccgatcagacgtagatttggtcttttcacaaagtcccttattccttggaggctttgttcatttctttttactcttttttctctaaacttctcttctcgcttcatttcattcatttgatcttcaatcactgataccctttcttccacttgatcgtgttggctactgaagcttgtgcatgcatcacctagttctcatgccatggttttcagctccataggtcatttaaggtcttctctacactgtttatgctcgttagccattcgtctaatcttttttcaaggtttttagcttccttgtgatgggtttgaacatcctcctttagctcggaaaagtttgttattaccaaccttctgatgcctacttctgtcaactcatcaaagttattctccgtccagctttgttccgttgctggcgaggagctgcgatcttttggagaagaggcgctctggtttttagaattttcagcttttctctgagcagaacttctttacccattaagcaagaactcctccctattgccccttcctcctagcccctggtaacctcttttctgctttcacaaatagaactttttatttgccacaattagaaaacagattattggactgtggttcatatccaacagctcattcaacattagcacgtatctcatccccagttgcttttccagcactgctaccttcactgtgaagctccatgagtttttccagttcaaacctgggcttcttcagcatttttacttttctactgaaaacatcatggagaggagaaatagattggcaagccttttctatgtcttttccagtgctatccggaatcaatgtattgaccacatctttcaagtcatttgtctgtacctgtcaggtcatgatttccagcatcttcttctggatttggcagacctgttggtgcagagcataagagatcttccgtatctgattgttggtttttttagtaaaaccaatacagaacaaatgaaacaagtaatcataagtagtagtcttgatgtcaacatgagcttcaatcatggtgtgccattttttcaccctggaacacattttgtcctggagtaagacccatgccatggaagttaagtcaggcaatttttgccctgaacatctttgataatcagtttgaattttctaaatgcaacttcatcattctgcaagtcaacaaagactcactgcaaacacataacccttgagaccatcagatgcaatttttgttccttggttttggtgattagtgtctttctgatatttcttggacatagcaggagctttcacatcataccaatctttctaagaaaatggatcaactacctttttggctccctttgctgcctttcataaggtgcttgttcttgacaactgctatcgtgctgctcctctttccttctgtccttgggagtttgcctattctagaacctcataaaaatagaattatgcaatatttgtccttttctggtctgacttatttcctttagcatagtattttcaagttttatccatagcatagcacatatcagacatcacttcttatgggtgaataatactccattgtaagggtatagcacattttatttacacattgatcttttagtggatatttaggctgcccactctttagctcttacgaataatactgctacgaacattggtgtccaaatatctgttagtccctgttcttcagttctttttgggtgtataggagtagaatggctgttagctttttggtgaactacaaaactgttaccacagcagctccaccattttgcatcgtgtcagcagtgcacaagagttatagcttctccacatcctggacaacatgtatttttccttttatttatttaattttttggatgagagccatccctagtgggtgtgaagtggtaatctcattgtggttttgatttgcatttcccaaatgatgttgaaaatcatttcatgtgcttgttggttgctgttttttttttgatcttctttggagaaatgtcagataggcacagtggctgaacacttataatcccagctatttgggagtctgtggtggcagggtcacttgagcccaggagttcgagaccagactgagcaacaaagggagaccctgtctctacaacaatgtaagtaaaaaaatttagccaggcatggtggtacatgactgtagtcccagctactcaggaggctgaggcaagaggaacacttgagcctaggaggtggaggctgcagtgagctgtgattgttatcactgtcctctagcctgggcaacaggataatactctgtctccaaaaaaaaaaaaaaaaaaaaaaaaagggaaagaaaataaatgtctattcaagttctttacctatttttgaatttttgttgtaaaagtttatatatcctggatactaagcacttacaagatacatgatgtgcaaatatattctcccattctgtcggttgtcttttttaccgtcttgataatgtcctttgatgtactgtagttttaattttggtgaaggggacatcctgcaaagtagcagagtaggaatttctaggagttaatccttacattgaaacaaccagtaaactggaaaaaatgaccagaatcaacttgcagtctgtggtgccaggggagtgcttgatgaagggagaggctactgctcttgcagaatagtttggggaaagtctcaaatggactgtgccagccatcaacaagcaaaaataagccatcccttagacgttggaaaattatagttgtaaagttaccgcagtaacaagatctgagtttatcctgcttggagcttattgagcatcttacatgcatggattcatgttcttcatcaaatttaggaagtttttaggtattaattattccatatgttttttgcctctttctcttctaggacttgttcaatggtgttccacaggtgccttaggttctgttaattttttctttattttttcattttaatcttcagactggataatttcaattattttatcttcaagtttgctgtttcttcttcctgctcaaatctgccattgtactgctgtatgaatttttcattttagctcttgggcttttcagcttcagaatttctttttggttcttttctataatgtgtgtctctttactgacattccctgtttgttcatatactcttctgatatcctttagctctttgtgcatagtttcttttatctcactgagcatatttgagacagttgatttaacatctttgactagtcgtttcactgtctgggctgtcccagggatagttttctgtgaaattatttttttcctatgaaccagctatgtgctatgatttataattcgtttgttgagaaccaaacaatttaagtattacaatgtgttggtaactctggaaaacagattctccttctactcagggatttattttgttgtttgttgaggtctaaagttgtctattagtatagtgacttttccaagaaatttttgcgaagtctttgttccttgttatgtatgttactgaagtttctgtcccattatctctgtatctgcttgcagcctctcatattttaagatgtctggattttttaaaaatagtgtgtaatcctttttaagtgttctgatagatgtcaccagagaagccgctgtaagcctaagggggtcaaatataaccaaccatctctgctgatcctcagggaactgccataccaattaaatcacactccagcattttagagcacaaagtctttactgttcactatagcaacagcgagccattctaggaacgctgtccccatgttgcagcaggactatggaatgggtcatggtagctggtttatgcatgccagtctcttaccaaaggtaagacagtcaccttgataataccaataaccttatcacagctgtctaaaatggtattatttcccagtagtctaatacaagtccatcttccatttttccccttttcccaaaaatgccctttatatctgttttattattgttgttgttgttgttgttattattattattattttggagatggagtttcactcttattgcccaggctggagtgcaatggcgcgatctcagctcactggaacctccgcctcctgggttcaagtgattatctcgcctcagcctcccaagtagctgggattacaggcacctgccaccatgcccagctaatttttatatttttagtagagatgaggtttcaccatgttggccagtctggtctcagactcctgacctcaggtgatctgtccacctccacctcccaaagtgctgggattacagggggccgtgagccactgcgactggtgttattattttttaaatagagacagggtctcactgtgttgcccaggctgctcttgaacagctggcctcgagtgaccctcccgccttggcctcccaaagtgttaggattacaggcatgagccaccacacctggccatgtttctgttagtctggaattacttctgtgattaacatgaatggtggctcatgcctgtaatcccagcactttgggaggttgaggcaggaggaccacttgatggcaagagttcaaaaccagcctgggcaacatagcaagaccccttctgtgttttaaaaaagaaaaaaagatggaacaacaacaaaaagaaagatgttaaaccttacaataaggagtgtgtcaactaaaactataccaatatagctatttttcacctatcaggcaaaaatccaaatgtttgttaacatactctatttgagactttgagaaactggatattgttatacattcccaacaagagtatatttggttgtttctaacaaaattgcaggtttttttatcctttgacccacaaacccacttctaagaatttattttaagggtacatctgccactagtaaagtgacatgtagacaagagttattcattgagtcatcattgtaatagcaaaaaatgggaaataagctgtaaaaaagactggttgaggtacataccatgtgaggaaaaaaagaatgcaggtagatctgtattcactgttatggagtgatcaccaggatgtattgttaagtgaaaacaacagcaacaacaacaaaaagctgcagtacaatgttttttgcaaaaagaacttctaggaaaaaggaaaaagaaatattcgcataccatggcttaataaaaatgattatttatagggaaggtgaagtagggcaaatggaattgagtgataaagatggaagagaaatttgctatactttttaataagtttttgacttttgaaccaatgtaaatgttgtacatattcaaaaataagtgtatatctaaactaaaagtaaactctaaaagtagtgaacctacaaaatgtatcgaattggcaacatagcagcatattgtgggattttattattgattctgacagtctgtttcaactaatgcatcttagtctttaagaatatttctgctggatttaggattctggttaggcaatttttgcacttggaagacagccttctactgtcttctgacttacattgtagctgacaaaagtaggctaacaggcctacttttgtcttttttcatgataattcatccttttttctttgtatttaaggcttctctttgtctttgatttctgcagttttaggatggtatatttattttctttatcttttttttatagggatgggatcttattgttttgcccaggctggtctcaaactcctggcctcaagcaatcctcctgcttcagcctcccaaaatgttgggattacaggtgtgagccaccatgtccagtctagtgtgatgtatttagatgttagtttctttttattctacttgagagtcattgaacttgggaaacttgtaggctctgttacttcacttctacgaaattcttgcccattttattttctctcagtccatccttttgagactctgattaaatacttgttatataatcgatatgtatatgtctgtttctggactctattctgtttcattgtttgtatttctctcctttctcaaataccactctgattactgtagctctatccatagtaaatcttgaaatcaagtagcataagtcctccaaatttggtattttttgaattgttattgctattctctgtcttttgcattttcattaaattttaggatcagtttgttagttactacaaaatgatcccctgctgggattttaattgggattgcattgaatctttagatcagtttggagacatggaatctcaactgtgttgagtctaccaatctaataatgtttttaatgtctctatttaggtcttctttaatcttcattttgtggtttttactatacatgtcctgcatatctttggttaatattacccctatttcatgtagctttttttgggaatgctttaggattttttgcatatacaatcacatcacctgtgaatatagttttacttcttcctttccaatctggatttatttattttttattgtgtctttttgcactcactaaaacagttccgaacagaagtgctaagagtggacatccttgccttcttcctggtgacagcagaaaggattctgtatttcatcattaaatatatattagctgtaggtttttcagagatggtctttatcaggttgaagaagtttccatctgttgttaggttcttgaaagtttgttatggataggtgaatttttcagatttttttttcctttttttaattgtattttctttagtagagatgagatctcactatgtggcccaggctggtcttgaactccaggcctgtagtgatcctcctgcctcagcctcgcaaagcactgggatttcaggcatgagcctctgtgcccagccaaaatttttcagatttttttttccagatatattgagatgatcaaagaaggcttttctcccttattttgttaacataatgaattatttgaacgctcaaccagccttgtatttcaggaataaaccctgcttaatcatgatgtatatgtatttttatgtatttctgggtttgattttctagtgttctgttaatgattttttgttactttttgtttatgagagagattgttctgtaattttctcttcttgtaatgactgtccaattttagtatcagggtaatactggcctcataaaataaggttggaattatttcttttctgaaagagtttgcttagggatggtcttaccttttttaaatattgaatagaattcaccagtggagccctttgtgtctagacttttcttcgtgggaaggttttttgtttggttggtttggtttggatcttttttgtagagaaggagtttcaccttgttccccaggctggtcttgaaatcctgggctcaagcaatcctcccatcttggccttccaaagtgccagtattacaggtgtgagccaccgcgcctggccgatgggaaggtttcaattacaatttctttttttttttttttttttttttttgagaaagagtctcgctctgtctcccaggctggagggcagtagcttgatcttggctcactgcagcctccacctcctgggttcaatctccctgcctcagcctcccaagtagctaggattaggcagctaccaccatgtacagctaatttttgtatttttagtagagacagggtttcaccatgttggccaggctggtctcaaactcctgacctcaggtgatccgtccgcctcggtctctcaaagtgctagaattacaagtgtgaatcaccgcgcccagcctgttgttggtttttgagacagggtctggctctgtcacccaggctggagtgcagtggtgcaatctcagctcactgcaacctctgcctcctgggcttaagccatcctcccacctcagcctcccaagtagctgggactacaggcacacgccaccatacctggccaattttttatttttatttgtagaggtggggtttcaccatgttgtccatgctggtcttgaacttctgagctcaagtgatccgcctgcctcggctgtccaaagtgctgggattacaggcatcagcctccgtgcctgaccctgtgtggtttttttatttttatttttacttatttatttattttttgagacagggtctcactctgtcacctaggctggggtgcagtggcgcaatctcagctcactgcaacctctgcctcccaggctcaagccatcctcccacttcagcctcttgatcctgtcattcaactcacttgagtaactgggaccacaatcacatgccaccactcctggctaatttttgtttttattttattttttattttttttcgagacagagtctcgctctgtcacccaggttggagtgcagtggtgcaatcttggcttactgcagcctctccctcctgggttcaagccatcctcctgcctcagcctcccgagtagctgggattacaggcgcctgccatcacaccaggctaatttttgtatttttagtagagacagggtttcaccatgttggccaggctggtcttgaactcttgagctcaagtgatcctcccactttggcctcccaaagtactggggttacaggcatggccagtgtgcctggccccctgtgtgggtttagctataaatttatttacacgttttattttcctgtatatgttatatcttggtgaatatctcatgcatgcttaaagaatgtgccttctgctcacattgttttttctttttctttttcttttttttccgagacggagttttgcccaggctggagtgcagtggtgtgatctcagctcactgcaacctctgcctcctgggttcaagcaatgctacctcctcctcctgagtagctgggattataggcatgcaccaccatgcttggctaattttgtacctttagtagagacagggtttcaccatgttgaccaggctggtcttcaactcgtgacctcaggtgatcctcctgccttggcctcccaaagtgttgggattacaggtgtgagccaccatgcctggcctgctcacattgtttttttaaatgtcaattggatcaggtttgattcttttgttcaagtcttctatatgtttactgatttttctgtctactgctctattgatttctgagaggggagagttgaaatcaacaaatgtaatgtggatttgtctttttttttaatttttttttagctgtatcaatttctacattatattttcagaagctctgttaattagatgcatatgcatttaggattctgtcttgatgagttaacccctttatcatgttctcactttatctcttgtaaatagtccttgttctaaagtctgctttgtctgagagtattattaagtcctcctggtttcatattatgaaggatgttcactgtgtactggttaccattttagcccactatatcttgggctgtatttttactacttgcctgagtccagtgagtcaaaacatttataagcacaacaggttacatgaagtccagttttattacccacagatgggcagcaagggacaggagaagcttagcattcattgcaaatcggtccctcaaggcttgggaaagctgcccagagcagatggtctcttgtctgtggatcgcagctaagggacccaggaaagaaggtttatgtcccaggagcaacatgtttcactgggctaaagcattggaggacatcctgtctgagggtggagggaatgacaggaacagaaacggaggctcttccaaccagctcctccttgtctcaggatgcttcattcccagcatgttatacagttacacaaaggtgtggggcagggcagggaactggcttgattcaaggcaacctggagcactgccctgtacatgtgcttattatttgaatgtgtatctgttagcattctgttttttttttttcctttaacctctctctatgtatttgaagtagatttcttgtagatagtatttacttgttttttgttatttatgtatgtaagagtcagtactattagtggtattgacaggaccacggacaacactattttgcgttatatatatcctctcccttgtctgtcatggatgttggaataaagttgctggattggtggtgatccatatcatgatcctgtcatttaactcacttgtgttgtgatctaccatgtgtaataagagactttaaatccatgtacatctcttttgtggagctaggcagtcaaagaagtgcgagccattcctagcacataatgtcaaaacataagccctgcattatgcttaggtttagaaactaaaacttcacagaaaggagataacaaatcatattcacatctcaaaacccaaaaacttgaaacatttcatttgtagaaaaaaggaataagaggccaggtatgatgggttatgcttgtaatcccagcactctgggaggctgagacaggcggattgcttgaggccaggagtttgagaccatcctggacaacatagtgaaaccctgtctctactaaaaatacaaaaaaaattagtggagtgtggtggcacaggcctgtagtcccagctactcaggaggctgaagtgggagaatcacctgagcccgagaggtggaggctacagtgagccaagatcatgctgctgcattccagcttgggcaaccagagtgagaccttgtttcaaaaaaaaaaaaaaaaaaaaaggaataaggccaggcaccatggcttatgcctgtaatcacagcactttgggaggccaaggcaggaggatcccttgagcccaggagtttgagagcagcctgggcaatacagtgagacccagtctgtacattaaaaaaaaaaaattatccaggcatggtggtgcagttttggcaattttgttgtataagtatgatagggtgtacttacacaaacctatgtggtttagcctactacacaccaagagaatatggtacagcctgttgctcctaggctacaaatctgcacagcatgttactgtactaaatactgtagtattcatctgtaacgcaatggtatttgtatatctaaacatatctaaaacctagaaaactacagtgtaaaagataaaaaaaaaaaggtacacctgtatagagcagttatcatggtggtgcttgcaggactgtaatttgctctgaatgagtcagggagtgagtgatgagtgcatatgaagggggcctagaacattatatacttttatatgactggcagctcagtaggcttgtttacaccagcatcaccctaaacacatgagtaatgcattgcaccacagtattatcaatattaccacagctttcactaggtgataggaattttccagctccattttatttttatttatttattttttttgagatggagtctctgtcacccaggctggagtgcagtggcacgatctcggctcattgcaacctctgcctcctggggttcaagcagttctcctgcctcagcctcctgagtagctgggactacaggcacatgccactgcacccggccaatttgtgtatttttagtagagacggggtttccccatattgaccaggctggtcttgaactcctgacctcaagtgatctgcccaccttggcttcccaaattgctaggattacaggtgtgagccaccacacccggccttcagcttcattataattttatgataccactgacatatatgcgatccattgttggctaaaaaaatgttaggcagtggccaggcgtggtgggtcacgcctgtaatcccagcactttgggaggctgaggtggacagatcacgaggtcaggagatcaagaccatcctggctaacatgttgaaaacccatctctactaaaaatacaaaaaattagccggctgtggtggcacgttgcctgtagtcccagctacttgggaggctgaggcaggagaatcacttgaaccagggaggcagaggttgcagtgagctgagatcatgtcactacactccagcctgggagacagggcaagactccgtctcaaaaaaaaaaaccagtagcaacaacaacaaaaaaccgtcatgcagctcatgattgtatttactgtgtaatatgtagtgctttgtttttctagtactgaaaaaaaaggtacatctggggcttgggaatgaagttctggtagagatgtaaatttaggatttactaacatttggtttcaatttgttccttattaggtagaggtatatccatgactcagaatttatttgtagccttagaggtcatactttgagggagtcaatatagatgagattgtgctggtcctcatctacctgattcagaaagagccagctattgtcatctgattttagctggacggtacagggcttactgcccaggtttaccaggtaccagcctaggctagacctgttctgtgcatttactcatgtgaaattgttacaacaatcctgcctcagagttgttctaatggaagtggaatattgagcacactaactagaacacagcaagttctcaataggttaagtatcatgatgattatcatgtattactcttttatagaagatgaaaaagaggctcaaaaagattgattaggagttacagagcaatcaatgaagagggctaatctaggtcttgaacagttttaaagtccatgctatatctccatttaaatacttacattgtagagtgtgcacatgacatgtcattagtggttatgtgaccacgggccagtcgtagcacccagtttcctcatctgtaaattgggggtaacacttaatgttttataaagaatgtctagagttcttagctgtgtgaagctggaggcataatgaaaattacgtttactccatcttctctgaaatgcattgtgacatctttccagattttaagtattaattctttgccagtactgtgtgtttagatagatcttccatcttgaggcttgtcttctcattttgttcatggtaatattttcactagctgtagttctgtaacaaaggtgaatatattaatctttcccttatagctcttgctttttgtttcttgcttaaaaatttattccaataaatttgtattccaagatcacaaagatattctcttacattttcttgtgaaagttttatagttgttaatctacttaaagtagttttttttttagatcagatgaagtagggatctaatttcattccccacccccaatagttgttgcagcaacatgaaaagttcatcccttttcccactgatttctagtgaacatctgatatatataaagtgtgcatttatgtaagccttaaaaaaatcacaccattttaattgttacagctttatagtaggttttattagttgggaggcgtgtcccctcagcttgtgaaaattctatggaaatttctgttgggattgttaatagaggtgctttgaatctatagatatgtttgtgggagcattggtatctttaccatcatgaacatgctttcttcatgatttagatattttaaaatattttaaaatatagcttaatattttcctgcacaatgaccttcacaatcttttaaaatttatttctaagtacttaatatatttttgttgctattgtaaaaaaatttttttttcattaaatgtttgtttgttgtttgtttatacatatgaaattggcctttggattactttgtatttgttcttatgcatttcattaaaaaatatatctgggaaccttattgcagtcttccatagtttaaattatatggcatcaagtttatattagagtttttttttttttttaatactttaagttttagggtacatgtgcacaacgtgcaggtttgttacatatgtatacatgtgccatgttggtgtgctgcacccgttaactggtcatttatattagagttttaacttgtttgttatttttatttattgtttttaccaagcactacgaaagaccattcttttttgttcaaaggaatactatttgcatttgttaaaaggaaatggtgttttacactctgtggagattttaaacaaaaggagcatgtctgtgttctacttccagaaatcctaattttgcagatctagagaaaacctgagctccttgttcttttgaaaatctcccatatggttctgtacgtttctgttggaaaaccactgctagagaagttgctaaacagtaaaagcatttagcccatgatgatgtgggggaagggaggcatttcatttaaaattatgaaaaatttatttatcatttaatatttcatgtgtgatgtatagataaaattagtatatttacatagacaattgtttttaagtgacagcaggtatgaatttaaaaagaatggacattgaaaaagaacaaagtcacagtttgagatgtattggttaagtactcagtatatttgtattaaaacttagaatataattttgtttttcccagttggagtcattcgttgcccagtttgcagccaagaatgtgcagagagacacatcatagataacttttttgtgaaggacactactgaggttcccagcagtacagtagaaaagtcaaatcaggtaagtgtattacatcttgaaccttttgcctgccagctcttttttttttttttttttttttttttgagacagagtctcattcattctgttgcccaggcaggagttcacaagtggcgcaatctccgttcactgcaagctcctccccacaggttcacaccattctcctgcctcagcctcccgagtagctgggaccacaggcgtgtcaccatgcccggctagttttttgtatttttagtagagacggggtttcaccatgttagctaggatggtctcaatctcctgacctcttgatccgcccatctcagcctcccaaagtgctgggattacaggcgtgagccaccgcacctggcctctttttttttttttaattgagatggagtcttgcgttgttgcccaggctggagtacagtggtgcgatcttggctcacttccatctcctcctcctgggtttgagtgcttctctcatctcagcctcatgagtagctgggattacaggtgtgtgccactatgcccagctaatttttgtatttttagtagacatggcatttcaccatgttggccaggctggtctcgaactcctgaccttgagtaatccacccgcctcggcctctcaaagtgttgggattataggcgtgagccaccgtgcctggcctctttttgccaactattgatgaggcaacctaaaatgctggagatctctaaaataaaaggagccaaacattagttaattgatctataaagttatataacattttaaaagaatataaagaataatgaataattcaccttaagaaataaaacagtgaaacagtgacagtccagaagctcttgattgcatacccacattccagtctcctccagagaaaccattattctatatttgacattacttcatttctttgtacttttactgtgtattgacaatgagatttttatttcaagctcagtttttcactttttttctattttaatgataagctctataatgatacatgtgaaagacaccatgtctttgatcagtaaggtttttacatttttaagaaagccttcttttctgcatggtcttactttgaaagcttcatttgttttttgggggtggtggttgttgttgttgttgttgttgttgttgttgttgttgttgttgttgagacagggtctcactctgttgcccagtctggagttcagtgatgtagtcgtagctcactgcagtctccaactcctgggctcaagtgattctcccaccatagcctcctgagtcactgggactacagctttatgccaccatgcccaactaactaaaggcttacttggcagcattgtccaaggtgttggatttagagatccaatggtgtttttcgtttgtttctaatttctataacccacatgtagaacatctcttttggcttcttaaatctagatgtcaaatctatcatgcataatctatagtactccagtgggggttagccatgttgagattaattctacagtttgtgctaagtatagtgtgttagtctacttttggatcttgattcattgatgattcctctaacagttcccttaacttggaacagaagatctgggaaagaactaaatctggttagggaaaagcagttgttagctatgtttttcaggactctagtaatcacatggttaatttctgtactttttgttgaatttttagttttttgttccttggtagaactacaggaatttaaggttcactttaaatgaacatagctactactgactaaaatacctgtttttgtagtttggaaagtatccacaattcttcctgatgtgaaccttgtcaaaggccaaaacagacacgcttgctgtgggagataaactttctaattgtttaattgtgaaaccacccttaaagaaagaaacatatttatgtaggctacagtgttgagcacttaagtcctctgaaagttctcttctaaatacaaatgattttgtttctgtcttccattgcatcatgtcactttgctttacatgtgattatagctattctagatattcattagtcatattcatagtagtatctgtgtatgctcaatccagaaaactaaaaaatacagtagcataagtaatcttcaaatgtaaagtagcataaataaatgtcaatcagatgggatattcctatgacataaaatgatgataataggacatgagagttaaagggattctaatccaaaggacaagtttaagaggctgctttatacctccgtatgatcaattagttttcagtacgtttatgtttatttagtctgcttctgtcacagaaacatagtaggaagaagttaaactagagatggagtccaacatttagacatcctaaatgttgatactgggcatgcatgggttagggtaggaaatgtggtatgagaatagggtgctgctgggggcatttggtgaggatggagactggagatgtcatatgggggatgaatttgaaccaggcagtacttagcaagaggtagtgggagctgaattagcgtggtagcaataaggaaaggaagttaccacccagagagaacttgatatgcctgattgggtgtggaaggtgagagatgttttactgcctggatggtgcctttcacagacatcatgataaagtgggtgggagttaggtagagataataaattggttttgaatgggattgagtttgcattgcctgtgagactgtaaagtagaggtgtcatccatggttagagtggtgctctaaagagagttcatagctggagattttgaaaagttttaaaaactttttgttgtagataatttcaagcattactaaagaaacagttgacataacaaacgcccatggacccatcgcctagatcaatagccatcaactcttgttttgtgcatactctgatactacaccaccaaccactagattacattgatgtttattccagccattatatgatttcatctgtaattttttttttttttttttgagatggagttttgctcttgttgcccaggctggagtgcaatggtgaggtcttggctcactgcaacctcagtctcccaagtagctgggattacaggtgcccaccatcacgcctggctaatttttgatacagagacaaggtttcaccatgttcgccagactggttgcaaactcctgacctcaggtggtccacccacctcagcctcccaaagtgctgggattacaggcataagccactgcatccggcctcatctgtaaatattttggtatgtacttcagtaaaatattttttctgtaaacataactaccatatgaatttctatgtaaaaataaaaggaccagcctgggcaacatggtgaaaccctgtctgagcgaataaatgaatgaatgaacaagaaagaaaagcaagcaagctgggtgtggtggtgtgcacctgtagtcccagctagttgggaggctgaggttgcaggatcacctgtgctcaagaagatggaggctgcagtgagccataatcatgccactgcaccccagcctgggtgacagagtgagaccctatctcaaaaaaaaaaaaatttttttttaaatgcttaatgatctcattattatcaaatatctaagcagtaatcaaatggatctgaatattataggtttttttaaacaatggtttgtttctataaggatccaacaaggcctacacagtacatttggttgatttgtctcaaacctaattaatctcaagttacccctttgcttcacttgctttccttttcttcctatttaatgtttttgttgcataaactgagttgcatattcaatagagttagctttattctgaattttgctgataatttccataaagtcatttaacgtgctgattatatatcttgtgaaactgaataaaaatgtagtggcttgtttaggttctggttccgttgtgggagaagggtaagaatattttgatccatatgtccatgtgtatgctcatcaggaagcatatggtgtctggttgtctttctttttttctgatgttaatggccattaatgatcactgccaagatcctgtatttcattagggctttgaaaaatagtgacatttttattctattattcctctttatttcttaactggaatagaaagagaaagcttccttcatcaattctttgattaccctaagctatagtgcatccaggaaaggtcagttcaattttgattccttccctttagttgccaatttttagagcagtaagttaatttcttaggattcttcagaggtgactaataagaggagtgtgtgtgtgtgtgtgtgtgtgtgtgtgtgcgcgcgcgtgtgtgcgtgtgtgtgtgcgtgtgtgtgtgtgtgtgtgtgtgtgtcactctgtttgagtctgcaatagtcattgctgtctcccttgctgttttttctgttctagaccttgaagcagccatttctcctaggtgccttgattccttttcatgggaaataatatttggagaccacagtatggtacggtgggtgctcatcatcattgagttggtcacctatctaggcctttcagggaatgatctaacagagactttatttatttatttagagacagagtctcactctgttgcccaggctggagtgcagtggcgtgatctccgcccactgcaacctcctcctcccaggttcaagcgattttcctgcctcagcctcccgagtagctgggactacaggcttgtgccaccacacccagctaattttttgtatttttagcagagcggggtttctccatgttggccaggctgatctcaaactcctaacctcaagttatccaccctcctcagcctcccgaagtgctgggattacaagtgtgagccactgcacccagccgaaatgttggttcttaattgcattgatgtaatttgttttctctaggaaaaaaaagtttatatatatgtataatatatatataatatattatatgcataatttatatgcgtaatatataatacagtcttggtgcaattaggaatcattttaattcttaaaattaagaattataaggccaggcatggtggcttatgcctgtaatcccaatactttgtgaggccgaggcaggcggatcacaagattaggagtttgagaccagcctgaccaatatggtgaaagcccgtctctactaaaaatacaaaaaaattagctgggcatggtggcacctgcatgtaatcccagctacttgggagggtgaggcaggaaaattgcttgaacccagagtgggtgttgcagtgagccaagattgcaccacagcactctagcctggatgacagagtgagactctgtctcaaaaaaaaaaaaaaaaaaaaggaaaaagaaaagaaaaaaagaattatagactagatataagattttctgaaaagatacaaatacaattcttaaagtatcacagaggtagcaactttgagaagcagctgagggaacaaatgcaaaaggatggaattattaaaagataaaagctcagaggaagggcctcgtggaacttaaacacctgagaaggaagtgcatcttggctggtgatggggtctgggtgtttggcttgggactcaggcttctgacgggcagaagtagtggtgctggcatctctgaagtgaattacagtaaagctggttctacagatattggaaaaactgcaaactagagctagctccattgtaggaaggaactgctgcacctgggatgaagcagcatcactagtgtgatgctcacagaagttacatgcaggtaggaagaaaagaggaagccgactatgagaatcaagtgccttcttctgacattgcattctccttccagcactacccgttgttagactcgaatgtgaaaccagcttgtaaagcataaatgttgcttgcagaataagagtttatactagagtggagttggagctgaaaatagaagttgtagaatgtttgtatcaaaacagaaagcaagaaagacagcagttatatgtatgcactggagatattcaatcaaatcatgtgtgtgtgtggttttttttgtttgtttgtttgtttgtttgtttttaaagagaaggagtctcactctgttgcccaggctggaatgcagtggcgcgatcttggctcactgcaacctccacctcccgggttcaagcaattcttctgcctcagcctccagagtagctgggactacaggcgcatactgccacatctggctaattttttgtattttagtagagacagggtttcaccatgttgcccaggctggtctcgaactcctgagctcaggcataccacctgccttggcctcccaaagtgctaagattacagatgtgagccactgtgcccagccaatcaaatcatgttttaaagttacctgaaacaaataaatcttctctgtgcagttaagtcacccacttgattaggcaggttcatttattaaattttgcttttgacatttaggaatttaaatttttaaaatattgtataactacatgtaaaacattcatgttgtttgaaaataaaatctataaacttctatccctgtcttgtctacccatctaccttatttcttcccaacctcataggtaactatttaatgtcctttatggattatccttcctttttaaatattatgttaatgtacaatttaaaaataaatcatcccactccatcccatctgtatcactctgtttttgcattgctataaagaaatacctgagactgggtaatttataaagaaaagaggtttaattggctcacggtttcactggctgtacaggaagcctgatgctggcatctgctcagcttctggggaggcctcaggaaacttacaatcatggtggaaggtgaaggggcagcaggcttgtcttacatgtggccggagcaggagccaaaagagggtgggaggtgccacacacttttttctttctttcttttttttttttttgagatggagttttactcttgttgcccaagcaggagtgcaatggccagtcttggctcactgcaacctctgcctcccaggttcaagcgattctcctgcctcagcctcccgagcagctgggattacagatgtgcagctaatttgttgtatttttagtagaaacgggatttcaccatgttagccaagctggtctcgaactcctgacctcaggtaatccacccgcctcagcctcccaaagtgctgggattatatgcgtgagccactgcgcctggccatgccacacacttttaaatgaacacatctccatgtgaactcactaccatgagaacagcaccaaggaggatatccacccccatgatccagtcacctcccatcaggtcccacctccagcattggggattacaattctacatgaaatttggtcagggacacagatccaaaccatatcattccaccccagcccctcccaaatgtaatgtccttctcactttcaaaacacaatcatgcctcccaacagtcccccagagtcttaaccatttcagcattaactctcaaaaagtcctaagtcttatatttgagatgagaaggacaagacaagtctcttctccctatgagcctgtaaagtcaaaaacatgttacttccaagatacaatgtaggtacaggcattgggtaaatactcccattccaaaatggagaaatcggccaaaagaagggggctgcaggccttgtgcaagtccaaaacccagcagtgcagtcattaaatcttaaagctccaaaataatcccctttgacttcacatctgtcatccaggacacactggtactaggggtgggctcccaaagccttgggcagctgtacctacccctgtggctttgcagggttcagcccccacagctgctctcataggttgctctcatgggttgacattgagtatctgtgacttttccagactaaaggtgcaagctgctggtgggtctaccatcctgggttctggaggacagtggctttcttctcacagctcacttgggagggccccagtggtgactctgtgtgggtgctccagccccacatttctcctctgtactgcgcgagtagaggttctccgtgaaggctctgcccctgcagcaggcttctgcttggacatccaggcctttccataaatcttctgaaatccaggcagagagaggctcccaaatctcacctcatgcattctgtgtatctgcaggtttaacagcacatggaagctgccaaggcttatgccttgcaccctgtgaagcagtggcctgagctgtatttgggcctctttgagccatggctggaactggagaggctgggacacagggagcagtgtcctgaggcttctcaggggagtgagcccctgagcctggcctggcctgtaaaaccattcagtccttctaggcctctgggcctgtgacaacagtggctcctcagaatgtctctgaaatgccttcaaggccttccccctacccccagtttctgcagcctgcttgaattcctcccttgaaaatgggcttttctttcctaccacatggccaggctgcaaactttccaaacttttatgctctgcttccctttgaaatatctaagttccaacttcaggtcacttatttgctcatacataggagcataggttgttagaagcagccagatcacatcttgaacactgctgcttagaaaccagatactctaaataatctctcagattcagagttccacagatccctaaagccaggggcacagtccaaccaagctctttgccaaggtgtaacaaaggtgaccgttgctccatttcccaataagtttatttccatctgtgacctcctcagcctggacttcattgtcatattactatcagcattttggtcccaacaatttaacaaatctctaggaagttccaaaatttttctcaccttcctgccttcttgtgtgccctccaaactgtttgaaattctgcccattacccagttgcaaagctgcttccacattttaaggtatctttagagcagtgccccactcctcagtaccgattttctgttatcagtctggtctcacattgctataaagaaatatctgagactgggtaacttataaagaaaagaggtttaattggcccatggttcttcaggctgtacaggaagcatgatcctggcatctgctcagcttacgatcatggcagaaggtgaaaagagcaggctcatccacatggctggagcaggggcaaaaagagaggggggaggcgccacacacttaaacaactagatctcgtgagaactcagtcactatcatgagaacagcaccaagggggaaatcacccccatgatacacctacctcccagcaggccccacctccaacattggggattacagttcagcatgagatttgggcaggcacacagatccaaaccatattaccatctttcttgaataagcagtagcattacacacacacacttttcctgttttatttcattttatgtactaacaatctctcctgagtggtgtaaatagaaattacttatttctttttatagcttactgtggagattacattctagattacatccttttagagatgctgtgtgaggctaaggaagtagatgagatcaatccctataatcaaaaactacagaatcagaggaggaagggtgggatccacagtgacaatcaggtgagataggaggattggcaggtattaaggaattcacatgatttctaggaagcagaagtcactggtatcaagtgatgttagaaagattgaagatgataagagcagagaaaaggtagattttggtttatggacatatcaggtatttggaatttggttagtgtcaactgctgagtgaagtggaaaaaaattttactgtcaaacctgttctcatctccacatcccacttccagcaaccctcaccaaagccactgaaaaatcctagcttgtcattatacagaaacacttgctccttttctaatttgttctctacattgtagccattgtgacataaaaatgcaaatctggccgtgtcactttcttaaaagcttttaatagacttatttggacaaacaccaaaattgccttgtgactctgcttaatctggcccctgtctcttgtcctagcttcttttgccagtcttcccctgaatcgcaccacttcagtcatacttaccttcgttcagttctttgaacctgcctgctcttcttgcttgggactttttgtacatgctgttctctcttcctagaagtaaaagccttcactgggtaatccctcctcatgctttccccagccttccaaccccactaaaatgagatccatttcttcatcatatgctcttataactttccatagatttcctttatggtaattctcagtttgtaattatatattgatgtgcttattctaataatgtacatctgccgcacatttaatcttcacaactactcagtaatatctgtattattaccctcatattaaagatgagtactctgtgtaacctgcccaagaccactgagctagtaagtgagggaactgggattttaacctgcactatgtacaagactgtagttatcataagggcagcgaccatgtttgcttttcctgactgttctgttctcacacctagcataatgtttgggaaatacctagttgaaatatttgggatgctgaattaaggagaaaatatacttatattcttgtctcttcacagtattttcatttcttatgtgtataatgtaacacacaaggtcagtttaaaatttcccaacaccattaggaggctaactgatttagcctggtacaattggtgtatcatgtacgcatagctcgagataggaccaccttttcattttctcaaaaatttacgtgccatggttcttttgtcaggtatgtacaagctgtgaggacaacgcagaagccaatgggttttgtgtagagtgtgttgaatggctctgcaagacgtgtatcagagctcatcagagggtaaagttcacaaaagaccacactgtcagacagaaagaggaagtatctccaggtaataaatgagatctttgcatttttttccttctatctttccccgtcttttcttccttcctgtattgacttgttttgacacatttgttttgataagtattaaatatactgttttaagtaaaagaggtttatattatcgaaatttaagtacttacaaattttggaaagtacgaatagatgtagaaccctgttttacattcatactgcctgtcctcctgcttctataaatgtcttcaattggtgtgaatatagaacaaatggagaaaaaaattgctttttcttatttttcttttatctctaagataacaacaaagagtgggcttaaatattttataactcttccttttgatattcttgttgtaaacctgcatcatgatatttgtctgatatgtggatagccagagaggcttttttatgtaattattatttccagttttatgtaattattattgtcttgtttttaatgtacagttcactcatatgttttttattttggtaaaatacatgcaacataaaatttgtcattttaactactaaatgtacaattcagtggtatttattacatttacacattgtgcaaccatcactactattttcaaaacttttttatcaccccaatcagcatctttgtaccctttaagtaataactccaattttctggccgggcgcggtggctcacgcctgttatcccagcactttgggaggcagaggcaggtggatcatgagatcaggagatcgagaccatcctggctaacacgttgaaaccccgtctgtactaaaaacatacaaaaaaattagctgggcgtggtggcgggcacctgtagtcccagctactcgggaggctgaggcaggagaatggcgtgaacccgggaggcggagcttgcggtgagccgagatcgcaccactgcactccagcctgtgtgacagagcgagactccgtctcaaaaaataataataataataataactccaattttcttcccctagctcctagtaacttctaacctattttctttttgttgagagtgagtcttgctttgtcacccaggctagccgtagtgcagtggcacgatctcagctcactgcaacctctgccacctgggttcatgctattctcctgcctgtaactgggattacaggtgtgcgccaccatgtgtggctgaattttgtatttttagtagacacagggttttaccatgttggccaggctggtctcgaactcctgacctcaagtaatccgccagccttggcctcccaaactgctgggattacaagcgtgaaccactgcacccagcctttattttctgtctctataaatttgctgattctagatacttcacgcaagtggaatcacatggtatttgtcctttgatatctaacttattttacttagcataatattttaaggattcatccatgtaatagcatgtatcaaaatgtagcaaaaccgttttgttttttttttttttttgagactagtgaaagacttggtgtaatcccagcactttgggaggccgaagtgggatgattgcctgagcccaggagttctagaccagccttgccaacatggtgaaaccctatctacaaaaaaaaattagctgggcgtgatagttacatgcctgtaatcccaacaacctgggaggtgagatggtgggaggaccacttgaaccagggagctcgaagctgcagtgacctgtgataattgccattacactccgtctgcgcgacagtgtgagatcctgtctccaaaaaaaaaaaaaccgtcttagcgttgctggagttaattccatatttcatcttgatgtgttgtgcttttaatattcttgtgatatattggctgatttttctctatctggttattttcattttcattctgaattctatatgtttatatatttgtatcttcagaaatatttcttgtatttatctaattatcagttttttagttcattaattttatctgtaattcctctcaggttaccttagggtttttgtgtgtgtgtgttttgttttgttttgttttgtttttttagacagaatctcactccatgacccagactggagtgcagtggtgcgatctcagctcactgcaagcgccacctcctgggttcaagcgattctcctacttcaacctcccaagtagctgggattatgtaatccctgtaccaccatgcctggctaatttttctatttttagtagagacggggtttcaccatgttggccaggctggtctcgaactcctgacctcaagtgatccacccgccttgggctcccaaagtgctgggattacagatgtgagccaccacgcctggtataggccagcatactggtttgtcaattttgacactattgacattttgagctagataattctttatcgttggggactgatttgtgcattataaaaaaaaaatgcaaatggctgattactgagcattgtttcatttcagttattaaagaaatgcattctaagatagtaaagtatgtgtcttctctctttctctcttgctttctctctcgcatttattaaattgtcaaaggtgaaaaattttgagagttccccctgtgaatacagttaatagccactctacactggttgaagtacaaattggcacaattatttagcttttttctgtatgaattaccctttgactcaacaattccaccacgaggaatttaccttatggaaacatttaaatgatttataattttcatatgtttatttcagcattaaactttcaaatatccttagcaggtggtatagtggtatatctatttcgtgaaatactatacagttaataaataagaatgagatggatacatatactaatacagaaagtcatctaaggtagagttaagtgagaaaaaaaatctttaaaagacaatatatgtactaccatttattgttttataaaatgtaacactgcactatactatatgtacttccatacttagaaaaacaaccagaggagtgcacaccaggttattaatagtaattatctctggaggtaagattatttctgaaatgtttggattttgcctttaattattagtaagataactgcggtttactatttaaccatatttattcatattctgattttttcacttaacattatgacataaacattttccagttttatccccacactggaaaactagagtgtaataatgaaaacattattatttctgtgttaatgggtattctctgttaggatttttacaaaagtgggttatttgactactccttttaggcatttttattatattttctttcttcctccctctttttccatctctttctctgcctctctgtctctgtctgtgaggtctcacagtgttcccaggctggactcaaactcttggtgctcaagcaagcgatcctctcaactcagcttcctgaatagctgtgactacaagcgtgggccactgtgccaggcttgattttccaaattgcattttcaaaaaatctcctcccatatttgggatagaagacatccaggtggttcatactcatttaccagggctgtcttaagactttttaatgcaataaaacatatttttaactacacacttagttctttcatttactcctgaactaatgttaatttctacttggaaaatgaaaaggttatttactttttttttcctgaaatgctgacaatatgtgatatcttaatatctgtaattcttagtgaaagttatggtatagtataggtgaagctgtagtgtttatatcaatagatgtgaattcaaatgagcaatctaataattatttactattcaattatgttaattttcttctctttgtctcccattgtttctgcagaggcagttggtgtcaccagccagcgaccagtgttttgtccttttcataaaaaggagcagctgaagctgtactgtgagacatgtgacaaactgacatgtcgagactgtcagttgttagaacataaagagcataggtaccagcatctttggttatatatatagattcatatgcagctttagaggactaaaggactgctgccaaccctcatcaaatggcagtctgcaaataggttttgtttggccagcactatgctggcctgtactggggtttgtcacttttgacactattgatgttttgggctaggtaattctttattgttgaggactgatctgtgcattatatggtggtcagcatccttgacctctaccaactagttaccagtagcaaccctctaaccctccccagttgtgacaacaaaatgtggctccagacattggcaacgtcctatggagcaaaatcatcctgagttgagaacactggccaacacactgttttaaaatatatagaactagttgccagcattgtaaaatggggagattttacattttttaaatatctagatttctggcttttttgagaaaacggaagctgttctagccctgggtctgtatacttcatgtcaacatttgaggcatgccttttccagttcattatagttcctagcaaagctcacttttaaatctgatctcaacagtcattcaaaggtcagcaacagatgatttagacagtaagattcggattgatacaaatataattgcttatgatggtctaggctcccgataatggcagactagataatttggatcaacagtgagaatgactagaaaacctgcacaaaatacagaaattgtctatatgaaatgctagagcaaatagtaaagcattattggacaggattgggttggagttggggctaagaatggtgggggcctttttctccccttgaggtatttgcccagagattgaggagtaattttgataggctcacagggctgagaaatcacagcttagagtgcaaggatcatgcatggtgaatgtgtctccttgtcttgagttgggaccctgaaagtctgcactattatagtaaagataaattagctagtaagttgttcctcacagggactaaagctcagcaactaaaattggattaaagtgaaatcatatcgctggctcctcaagtttccttgtagaatcaaatgtaaatccttgctagaaagaaaaagaaaacatctaggcctccaacttattcaataatgaattttgcaaaaacagtattcacagaattagaaataaccaggtttgttaggagattagacaatgcgaacatagtgagaccccatccccacaaaaaattagctgggcaaagtggtgtgtgcttgtattcctagctacttgggagactgaggtgggaggattgcttgagcccaggagttcaagggtgcagtgatagtgccactgcactccagcctaagtgacagaatgagaccctgtctttaaaaaagaaagaaagaaaaccctaaaaattacagtaactgaaattaactcagtagaagggcttaagaacagatttggcctagcatgaaacgagaattaatgagctagaagaaaattaagaaaatatccagaaagaagcatcatcagcaagaggaggatgaaaagtagaagagattaaacatctaatgtggatgtaattgcagtccaagaaggatggaaagtacagagaatgggaaggaagcaatactcgaagacagaatgtaatggctgagaactttcagaagctgacgaaaggcattcagcccatatttaagaagttgcacaaacctctagcaggataattaagaaagtaatatttttaaagtgcaaaaagaaagtaactttcaaatctaaaattctgtacctggtaagcatattctttaaatatgaaggtggttgaaaaacgtttcaggcaaaataaactgggagagcatatccctgctaaactctcatttaaagtacctcttagtagaagaaaaataataggagatacagaaaggaaaatggagcaataggtatgagtaaatctaaatgaatgttgacttaggaaacaataatatcttgttgatgtggtgtgcgtatatgtatatcacatagcagcaaatgtactaaaagggtatggaatttatgttctaaggtccatgcatagtctaggaagagggtgaaaagtaccaatattagatgatatgtaaaaatctgttcttgtaatgtctagagtagtcactaaaagaataataagtacatataattaccaaggtgtggagagttgtggggatgtggaatagttaatcagtataaacaaaggccaaaaaaatgagaaaaagaaataaagaacagatggaatataatgagaccttggtaagttggtagatctacaaatatactataattatactaagtgtgaacagacaaaatgttccaaattacaagacaggtttcggactggataagaaggaaaatagaaaaatgtgctattttctttttatgagaaatatctaaaaactcaatgtataaaatacttaatgggaaaagacacaccatataaatattaaccaaaggcaagatggtatagtagacaaaatccattatttgaggtaaagagggacactttgtaaggatgaaagtctctcttcatctgaaagatatgagttgtaaatttatacaggttataaacttacaaaaaaatgacagaatttcaaactaatagaaaactccatagtcacagtggaaaatcttaccactttatgcaataattgaagccgagcagtgtggcaggtgcctgtaagtgctagctacctagctactcgggaaactgagaaatcacaggtgggaggatggctgaagcccaggagtttgagttcagcctgggcagcatagcaagacctatctctaaaaaataagtaagtaagtaaataaataaataacaaaacaagcagactaaaaaatcagtaaagatagagaaataagggccaggtgcagtggctcacacctgtaatcccagctactcgggaggcttaggcaggagaatcactcgaacccaggaggtggaggttgcagtgagctgagatggcaccattgcaccctggccgaggcgacaacagcaaaactccatctcaaaaaaaaaaaagataaataagattgaataccacaattaacataacgtcttatggacattgtggaacactgtaccccaaaatatacattcttacaataaaatatttttaactgaccatatgctaaagtcttaaatttgaaaatattgaaaaataccatatatttggaaatgaaattcttgtgataactaaagtctactgatacacaatcctggaattctagattaaaggaaaaaattatttagaagacattattgagacaaatgatataattaagaaacatggtctatagtttaaagtactgtaaacaaagtcattttttttttaactgtactatgggcacataagaaaatccttttttttaggaaatgcacactgaattattaaggggttgaagggctatgaggaggcaaactaaaaattgattaatctgtataaggagatatatgatctctatatacttgcaaatttaactttgaaattgttttaaaataaacagtttaatacattcaaatcatcaagaagaaattccagtagatggtagaaaacattttcatctgaatgatagtgaaaaacatcagtcaatcaagccttgaggtttttctttttaataactgaagccatatttggaggacaatttatattattaaatgcatatgttatatgttgaggataaagtcaattcactaaacatttattgcagtttagggaaagtaggtaattaaacccaaagtaagtgggttttaaaagaaacataataaagacaagtgtagaaatagtcaaagccaaaaattcagtctttcaaaagactagtaaataatcaacaattctctgtatgagtgattgagagagcaggcccaaataaccactaccaggagtaggaaggtggcattactccatatttcaaatgcattttcaaagataaaaaggatatctgtcaataataatgaaaatttttacatgatattggaaaacttagagaatgaagctttttaacaaaacttttgctaaatacaatagaaagtcagaatagtcttttaatgttcattcataatttaaaaccttcccacaaagaaaattacacatgcaaatgacacagatgaatgtaccatatagttaaggcaaaaatagccccttttggccgggcgaggtggctcacgcctgtaatcccagcacctggggaggccgaggcgggcggatcacaaggtcaggagattgagaccatcctggctaacatggtgaaaccccgtctctactaaacatacaaaaaattagccaggcgtggtggtgggtatagtcccagctactcgggaggctgaggcaggagaatggcgtgaacccaggaggcagagcttccagtgagccgagatggggccactgcactccagcctgggcgacagagcgagactccgtctcaaaaaaaaaaaaaaaaaaaaagcccctttcttatacaaacttgtctggagaatggcaaaaaaatgaattctttccaacttgttatatgaagccagcataacctttacaccaaaactgacaaggaatagaaatggaaaattacaggccagtctcactcatgaaatgaatgtaaaaattccaagaaacggaaaataagtaggaaacagatgatttgagaggaggggaaaacttgccttaaatctcgtagtattgtcattttgggacagtgtaatcacaaccaatttggcctcatcttagggatacagaattcatttaacatgccaaaatcattgatgctaaaatcttgcatgtcatattaaaagaataaaggaaaaagtatatgcctatctcaatagaagcagtagaaacattccataaaaattaaatatacattcatgatacaacatcttagcaaactagaaataaaaaagaacttcctaaacctgataaagattatttatggaaagcagaaaacgtacttaatattggaatattgaaagtctttgcattgagattaggaacaacataagggtgaccattttgaccatttcatgtaaccttatattaaataagggtagtaaagaaaaagtttactaaggtaaaaaaaacttgagttgcctataaaagtatttgaaatgttataattcacagatatgattatatactaaggaaatccaatgtaattattaactgggtatcccctttttctaactggcaaccctatttagttacatgtaaacatttaaaatcacattatataaaattgttaatttagaaatactgtattttgtacattttatagaaaaacttaaataaaattcttgttatgtatcttctatatcgttgcctttctatcttctctagaacttctcttgagttatcaaacatagtctggcaaagtaaatcatctttcctcagtttcaaattggaaactttttaaagtgctgtatctcattatactgttgcttaaaagttttattacaaggcataacatcaagaattttgcccttctctgtctgtatttatcctgatttatcttgtggcccctagaacataactacctattatttaaaagtggtcttttaaaatgtttattttcagcaggcttgcataatgtagaaattacaaaatagttaataaatctgattatgtataattgactattttttgccaagtccaccaagtgaaagtgaactctgtaagcttataaaaactgaatgatggatgcatgtggttctcaaactttcaaaatatttatgtgtccataatctttcttgagggataatttgagaggtgagggaaacttgccttattagggatacgtttgatgttttaaaagattattatataaattctttataatcctattttatgtttttatgtctttttttattcttggactttttcctcattgtatatttttatatgaaataatttgcttatttcttcagataccaatttatagaagaagcttttcagaatcagaaagtgatcatagatacactaatcaccaaactgatggaaaaaacaaaatacataaaattcacaggaaatcagatccaaaacaggtaattttatggtattatgtaatcatttttatataatttgttaagtatattcacttttagaacattttccttaagtcacagttaagtaatacgttgttagatgactgcaataacacatgactgataagactttcccagaaacttagttggaaagcattcttttctgctgtaaaatttcaaaactaataataaactacacttagtattttaatagctcatttatctaataggtattgataacttattatcacttattttccaattttaaagaaataccaaaatttaaatgccaaatcaaccatttttttgccagtattgtaaaatattttaacacttgaataaacccttaattgttattttaaggtttgctgaaatttgagatgcctgccttatgctgcaatttttttaaaactgcaaacaggtggaaattttaagacactaggatacagggattgttaaactgttccgcacactttttacttcttgtctgataaaatgcttacttacacaattacttgttatgccttttgccctggtaagaaaatcatcaactgtccaaagtcttagacatcagtgattagggagaaccactaacctccatggagcgggggcagctggaggtgttgtctaacccctttttaaaatcccatttagggcacatactgacatttaatttacacacctatgaaatcccatgacctcttctgttgttttacacacaaaagaaatgtcactgcctaaataagtcaagaaatgtttattagaatgagccagcgtaaaagagacctcacagagaatttaaatgtttttctatgtataaattgtgtcagactttaaggcagtcatcacaatctattattatcattttggaacatagctgggggtggagcatttgggaatttttttaaggtaattaaatccctgtattacctgattcccttaaaagagatttttacacatagttttaccatttcttgatgccccagcatcattcttatatctgtttattattatgcattatgttgtgtatcttttagtttttcttgttatcagctctcatttgtttttacctctgtttttgttttttgttttttgtttttttttgagacggagtctcactctgtcacttaagctggagtgcagtggtgtgatctcagctcactgcaacctctgcctcctgggtagctgggattacaggtgcccaccactgtgcccagctagtttttgtatctttagtagagatgggctttcaccatgttggccagcctggtcttgaactagtgacctcaggtgatctgccacctcagcctcccaaagcactgggattacaggcgtgagccaccatacctggccctgtttttacttttctctttgacacaactatagttaatgaaatactattttctttatttaccatattctaatcagaatagtatattttgccaagtagaataattggtgggtttaaactttttttattctgagtaattgaaaatttgtaatgaatatttattgaatgaatgaagagagataattataggcatttctaccatctagtggcaaaaggtagcaatcataaaataattaattttaaattaaacatctgcccttaatgaaatttatccctttgacttttttcttactgtttcactgagtatatggtttgatttatggtcaaagtttacatttttttttatgtaccgctgtcaattttttccactatcatttgttgaaaaaactttctgttgaattgtttttcagcacctttatagaccatatatatgtgtgggattattctgttccattgtgtttttctcattgctagtacttcactttcatgatcatgatcattgtagttttttatagtaagtcttaacatagtgtttttcaaatttcttcttttatttttataaatgatttgtgctttttttcttctacaaaataataacattgtgtgtaacaattttgatttctgaattgaggcaaaaaattaaacaatctttgttaagtgcaaattgcttacatatctttatagcctatgtgattataaaagggtacatttattagagtaactggtagtcatttttatgcatttgaccccatggcactgtttttcccttactcatcctattctaccatcatgaatatttaaatgacttttttgagattggttgcttctcaggcttatctggttcccttgatcctgtagtaatgttgatgtcaaacaattatctggaagaatttccagcaggaaataaagtctctgccagtttggtcttgagttttggagggtaactatgggagaagcttacagaagaaatgaagcttttaatttaatctcacaaagtttggtggatgctctgttattttctataagatattctggtgtggtaccgtatgtttttctttctgtaagagtgttgctggaatcaggagactggagagaccagtaggtgaaacaggaggattttattgagtgcactcatacccagcggattaatatccaaagaccaggcctagaacaaagactgggcctagaacaaaggctgggcctagaacaaagactggacttggcttttatacacacttctaaaaggggatgggctagtttgaaacaagcttacagtggcgtgaagcatagtggtgtgaaagctcaggtacagaagcagaacaaaggcagttaatcatactttgacaggttcataactcaggcttacaatgactcttgctatgcggcctagatggctgttatctaggcttgctctagtgccttgtgctggcttatctcataaccttcactatggtgtctagatggctacaatccaggcccgcccaggcatgtctcatgactttcactgagctgcttagataaaacaatgcttgaagttactagttatagaaaacaagaatctataaactcataagtttactcataccataggagaaagaaaaataaagaaaatttgtttttttcttctccccatgttgggggagtgctgggagagtcttcagagcacattcctttgagccctagcttcttagataatattatcaagactttcctgggtctgggctgtgcctgtttctgcctctgggataagtcagcctaatacatgaaagcttgtttttcaaacttgcttttctctttttaattttatttttctttttttttctttaatttcccacctcaagagaagtatgtggttgataaaacatagttatttggctgctaattttgcaaagaatgggttaagtagcaaactactatttttgtctttttctatttaggtgtatgaatactgtagcagttaagaatactaagaaaagagtgtcacatatacacttttctagctttcggttgcaattaatatagtagaacatgttcagaatcatcatggtttataaatcctttttggtccacccccacccccccccccatccttttaggtagagcattgattttcctgggtgttctcataatttttccaaaccatattttcttaaaatgtactcattctcttctaattttatatatatttttaagattcaagacttaattttaagattgagtggtgatatctttcagaagaattatatttctgctgtctcatcttcaagacagtcaatttaaagtgaaggactcagaaatagagcttctaagggctgaaaacattttggtctaatttagacattaaaacgtcaattttaaatattatacaaaaaaactgccttatgtttttccccgttttaattttcagaattattgaagtaaatcaaaatcaaaagcaggtggaacaggatattaaagttgctatatttacactgatggtagaaataaataaaaaaggaaaagctctactgcatcagttagaggtaagtgactgcccatgggatagtatattgattcaacatagtatttcctaaagtactgtgaagtagaaatcatagtgctttttatatagttgtttcattgtgatttaatatttttttttcccactcccaagttttcctttgctgggttttgtattgtagctgacaatttaaagctttataatacgctatgaatgtctgatgactgattgttttctttatagcacaaattataatgccttgcttgtaggaggatctctgaatgttaaacagatgagttattttcgagatgcactgaaatgaaaattttgcatcaccaaggtggtttagtggagcagaattttctagaaagatacactgttcgatttagttctcaaatatatatatttaaccctgtgagaagttaggtaaaagaatatggctagccctgccctcaacattttgtaattgtaattgcgagagcagcacttagggagatatgcccaaggcacttagttgtttctcactgcaggtaagaaaaacattaccatcttcctcagctttttaaaactcatgaaggtcaagatccaaacttggtgtttgacttcaaatcatataaggttataacagctacatggtacattaatgtataatattaattgcatgatttttaggtattcttttagtacgttgacatagaaagcatattgatacagtaaagaagcaaatgagaaaaaaaagaatcctaatgtttgaagatttgaggaaaaataagacttctagaaataatttaggtcatcctttttatatcataatttaccaaattaaaaggtttctgtcagaaagttctatcccttctgggaaagcatggtcattcctgtgtattatcagctgtacaggaaacaaagactaaaataattctctgttcttttggaaacgtagttatttagtgaggaagtattctgggcaggaacaatcagaccccatttatagtaactatttgttcaaggtctgtgactttaaaaaaaaaaaaaaatttaagtacaattttaagtttccaaaactgcttaaaatcaaatatcactttgatttgctttcccagatattagtagtgcatacattactatgtctgtgttttcaaacttgactgtacatcagaatcacttgaagagctttacaaaggagatgaccagacttgcaaatctgtaggaatgaacctggtcagtatatctactgatgaccaggttcattcttaaaattaaaaaaaaattttttttgagacagggtctcactctgttgcccagacagaagtgcaatagcgtgaatcacggctcactacagcctccacctcctggtctcaggtgatcttctcattgcagcctctcgagtaattaggactacaagtgtatgccaccatgcctggctaatatttttttttttttaagagggggggttttgacacgttggctcaggctggtctcgaactactgggctcaggcagtctgtctgcctcagcctcccaaagtactgagattacaggtatgagctacccaccttgccccccctttgttttttttggagacagtgttttactttgttgtccaagcttgaatgcagtggtgttttcactgcagccttgacctcccaggctcaagcaatcttcccaccccagtctcctgagtagctgtgcaaccacacctgactaattttttatttttgtagagatgaagtctcactctagtgaattttcttattttactttttagagacaaggtctcactctgtcacccaggctcgagtgtagtggtatagccttggctcactgcagcctcaaactcctgggaaactgggactacaagcgatcctcctgactgagaagctgggactacagggcgtgtgctgccactcctggctaatttattattattattattatactttaagttctagggtacatgtgcacaacgtgcacatatgtatatgtatacatgtatacatgtatacgtgtatgttacatacgtatacatgttacacgttacatgttacatatgttacatatgtttacatgtgttacatatgtatacatgtgccatgttcgtgtgctgcacccattaactcgttatttacattaggtatatctcccaatgctatccctcccccctcccccaaccccacaacaggccccggtgtgtgatgctccccttcctgtgtccaagtgttctcattgttcaattcccacctatgaatgagaacatgcggtgtttggttttttgtccctgcgatagtttgctgagaatgatggtttccagtttcatccatgtctctacaaaggacatgaactcatcattttttatggctgcatagtattccatggtgtatatgtgccacattttcttaatccagtctatcattgttggacatttgggttggttccaagtttgtgctattgtgaatagtgccgtaataaacatacgtgtgcatgtgtctttatagcagcatgatttataatcctttgggtatatacccagtaatggaatggctgggtcaaatggtatttctagttctagatccttgaggaatcgccacgctgtcttccacagtggttgaactagtttacagtctcaccaacagtgtaaaagtgttcctatttctccacatcttctccagcacctgttgtttcctgactttttaatgatggccattctaactggtgtgagctggtatctcattgtggttttgatttgcatttctctgatggccagtgatgatgagcaatttttcatgtgtctgttggctgcataaatgtctttagagaagtgtctgttcatatcctttgcccactttttgatggggttgtttgtttttttcttgtaaatttgtttgagttcattgtagattctggatattagccctttgtcagatgagtagattgcaaaacttttttcccattctgtaggttgcctgttcactctgatggtagtttcttttgctgtgtagaagctctttagtttaattagatcccatttgtcaattttggcttttgttgccattgcttttggtgttttagacatgaagtccttgcccatgcctatttcctgaatggtattgcctaggttttcttctagggtttttatggttttaggtctaacatttaagtctttaatccatcttgaattaatttttgtatcaggtgtaaggaagggatccagtttcagctttctacatatggctagccagttttcccagcaccatttattgaatagggaatcctttccccattgcttgtttttgtcaggtttgtcaaagatcagatggttgtagatgtgtgctatttctgagggctctgttctgttccaaaggtctatatctctgttttggtaccagtaccatgctgttttggttactgtagccttgtagtaaagtttgaagtcaggtagtgtgatgtctccagctttgttcttttgacttaggattgtcttggcaatgcgggctcttttttggttccatatgaacttgaaaatagttttctccaattctgtgaagaaagtcattggtagctcaacggggatggcattgaatctataaattaccttgggcagtatggccattttcacaatattgattcttcctatccatgagcatggaatgttcttccatttgtttgtgtcctcttttattttgttgagcagtggtttgtagttctccatgaaggggtccttcacatcccttgtaagtgggattcctaggtattttattctcttcgaagcaattgtgaatgggagttcactcatgatttggctctctgtttgtctgttattggtgtataagaatgcttgtgatttttgcacattgattttgtatcctgagactttgctgaagttgcttatcagcttaaggagattttggactgagacaatggggttttctaaatatacaatcatgtcatctgcaaacagggacaatttgacttcctcttttcctaattgaatacactttatttctttctcttgcctgattgccctggccagaacttccagcactatgttgaatagtaggagtggtgagagagggcatccctgtcttgtgccagttttcaaagggaatgcttccagtttttgcccattcagtatgatattgactgtgggtttgtcataaatagctcttattattttgagatacgtcccatcaatacctaatttattgagtttttagcatgaagggctgttgaattttgtcaaaggcctttcctgcatctattgagataatcatgtagtttttgtctttggttctgtttatatgctggattacatttattgatttgcatgtgttgaaccagccttgcatcccagggatgaagcccacttgatcatggtgaataagctttttgatgtgctgctggattcgatttgccagtattttattgaggattcttacatcaatgttcatcagggatattggtctaaaattctctttttttgttgtgtctctgccaggctttggtatcaggatgatgctggcctcataaaatgagttagggaggattccctgtttttctattcgttggaatagtttcagaaggaatggtaccagctcctccttgtacctctggtagaatttggctgagaatccatctggtcctagactttttttggttggtaggctattaattattgcctcaatttcagagcctgttattggtctattcagggattcaacttcttcctggtttagtcttgggtgggtgtatatgtcgaggaatttatccatttcttctaaattttctagtttatttgcatagaggtgtttatagtattctctgatggtagtttgtatttctgtgggatcggtggtgatatcccctttaacattttttattgcgtctgtttgattgttctctgttttcttctttattagtcttgctagcggtctattttgttgatcttttcaaaaaaaccagctcctggattcatcaatttttttgaagggttttttgtgtctctatctccttcagttctgctctgatcttagttatttcttgccttctgctagcttttgaatttgtttgctcttgcttctctagttcttttaattgtgatgttagggtgtcaattttagatctttcctgctttctcttgtgggcatttagtgctataaatttccctctacacattgctttaaatgtgtcccagagatccaggtacgttgtgtctttgttcttattggttgcaaagaacatctttatttctgccttcattttgttatgtacccagtagtcattcaggagcaggttgttcagtttccatgtagttgagcggttttgagtgagtttcttaatcctgagttctagtttgattgcactgtagtctgacagacagtttgttataatttctgttcttttacatttgctgaggagtgcattacttccaactgtgtggtcaattttggaataagtgtgatgtggtgctgagaagaatgtatattctgttgatttggggtggagagttctgtagatatctattaggtctgcttggtgaagagctgagttcaattcctggatatccttgttaactttctgtcttgttgatctgtctgatgttgacagtggggtgttaaagtctcccattattattgtctgggagtctaaagtctctttgtaggtctctaaggacttgctttatgaatctgggtgctcctgtattgggtgcatatatgtttaggttagttagctcttcttgttgaattgatccctttaccattatgtaatggccttctttgtctcttttgatgtttgttggtttaaagtctgttttatcagagactaggattgccacccctgcctttttttgttttccatttgcttggtagatcttcctccatccctttattttgagcttatgtgtgtctctgcatatgagatgggtctcctgaatacaggacactgatgggtcttgactcttgatccaatttgtcagtctgtgtgttttaattggagcatttagcccatttacatttaaggttaatattgttatgtgtgaatttgatcctgtcattgtgatgttagctggttattttgccctttagttgatgcagtttcttcctagcatcagtggtctttatgatttggcatgtttttgcagtggctggtctcagttgttcctttccatgtttagtgcttccttcaggagctctggtatggcaggcctggtggtgacaaaatctctcagcctttgcttgtctataacggattttatttttccttcacttatgaagcttagtttggctagatatgaaattctgggttgaaaattcttttctttaaggctgttgaatattggcccctactctcttctgtcttgtagagtttctgccgagagatccactgttagtctgatgggcttccctttgtgggtaaaccgatctttctctctggctgcccttaacattttttccttcatttcaactttggtgaatctgataattatgtgtcttggagttgctcttctcaaggagtatctttgtggcattctccgtatttcctgaatttgaatgttggcctgccttgctaggttggcgaagttctcctggataataacctgcagagcattttccaccttggttccattctccccgtcactttcaggtacaccaatcagacatagatttggtcttttcacatagtcccatatttcttggtggctttgttcgtttctttttactcttttttctctaaacttctcttcttgcttcgtttcattcatttgatcttcaatcactgataccctttcttccagttgattgaatcaggtactgaagcttgtgcattcgtcacgtacttcttgtgccatggttttcagctccatcgggtcattttaggacttctctacactggttattctagttagccattcatctaatcttttttcaaggtttttagcttctttgcaatgggttcaaacttcctcctttagctcggaggagtttcatcgtctaaagccttcttctctcaactcatcaaggtcattctctgtccagctttgttccgttgctgtctaggagctgcgttcctttggagggggagaggcgctctgatttttagaattttcagcttttctgctctgttttttccccatctttgtggttttatctacctttggtctttgatgatggtgatgtacagatggggttttggtgtggatgtcctttctgtttgttagttttctttctaccagtcaggaccctcagctgcaggtctgttggagtttggtggaggtccactccagaccctgtttgcctgggtatcagcattggaggctgcagagcagcgaatattgctgaacagcaaatgttgctgcctgatcgttcctctggaagctttgtcccagaggggtacccggctgtgtgaggtgtcagtctgcccctactgggggtgcctcccaattaggctacttgggggttagggacccacttgaggaggtagtctgtccgttctgagatctcaaactccgtgctaggagaaccactactctcttcaaagctgtcagacagggacatttaagtctgcagaggtttctgctgccttttgtttggctatgccctgcccccagaggtggcgtctgcagaggcacgcaggcctccttgagctgcagcgggctccacccagttcgagcttcctggccgctttgtttacctactcaagcctcagcaatggtgggcgccccttccccagcctcgctgccgccttgcagttcgatctcagactgctgtgctagcaatgagcgaggctccgtgggtatgggacactccgagacagacgtgggttataatctcctggtgtgctgtttgctaagtccgttggaaaagctcagtattagggtgggagtgactcgattttccaggtgccgtctgtcacagcttcccttggttaggaaagggaattccctgacgccttgtgcttcccgggtgaggcgataccttgccctgcttcggctcacactcggtgcactgtacccacggtcctgcacccactgtccgacaagccccagtgacatgaacccggtacctcagttggaaatgcagaaatcacccatcttctgcgtcactcacgctgggagctgtagactggagctgttcttattcggccatcttggaaccactcctccgccacccctgtttgtttttttttttttttttttttttttttttgtaaagacgtggtctcactatgttgcccaggctggttggagtccttttttaaaggcaaataaaaataaccccttttatctgttaagactcataagaaattggctgaaatagatattaggatagaggaccaaaaatccagggcttctgattcttaattctcaaccttctccaaagtaaacaatttctattcctactagaatgtttccaaagaaacacttaataaatttttacagaggtcaaaaatagtctactaggcaaattactgtctctctgaacttaaattagatatggcagagccgttggatgttgttagtagtccatcaaacagacaactaccatttcctccttaattcaatgtagctcaagtgtattttccaaatctggaactgactagggctaggatctgggttcgctttttattgagaatgtaagtccatgttgtagtatagcaattttacttgtaaacatttctaatttgtctgagacagcagaaagtcctgttttcctcctttttccttgctaggtctaggatgaggtttttggttaggaacctttaaaataacccaagttcagtgtgctctacttttgattatccatcttctctaaggaaagcacatacatacctcctttagagaaatctatattcttttatgtagcttttgttagagtgcattggcccactcattcagtgcatctgttggctccgatgttaattctcaatagacaaataatatgatgccttttaagaaaattaccacatacaaagggtaagtgtcatctacaacacagcatgactctgttttgcacaaactacttgcaattccaactgttaaatagaatccctaaaaggtgaaatcatatgattgagtaaattatgtgatagagttactttataggtttgctggacagtacatctgttttatttgtgaatgttgaatttcatagacatttactgtactatagctaatctttccttttttgtgtattgtaacatgcatgaacagagttaaatcccagaatatgtaaaacctgatccagggccttgaggagtgaggggccacattgggatgcagttttttgccatagtgaaagtgatcctttatactaatagggaaaacagagtatttttagtttcagtaaattgagtaattagagattgtagttattctaatttgtttacctggaaatgaccatcaaagtctatgttacatgctgatactaattttgaaactattttcttgttttcagagccttgcaaaggaccatcgcatgaaacttatgcaacaacaacaggaagtggctggactctctaaacaattggagcatgtcatgcatttttctaaatgggcagtttccagtggcagcagtacagcattactttatagcaaacgactggtaagataaagtatgctatttaatatactgtaaaaatgcacagtaaaacaatggagccattgtaatgcttaaaatttattctgcttgtgcatcagtgctttttacctatttctaatatctatcaaaatattttggttttaatatttttacctggcataatttgggtgtaatttcagttttaatttatcattaattcctttttttgttctttccaagtattcactgtcttcatagcaattgaagttaatatcaaaaataaggatgatagtgaacattttctgattatctatagtgtgccaggtactaattctaagaatttccatgtaatatttaaacttttacctcattcttatgagatatacctattcaccccccttgtacacatgatgaaactaaggcatgtgattatgtaacatgtctaacatcacacaatatgaggtatagccagggtttataatatgatctcagacatgacctgagcctgtgttcttcttcttggtgctgcacggcaatctgtagtgctggatatttttgccacagaaaaatagctctgtgatttggtgaactatttgacattggtctagaaccttactacttcacatatgactaccacatcacttgaggattctggtcaggagatctggggtggggcttgtgaatttctaacaagccttcaggtgactctgatgctgcttggtctgtgggctgtgctttgagtaacaaagatatagaagacatttagctacattcttaaaaattcctgctttacattaatcttattaaagattcaacagagatttatactccgaagtatactataaaccataggttcagttccagactatcgcagtaaagcaaatatcataataagccaagccatacagtttttttaagttttccagtgcatataaaagttttgattataaatactgtagtgtaactgtgcagtagtattatgttttttaaaaaaacagtgtatatacctcaattaagtaatctttttttttttttttttgagacagagtctcactctgtcgcccaggctggagtgcagtggcgtgatctccactcactgcaagctccacctcgccggttcacaccattcttctgcctcagcctcccgagtagctggaactacaggcgtccgccaccaggcctggctaattttttgtatttttagtagagacggggtttcaccatgttagccaggatggtcccgatctcctgagcttgtgatccacccgccttcgcctcccaaagttctgggattacaggcgtgaaccactgcacccagcttaaagaatactttattgccaaaaatgttaatcatctgagccttcaagagtcataatctttttgctggtggagatgttgatggccactggggttgtagttgctgaaggttgggatagctgtgtcaatatcttaaaataagatgacaatgaagtttgcattgattgactcttttttagtggaagatttctccgtagcatacaatgataatttgatagtattttacctacaatagaacttctttcagaattggagtcagtcctctcaaagccagtagctgcggtatcacctaagtttatggaatattctaaattctttgttgtcatctcaacaatgatcacagcatcttcaccaggagtaatttctatctcaaaaaaccacttttctgtgctcatccataagaagcaactattcatccattcaagtttgatcataggattgcagcaattcagtcacatctttaggctctacttattattccagttctcttgctgtttctaccacatctgtaattccttcttcactgaagtcttgaactcctccaggtcatccctaaaggttggaatcaacttattcctaactcctgttattgttgatatttttgtctcctcccatgaatcactaaggttcttaatggcatctagaataatgaatcctttctagaaggtttttaatttactttgcccagatccatcagaggaatcactgtgtatggtggctattatactagccttatgtaacgtatttcttttttgtttttgagatggagtctcactctgttgcctaggctggagtgcagtggtgtgatcttagctcactgcaacctctagctcccaggttcaagcaattctcctgcctcagcctcccaatagctgggactgtaggcatgcgccaccatgtccagctaatttttctattttttataagagatggggtttccctatgttttccaggctggtctcgaaactcctgacctcaagtgatccacccgccttggcctcccaaagtgctgggattacagcatgaaccactgcacccagccgcataatgtatttcttaataattatttcttaaataatacttgaggccatgcacctataatacaacactgagaggctgaggcaggaggctcacttgaggcttggagttcgagaccaccctgcgccacagggtgagaccctgtcgctaccaaaaggagaaaaaaaaagacatgagaatcagaattacttcttgattcatgggctgcagaatggatgttgtgttagcgggcatgaaaacaaccttaatctcatatatttccatgagagctcttgggtgaccagttgtatttgtcaatgagcagtaatattttaaaatcctttattttctgagcagtgggtctcaaaagtgggcttaaaataataactaaaatatattgtaagtagatgtgctgtaatcccggctttgttttcacttatagaacacaaaagcagcgtagatttaggataattcttgagggccctaggatatttggaatggtcaatgagcattggcttcaatttcaagtcatcagctacattagtccctaacgagagtcagtctgtcctttgaggatttgaagccatgcattgtcttctctctatgaaatttctagatggcatcatcttccaatagaagtctgtgtcatctacgttgaaatgtgttgtttagcatagccaccttcgtcaatgatcttagctgtatcttttgattaacttgctgcagcttctacattagcacttggtgcttcaccttgtacttttatattgtgtatactgcagaatggatggtttctttccataaatctcatggaccaacctctgccaccttaaaactttcttttgcagcttcctcacctctcacagccttcattgaattaaaaagagttttaggacctttctctgaattagatcttgggttaaggttatgttatagctggcttgatcttctatcaagaccacaaaactttcttcctatcagcaataagtctgcttggcattctcttcattcatgtgttcactggagtaacactttcgatttccttcaagaacttttcctttacattcacaacttggctaactggtgtgagaggcctagctttcagcctgtctcagctttggacctgccttcctcagtaagcttactcatttctaacttttgattagtgagagtcatgcaactcttcctttcacttgaacacttagagactattgtagggttattaaattgttgtgtctgagactacggaggcctgaggagaggaagaaagaatggctaaattggtggcacaaacagaatatactatttatgtttgctcttacatgggtgtggtttgtggtgtcccaaaacagtcacaatattaacatgaaagaccacaatcactataacagattattgttaagaattaccaaaatgtgacagagacacgtgagcatgtgcttgctgttggaagaatggtgctgattttctcaatgtggtgttgtcacaaaccttaaatttgtaaaatttacagtacttacgaagcgcagtaaagcaaagctcagtaaaatgaggtatgcttgtattactacctctaaatgaagttttctgtcacctattccaaaaaatggaagtccagaaattttctatacaattttaaaataaggaaatgtgattctggataaactttataaagtaacttcaaatattgagtgacatcagagttctataacttttcttaatcatgaattgtatttaattcttaggatttgttttcctttcataattatcagtgctatagtctccatcctgagtcttattttttcattagttttaatggaaaacatctatacactatataccttctgtattctgttacttacatttttttgaaagtcaaatagaaaagggatagagggaatagagaattgtgtttttcaacttaatccatcatgagtatgtatgtgtaagacacattcatgcaatcagataagcattccgtcaatctccttatcaatttaaaaatgtgtttttcattgtgttctgattttgtttgattgtattatggagaaaataaaaatagatgggataaattaatttacacaatgaactgttgaaataggaatgaaagagatagtcatctatatgatacatagaagaaaataggagcagtgaatcatatagtaccagtattaccatattcttggttaactaaattttaaaatcctgtggaacccaagtgagcactgatgcatttctagtagcagctgtagataataatttgcctgtaatgcatgcagagctgaggttcatgattatttttaaacatttagaagattttctaacttcagaaaatgtgaaaatcattatattgtataactctgttctccagagttctgctttataaatatagccatgtttactcaggttatcctttaagtgatggattttatgtgcttaaaaaatggaaacgaaatgcctagcagccctgaaacctcaagcttggcttgctattttaaaaaatttatttatattttactatatatttaaagtgtacaacatgatattctgacatatatgcatattgaaattattgtttcagtcaaacagatgaatatccattatcctacttaccttgtatctatgtgtatggtaagaacacctaaaatccataacatttttgatatacataacagtgttattatggaggtttttttggtttattcttttggttttctgttttttttgttgttgttgtttgaaacagggtctccctctatcgcctaggctagagtgcagtgacatgatgatagctccctgcagcctcaaacttgtaggctcaagcgagccttttgcctcagttccccaagtagctgggactacaggtgcatgccaccatagtccagatttttttttttgtagagacaaggtcttgttctgtcaccccagctgtcttgaactacaggtgtgagccaccacatctggctggcattacagtgttattaactgtagttcttactctgtacattaaatctcaatgcttattcattctacctacctggaaatttgtaccctttgacttctctacatttcctacccacctagcccctagtaaccaccattccagtttgtcttcaactttctaaaaatattccatgtataagtgagattatacagtattttcatttctggatctggcttatttcacttaccatagtgtcctcaaggttcatccttgttatcacaaatagcaggatttctttccttttttaaggttggataatattctattgtatatatctactgcaatttatttgtccatgcatcattggatacaggttgtttttctatcttggccattgtgaataatgctgcaatgacatgggagtgtagatatctctacaaggtcctatttcatttcctgttgtaatatacccagcagagggattgctggacctacagtagttctgtttttaattatttgaagaacctccatatcgttatccgtagtggttgcaccaatctgcattcccacctaaagtgtacaaagggttccttttatccgcaccctggccaacacttgtcttccttgtctttttgatattagctggatcctaacaggtatgagatgatagctcattgtggtcttgatttgaattttcctattgatcagtgatgtggaacatcttttcatatgcctattggacatttttatgtcttctttggaaaaatataaattcaaactctttgcccatttcttaatcacgttatttgggtttttgctattgagttgtgtgagtttcttataccagttgagcatcccaacggaaatctgaaattctccaaaattcaaaactttttgagcaccatcatgacaccacaaatgggaaattacacacataagaattgaacacaccttggattcatgcacaaaattattagaaatattgtataaaattgctttcaggctatgtgtgttgagtatatgaaacataaatgaatttcatgtttagacttggaccgtatccccaagatatctaattatcaatatacataatacataaaatctgcgtgtgtgtgtgtgtgtgtgtgtatctatatattcacataaaaactatcaagaatcttactgtcttgccttctcttcctggcgtggaggcaccagcatggtgactgaggtcactgcacattggagagggttggggaaccgcaacaggcatgaagctggcagccacggatgtgaagtggtgagggaggaatacggaagtggtaagaagaattagccagtgtcatttggattttggttacattgagtaaataagtaaatggattgaataagtaagtaaatatattgaaggtaatcgcagccaagtttccagagaaggtgtttagaaagaagttaggctaggaagggcccaaagatgtgttggattggaattaagagtacaagtatgaacttagagttttatttttattcttggactcagatctagcaataattatagatgtatatgtccatctgtatgtgtgtatgtattcgttgttggtgtgctgcatcccaatagcagtgaggtcacttccttccagatcttggtttcaaaataccaaagaaagggggggaaagtaaaagttgtgcccagaacatgttgttataccagaaaactaccaaaatgctcagagaataatggggacatgtcaaagggaacaggattcagtgtaaaagggctcccactgggaaaaccaagaacaaatttgaggatcaaaataagtcactgtaataataaattataacacactgaattaaataagattacatgaattcataacataaatcagtaaacagtagattatttgggggagaagttgataacaaaactaaaagttatagaaagaacaatgggtatacagaagcacatttgaccactatcatagagataatttgggaggactaattagtggctgtaaatatgctgggtagaggactgatggggaacagagtattagtagaatctcagaatacctcttcaactttaaggttaagaaattgagtagcagaattatagatcaagattaatatcaccagtggtatgacaagttgacatcctacgtttcctggcacgtcatcatttgtgtggtattcttgccaagaatactgtaactaagtctgatcaggaggaaatatcacccaggttaaaggtcatcctgcggaatgtaaggcataaaatcttcaaaacacatcagggacatgaacgaaagggaaagactgagcaactgaaaaatgaggcagctaagcaacttatatccttgatggcatcatggaaaagactgctgaaactgttggcatttggatgaagtgtttaaactggatggctgtgttgtaacagttggtttatgaatttggaatctgggatttggttatgttagaagatctttgttttaggatatccatactgcagtatttagggaagacaggacctcattcctgtagcttgctctcaaaagttttggaaaaagactaataacgtgtgtaggagcagttgggtgggcactggagcaaatgtggtcataacttaacactcagggaatttgggtgaaaggaatgtagggttcttttacttttctggcagtgtttctatgatttcaaaattatttaaaaataaatgattaaatggctattgtcaaaaagataaaggtaacaagtgttggagaggatgtggagaaaggggaacgcttgcatcccgttggtgagaatgtaaattagtacaaccatagaaaacagtatggaagttccttgaaaaattacatatagaagtatcatgatccagcaatctcacttttgggtatatattcaaagggaatgaaatcaagatcttgaatagatgtatgtactcctgggttcattgcaacattattcacaataaccaaaaaatggaatcagtgtaagtattcaacagataaatggataaagaaaatgtggtacatatacccaatggaatactattaagctttataaaagaaggaaatcctgtcatttgcaacaacatagatgaacctggaggacattatatttacttcatgatctcacttatacgtggaaaaaagttaaactcagagagagtagaatggtggttaccaagggctggaagggattcagggtattggaagggatgttgatcaaaggctgcaaaatttcaattagataggaggaataagttcaccagagctattatacgacatgagacctagaattaataacactgtgtttgtattcttgaaaattgctaagagaattgattttaagtgttctcatcacaaaaaaataagtatatgaggtaatacatagattaattcaatttaaccatttcacagtgtatatttcaaaacatgctgtacacagaaacatattcaatttttattggtcaattaaaataatgctttttaaaaataaattattaaattttagataaaacaattattaaattttagataaaacatagttcttagaatatttcttatggttagcatgactgctgcctggtaaacactttgctacatattctacctagtcccaaaataagttatttatttatttatgtttttagagacggagcttccctctgtcacccaggcttggattgcctcccaggttccagtgattctcctgccccagcctcccaagtatctgtgattacaggtgcatgccaccacacctggctaatttttttgtatttttagtagagacggggtttcatgatgttggccaggctagcctcgaactcctgacctcgtgatctgcccgccttggcgtcccaaagtgttgggatgacaggtgtgagccaccgtgcctggcctatacgtatgttttaaaagtatagccaacgggatttgccgacaggttgaatatagggtgtaagaaaaagaaaggagccaaggactttaagttgtagggaaaaacagtattaccaataattgagatggagcaggttataggaagagtacacctgaggataaaaagtacagtcatgtgttgcttgatgacggggatgcattctgagaaatggtaatttcggcattgtgtgacatcataggatatacttacacaaacctagatggtttactcttttgctctgatctgtacagcatatcactgtactgaatactgtaggcagttgtaacataatggtaaatgtttgtatatttaaatgtagaaaaagtacagtcaaaatacaatacaaaggatttaaaaatggtacaccatggaggttgcagtgagccgagctgagatcgcaccactccactccagcctgggtgacagagtgagagtcaaaaaaaaaaaaacagtatacctgtataggtataaggcatttaccatgaatggagcttgcaggactggaagttgctctgggtgagcaagtgagtagaatgatgaatgactgtgaaggcgtaggacattactgtacactactggggactttataagcaccttacttttagactacattaaatttatttgaaaatattttttcttcaataataaattttagcttacttaaggaaagcttaccgtaactttttaactttataaactttttaattttttaaatgttttgatttttgtaataaccagttagcttaaaacacaaacacattgtacaaattcttccttatatctttaattcataagcttaggtatttatttgtttattttaaaaccttttgttaaaaaccaggacaaaaacatacacattagcctaggcctatccaaagttcatatcatcaatatcactgtcttacacctccacattttgtctcactggaaagtcttcagttctcatctcctattataataatgctttttctgagactatctcttgaaggacttggctgaggcggtcactttttttagtaagtaataggagtacactctaaaataatgagaaaaagtataatataataaatacataaaccagtaacatagtcatttattatcattatgcaactggcagcactgtaggtttgtttacaccagtatcaccataaacacttgagtaatgcctggtgctgtgatgttacaacagctccagcatcattaggcaatgggaattattcagcttcattaattttatgggaccactgttgtacatgtggtccattgttgactgaaacattgctatgtggtacatgactacatatgaatgtagaggaagggagaagtcaaaaaactgagccctgggcattccagcacatagcggtgtgggagagaggaaatcaccaacaatggagactgagattgtgcactgccaagaagcagaggaatccctgcccttactggggagttcaaaaacaggttggcattggaacctaaatctattctcagtggctccaaaagagtagcagctagtgaaacaagggaaaaccatgggattatagcgtgctagaaaccaaatgaaaaaaagcatttccacgaaggcagactgaccacctgtgtgaagagctactacaagcctgaacataatggtttcaggaaagaatgggcagggaagaataggagacggtaaacctagaggagtcttttgaagagttttgctgcaaaagaaatggggtagttgatgatgggagaaaaggagtaaagagttttgtttttagctggaaaaacaaagcatatttatatgttgatgggtgtgatccagtaaaatgggaaaattggtgttaacagaagagggatgaaaattactgggcaggcaagacggggtgtgctttactgcacaagtggaaggctggctttaactagaaacatggacgtttcatcatccattgtaacaggaggggatattgactgaaaagtggtggaagtttgtggaagatctttgattgttgctaattttcagtgaaatgctaagcaagtacattagctaagattaagaatgggggaggaaatactgatgattcaaaaagaaaaaagaaagtaggaaatagttatttaagaaagtagggaagtgaatggactagagaaatgtcatatgttagccagtcagccttaatgttagccagtcagcagccttaatggcctacctgaagtaagtggtcatgtgtttgaagtgagatcagttcaattatattcaggcagaatgtgggatttaaccagggtaggttgttttatctagggcaaacgttgaggagagtgaagtgagcatacataattgagtgagagaaagaggagttgatggtgtgtgtgtgtgtgtgtgtgtgtgtgcaaagtcttacaggacctggtgggtttgtaggattattggtatttgggcactagaggaagtgaatcatttggttggatattgaaatcatcaaaaattgccacaggactaatgttggagatggtaatagtgaaccaagaactaaaatcttcaaggattgagggagaatgagtagatgttcattgatgactgcagcgtggaggaaagtggatggtgtggtgtgatgatatgagattcaaagctggttgtattcagggcgatggcaggaacagaactgtaacaaggaacaaggagaaccacctcactcacaggcccagttccatttcctaaacagacgaatttgtattccctgtaactcattagcccctagtcttctgaatccttttctaagagagtaagtaaaataaatgaaagcattaagatacattaataatttttattttacaaatatttgagttagtgattctgcagagttttattaataattcaaaaaactgactttaacctgtcacttcaaaataggttaaatagtgcagctgagttacgcctcaaaagtttttaacttgttttggaaagaaaattgtgttgtatgtccaacaaacctatatatgattgtttattgtgtattgatgtacataccagagactgtttttgtatatttactgggcgcttaataaattatttgcctaatatttagttatctctcctttttcttctagattacataccggttacggcacctccttcgtgcaaggtgtgatgcatccccagtgaccaacaacaccatccaatttcactgtgatcctagtttctgggctcaaaatatcatcaacttaggtgggccattaccattacatacatttctcagtggcatttgtctgtaaaactcaatgattatgacatgttactgaaaatatgttcacttaggctgggcacggtggctcacatctgtaatcctagcactttgggatctctcaaggatcacttgagcccaggagttcaagaccagcctgagcaacatagggagagcccatttccacataagatttctaagttagctaagggtagtggcacatgcctgtagtcccagctacttggaaggctgatgctggaggatcgaagaaaatatgttctctcactttgaaaacgttttcattattttgttttaaaaagacatgttgtttctaatagtatttcattaacgtatgtatatggtaacaaatatacatgaatataaacacacatacatgtatagctgataagaaaacattctataacattgactgacagggtgtctagacttagggatttaggtgtcctgtcctgtcctattcccttaaccccccaaatctggtttgttctcttagctctaaatttatcagaatgggttaacttgacttgtcattgataaaggatttttgatatcctgaaagttttattttaaactactatatttttattggcttatctttacaactattcaataggaacttaatggttcaatcctttatcttgcttagggaagacttttagttttcttcttttgcctgatcaggtaatagttatatagatatcttactaattgaagtaaaacatacatactgacaagtacccagatcttaagcaatcaagtactgcataatgatatctcaatcagttaactgcatctatgacttataaatacagtttttttttttactttatctttcgtatgtttagatacacagatacttaccatcgtttacagttgcctacagtattgtccagataattcagtacaattgcatgctataccggtttgtagcctagactctacctagcaataagctatgccatataacctaggtgtgtagtaggctatacagtgtaggtttacataagtaaactgatgtttgtctaaagataaaattacctaaatgacacatttatcagaacatatccccatcctttagcaacacataactgtattagaactcactgaattatcacaaaaagagactgtcattttggtaacattaggaagaaaagtatccttgcaagcagttcagcagaaagttactactttagcttctttattgtactatttgctgagtagaaacacctttttgccttctttcttaatttctcacagggaaactatacaaacaaatttaagaattccctacacattgtctgtttatcaacaaacaatattatctttgatgattttggtggggggttggggggtgctcgttgaatttgtttcagagtcatcaaagatggtttcttatccccaacactagattctgggtaagaaaagaaaatggctggagaaagagcccatactcaccaggaaaggaggaaataggcaatctaacccataagggaagaacaaaaagaatcccggaagcaaaggtgataaggagacccctgcagactagtttagatacagacatatgtatattgatacatagcaggaaactggaattattacacactcattttaccaaaaagcatctttagaatacagaacatgtgtataagtaacttattgccacacctgactctaccaccacacattcatctgaactctgaacccatcacaagatataaatccaaacaagtggtcatatgtgctatgtacttatatcacaataggtaaatacacccacatatagacataagtacatttaagaattatatttaaaactgtacacacataaatggatatagtttcagataaatctagtttagccaaaacaaaaacaggatctcctagtctaatagtttgtgaaaccgacataatgaagttaatatattttactgtaggatttcttagagctgtcatttacagcactgtaaattcatatacaatgagatttgcattgtaaatctctaaagaaggagacaagtttcctaaacttgttacccatggcttctgagaaacatataaaagcgctaggggaaaatattgatctagatgaatattttgttactgtcttgagtgactttagataagttttacaacctctctaaaccttagatcccttatgtgtaaaagagaatgttattgtttcttctaaacatacacatataccttcttgtcatagtgaattacacacagtaaacatttaatgaataactgtatatttttagaatgcatatgattggtaaatcataaacatttaagtttctactgttgaaatcaagcttgattcaggcctttcaagggcaccgttaaactcttaaaactagttttaagccagtcaatgtattctgtatcaaaaagttaacatagtatgcattgtaaaggtataggaaacttgagagatcacaacttgttaatagtaaagattcagaaatactttttgggattgtttttagagccaatgttaggttcgcttgttttgatatatgacagcagttctcaaagtatagtctggtactctttcaggggaccacaaaggccacccttttccagctacacgtctggatgagtgttgtgccagacctctgttgacttcagtagggataggaccatgtttgagaggcccaagaagagacctggagccagtgaatgagacacagggcttatttagggaacttacatacaggacagtccagtggaagtgggctggacaggagaaccaccagcaagtagtttatatagcacttagcaccctcccgctagcaacctccatgtggcaaccttcatttaacacaaagcaaaaggcatccatccccaatatggcctggattccacaggctgagctgggggttcagatattcttcattgataaagaatgataatctccgggttggccactcctaggttccttaacgcagaactccaaacacacattcttcttaggccatacagggtcactcacagggtacacttaagttattgctgtcaggtgctgtctgccatacagtgagactgaaatttttttcatatattttaacttaacaatatattatgatagatagtgcagaaacagataatgtgatttcagctattaagccagacattcaaacagattttttaaaacatcaaacagtattttaaaatatcaaaaaatgtttaccaaatattttacaatatagttttataaaagcatgttgttatggttttattcttaaatgaattagaaagttttaaaaattattcttaatttctaatattataaatgttgatgactagaagttagatgaacaaaagctgtttgggggttctctttcagagtgttaaagggctcatgagatcagagaatttcttggcaattttgaagttctgcaaaaatagctttagaaaatgtgatatttcaccaactatctgaaaaactgtttcccttaaccttttctttttaattaggttctttagtaatcgaggataaagagagccagccacaaatgcctaagcagaatcctgtcgtggaacagaattcacagccaccaagtggtttatcatcaaaccagttatccaagttcccaacacagatcagcctagctcaattacggctccagcatatgcagcaacaggtaatggctcagaggcaacaggtgcaacggaggccagcacctgtgggtttaccaaaccctagaatgcaggggcccatccagcaaccttccatctctcatcaggtaaatttggaagcaggcctgtcctcacttagataattatagtataattgtgtttagcagctcaaaataacaaagacatccattttccatactctaaatatctgcatttataaaaatttatcacattaaggatccctgatttaatgcctagtttttaatccctacttaaaaaggatttaatggtttattgagttgataaatctattttcatctacccttcattgtctttaaattatagtgaaggataaatgtttgtattcctaaataacccaggcctgtgattgatgggaaaagttgtgtgcctataattcctatattggtgcttcagaatgatgaatacattaagaatctgccctctttgaggatgcagtgttcagtaaaccacattgcatcttagaaattaaggcagagtgaaatagaaaagggcagaagtgtgattcattataatctacctttttcaaactttatttctgagcaaatatactgtctaccgttcttatttttactataatccaattttttttttttttttttgagatggagtctcactctgtcactcaggctggagtgcaatgacacgatctcagctcactacaacctctgcctcccgggttcaagcgattctcccacctcagcctcccaagtagctaggactataggcatgtgccaccacacccggctaattttttgtatttttagtagagatggggtttcaccttgttagccaggatggtctcgatctcctgaccttgtgatccacccacctcagcctcccaaagtgctgggattacaggcatgacccactgtgcccagcccctaattttattttttaagttgcttcccctgtcacaggattcttagacactaactcaatcaaccataacagtttaggaggggggcggaaatcaccttacatcttaccagaccataagcatcttcatggcatggtcgacatcttacataccgtagcacattacactggcattaagtgtcatttttttggttgtcaatatgtaaacattagtctggatgaaggtggcaaaagacttctatgactacctttattctcccttaaggaccattttgggctaagaaaaattatcccttagataaatttaaaagcttttccatgtaatttcctaagtatgttctgcttgtatttctatgatataaaacccttcaattcataaaattttcatagaaaaataaaaacattgctatggcttttaggtttatacttttttaaagtttcgagattttcttatttttctctaatattatttttctactctttacctacagaatttcacttgcttagaatcagcttctaaatgtatttttcactgggtctgtaattgctggccactcttgaaagttaatgagaggtaaacccagtgccaactaatttttaagagagaagcagttgacccaggtgaggatagtaaattccaaaaataggaagaataaaaataataaagaggataggactgtactttatagctgtctgccttcacagtgtcaaagtttcaggtgttgctgcttcaaccttaaaagattatttatttgtcccctgtgaatgtagggggaaataggctcctctttgagaagttgtgatcatacagttaagatatactaaaaagaatatttattttgcaatacattcccaactgtagagaatcagtcaagaggagactggcatataaggttacctttttcttctaggactggtctcaatttccagggctagtatttatgagcccacagagcaggcttgctttctagcctttgccttgttgcaggaatcagaggaccagagagaccaatggatggaacaggaggattttatttaagtggccactggcccaacagattcacatccaaaggctaggtcccaaacaaagacagggcttgacttttatacacacttctgaaagggtgttggctaatttaaatggcacaaaactcgtggtacaggcaaggaggcttacagaggcagaacaaaggcagtttgaatcaaacagtgacagattttgtaatccttagcatagcttgtgaccttgcagctgcattgaaagaaaagcaggagcttataaaacctggaaattgagtaatggtaaggggcatgaggagatagtaaaggaatttgtttttcttaactttgctctgagtgggtgttgggagagtctctggagctccttcctttgggctctggctttccagatagtgttttcaaggctttgtcagggccctgcctattgctggccttggagtgagtcagctaagtacaggaaaacttgttttcctctttttaatttcggcttcattcccccctttgatgctccctgtaaatgaagtttaatggaaagcatctctatcacttaattcttcatgaaaaggcaggtttcttcctttgacaaaggttgatatttagttagagccattagctgagtggtagtttgcctggttacaagagtctctatggccgattggatgtttttaacaaggaggggtaagagacaagggagtattaagcaacctcctagtatggccaggactattcctattaaggttttaaatcctctgagggatgaaaaccagcccccgaagagggtatctggagaccatcctttctaagtctgggctggaacatgggctaatttttggatttttgcagttatatcttcaatgacctttccattgtcatcaatttctaggcagcaattagttacattgaactttctgcataccccaccttcctgggctatgagactagtctaaagccagtctattttgagaaatagcatttctcgtttttgtggcttgttaggccagtagatttaaggcccttgcagcgacattagtcatgatttcaagcactgcctataacgttatgatgcagttgagcatgtaaatagaggtacagtatccatacattccatcttccgcccaggtggctgacccataatattggattattctctcagggggccattcatcatctttctaattcctatggttatgccccttttatttctcctttttgtttcatcataaacagggtatcctaaggcttctccttgccttagagggattaggcagaaggatggtctgattgtccctagtacacaggcctctggcagctgcccatatgcccatgacccacagatccagtagaggccagagggtgcctgccaggcatttggagtttcaagctggtaccaagagtgatgtaaagaggggaaacaggagaatggactagggtggggtgatttggaattatttatcctgccccaccataaagtctttcctgttgtttcattgtaatattgctgtcctaggcaagttaattctatcctacccagttggtaaaggcctttccccagcgaacaatgcagaatctcccgataatagagattttttaagggccagacgctcaagcttgtgaatgttggttcaggggagaggacagtcagagtaaagttaccttggggcattagctcctttgcttcctactgccattgatcccctatgatggttcctccacatgcatagcatgaggagacatgtaggctactgactatgttttcagccagttgggcaaacaggttgctggccaagggagaggattcaggcaactcctggtggatgtgctcatagaatgactcaaaaactcggaactgttgggttgaatcggtccaggttttctttataatatacagactgacttctgagtttactttttgacctttgactttgaaccccagtgtcctgggatagcctgtagtccatatgggcagacctggctctaagatggtgagatgtgcaggatagcaaatgctaggtttatgagttggtttttccagtagtttcatatgtatgacttgccttggtggttgttgataagtggaccaagtcatgcagctccagcgggctattaacggggacctagaggaacaaacggggcacacatttttgcttggaacaagtaccatagtgccctgtggggccaatgataatggaccactacaggattgctacctcctggcaaacattgaagtataaggatatgacctccccataaggggaagaggctttgatttggtttggaagatccccttccttagtatgaacttcaaaccaagtctcaataggtggggacttagggtcctaacatatgtagggctggctatttcctgggtcacagattgaataggttacctggttatgagcacaagttcctaagtggctccctgcgcactcataataaatatagtacagcagagtcctagttatggtgctccccgaccgcgtagtatgtatgcagtgggggcacccttctatgagtccattttctgacactggtatgaggagtgccatgatggggatgagtagcaacaaagtaaagagtagcatgtttatacccagcagggacaaaagaggtctttgcccccaggaggaggttggataaagagacaggataatagtaaaacaattagtattataaggaaagctattggacctaagaattctaaccacatttacttccctgatggtgctcacgcttcagccgtgcatagactagtcagcttctggggtgactagagccgggctgttgtctcctcaagcttcagccgtgcatagactggtcagcttccagggtgaccagagcaaggctgttgacttcactggcaacctggtcccaccgtaggatcagctgggtcagatggtctgggtcctgttggctggtccacttgtcttgggctgctggtttcagctgactgtggtggatccaaggcacagttcctgcaactttaacagcagtgggagtggacaagattacagtatggggcccatcctatatgggtcctaaagtggttgggttccatttcttaacctaaacagagtccccaggtctaaaagggtgtgatgggtctgttaggcttatgggcattctttcctgtacccagccatggattctttgcatggcttatccctaaagcctgcatttgccttcttaaggttaattcccctagttcatggaggtcacctttaatttgacctatgattggggatggccaaccgaacaagatctcatagggcaaatagccagtttgtttggtgggggtgcacctgactcagaggaggaccatgggcaggacttgatcccatctcagatgagttttttgccaatatttcttcagtagctgtataagtgtccaattcatgtgttccacttttcctgaactctgtggcttataggctatgtgtaacttccattttatttttaacagccttgctagatcttgagctatttcggctacaaatgctggaccattgtctgaccctggagtcaagggcagtccaaatctggtgataatgtctcttaacaatactttagtcacttctcatgctttctctgttctggtggagaaagtctcgacccatcctgaaaaggtgcagacaagcactaacatgtacggatagcctctggctcggggcagctcagtgaagtccattagtaggtttttacagggtgtggctcctatttactgtattcctggggccgagtgggcccttgccgtgggttgttctgggcacaaattagatattgtttgcaaacggctcgggtgatggcagtgagccacagcacatagaaatggtgtccaagtagtctttctagtgccgttttccttattatatgagttccttgatggaattgtcttacaaatttgggggtcactatttcagggatggctagcctctcatcagagaatttccaccatcgttcttcaatgtaatgtccagtctgtttggcacaccaggccctttcatttggagagtaatttgggacctctgggaggagaggcaaagctagggcttcctttttacaatgcggggtagtcattcctgcctgttttgcctccatgtctgcttttctgtttcctttggcctctagtgttcctgccttttgatgcctttgcagtgcataacagccactttctttggggcctatacagcatctaagagctgtaggagttcttcctcgtactttatttctttgcccccagcagttaagggtcctctttccttatatatagctccatgaacatgcaatgtggcaaaggcatatttggagtcagtataaacattgactttttttgtcttttgctagcaaaagggctcttgtcagggctattaggtctgctttttgggctgatgttctgtgggcagaaactgagcctctaccactgagtccaatgttactactgcatacccagcctgccggaccccttccaatacaaaattgcttccatctgtaaagtattcaacatctgggtccttgaggggttggtgtgtaagatctttctggcttgaggatacctcgcctactccatctacacggcaatgaagggggcctcctggttccaaatcagttgggagcaaggtagccaggtttagggtatttatgtgaggatttttgcataggagcccttggtattgagtcattcttaggtttgataatcaaggatgccatctctgatccattaaagttataaccgagtgcagtacctggatggtcagttgctgccctagagtcagttggtcagcttcctgtgctaatagggctgtggcagctagtgctttgaggcacagaggccatcctagtgccacagaatccagttgcttggataattatgctaccgggccatgccatgatcctatgacctgaattaggacccctatagcaattccttttcactcatggacatatagaaagaaaggcttagttagatctggcaatcctacggctggggcctgagttagggcttctttgatctgcttaaatgccttctcctggtcagcctcccacaggaggggctccttttctcccctcttttgtggcttcatataatggcttggccataaatgagaaatttgggatccagatacagcagaaccctgctgcccctaggaattctcttatttgtcgctgggtgtttggagtggggagtgcacaaacagccttctttcgctcactgccaagccattgttccccttgacttacttcaaagcctaaatattggactctcctggagcagatttgagccttcttcctggacaccttatacaggagatggaggaggtcttgggttccttgaaagcagtcttcttgggttggggctgccaaaaaaaggtcatctatatattgcagcaaggtgcagttgtcatttggcggggtgtaggccttgaggtttaaagattgtgggagattttttgaatccttgtgggagtcttgtccaggtgaactgcgactcgccccatttgcgactctcaaaatgggctaattggtgccaggtgaagacagaagaatgcatctttcaggtctaggcaagtaaaccaggcagcacttgctggaataagtcccatcaaagtatatgggtttggtactatcgggtggatgtttactgtagtgtggttcacagcacacaagtcctgcactggcctgtattctccagatggcttctgtactggcaggagtgggatgttccagggtgactggaatttgactacaaacatgattccatgttagtagagtcgctcactctaagtgtttgtgaacacctcatatggcttccgggaaaaccaggtactggcaaactaaactggggttgcccctggttttagctctactaccactggcatctaatctttagccagcccgggtgggttatcttcagcccatactccaggaattttattaagtagcctctataattcaagtattcctggtttgtgagacagttctggtggcttttttgtgtatagcctccattcctcagtttgcaggacggtaagggttaacaccatggcctttgggtcagtcaggtttagagtcatatccccttgtagcccaaaagcaatctgtgcttgcagttttcagagtaggtctctccccagcaggggaactgggcaatttgggaggtacaggaattcatgttggacctcttgtcctcctataacgaacctccttggccaacaaagtggcctcttctctgagaccctggtgacccctacaatagttgtatagtttttggatagtggtcctatggatcgggttactaccagctattcagccccattgtccaccataaagtccattagctggccccccacttctaatgtgaccatgggctcctgggggcctaaggagaaggagcctggtctgtccttgtccttatattcttcagtccctgccaccccgatcaggtcggtatctggttccttcagggtgcagcagcctttgactggtggcatttttgtttcatagcctccgccattttcttcactgccctctggacactgattttttccagtgtcccttttagcatcatgcacattggtgcttatctaacctcagccggcttttgagcctctgtctggtttggccccatctccgtctgtgcccgtgtccacatccgcaccctcttgcaatgctagtttcccttaccgtaagggtcactgctaacatattggcctttttcctaagcctccgatctgcttccttttttgcctcttggtcacggttaatatacatcttggtggccactcctataagttgggtggcattcatgcctgcgaaattttttagcttttgcatcttccacctgatgtcaccctgggcttgtcctgcaaatgccgtgttcactgtgcactgattttcagaggcctcagggtcaaacggagtgtaaagctggaatgcctcacagagtctctcataaaactggctagggctctcatcagctccttgaagaacttctgagatatttcctatattgattgcctttttcctgccttcctttagcccttgcaagagtgcttctcggtacctctgtaggtactgtaattggactgcatgatttgaatcccagtgggggtctgcttctggaaactggccctgagtgtatgcctgaacgttaagtgtgccttcaggtgcactggcttctaggcagcagagagctgcctggattaccctccagcactcctcagtgttaaacagtgtcaagaggagctgcctacagtctggccacgtaggattgtgtgtctggaagatggattgcattaaatctatgagggcctgggtcttctccatgtaggagggggtatggtgtttccagtttaggagatcagtggttgtaaaaggctggtagatgaagttccgttgccccccttggacttgaccctgttcatcataatagatgggtccccgtgtctccctaagaggcatttgcatagcccaagcatgaccagattggaggcagcccacttgatcatcttatctttcttccctgacctcctggggctccgatctttccttttggggtgagtcttggagcatgttaccatctgaatctgactccttgggggccgttggcctcagtaaatgggggtagattggaatatatggaagaggaatttctatctcctctggcagttcctgcaaaactggtttctcttgcccttcccatgactttttctttgtctccgtatttgccagcaaagctgattttactttcactttaggctcggtctgagccacaagcattttgcagtaagctgccaggcagggctgcaaccatgcaggtcaagtttgaactacatttagccatgagtcaatataagggaattggtctgggtgccctggctgtccttcgaccccaatcaccaccttaaatacatggccaattgtttccctatctgtggttcctttggctggccatccgacactaaaagagggccattctatttcacagagttctcaacctctgaggggtcaacttcatcccgtaatcccctgcataacctttcttaaaattctttaacatacattgtaatggggtgggttttgacgacttccctctcatttcctcccagttacagcgcaacacactcactctcactttcacttcggaccgattagaccgtccccctcgcaggagtatttcagatgccacttagcattggaggctctgttttgacccccacaattactaaattgtggggcacctccctaagccatatgtggaacactgttagtcccggtcagtcccatggttctctcagagtgtatggtctacgctaagagaactgcggcccccacacatcactccccgcattggttcctcctggaaccgcctctttcacatgcactcacacacttccccgctcccagttcctctttctcaactgactctgcaagccactctcatgtcctgggttggttggggtgtgagcttgtgagcttccctgactttgcaagccactctcacgtcctgtgtttgaccactagttacaccccgggaggtgatcaggctccccttccattcttatgggacaggtcctgcctcgggctcaaaccttaccacaatcctgtagtgcactgttcctggaatcatcctgttcctgcttaggttccattgtgctgtcaggtagggtcaagggagagctgatcacccctctgggttgaagttctcccagtggcgcctggggtcacaggtctctcccggcctggggctccagtctcacaggcgaagagacagtaaacctttcgtctccaatcccgggcgagcccccagaaaatgtttcaggaatcagaggactggagagaccaataggtagaagaggaggattttatttaagtggccactggcccaacggattcacatccaaaggctaggccctgaacaaagacagggcttgacttttatacacacttctgaaagggggttggctagtttaaatggcgtggtgggaatctaatggcatgaaattcatggtgtaggcaagcaggcttacagaagcagaacaaaggcagttaatcagtgacaggtttcataatccttagcatagcttgtgaccttgcagctgcattgaaggaaaaacaggaacttacaaaacttggaaattgagtaatggtaagggggatgaggagatagtaaaggaatttgatttgcttaagcttgctctgagggggtgttgggagagtctctggagctccttcctttgggctctggctttccagatagttttatcaaagctttgccagggccctgcatattgctggccttggagtgagtcagctaagtacagggaaacttgtttttctcttttttatttctgcttcagcctcatttgtgattccttcacccagccttcctgtaatcaaccagggttgttcttggagactttgctttgaaaatatgttttctggccaggcacagtggctcaagcctgtaatcccaggactttgggaggctgaggtgggctgatcacttgaggtcaggagttcgaaaccagcctgaccaacatggcaaaaccccatctctactaaaaatacaaaaattagccaggtgtggtggggcattcctgtaattccagccacttgggaggctgaggcaggagaatcacttgaacccaggaggcagaggttgcagtgagccaagatcggaacaagactccatctcaaaaaacaaacaaacaaacaaacaaaaaacagaaaatgttttcttctatggagactcatcctctaagttgtaattactcagtatcttaacagccagctaagcacccgaacatgttttggtaatgatatggcagactagatttggattaaagccttggtgtgctgcttggtgttagctgtgtgacttttttcaaattatgttttcaaacttttagtttcctaatttgcaaaacaaaggtaataatacctacttcataagactcaataacataataatatgtaaaatgcctgccagggctcaataagatctaaaacttactaagtgttactaatatcaactattttcattattaacgatttgttcattttgagtacacccactgagccagattacttgttcaaatcccagctccatgccttattgtctttgttaatcttgagcaagttactaaattttctgtgctttattttagctttcttatctataaaatagaaataatctgtgctttataataatattgctaagaataaattagtgaatacatgtgaagcatttaaagcagtacctggcatttaataactgctcaataagtgttagcagttattattctaccatcactttatttttaggaggtttcaaaagggtagttctttgtgaaagataattgtgaaggacttagaaggataccaaagacacattttatttacttcccaacatggcctaggtccaattctggtacaatctacttacaaaatctaggtggcaatccctctcccaaggttctttcctagtaaggttcttttaaaaaagttgtttacacaaattctgaaagtctgcccatcccccacccctcattcccttatgtaaatcttaataattgattgatctgtggcagagttctatttttctgtaaaagttttataagatagagatttataatttgtttttcagaagaagattgttactaaattggtttaatttcttttttctagcaaccgcctccacgtttgataaactttcagaatcacagccccaaacccaatggaccagttcttcctcctcatcctcaacaactgagatatccaccaaaccagaacataccacgacaagcaataaagccaaaccccctacagatggctttcttggctcaacaagccataaaacaggtatatatctaccttcttttctcaattgctttttctgctgctttctactttcaaatcacaaagaatttacagattaagcaacaggttataaagagccaagagcaagccttctttttcattttttaaataaatgtgaattgcaaagtttgatgctttttatcagtaagagaaattaaaccacttatgtagaagtgatggcccaatataatcaatgaccataggtattaatttttataatatggtatggataacttttaggtgagtatattaaatttcctaagataaaagtattctaacaaatacaagttacattccacaaaatagaacaataaatgaatctttgaagcgtctcaagaagatttcttggaaacaaaattatggcacagtttcaagagggaatacatatatatctgatgaagtttaatatttaattcatatttaatatgatacagcttatttatttttatttttttattttttttgagacagagtctctctctgttgcctaggctggagtgcagtggcgcaatctgggctaactgcaaactctgcctcctgggttcacaccatttctcctgcctcagcctcctgagtagctgagactacaggtactcgccaccacgcccagctaattttttttgtatttttagtagagactgggtttcaccgtgttagccaggatggtctcaatctcctaaactcgtaagccaccgtacctggcctccttttttttttttttttttttttttttttttaaagtctctctctgtcactcaggctagagtacagtggcatgatctcagctcactgcaacctctgccttccgggttcaagcaattttcctgcctcagcctccagagtagctgggattacaggcgcccactaccatgcctggctaatttttgtatttttagtagagacagggtttcaccatgttggccaggctagtctcgaactcctggcctcaagtgatatgcccgcctcagcctcccaaagtgctgggattacaggtgtgggccaccatacccggctgtattatttatatacttagtgtcttcaggtaaaaatattttctgtgttttacattatcttaaagttatcacagtgttttttcttctcaaagctcctatgacaacagcctgtctagctgattgtagactgattttggtttctccaagaccaaaataaagatgatgcaattttcataattctataacatccattttaataaaatcattttaatattttattctaaaagtatgtacactctgtgtctatacatatcttcgtataatcaatttgcctttgctatatcatcaccaaattctcttaaacaatattttaattatttaaaataaaattcatacctattatttcatcattagaaggaaagtaaaaaggacccaagcttcagtttggccttaaattctacttattttcctaataattttgtggcacttacgtagtcttttcgcatctcccttgcctcagctataaaatgcgtatcttgcagagttatgttgagagtttattctaatgtatatacaagcacctagcacatgctcagtattcaaatgtttacctcttccctatttattgtattttaatgagtagatactctaagcatgtttttttaaaatggttgttgaccaaaaatgtaaacatgaatgaataagtaaaggaacaagccaggaaaaaatctactgggaaattgcttttaagtagtagatgagtttaacaaattagagtatactcatacagtggaatacttttcagatattaagaaaatgcagtaatctagatatgattttctgagtacgtgaggaaaagcatgttatagaatttttgtgaggtgttatctcatttgtatgtgtgttttcctccagcctcatcatgtacatagaaaaaaacctgaaacgatccaccaactgattgttcttggtagaggaggaggaaagggggcatagaggtggggaatatgagggaggagtaggtggtaaagaagacattcatgtccaacttcatatgtttctgtatgtagtttctacaatggaatatataaattaggtttttcaaaattggaatgtttcagacattttatatagtgctgttcatttgtgaatgaccatgtttggaaaatacggcatcttgcagtacacttagttactttccttcttccagcatgaaaattttcaaacataataaaaattgaaagaattatatagggaacattttgttctacttgccttattacatgtttatctattcctttgtccattcatcaagtcatcctttttttttttttttttgaggcagaatctctctctctgtagcccaggctggagtgcactggtgcaatcttggctcactgcaacctctgcctcctgggttccagtgattctcctgccacagcctcccaagtagctgggattacaggtgcccaccaccacgcccggttaatttttgtgttttagtagagatggagtttcaccatgttggccagggtggtcttgaactcttgacctcaagttatccacccaccttgggctcccaaagtgctgcgattacaggcatgagccaccatgcccagcccatcatgtttttcaataggttttgagtaaattccagacagcagcatgcttcacctctatatacttcagcatgcctatcatcatcttaatgtgtttatctcagcaggaatgatagtactttcctcagatatttatcgaggcctaattatctgttcatatatgagaagaggaatataaaatcctgaaagtaccagtctgtagcttagtattttcaagtatttcagatagggatagaagaaatgtatgttttcaaccctccatctttaccttgaagttgctatgtatatatttacattttttttccaatatgtataaacctgccaagattgggtactgtgattttctggtatatactaactgttgtcttccagtaaaaatcagtgctttttactgttttggtttttttttttttttgacaagattaatgaaaattatatatacttgtgcagtcttttgctgtcccattctccttccatgtaaattacagttgaactcttctacttcattttgtgtgagtgattacatagatgttgtattttataagcttgttgatagcctttgttcttctcttcttgttactgtagtggcagatcagcagtggacagggaaccccatcaactaccaacagcacatcctctactccttccagccccacgattactagtgcagcaggatatgatggaaaggcttttggttcacctatgatcgatttgagctcaccagtgggagggtcttataatcttccctctcttccggatgtaagtagacacaaaatttatactagcctctgttgaaaactgttggccgggtgcagtggctcactcctgtaatcccagcactttgggaggctgaggcagacagattacttgaggtcaggagttcgagactagcctggccaacatggtgaaaccccgtctctaccaaaaaatacaaaaattaaccaggcatgatagcacacgcctgtaatcccagctacttgggaggcggaggctgtggtgagctgagatcatgccactgcactctagcctaacagagcgagaccctgtctcaacaaagaaagaaaattgttagtgaatttggatctggtagaaggcatgaatttgttggattataggttgtttgtttttacaagttaattttaatcctttagaatattacaacagtagtaaaaataaaaagattatgaacattggacacataatctaatgtctttcaagccaccggagttaaaggtgtttgtaaatgagtgattatggtgatggatcatggaatctaagctgggaaaggagaaaagtaaggacatggaaagatatgctgggacgttgaatggctggacatcagaagagatgaagacaagtttaataatagaaatcctgttagatcatactgacaagtgcaaaattacctctggtttatactacatgtaaattaactcactctccaaactctttgtcagtatgactttttgttatttattatatttttaaatgatttttatttttaatagagatgggggagacgccctatgttacccaggctggtcttgaactcctgggctgaagggatcctcctgccttggcctcctaaagtgctgggattacaggcatgagccactacacccagccagtatgactattccaaaggcagaaagtctgcattctgtagacagatctccatatataagttgattctgtgtttgatcctttttttaatctaaagttagataacctactgtcgtgcacatatacatacgcacctaatgttaagaagcttttaggaaatatcttgtactctttacttggatcaaattacctataagattgtgaaaataacttttttattttcattatttgtttttcaagttgagatcaattaatatttcctaatagttgcattgttaatcttaccagagtcattccatttttaaaatagttttgtatactttaaatgagtagaatacatatattttctcatgcatggatggttcataggaaaacttacatctaatccccatagttttatttggcttttaggattatcccacaaagtaaacaactttccttgtattaagttctcatgaatttagtcattctagtactttttgtactctttgaaaaatattggccaagtattgccaaaagaatattaaaacaaaaatgaccctgtatattaaccacctggcccgatttccctgcccccgaacccacagaaagtaaaattctttctgctttttcctctgcagtcctcatacaggtgaacctttttccaccaggctttcttacctgaaattcctcttaggaattacagaataagctgaaatgagtgactgttttctcattcctcccaaaggtgcttcataactagtaccattctaggtgcataagcaagaaattgattcattatatacaaactgtgccctatggctgtaggacttaattatcttatagaatcctggttgaacaagagtagaactatgttaaagaattgaactggattttaagcccaaagacattggtgggaaatttggtatatgtaggcatgaaagaatttttgtgtctaaagtattaaactcttactcattagggatttgtaaatatttttgcctggcaatgaataaggaaaagaagtgttatttgtattcctgttatattaaagcaagaatctttagggttcaccttttctcctacaaaacaacagtaatgtattcagtgaggttagtgctgtagatatatggacttcgtctatttagcacatacccagagtatcagttgttaaagtatccctttcagaggatccactaggtcctatctatctgtgtgaggctagattttcttcatatttttcaagcaaaaccatataccacaatagattgaatgctgtttagggagacattaaagagattcgcaagaaatgtaaaattgtgatagtcttctcaccaagtttatgtttttcatatggcaagcttttgtcgtttataagaattttttcaatttttaagagtgtgaatgacatgatattccttttgactcctgtttttgaaatagcgtcctcaatattttactaaggtgaaacactaagatagtgaaaacctttattcaaggttgtttatggggaaaatatctgttagaacttctcaaatgtggtatctatgttttgttattcgataataattattaagttattgaagctttcttataaatttaaaagtagcttttaacttgcaaaatcagaatgccctgaaataatttcttttcttgtaagattgactgttcaagtactattatgctggacaatattgtgaggaaagatactaatatagatcatggccagccaagaccaccctcaaacagaacggtccagtcaccaaattcatcagtgccatctccaggccttgcaggtaaagtgggcttcttttgatttttgtgaaagtttttctagttttcactttacttggaataaaaaattacccctcttctccttttttgttgaatgcttaatctgagtttttcactatttaaaattagtatgctttcagagaaaacaaaggttaaatttctttatcctttctttcttttgagtcacagtctcgctctgttgccaggctagagtgcagtggtgcgatcatagctcactgcagactcactcctgagctcaagcgatctcccacctcagcctcctgagtagctgggactgtaagtatgctgctctaccaaacgtggctaatattttttggtagagacagtcttgaacttctggccttaagcaatcctttctgccttagcctcccaaagctttgggattacaggcatgagccatcatactaggccttctttaccttttcaatttcaacagaacttctcaccattatagtacttccagggggaaattggtgttatattctttcttgttgataagttgcctgtgatgtggtctttaagatgtaatttgcctagggtcaaaatgtattagtgacaataagtagcaatcactcttctggtgatttgtttggtgtttaattgtgtttgtgaatcttgacatacctactcatttcctctgagagaaaaacgctaatattacttctgaggacgtaggtaccttaaaccaaaatatgaaaagagaatttaagtcactcaacagtcacatgaacacaatttaaatggggatgcccgttttaaacaaacttatgacaaaatatagcagagaaactgtttatcatatgacaagtttatacaaataaggaacacatgtggtattgccaaaggacatgataagtagataattccctaaagaggaaatacatttatccaatatagcagatgagacaaaaattcattcttactagtggtcataagaaaaatcaaacaagatagaatttctaagttactgaattagctaagacttaaataataaaaatagtcattgagaatgtgatgagaggtactctcatacataggtggaaggggtatgagttggcaaaacattcctggaaaccatcatagcaatattactaaagtttacatttatccaatattgtactgtgggcaaagtaccttatatgtattacctagtaggatatttgcttcaaggggcttggaaaatgtatgtacccttgaacctagtaatttccattttaatatgccaattataaggaaataattaggaactggataggcagatcgtatttattaatatttatattactattaaggcattatttgcagtagttaaaattttgaagcagtgcccaaatatgaggataaaaataaattagaatgtgctcacttgtaaacagattatttacctattcagacaatgcttatgtagagtttttaatggcatgctcatggactactgtttagtgaaaacaagtatacagaaccatataaaagatgtaaaagtatgtttaaaactggaaagagatatatcaatcaaccttagcagtgtttatatatggatggagaagttatgggctacttaaatgttatatatttttatagttttcaactattctaaaatgaagcatgtattcttatattatcaggagattataaatagccattgttttgattgattttgaggcagggtctcactctgttgcccagggtgtagcaatcatggttcactgcagcctcatacgcttgggctctagtgatcctcctgctttagccttcccagtagtggggactacaggtaggtgccaccaggcctggctaatttttttttttttttttttggttagagacgggtctttgttgtccaggccttttatttttaaattaaattctccagagtttacaaaccaatgaaatgataatcttcattttatcagccacatcctgttgttcatcaaaccttttagaacttctgtcaattcggaattttttttctacttcccactttcattgtattcctacttgttactgtttagtttgggccttcatcagttcaaatcaattatttgcaacagttttccttctttcttggctgcttttaattagatcttccttgttccagtctacactaccaccagagcatagcttcttaatctttttagggcagtagtccagaatccctcttttgtttattgccttaagtctgaacccattgatctttctgtgtcttccattagttggtttaattttgtttacttggttttcttttttgaactccttttctatcagcccgtaccacctttcgttgtcttctgtagcttccactggcactagggtctcactgagatcttacccctgttactctaacacagaaagacttggcaatgtttggagatgtttttgattgtcacaccccaagctgggaagtatagagagatgccactggtatctaataattggtggaggccagggatgttgctaaacatcctgaaatgcagagacattcctccacaacaaggaattatctggcccaaaagtcaatagtgcagaggctgaaaaaccctgccggtgtaacaggctgtaacagactgctgaaaattcagcaactacttactgtttcatagaatttcatcatggttcccagtttcaatgtagtgctaagtgaacacattcaacaggacttcaatgcataattattcattcgttttatgaatgtatggtttccccctcctcaggacctgttactatgactagtgtacaccccccaatacgttcacctagtgcctccagcgttggaagccgaggaaggtaaactgactaaaccatattttctagtatataaaaatctctaattagatttcttttgccagtgttcaacatgttttgatactcaatatattttgaacaatttcctttatttttaattaaaattttaataactactatatattttaatgaattagttaagggattaacaaaagtacaaatttacctttgaagatagaagaatatttgtcaatatgttgaaaataagaaatgttggatattcatataatagcaaagaaaacataaaaatgaataggcataacacagtacactatatagaaacacaaatttagagaaaagataaaattttatgctaatttgatctctaatgactaaatgttgattctactttaaaataaatatacagttattgaaattctatattttaagcaactgctctcctcttccctgcattatgcctgaaaattcctcctagctagtgaacccagttcttactttatcatatggaagaattgtctgagggagaaaagtttgcctttaatcccatgagaacatagtgaatctctgtaaaagctttttgacccactaccttctttaaatagtattgtgtaaatacatgattatttcattgtcttcaccaaagtattcactttgctactgactagagaaggaaatgagaaagcctaaaatcagatgccagttctaagatactaaatctggttgcctaattgtaaagcctcaggtttttaaaagtttaggtttattgaaacatctttctagatatataactatttagataggttaatatgtaaaacatttttatcataaatgaaacttgcatacaccagtttcatttgttatgcatcattaattgctgatgttaacatacttattgttgtgaagatacagtattttagaaagttgttgttatactttttatgaggtatttagcttaacattcttagattgctttttcttctctctcatacttacagctctggctcttccagcaaaccagcaggagctgactctacacacaaagtcccagtggtcatgctggagccaattcgaataaaacaagaaaacagtggaccaccggaaaattatgatttccctgttgttatagtgaagcaagaatcagatgaagaatctaggcctcaaaatgtaattatgaatgcttgcaatgctattcctatgcatggtgggtagggtgagagaatcttttaaatagctcttaggagtttttttttaatgttatatttaaaaggatttaaagacaatttgagggaatctctcagtaaattaaacaaaaagacaaagatggaaaaacaggaaagtttttaaaaatcagaggctcagatatggaggctgggcagttaaaaggagatattctttctttaatcagagttttatacccaggcaaattatcaatcagattgacttgaagattaactaaacattttcgtgcaagttctcaaaataattcttatgtactcattctcaggaagatacttgataatatgaatcatcaaaaatatagtaaaacaagaaagaagacataagattccaaaaatggaatctgacacagaagaaaaaggcaacccccagtacagcagcagcagcagcttgtgcagtagtctgtagcaggaagacataggactcccaagggagaaaaatgcttcaacagtattgagaatctcctgttggagattgtgagaataacatagaaataggtacctagaaagataagcaactgaaaatataaggtaattacagagtcttagtaaaaacaaaaagttgtacaaaaaatgtcttagtacattttgtgggtctgcagtgaacaatatttaaataataataataatgatgtaaacaaacacctgagtacgaatgtaactaaaaactgtgatgcaatcaggatataacctgaatatgcacttaaccaaaaattgtgattttcagaatacttaaccagtacaagacaaatactgatcagttagaatagatactggcaataaacagttataccagtacctaccaactaaaacaatcaatgcttaatcaaaactaagttaaagggatggggtgaatggtggtggtggtggttttgtgtgtgtgtgtgtgtgtgtgtgtgtgtgtgcgcgcacgcacgaatggaagcaggacggggttggagaatcagaatgtaaaaacctaatctcctgatcttcactagtaaggattatagatgtattgcaatttttaacaatcattttatttagaaatatggaggtaaacagcagaagaaaaagctaggtttgaaaatagttcttccaaggaataagtgcttttaactatatctacatttattactttgaaatttttgaaaacatttgaaggagattgtttttgttattgatttgaaattttcaccatcctgggcttcaacagaaagtttagattcatcttataatttttgtatcttaggtataatttgaatgaacagctccagtgaggtatatatatatatatataggtcatgtggttgacttccactctacccaacccattctctaatttctgtagccatccccagacttagattttttctctatttattttggtattttttagtagaggttcatgtcttctaagccagttagcaataaacatatacccttctcctgaagattcctttgaagcagccaggtgctcaccagagagtggtctacagttcagaattgcattagtgataaaattttttttaaagccagttaaatatattttttttctactacaggccaattatccaagaagcatactcacctccctgctcttaaatagcagtcagagctctacttctgaggagactgtgctaagatcagatgcccctgatagtacaggagatcaacctggacttcaccaggacaattcctcaaatggaaagtctgaatggttggatccttcccagaagtcacctcttcatgttggagagacaaggaaagaggatgaccccaatgaggactggtgtgcagtttgtcaaaacggaggggaactcctctgctgtgaaaagtgccccaaagtattccatctttcttgtcatgtgcccacattgacaaattttccaaggtaagatagtacttcccttcccacattcttttactgtaaacttttgaagattattttaacagaaagcctttgaaaaaacttaaatgaaattccacttggcacaagtgtatactccaaaatcccaatgaatagtctaggttttcccatacccttccgcttattctttgtgcttctttcaaaaaactaatcattcagcctgagcaacacagggagaccctgtctgtctgtacaaaataaaaaattagccgggtatggtagtgcatgcctgtagtcccagctactcaggaggctgaggtgggaggattggttgagcctgagaggtcaaggctgcagtaagctgtgcttgcaccactgcaccccagactgggcaacagagcaagaccctctccctagtcattacaaaaagaaaaaaaaataacaggccctttaaattatcacaagggatcatcataaggaacaatgtccctatgcataacagctaccacagtttattatgtctttttgccaggcatcgaactgtatcttttacaagtatttcaagtaaattctcataccctatggggatgatgatcatcatcatgaccaagatggttaagagccattgggttgatctctcagttcttggaaggccatacttttgaaaatttaattttataaacttaagagtaacaagaatagtacaaagagcttttctagttcctgaatcctttggaggaaaaaaattcaattatgccctagatatgtgagccctagattaaatttgtttaggtgtttcttttttttcaatatatgtatctcacaccttcttaactagattttgatgtttgttaggcccttgcattatatttctgctgtttcctctcagcatggtgcagtatacctagtggtatgtggtaaatgctcagtgattaaaattcatgccaaatgaacaattctgtatcatagatgtcatggaggaggtgggaaagggaaatagtgaagagaggaaatgatgcattaggaattcaaaagtacattgtcccctaacagtggagagtggatttgcactttctgccgagacttatctaaaccagaagttgaatatgattgtgatgctcccagtcacaactcagaaaaaaagaaaactgaaggccttgttaagttaacacctatagataaaagggtaagtctttggtaagatgcattattgtattgtagtgcaatattgtactgtggtaccttttgtcaaagaggtgtatatccatccagattttatactgatcctttttatttaagagtatttttttttgtttacaaaggtacatgaatcttaaagactgtaactttctttaaattaaaaaaatcacagaattaatgcatgtattttatagaagcttattgtacctgaacaagatggaatatgtaccctagacttttaatctaccttaagtaaatttctattttgttttatttcctactatagataagatttttccttagaactgccaccaaggagctgggttttttctttactcttcctggaaataattccttttttttcactgaatgggactagacttatgcatcaaagccaactgatatatttaactgtaaataacatttaaagctaccaagtcaacactttgttaccaaaaaaactcctttgctaaattattaagtagaacagtcaatatgaaagttgtcatgcaagaggggacgtgcccattcactgccagtactactcagtggttactgggataaacccataaagcagggaagtatatgaatagcagagcacatggttggaccttcggcatgcagaaaggtgccttaggtctggatgcatattgagaaggtccacctccagttctcctaagagacgtacgttcttcctttatagactattactaatttataatacacagactggagcaataagtgcaaatttattgttagaaaacttcaaatggttttctagtgattgtcttagttcattcaattacagggcctgttcccaaatattgggaaggagagcaaaactccgagaatcagtaatttttttgtattcatctgggttttaatttttagtctgacactttgggacctctgagattgttatttaaaataagctgtgaattcattgttttataatattttatctcagtttttatttatttttgcttagaagtgtgagcgcctacttttatttctttactgccatgaaatgagcctggcttttcaagaccctgttcctctaactgtaagtattaatgtcattttctgcatgtttacacagtggaatgcttttctggaattttatgagaatctagcttatattaccatttttcagtactttttaatatctaaaccttaaatcttaataatacatactgaatgctttgatcctatgtaggtacattttagtaagtggcccaaaacttctgttcatttctcaggtattctttcttctttcttttctcatctattttacttaccactgggatgtttagggtgatttctgttaattttctgtatttcaggagttttaggcatgtttccgaagctgttggaaaaaaaactttgaaataaagacatctctccctgctacattttccgtacttatttttctttataggtccagacttcaagtaaataagtagacgttaccaatacaaaaaaagttgaggaagtatgtgcgcaggtgctattgacttcagaaaggttcatattgaaagtttgatgtgactgtggccgggcgcggtggctcacgcctataatcccagcactttgggaggccgaggcgggcggatcacgaggtcaggagatagagaccatcctggctaacacggtgaaaccccgtctctactaaaaatacaaaaaattagccaggtgtggtggcaggcgcctgtagtcccagctactcgggaggctgaggcaggagagtggcgtgaacctgggaggcggagcttgcagtgagccgagatcatgccactgcactccagcctgggcaaaagagcaagactccgtctcaaaaaaaaaaaaaaaaaagtttgatgtgactttaacgcataattttagagtgctggaaagggcctggtaccccaaaagagtattcttctaatgtctgaaccccggaggcggaggttgcagtgagccgagattgcgccattgctctccagcctgggcaacaagagcaaaactctgtcccaaaaaaaaaattttttttcatttgttctacagtttgataaatctcaaattaatacaaagttgagaagaaaatcagcttagtaaatacagtcagcttctctcttaagaacaggttttgagaacttgatataggaaataaatacctccagggagaagggtcttttgtacccaaaagaggcagggtaaagaagtcgagaggcttgtaacaacattaccaacttgaaaatgtaaccttgaattgtactttttattatcctggcttacagttacgttattaataccaacaatgacaaagtagccccctttttcttaataaatatcatctcatttagtctgtacaaaatgctgtgagtttggcaggattatccctatttgaaatatgaagaaactgaggttaagtagcttacccaggaccatgacactgagcagcagagctggggattaaacccagattcaaagtccttcttcctcttgtataatacatgcagcaaaaacatgtcagattctactagaaatgatattcttcctagtaattgctttttgtttaataatgaagaaaaaaatctagatgattaagaggaaatatgtgaagacaagttttttcattaaaaataattggggctgggtgcagtggctcacgcctgtaatcccaacattttgggaggctgaggcaggcagattgcttgaacccaggagtttgagaccagcctgggcaacatggcaaaaccccatctctacaaaaaatacaaaaattagccggctatgttagcgcatgcctgtaaccccagctacgcgagaggctgaggtgagaggatcacttaagcccaggaggcaaagtttgcagtgagccgagattgtgtcactgcactccagcctgggtgacagagcaagaccctgtctcaaaaataataattggttaaacttttggaaaaagtcacacaaacctttaccagtgtgtgtggaaggcagtgggcacttgtaaacactgttaaatgggtttctttactaatggcaaatagcacagagaaaagcaatgagaacattctgaattttagagcacatctcatagaatatatttaggacaaggtggaatttagctatttgtattataacatctcatttttttaataggtgcctgattattacaaaataattaaaaatccaatggatttgtcaaccatcaagaaaagactacaagaagattattccatgtactcaaaacctgaagattttgtagctgattttagattgatctttcaaaactgtgctgaattcaatgaggtgaggctaggggagggaagggggcaggaaggaacagcagtgtgaaaatcattttattactaaacaccttgtcaacataggagaccaagatgtctgagttagaataaatttccaacttttcagatcagggaatgcaagagataattcagataactctgtccacatttatattcaaaggtttattagatggtgatggaaatgcaaattacagctgataactgaaagacaaaatgtttttctctgacctagacatattctttatcattcccacctgtatttcttatttttatgttgatcttgaaatattaaggatgtgggccaaatagctctaatttaaaaatttctcatctgtcagttcatctacacatcagtcagacttagaaccttttgctgctggtggtttgttctctgttactcattctaatagtactacatttaatttgttctaaaaatacctggttcatgatcctatggttatggaatcctaactgatatgtgtttggcaatatagtcctaccattaccaccttcttttagaataatccaggcttttacttttatcttttttccacacttctgaatcttttattttagctggccttctgtacagagactttgtctagtcctaaactattatttcaatgactatgcatgaacacttttcaaaacagctcattaatatatataatctcagaagtcaaaagtgtgtcctttttttactcatttttatttttactccacagcctgattcagaagtagccaatgctggtataaaacttgaaaattattttgaagaacttctaaagaacctctatccagaaaaaaggtttcccaaaccagaattcaggaatgaatcagaagataataaatttagtgatgattcagatgatgactttgtacagccccggaagaaacgcctcaaaagcattgaagaacgccagttgcttaaataatatgcagcaccactagcttgtgctggtttttagatttttttgttttcaaaaaaacatttgtcagtaatttaacatcactacaaaaagaagagtttgtgactattctcatctctgttttggacgtttactagactttgatttccttaatagcccatttctgttaacctcttatcactaagaaagaaaggaaagaaggagatgaatagaagaaagaaaatggaaagaaggaaaaaaggaggatagaaaaaggatggaagaaagaagcattgaaaacaaagacattcttcccacttcttggatttttaaaccacagtctggagtgatagctactgtagaaaggaaatagactttgtatgaactctttaagttgaaaagtaaaaaatatatgtggtttggatgtgtgctttaattcagctttagaaattaataccactacccgtgaattatatggcctgacaatatgaattaggtgtactgtactgaagaacagtactccacaaacatgggtggtaacaagagttccatcccaggaggccaaacggtgcaacagaagggtaggttagatgctattaagaaggcacttaatagtacatcatgtaagatggcaactgtattaaagaaaaatccggaaaac

SEQ ID NO: 36591 - DNA, 12630 bp, Homo sapiens
ggagagagccgccgagccgagccgagccccagctccagcaagagcgcgggcgggtggcccaggcacgcagcggtgaggaccgcggccacagctcggcgccaaccaccgcgggcctcccagccagccccgcggcggggcagccgcaggtacagccgggccccccatccctgcacccctgggcgctgcgtgggggcggtgggagcccctagcctctgggtatcctttcccaaggagtggccactgggcactctcccgggcgggctggaccctgaggggcagggctgggcctttctccacctctgtcccaggcccagcaggtgccaggcgggcctatgggacactgagtgggtaatagagaagggggcctgtgtgagcgccttcagctgggcctgactggaagggcgtgggcatttggaggtatccatggggtgggggggcttgcggagtgtactgtcttaggacaggcgtgtgggtcagacatgggtggaggatctgggaatctgtgtgttttttgttccagaggggtgtccacgtgttttgtgtgctggtatttggctctcagggtcttaagtcagagttaggagggggtgtacaattgtgtactgaggatgtttggagttaggtgtgtaaggacttggggtttggtttggaatacaggagcttccaggggatggggtagaggagctggagggtgtagggtacgtctggtatatgagggtgtgtgtgtgtgtgtctgggtgtcatcttgtgtgggtgcgggtggatgtgtgttttggggtgtaagagggagctgggtgagggatgtttggatggacaggcaggtgttcgggtgcagggctgtctggggcactgtgtggtgtggacatgtgtgctgatgtctgggagtacatgtatgatcaggtgtcacgggatgtggatacaaggcgtactggatctgggaggcaggtgtttgagttcagggctgtggagggggcttggtgtggcatgtctgctacagggatgtgtgtggatctgtgagggttgtatttggtaggcctccatgtgggtttcagactctgcctctagagcttacactcgagtctcctttcctagaagattctgcccctggatgggtgggcagggtcccctgggaaaaaggtcctgttccaggagtggaatctcacaccagaggccctagtcagggcaccttctcctcattctcccttagagaaaaagagagaaggaaagtgctctccctgaggtcacaaagcatgctgggctctgttttggcctcatctgtggatgggttgggaggctgtgttctctgaatggggcccattctggcttcatattggaagtaccagccaaggccattcgatggcctttgccctcagcaagcttagctgggggccccaggccaggtgtcattagggcctctggagccagcctctacctaactccaacctcagtctccccattcttcatctgataaatgggagagaactcccaccctctcctgctggatgagacagacctcagcagaggaagggccaggctggatagggttagatggggccaggaagggacagagtgagcaggaccatttctcatgctcccgggacccagatggggagtcaggagggagaggtctggggagctccagctgtggctgttgttgctgtggtaacagtgcagaaagagctatttaaaaatgtggctgagatgttgctggaagcccaggctgctggaaacctgatttcggagaggccggggagtcgggggaaggaggagggaaaggagacaccccagcaatccccagggtggggcggggacatcactggttctggggacagggggatcctccaggcttctaccagctgctctgggggtttatctgttgtactgccagaagtcagggtttccctaggtgcttggatttggatagggggaaaactgggaagagaactagaataaatgaatgaatgaatgcatgactttgttaaataaagaattttgctgccactgtgaaaggtttttctctaggcatgagaatttgctgaatgttgaataaacaaatgaatgtttgttgaatgattttgtcaaatggatgaatcaaggatgaataaatgcaggttgaatgactgaatggggcctgcagtaaattcccagacagagggctgggctctgctgagtctcctccttccattctccttacaggagccctggctgtggtcggggggcagtgggccatgctgggggcagtggaaggccccaggtggaagcaggcggaggacattagagacatctacgacttccgagatgttctgggcacgtgagtccagggcaggattgggtgctggatggctgagggaggctgagtccagggtggggcttcctctggtcaattaatgcttcctgtttcccacagcccaggccctgtggcagcactatctagggcctaaactgtccccagcttttcacttctggatgacagtgggtgggacacgggctgctctcccaatagccctgggttcttgaagagaaagaagtcgagagaatgaaggtgccagtcagtccatttaacttgctgccaagagctaagtgttctagcctaggtttgggaactgaggctggagatggctctgttcttggtgctgggaatgcagaaataactcaaacctggtctctgcccttcaagttgatcccagacatgtgcaagagacagacctacagaaaatgacaacagggtgtgtgctgtgctccaattaaggttgggattgagggctttgtggagcccagagagagctgtgccttctgcctgggggaaaacttcctggagaatggggcattagagctggggactgaaggatgggtaggtgtgcacttgtcagagaggaagaaggacattccaggcagaaggaatagcataaacaaaggcttagaggcatggttctatgtggagagaggtagagtgtgatggagcttaaaatcacaggctggggggagagtggaaaaaggggctggagatgaaagtgggacagtttgtgtagggttttggaagccaggccagggaggctggatattgtcccataggccaccgggagacacttaagactttttggcaggtgtgcaattcaggatagtcactctggccacagcttggagggtaaattggagagggacaagactggaaaccagtgatgaggttactacagtaactaattatccctgaggattgaaatttcaccacgagagatgcttttctttgacttatgacttcttattctcccagagaaagcaaacagatgtggaaagaataccctagcaaatcctctttaatcagttaactttagttaaatgagtttatttgttcctttttaagaacctgttctaaaacactgcttcttaaagttcaatgagcatacaaatcacctgaggattttgttaaactgcagattgatttagtaaatctggggcagggcctaaagttttgcatttcttttttttttcttttttttgacccaggatccaaagcagtagagattttgcatttctaaaaaagttcccgggtgatgctgatggttctttaaggttctaaagggtgttaaattagccatgactcgaattagcagaaaaagggatgaaccaactgtacacataatccaaaagcccaggggtagacctcaggcatggctggatccagagggccacataatgttatcaggaaatatatttggccatttctcaggttggacttcctttgtgttaatttcattcccaagcaggctctccccaggtggtggcaaagatgatcgccattagctccaggcttacatcctaccagctcaacaggagactcattctcaaagtgctagtaagctggcttgcatcacatgaccaattactgtggccaggggagagactactttgactggccaggcctgggtcatgtgaccatctctggagccaggggatggatgagtgactaggggagggtcatccacgtccttggtccagcagtggtcacagaacccatagggaatggaggagaggctggagggaagctggggttccagttcttcaccttgtgaatcccctctcccgataggggggccttctcggaggtgatcctggcagaagataagaggacgcagaagctggtggccatcaaatgcattgccaaggaggccctggagggcaaggaaggcagcatggagaatgagattgctgtcctgcacaagtgcgtgggccacagcctttccctgccccaagctgaccctgccttggccctcccatcctcctcctttcctgctttggacaaatcatttaaactctctaagccttaaattgcccctttataaaatggggatcacaatttccacttggcagggttgtggggaacatcagaagtcctttatttcaagtgcctggcctaacatgacagatgtgatggaggtgccagtgcttagtcacaggggtttaactgttcaatcaggtgtaaagatccatcctgaacatggcttggacccacatatctcagttggtgttgtctctggacctacctcaagttcccctcacatattaaaaccactcagcaagtttaaaaatgactgtctgctgacccccagactaaatccacaaccaactggtctatgaattgctcatgctgatatgaaacctcctgtcctcactggaaaacttacagagaatcacttccaatctctcccctgagcttccaaccaccctgggcagataattttttttttttttttgagatggagtctcactctgttgccccggctggagtgcagtgacgcaatcttggctcactgcaacctctgcctcttgggttcaagcaattctcttgcttcagcctccctagtagctgggattacaggcacctgccaccacgcccggctaatttttgtatttttagtagagatggggtttcgccatgttggccaggctggtctcgaactcctgacctcaggtgatccacccgcctcggcctcccaaagtgctaggcatgagccaccacacccaactcctggcagagcatttctaataagacccagagaggacagggatttgtatacagtcacatggcaagtttgtggcagagctgagccttcctcatcatcaagatcaattatcgcctgaccaacacggagaaaccctgtctctactaaaaatacaaaattagccaggcgtggtggcacatgcctgtaatcccagctacttgggaggctgaggcaggagaattgcttaaacccgagaggtggaggttgcggtgagccgagatcacaccgtgcattacactccagcctaggcaacaagagcaaaactccatctcaaaaaaaaaaaaaaaaacaaaaaaaaaacaaaaacgccaggcgcagtggctcacgcctgtaatcccagcactttgagaggctgaagtgggcagatcacctgaggtggggagttccaaaccagcctgaccaacatggagaaactccgtctctactaaaaatacaaaattagctggacatggtggcgcatgcctgtaatcccagctacttgagaggctgagaaagaagaatcacttgaacccaggaggcagaaattgtgatgagccaagatcatgccattgcactccagcctgggcaacactccagcctgagcaacaagagtaaaactccgtctcaaaaaaagaaaaaaaaaatcaattaccattattgtttcacttatgagtatttaccgtgtgccaggcactgtgccaagcaccttacctgcattatctcacatgatcctcactccaactctttgagggaagtactaccattggcttcattttatagatgaagaaactgaggttcagagaggttacattaaatctagcacctaccctgtaccaggtgctggaggaacagtggcaagcaagacaaagcctctggattcggggagcttatgtctggtgggggaggctgacaaacatgtaaacacagaaaactatatatatatattttttttgagatggagttttgctcttgttgcccaggctggagtgtaatggcatgatctcgactcactgcaacctccgtttcccaggtttaagcaattctcctgcctcagcctcacagatagctgggattacaggcatgtgccaccatgcctggctaatttttgtatttttagtagagatgggttttcgccatgttggccaggctggtctcgaactcctgacctcaagtgatccgcctgccttggcctcccaaagtgctgggattacaggtgtgagtctctgtgcctagccagaaaactcttaagaggtatgtatcaggctgggtgcagtggctcactggtgaaaagatctgcacccaaatagcatgtgacgggcaggatttggacccaggtctgtgtatgccagagcccagtgtttatccctctgctctctcaccttccaaaaaatggtaataaaccatggtaagctagcttttccctttggggacgagatccttggtttgtcctacccaggtatgtaggcagtggtcgggggttgggggtggctgagctgtcctgagctctaaaccgctgtttttttttttttttttttgagacagggtcttactctgttgcccaggctggagtgcagtggctagtcacaggtgcaatcataacagactgcagctttgaactgctggggccaagtgatcctcctgcctcagcctcccaagttcccaagtagcttggactacaggtgcacaccgccatgcctggctaaaccacctcatttctcctttcaggatcaagcaccccaacattgtagccctggatgacatctatgagagtgggggccacctctacctcatcatgcagctgtgagtggcccaacctctgccctgcccccacacctctcccagctgtcccaaccctctttgccagactgccctatcccctgctgcagggtgtcgggtggggagctctttgaccgtattgtggaaaaaggcttctacacggagcgggacgccagccgcctcatcttccaggtgctggatgctgtgaaatacctgcatgacctgggcattgtacaccgggatctcaaggtggggctcaagggggtgtggtgagctagggtacccaggggtggggcctttgcaaaccccaaactgtctgaccttgggcaactttcaccccctcactgagccttggatttccatctacaaagtggatcttgtaacctttaaactgcctcctcccattctagtccagatactcaaaggaacacgagtgaattgtgtggcattttatccaaacaacattttgtctttttctgattaaaaaaaaaaaaatctggccagacaggatggctcacgcctgtaatcccagcactttaggaggcagagacgggtggatcacctgaggtcagttcgagaccagcttggcaaaaccctgtctctaccaaaaatacaaaaattagcccggcgtggtggcagatgcctgtaatcccagctactagggaggctgaggcaggcgaatcacttggacccgggaggcagaggttgcagcaagctgagattgtgccattgcacgccagcctgggcgacagagcgagcctggacgacagagcgagactccatgtcaaaaaaaataaaataaaaacaaaaaatcctattccccttctgtagaaaacttggatgggacagcaaaacataaagaaaaaagccagaaatccccgaaatcctactcctcggaaatagcgacggggctcacatttagcagtacatctcaatccgttctaggagaagggcacttggggtgtgacatgcctggttttgaattctggctctgctactgcctaactgtgggttcttgggtgagtcactttgcctccaaaggcatcagtttcctcatctgttaggtgagattatacagactggcctagcagggaagcagtgaggatggcattaaatcaagcactaatccagggtctggcataaaataggcattcaaacattcctttagggctttacagtgcacacctgaggtttagagacagttcccccccacaccctcttgagccttgtccttcctggaatttttggccttcttgagagcttccttgattttcttatgacagccatgaagccacagtggcttttggggatccattatttctcagaaggtgcttggagcggcagaaggttctaccagcctctaaccatctctgattgccccttctcttccctcctgcccttcaagccagagaatctgctgtactacagcctggatgaagactccaaaatcatgatctccgactttggcctctccaagatggaggacccgggcagtgtgctctccaccgcctgtggaactccgggatacgtgggtgcggagggccctgggctggggctgtgatggtggggggaaccaggagttgaagggcagagatttgtcaccaccacgtcctcttccctccacagcccctgaagtcctggcccagaagccctacagcaaggctgtggattgctggtccataggtgtcatcgcctacatcttgtaagtggggcttggccatggtaggctgtggctccagagttgtcctctcgcctactttcctctcttccttcctctgctctccctctgccctcccttccttccctccctcccttccttccaccaatcaattaccagtattacttcattcaatagatactatgtttcaagcactgtgccaagcaagcactggggtaaatttagcacagcacaaaccagacaaagtgcctgccctcagggagctgactttctttctagtagggaagacagacaatcaacaagtaaataaatctacaaactgacgtcaggtgataaaaataaatactgtggagaaaaaccaagcaggaatagggagacggggtgatgccatttcagtagggaggtcagggaagggctcgctgtggaggtgatgaccgagtggtgagggagccagacattggaggtgtggggaaagagtggcataggcagaagcaatggcaagtgcaaaggccctgaggagggcaagatggcggcacatacaaggaacagaaaggataatgtagctagaacaggagtgagcaggcagggctggtagagtttataaagggggaactccttccatggctcctgcctgacccctgagactgccccagtgctccaccccggagccaacggcacccgaaagtggaaatgaggatgagtttctccctgcccaggctctgcggttaccctcccttctatgacgagaatgatgccaaactctttgaacagattttgaaggccgagtacgagtttgactctccttactgggacgacatctctgactctggtatttggggctttgcttttttcccctgggccctgcctctggttcctccctcacctgctttgggggcggtctccctcctgccttccttctgtcggattttccagcaccacacaaagagctgtcttcgagaccagacaccctaccccttcttccttctgcttgggtacttccttctgcttggctcccagagtgagaaactaggcattcatttgttcaatcttcaaacatagtctatttgaaaatacctctcccctattgacaccctaatgtctaaaacaccaccataaacattttcatcctccttttgtgccccctattaagaagcaaacctgtgaagctactatcgtttatcatcagtgtgaatgcactgagattagtcaagaacaacttttttttttttttctttcttttttgagacgcagtctcgctctgttgcccaggctggagtgcagtggcacaatctcggctcactgcaacctctgtctcccgggttcgagcaattctctgcctcagcctcccaagtagctgggattacaggcgcccaccaccatgcccggctaattttttttgtatttttagtagaaacaaggtttcaccatcttggccaggctggtcttgaactcctgacctcgtgatccacctgcattggcctcccaaagtgctgggattacagacatgagccactgtgcccggccatatgtttttcttaagagagaaaggaaagagctggaaggcacggggtgggagggcctgaagaagagcataggttgggtggggtggggcatggactgatttggcctctttgtcttgatgccaggccagacctgagggagtgggtatgctcttggggagtacacaggcagtaccatgctgtcattatctttgcttttgtcttgggggtttagccaaagatttcatccggcacttgatggagaaggacccagagaaaagattcacctgtgagcaggccttgcagcacccatggtgagaattcacacaacctgtgagctggggcgggatttggggccctcaggtctgcttctgccctcataggcaacccaccacataaccccatcctaggattgcaggagatacagctctagataagaatatccaccagtcggtgagtgagcagatcaagaagaactttgccaagagcaagtggaaggtgagtccatatccctagttctggtcccagcctccccaggactcctccccatccctacccaggctcagcttgcacagcacctggcatcacactgggcacacagtaactgcttagggatccttactgaaggacttcattcattcactctttcattcaacaaacactcccaacaccttctctattccagagagggtccctcacctccaagtctagaggaagaagtctgtaattcttcaggaggcatctgatccagcctatggggtccgagaaaggtcataaaagtggtgatgacctgacagagctgtcagttaagtaggaattagtgaggcatagcggaataatgtctatagccattccgggaagtgcaagtgctaagcctggccagactggaggggctgaggggactgagaggcaggagcccaatttagagaagcaggtaaggggccaggcctcttagggcctcatatgccacagaggagcaccaacttgatcctgagggcactgaggagccccagaagaatcttaggcaagtatttgctgcatagaaagggctctcagggccaggcatggtggctcacgcctgtaatcccagcactttgggaggccgaggtggttggatcacctgaggtcaggagttcaagaccatcctggccaacatggcaaaaccctgtctctactaaaaataaaagaattagccacacatggtggtgcgtgcctgtaatcccagctacttgggaagctgaggcaggagaattacttgaacctcggagatgggggttgcagtgagctgagatcgcgccactgcactccagcctgggcaacaaagtgagactccacctcaaaaaaaaaagaaagagctctcaggatgcagagaatggcatggagtaaagactgggtgacgcattaggaggctgtggcagagatacaggcaggagatggtaagggtttggaaccacagtagcagcaacagggggcagagaacagtggttgatccaggagtcatttaggaggtgaaactgacaagacatgacgatgcaatggatgttgggggaaagagatgtcaagggctggcccaagactgtggctgggaacagaatggatggtggtggtaccatgactgagatggttatcacagggacagaaacatgttttggggggatggttttagttttagacatggtgaatttgaggggtgtgtgggacacctaggtggagatattgaatagagacacacctgagcaagttacttcagctttctgtgcctcagtttcctcctttgaaaatgataatagtacctacctcaaagactttcatgaagattaaatgaattactacgtaaagtgcttagaacagtgcctgacatacagtgctatagtgtttgctattacatattaatatgaattatagttatgtttctatttatatatatagatacacatacatctaacatatgtgcgtgtgtgtgtgtaaatatataataaagccttgtagaggtttttggggggctttaggggaattaataaaataactcctgaatgaaaataacagaacaattgcaagaatcccactgcgcccctgccccatgacttgactctctcaaaagtcctttctcccctctcccttcaatgccttcaatgccagcaagccttcaatgccacggctgtggtgcggcacatgaggaaactgcagctgggcaccagccaggaggggcaggggcagacggcgagccatggggagctgctgacaccagtggctgggggtgaggagcgggctctgcagaagggcatgggtggtccacaaaggtgcacccgggctggagtggagggcctgcccctgcggccacctctgttctgtcttcccatgcagggccggcagctggctgttgctgtcgagactgctgcgtggagccgggcacagaactgtcccccacactgccccaccagctctagggccctggacctcgggtcatgatcctctgcgtgggagggcttgggggcagcctgctccccttccctccctgaaccgggagtttctctgccctgtcccctcctcacctgcttccctaccactcctcactgcattttccatacaaatgtttctattttattgttccttcttgtaataaagggaagataaaacc

SEQ ID NO: 36592 - DNA, 50891 bp, Homo sapiens
gaagtggtagcagttcctcctaactcctgccagaaacagctctcctcaacatgagagctgcacccctcctcctggccagggcagcaagccttagccttggcttcttgtttctgctttttttctggctagaccgaagtgtactagccaaggagttgaagtttgtgactttggtaagtagacttttctcattgctttttccttaaaactgtgttcccagcaaagtctgataaggcaagcgtcaggtttcatcttatccttggattgtttcccagagaccaggctctgttcaaactcagaaagtgaataatcaagttttgcaagttcctcttaatgaagacctaacgtgtcctaacaaaaatattttttggtcgctgtttttttaggggttgctttttatttgcttttgctgatgttatttatttacttactttacaactgccttgaattcagattccttttgacagccacaccagtccagaagaaaccacagctggcgctgtttatgtaccaagagctggcttcattcaatttaatcattatttgtttgcaagccaaaaaacagtcattttctgaattaagtagtcctttcacctttgtttatcaggaaattagaacaactatttgtaaacaaccttgaagcataaaagtgaatctaaatttggaattttaggatgattttctgatatatagatttagttgacgattaaaatcattggcacatgtgaccagttatgaaaaaaggtggggggtggctgatgcataatatcaagaaaagaaaatatactgttgacattgtttgaaaatagatggaaagagggtttgcaaagtgaaggggattcatcatgttacctaagagtctgattttctgtttctgtatctttttttccttctgtttcactctttctctgcctctaagcctctaagctgcttcttgcctttcctctctcgttttctttctcttccctacatttttttatttgagatagtgaaagtgggctgataagtaggtaaattttctttctgtcaagaatactcaaaaattatttttataatttgaaggaaagtcactgtttccttaaaaattaaagttcaggcttttttttttttcagcatgggatattcaaagctctttactttctacagaaaatatgatacccatgtgcttatttgaatcattattcttatagtccagtaaatccttactaggtcatgagtcaacaatgacagaaaacccagtgaaacaaactatcaatttatttacaaatgattcaccagctgtcagacttctgtgcagaaaaaaaatatataatactgtgtgccttctttagggaaacccatgtgagctaggcttgtacttctatcagtagttttcttgctaacatgtgcatgaggcaagtttagggactgtagaaattgtactgcatctgccgtgcttgtaatactgtaaacctgtgacaagctggttgagtggcagtcctctgagaaatccaagttactccaagctcactgtacatgatgtattccctcctccatgttttacccaagttagcccaggctaacttcctttgactaccaaattgttgtgggtttcctatattcagggactgcaagttaattctttcctgaggaaagccaaaatacaaagctagctctcttagaactaaaaaaattaacaaatattgcacaaagccagtgttaactattttttcctaccatgatttccttccattaatggtagatgaagggccatttaatacatctttcttggcccttataaaacaacgtccatctaagtacttaagccaataaacatcagtttcttatttttattgactaaagagaatatttgactataagtggttaatttatacaaatgagataactcttagaaaattattaggagaaccagaattgttttaaaagatgcccataactaaagtggtaatattaatgataataaccaatagtcaattgagtgcttactgcaagtacttactgcaattgagtgcttacaaggcactgttctgagtgttcaatatgaattgtatcacataagcctgtcaacaatcctctaaaataaggtcgttaaataaaatatgggatgaccatttgaatttgaacttcagataaatagcaaataattttttagtcccatgcaatatttgggcatcctgtatgtttatttgccaaatctggcaaccattctataaagttttgtaaaacttattattcctattttatagatgaagaaattgaggcacaaaaaggttaagcatcttgcccatggtcacacagatggaatggtggagacagaatttgaacccaggctctctgaccccggatgcctttccctttatcactagacatggtcttttcctgctgtgtgtatataacccagcacatggagctagtctgagatccccctgtaaggtttgctggattagcttgactctgaatcagcaggtggttcccttgcttttcctctgtgatccgagaaaaataaatcctccccaattctgaaaagctgttctcagcagaaagaggaggaaactgtccttggttcttgttctcggactaactgaagtgcctgtgacccatgaaatgctagtttgacaagttgttaacaggtgtacatggggaaaaaatcagtttcaatagtcaagttagctttgggaatagaactgggttaaactgtgtttaaaaggtctctttaatgcagtaatcctaagtctttaacatgctaatacgcactgtggctttcaaggaaaggatctagtgttttccaaactctgttttcaaaattttgattacagcattcacctccctctttttttccccaatgtcctgtagaaaacactgagagaactgacatttttaactttatatggaaagaatcgtaaatatggtgaatctggatgtcctcatcaaccagcttcaaagactatcacccatgcaatcttgtttcatctgcatagccactcatttcccacacacacccacttgagttttttaagttatttcatgcaccatatcatccagaaatagaaaaatgtcattttaaagcatcctgtctcccctaacccagagaaaacccacaagttcagctgatccaagacagaaaaattccatctcatttcaccggtgttaagaaaggaatgatgacttacaaggtatacactcttctcattcttcatggttgactttcttcatgcagaattcttaatcaagtaatataatattcttgggttttttttttttttttgagacagagtcttactctgtcgcccaggctggagtgcaatggcgtgatcttggctcactgcaacctccgtctcccaggttcaagtgattctccagtctcagcctcccaagtagctgggattacaggcgtgtgccaccatgcctggctagtttttgtatttttaatagagactgggtttcaccacgttggccaggctggtcttgaactcttgacctcaggtgatccaccagccttggcctcccaaagggctgagattacaggcgtgagccactgcgcctggcataatatgatattcttgatggaagcagcctccaaattctcagcacataatctatatactggaatgggtaacttccacattatggacatgaaggacctcctagctactagggaaggtggagctagaggatcacttgagcacagcagtgtgaggccacattgagctaggatcacaccattgcactccagcctggacaacagggaaaaaccctgtcgcttgggttggcttataaaaagaggtaccagaggctgggtgcagcaactcacacctgtaatcccagcactttggaaagccgaaacagaaggattgcttgaggccaggagtgcaagactccaggctggttaacatagtaagacctcatctctgcaaaaaagaaaaaaaaaaaagatggaccagataaaattccactgaaaagcaaaaatcaggtctcctgcctcagttcacaaacaaccttacatacaatctctctcccttgctgtatggctcctaatcactgtatccaaggaacagccaagctgtctggagaccacaggtttttcaaagacatttgccggaaacagcaccgtgcgctgagagttggtactgagccaggctcagttcagtttgcttacatgagcttctccccagatttatgccaatgcatttcacaaattttcagggtgcatttggccaagacatttcagccaaccaggttattcctgtgggtgcttctcagtatcctaaatgcaaaggaataattaattattcctctcagccaaggaaataaaagtagggagagatgattagaaattaacagaggtatgtctcgaaggagagtgctgtttcccattgctcaataggtagtgctcatttgccctatatgctgcaaattattgtcagcaggaaaggaagtatatatgttagctaagctaaatgtctgaataatataacaacaaaaataattataacaaatataataataaatcccacatatcaaatgcatccggtgtgctcggtattatactgatggctttacatatattacacatttaattttcatgatgctcctggatgagaaataatgcttttgtgttttacacgaaaggaaattgaggaaaggaaagggaaattgaggcatgcagaatgttaagttaaatcattttcccaaggtcacccagcaggaccttgacaaagcaggagtttgaacccaggtctaaccaactgaaaacccagaccttttctgatatatcacacatcttctacacaacataatacacagtttttacagcttcccttatttgcaggcctctgtgttcgtcccagtctctggatcaaagtcttattagacttgtcctgattgcttcacggggagtacagaacatattctcatgctgattcctttcaaggtcagccagctttccttctaacctctgaaatgacactcatttacattactcaattatttctgcccaaactattttatttttaattttctttaccaatggatttatttcttaggtcctaaaagaagaaaataaaatagacttctactcatagttatctttgtgcatcacgagattttcacaacttagagtataccctaataaaataataagaagaatttaatgtcaggagataaggttccttttaggacttccagaatcaccccaaagttttatgatgtgtctccaattccaaacctgaaaggagaacatgatggtttatgagacttcaatccagtctggaagcagactcactgttctagaagcaaaggcacaaatgaataggatagagactgctacaatttgaatgtttgtcccctccaaaactcatgttgaaacttaatcccaatgtaacagccttaagaggtggggcctttaagaggtgattgggccatgggggctctactctcctgatggattaatggattaacagattaatggattaataggttatcacagaagtgggtgagttatcatgtcagtgagtctatcataaaaaccattttggctctcagtgtgccccttcttgtcctgtcatgccttctgccatgttatgacacagcacaaggccctcaccagaagctgactagatgcagctgcctgatcttggacttcctaacctctagaattgtgagcaaaataaacctctttcctttataaatttcccagtctcaggtattctgttaaagcaacagaaaatgggctaagacagaggggaaagacaagaagatgaaagaaaggaaaaaaaaaaagcacacatagcacaccttgctgataaataaggatgatgatcaaaaaccctcatgaaatgagaagattggaaagaaatccataatgtacctggaagtactagacccaatccgagattcacctgttcatcagaacaggccttttttgcatattactatgttccaggcactgttttggggttatagcagtgcttgtgacagcaaggcttctgctttcaaggagtttctagggacagggagggagccagattttttttaattttagtaaaaacaaaaaataagaaaacatcaggaatatttatttgaaataaaacagtgagataagatagagattgagcaagaattataatgatggtcaagggatgtctctctgtaaaggtcaaattttcaggacagacctcaaattgatgagtggtgtgtatgctgagagaagacgcagacttgagacattcaaagcagacaggacatcaagagcaaaggccctgaggcttcagcaaatttagtatattggatgtaacagcaggagggcccatgtgggtaagctgaggacatcaaggtgagaatatcaaggtgggtagggaccagatcaggtaagatcttgtgagcccttgtaaggacctttaatttatgcaaagagcaatagaacatgatataatatctaagagtgatgaggatataaaagaaacaagactagccacatacaagttgataattgttggagacagtggtgggctcatgataaaaatctccacttttaggctgggcacagtggctcacgcctgtaatcccaacactttgggaggccaaggcgagtggatcacctgaggtcgggagttcgagaccagcctggccaacatggcgaaaccccgtctctactaaaaatacaaaaattagccaggcgtggtggcaggtgcttgtaatcccagctacttgggagggtgaggcaggaaaatcacttgaacctgggaggcagaggttgcagtgagccaagatcatgccattgcactccagcctgggcaacaagagcaggactccatctcaaaaaaaaaaaaaaaaaaactccacttttgtatatctttacattttccactggatatagcctcgactgtactcaccaggttctccacaccctaagccacatgccagatttgtttagcagattcagtggagcaggttcattcatgggggcaccaaaccaaaagtccttttaaaaacagttacctatgatttaaaagtgtgaagtgattgtagtatgatggggaaacagtgggccaactatcatgagaattaggagatctggacagctacatgatctctttgatcatatagttttcttacttgctcagtgcagcagtagtgccaacctgtcctcagacggggatgtaataattaaaagaggtagcaggggaaaattctacaaaccatggagggttgtgcaaatgtaaggaattattatttttttttatttttatttatttattttgagacggagtctcactctgtcaccaggctgaagtgcagtggcacgatctcggcttactgcaacctctgcctcccaggttcaagtgattctcctgcctcagtctcccgagtagctgggactacaggcatgcgccaccacacccagctaatttttgtatttttagtagagatggggtttcaccatgttggccaggatagtcttgatctcctgacctcatgatccgcctgcctcagcctcccaaagtgctgggattataggcatgagccactgtgcctggccaggaattgttattatcttggatgtctttctattacaattaccactactactgcaaaaatcctaattgctaataaagtatttttaggtttttaaaggatttcatagagtatgattgctggactgagcacagaggtaataattggtagagcagcagttaagaagattgctctaccacagaattaaaagaatgtcttcgcatagtccaagaactccagctgaattttgaaactccaaaagctcaaggaacaccagcttcacatttgcctgcgggaggggtgtgtgcacacattttgatttccagccctggaagtggagaatggtttattaagtgtttctccaggacatcccttccaaagggttgacagcatgtttgagcaactaccttggaaacacttaaaacctactgaaatgtaggggagtacaattatttctgaactatgggccagagtgagaaagtttgcccaagtctcatgattatgttccagttctctgctcttcaaaacactctgctaaggtgaccacacttgtttttctctctcaggccattctgtcatttagttgcataacctcagttctattctttcaataatatacatagttcacagtgccttcggggtagtttccgtatcaaggttttggtttcttctgatacaaaacacacacacacacacacacacaccccttccaatcctagaggaaaagagtatactaagtagagttaataaagaagcgttagatcccagaccattcagatttagctggtgggactgtgaggagtgtgatcatacagaaatgaacctctcacaggtggttaagtatgctggagttggaggcacagcctgtgtttgaatatcagctctaccacttcttacatgctgtgtgagtttagacaggtcacttaattaagctaaacttcctcatttgtgaaatggaaataataatagtaactgctttgtggaactgatgagaagattacatctatgagaagcacttagcacagtttccaggacaaagtgagtgttcaaaaaatgttaaggagttaccgttgtggttataggttggtgggaagcaatgtaaattattttattacaatgtctctcacctgacttctctttggctaactcagtggctctcaacttggggtgattttctgcccctatggcagaaaatgtgcctttttcagttgtcacagctggggaatgttactggcatccggtgggtaaaggctagggatgctgctagacattctacaatgcacaggacaacccccacaacaaagaattatctagcccaaaatgtcaacaatgctgaggttgagaagccctagaaactaaaacagtgtggggtttgtaatttattgaaaccatgtaacaactttagttattcaaagacacatttacctgggatataaaaactctaaaatgtacttcaattgtggaaagaggcatcaatgattaaccataatcatttctgatcatgaccaagtcacccctgagactagtaactgcaggtgctcacaaaaaaatatgcagctgtccttcctgccttcaggggatcattcatgaaagtaatttctcacctgaccaaaatgatcgcttaacatttattgcatcattgcccctgtttctgtagactactctaccgaagttttaatttgtcactagtttaaagggccaaaagatctgttttcttcagatattagagacacaaaccaagcatctcccactttcttggaattccttctcaaaaatgactaaagtctgagactgttttcttatttaatgtctattgaattctgttttacagaatttcaaaagagcaggttcttagcttacttttcaatggaacattttagccaggtagtataagtacaggtgcgggtaacctcagataaatcaaggtgttatgcagctgtctctatattaaaaatatttgctgacatcagtgtagacttcatcttgtagttcttcagtgttttctttccttatcttttgctcataagatggctttgtgtttggtttgatattatactgagaaagcatattagaatcaaagcaccaagatttcaaaagtccagactactcttcccaaagagaaatgtgcaatcacaatagcatgacatgggtacaaatatagaagtatgttattaaagtattgagaattagctttcctaacctccccacctgcaatcttttactcctaatctccaaaaaatgaacaaatcattggctcaaaatggtcacaaattgtatgtggtgttaaaaatctattatttttattgtatataaaatgttgccaggtgtggtggctcatgcctgtaatcccagcactttgggaggccaaggcaggtggatcactaggtcaggagttcaagaccagcctggccaacatggtgaaaccccatctctactaaaaatacaaagattagctgggtgtggtggcgtgtgcctgtaatcccagcttctcgggaggctgaggcatgagaatcacttgaacctgggaggcagaggctacagcgagccaagatggtgccattgcactccagcctagatgacagagcaagactcagtctcgaaaaaaaaaaaaaagttatactagttgggcacggtggctcacacctgtaatcccagcactttggaaggccgaggcaagtggaccacctgaggtcaggagttcaagaccagcctggccaacatggtgaaactccatctctactaaaaataaaaaaattagctgggcgtggtggcaagcgcctgtagtcccagctactcaggcggctgaggcaggagaattgcttgaacctgggattcgccactgcactccagcctgggcaacagagcaagacactgtttcaaaaaaaaaaaagttataccactattactgtaatcattaagggaagaatacttctcatcagagtttgtctgcagtaaagtactcttgtcagctttgtgttcctttctgtcctatcttatgtacaaaccgatctccattatgtgtcacctgccttctaatggctgatcatcttgattcttacattacctgaaacacagtgaaagtgttagtgaacttagaatagtggttcttaactagagatttacccagggagattttttaaatcctgatgtcctggccacatcccagactaattaaataaaaatcactaaggttgaaagccagtcctcagaatcttttaaaactccttacgtgattacaatgggaagccaaagttaaaaccaatgagttagaaaaaaaaaaactattataatgagcagaagcaaaacacccaagtgacgtttgtaacatcactctctcacatctactttcaggtgtttcggcatggagaccgaagtcccattgacacctttcccactgaccccataaaggaatcctcatggccacaaggatttggccaactcacccaggttggttggacttttagctaaagattgttgatgaagctgggtgtggtggctcacgcctgtaatcccagcactttgggaggccgaggcaggcggatcaactgaggtcaggagttcgagaccagcctggccaacgtggtgaaaccctctctctactaaaaatacaaaaattagccaggattggtggtgggcacctgtaatcccagctactcgggagtctgaggtaggagaatcgcttgaacctgggaagtggaggttgcagtgagccaagatcgcaccattgcactccagcctgggcaacaagagtaaaactctatctcaaaaaaaaaaaaaaaaaaaaaaagattcttgatgagtctcaaggggaaatgtatatagaattgtctgttttgatattttttgcccttctggctttatttaaatgtaagagatgtacatgaacaaagactatatgagcttagaaatgctgaagagagccaagtggtaatcataagccaggatttgaatttcttaggcttcacatgagaaagtgaaaaatagtcttgtaatcaataagctgaatcaacagcattgggaaacatgattccccaaagtgctgatatcagaatatgatttcttgtcagctggatatattgggatttgaccttccttataagtggtcagttaaacacagggagccctactttctgaagagcatctaaggagaaggtgaactggggagcaaagccatctttagtcactgttccaaagccctattccctttgcttgtaagattggatgactcttctgtttggagccacaaggccaggtgaattgcttctgtcctgatctgtttaaatatattaattaagaaaatgtcacagaatctttagagtagaatgtctcaaaaactaatgggtcttaatcctgccaaaacattgggattatctggagaggtttaaaaaatatattgatgtctgcctgggaggttcttatttaattggtctagtatgtgtcctgggcattgggatttttagaagctccttggtgatcagttcactctaatgtgtagccgaggctgagaatttctgccctgactatatttcatagaggagaaaactcaggcaggctatttgagaccagcatcttctgtctcccaggtcaaagctcttctcaccatagcctacccatcttctgtccctttgaatgaaagagaggctacaaaaattcagatttgcttgttaatacctatggctctgtatagactcctgttctgttgctatgttttcccattaagaccaaaagattcttctaggctgcaggatctgagttcttcttctgaagaaccttgattacccatcagattctattagggcagtatttctcaagcttccatgtgcaaatgaatcacttgggaatcttgtcaaaatgtagattctaattcagcaggtctgatgtgggacctgcgattctgcatgtctaacatactcccaaggatgacaatggcactggtacatggaccacatttgaagtgacaaggttctagggctcagattcctacccttgtctaggtacttttttttttttttttttttttgagatggagtctcactctgtccccgcaggctggagtgcagtggctcgatctcagctcactgcagcctctgcctcccagattcaagcaattctcgtgcctcagcctcccaagtagctggaactacaggagagcaccaccacgcctggctaattttttatatttttagtagagatggggtttcgccatgttgccaaggctggtctcaaactcctgagctcaggcaatccacccgccttggcctcccaaagtgctagaatttcaggcctgagccaccacacccagccttgtctaggtactttaaatctacataatcataagatgatggctgtctagatcagtgtctaggtacttttaatctgccttgtctaggtatttttaatctgcataatcataagatgatggctgtctagatcagtggtttttaaagtgtggtccctggaccagcagcatcaccatcacgtgggaacttctcagtaatgtaaattcttcacgcaatacccagtgaaccataaactttggaattaaagcccagaagtctgtgttttattgagtcctccaggtgattctgtgcatgctaaagtgtgaaaatcactgcttcatacagacgactatttaaaaagtcagctgtaagaacacaattagacctaaagtacctgcttctccgctactcaggtcacggtatattattcctttcccaccttgtccctatcgtagatgggaagtgattatagtggtggtcaagcaaatgacaagtgtgacaagcaaatgacaagtgggaccaagcagcagccaccgtaacaacctcctctctggctcccaaagctctagtaaggctctggattaaagacaaacttgaatgctgcatttccaaagcatggtgctctactacatgcatctgaatcacttgggagacttgttaaaatgcagatgtcagggccccactcaggaactaatgagctggaatctctgatggagatgctgaggaatctgcatttcaacatgcaccgctggataattttgtttctgatgcacggtaatggttgtggaccactgagctaatgcagtgcatctcagtgattactgtccatcagaagcttgttaaaaaatattcttgagcaccacccccaaaggttctggttcagtaggtcaagggtggggcccaagaatttgatttctataatgcttttaagtgaagccaatacagaccacacttagagtaacatgttctaatttttttatgaaccaggaattaataaactgggcagatagtaaagcattgcccacagaggttgaaagagactttcagattcatcgagtctaatctcatcagatggttgagcttcttccacaaaatccccaccaagtgggtctctttgaatgctctaccaacaaggatcccactacatcagagatgaaccatttacttaaatcagatcaatcacccaactatcaactaagcacttactatgtgcaagtctctatgttaagtgctaatgaagataaatgagttttctcagggagtcagggaactgtaactaaagagtacagctcttttgttttcacttaaatatgtgtcattattgtggaactattaaaccacaccattgttcattctacacacataatgaaaaaaaaaatcaacaaatttttatgatagtgtgattcatagaacttactttcattaatttttgcttttatttttttcccatagctgggcatggagcagcattatgaacttggagagtatataagaaagagatatagaaaattcttgaatgagtcctataaacatgaacaggcaagttggggagccaagagtgggaactttgatctttgaaataattaaaataattctgcatatataaaagtgctttgcctgttttccaaggaacttatacaagtcagaggtcttgtttacaaatatattcctctttatgcaaatttttgttccaaaaagtttgtgaatatgagtaatttcaagattttatgaacacctgaataaatactttggcttgacaagtagccactgcttaattgatctcatttgtcaattcaactattggccaaccaggttgctttgtaccatgatcataatattgctcattccttaacaagtattatgattctgatgttagcacaatgtctgtaatatttcactgtgggtgtcctttcctttctctaataccttggcagctctgtagaaaaaaacctcatgctccctttacgttcgcttctgctttgattttcctactctaggtttatattcgaagcacagacgttgaccggactttgatgagtgctatgacaaacctggcagccctgtttcccccagaaggtgtcagcatctggaatcctatcctactctggcagcccatcccggtgcacacagttcctctttctgaagatcaggtcagtatactgggaaaaccaggagatttcagatggacctagaatgaggaaggcaggctactcaacagttgtggatttgggagtctggacactccttgagctgtgcagttttaattctttcttaaataaagatacaaaggacaatttaggacatggaaaaccctagctaagagagagtaggaaccaaatttctctttggatctgtatgatccactttgttttgccactcttgcaactcttggcaatttgccccctcatcgtcatacacagagagagagagagagggagagggagatagacaagtcccccagtgttctgccttaattcccaggcttttggtgccccaaacaggtttctccactctccagattatccaaagatatttataccaccaaacactcctccactcatgaaaatccacattcctaggtagagaaaaaaagatttgagtgcataatcattgcctaacattttatgtgaatcattgtgttacctttcataacaactctgaatggacaatattcttgctctccttttatagtgagggaaataagtgcttggagaggttaaataacaaacaaattggtccaaagcaacactgctggcaagcatcactctgggattaaaactaggcctatttcattccagagcaattttcttccctataaaatcatgattctcagacttagctgcatattaggatcacgtggttttttaaaaaaaatcctgatgcccagggcactctccgtaagaaatcggaatgtctgagggtggacccaggcatcagtgtttgaaaaataatctccctcgatgattccagtggggaggcaagtttgagaaccagtactataaactaagctgcctgaatggggctgtttgagagaaactctcaaacgtgtttacacaggttgggaccgaccaagctttctttaatcttttcagaggaatgggtatttttaaagtagcaatagataaatctaactaatcttccaggtgtgaaacttaaggctatatgaaagaaatagtttgggacaaagaatcccttcctaatttccctgcagtcccatcataggcatgaccatcgcatctctttatggctgaagcttagcctgactgctggacccagacttttgcccagtgacctctggggtaggttactatcctctttgtcctgccagtacccctagaaatttgacttaattgctgcatctagggacttagggatttttcccaaatgctgtgtagaaagtcactggagttaaatctactccaaccatttttctgctgtttcttgaaaagacaggatgattcatttacatctcttttccttcacagaatcatgagggaagtattgtgattaccagtgttaagcatttgtgaatattttattccaaaaagaaaaaaaatcactttaccagccttttctgcagagataaagactggaggtcaggtgcggtggctcatgcctgtaatcccagcactttggaaggctgaggcgggcagatcacctgaggtcaggagttcgagaccagcctggctaacatggtgaaaccccatttctactaaaaatacaaatattagctgggcatggtggtgcacgcctgtaatcccagctactcaggaggctgaggcaggagaatcacttaaacctgggaggtggaggttgcagtgagccaagatcgcaccgttgcactccagcttgggcaacaagagcgaaattccgtctcaaaaataaataaaaaacaaaacaaaacaaagactggatagcagcaccaaaatttagcaaaatgtagaccacaacagctatttaacaattaatcctgaatgatagtaattaagttacacagaaagagaatgcaggtgctagtagaagaggaggaaagaaacagggagagtgagggagagaaagagagaagcaaggaacattatctacctatggcttccatctatctgattcactaaggtcaaaaaaattctctcatatcaactaagaaatctaatgaaaccaatcaacactagcttattcctagcatttagctgtgctgaatgctgtagagaaataggaggcgaagtttttctaatttatagtttgatgaaagcaaattagcatgtgtgaaatgtgtagaagacattataagatggcgggcaataatttcaagtacaagccacatatgctgggtgaagtcagagaatgagacttacgtgcagttaccacagggccgtcgttcaggtcttcataaagagagtgagaacttgaaccagacctcagaggagagggaggaaggagaggaaggcagcacaaaaacacgaccatgagtgaatatgtagaatgccagttcttctgtgcccagagttcatatttagaaagagaatgaaaataaaattgattatattggacacagattagataatccaaatttaatagccaggaggaatcttgagttgaaagaaaggcagtgtgatgttagaaggagggctgaatttgaagttggaaaacctacatccaactaccacttcagatatatgaccttgagtaacctccgtaaacctcagtttcctttctgtaacatgggaaaatagcacccacctaacttcttcttagggatttgtgaaagtcaagttagttaaaaaatggaaaacaccataaactgcaaaattctggacagatgtctcggtgattattctgtttattttcagcctgactcaatttgtggatgaaaaaactaacatccagaaagtaattaattaaattccaggccttttaatgaacagtcttctgctttttctcttaacaatataatttctcctatggaacaatttgaaagccatgcatgcaaatttagactaaaagcaatggacacaaaagaaacctgtatacattcttcggtattacgcacatgtgatgagtggtgcttttgggcacttgcctgacagtagcttggacagaaaagacactggagcctcagagaataactattgaagcaattctggaattaagaaataaggcctgaaatgagatggtaaaagatgttagaggaagagaagcaaggtaagacaaggtgacacacagaatcagaaatgatgaacaggaagcaacttttaaaataaatgttttctgagtagctactaatatgccaagccctgtgctgggcattgacattgcagcagtgaacaaaacagacacgatcctggctctcgtcaagtttatattttataggaaatagatgataaagaagtaaaataaaataatgtcagatggcgatgagttcctggaaagaaatgaaacaggttaatatgatagagactggcccaggatggctagaagaggggtagaagtcaatgggggagtgttcaaggcaggaaacagttttaggcagagctcctaagccagtgccttccgggacagcaagaaggcccaaagtgttgctggagaggagtgacaagggacagtaataggaaaagagggcagtgcagttcctagaggccaactcatgcaaactcttgatgtagtctgtgtggtggtgagttttgattttattttaggtaaaatggaaagccaatgaaggtcatgaaccacaaaatgacatgatctgatcgatactttaaaaagattcatgcttaaaaaataataataggccgggcgcggtggctcacgcctgtaatcccagcactttgggaggccaaggcaggtggatcacgaggtcaggagatcgagaccatcctggctaacacagtgaaaccccgtctctactaaaagtacaaaaaattagccaggcgtggtggcaggcgcctgtagtcccagctactcaggagagtgaggaaggagaatggcgtgaacctgggaagcagagcttgcaatgagccgagatcgcgccactgcactccagcctgggtgacagagcaagactctgtctcaaaacataataataataataaaaggtattagtgtaactgctgtgtggagaatgaattaggatggctgaaagagtgaacactgatttaccaaataggaagttctcacagtagttgaaacacaagttatggtggctaggactgggaggggactatgaagataaaaaaaagcggtctattttgaaatagaaggggatatgttttgaaaatagagaaacaaaagtgactatgaagtaggttgataaattctgccactagcaaaagcagagaaaattacaaagagggaatggttaaaaatgaagttgaattcattttaatatgatagaggctggggaaggatggctagaagagaagtagaagtcagttggggagtgttcaaggcagggaacagttttatgcagagatcctaagcctatgccttcagggacagcaagaaggcccttgtaacatgtacaagtttagccttgtacatgttaaatttgagggaaaaaaaatgcaaattagttatttctaccaagggctagaaatacaggactagtcacagatggaaagtaagggcaacaaaataaacttgagagccacaaacctgtgggttacagttaaaattataaaacactgtcaaaatttaattaattttaggaagttcactttgtcctcacaacaggtttttgaagtatatttttctaagtatttaatacgtactcttaacagtctgcaaatttgcaaaacctgaagttaatgagtggttaattgacttaagattttttccagaatcaaattcctttctccatacatacatgcgttggggtgtgtgtgtgtgtgtgtgtgtgtgtgtgtgtgtgtacaggtgtgcacctactgcaagaaatgaaagtgattgggaaggaagcaagataacagttattcacgtggaagatcgagaagtgtaaatatttaccaccaacagctcagttatattatggcaagtttatgaatgaaaaaaaaggattttcaattctgaatacatatcctactattttaagacctatagatcatttgattctttctccccaattttggaatttccactcagctcaaaacacatttgaatcttttattaaggttgctttgaacctaatgaggcttaaaatattgctgcagcatatttagcaaagtttttctgactcataacagttttatgatttttctcttatcctcagttgctatacctgcctttcaggaactgccctcgttttcaagaacttgagagtgagactttgaaatcagaggaattccagaagaggctgcacccttataaggttaaaagctagttttgtttagtggtacttgttagtttgttagtggtacttgagtgtgagggccaagacacaagatgaagctttggcttcttaaaaagatgggacgaatgcatctgtcagtggctggttacagcaatgggttagaatatttaatgagggaggtcatcactcctgcttcccttccccatacaggggtcacaagccaatagacaagccagtccttttgaatcctttactcatggccttgagaggaaccaggtgtgagtaaatggctggatgagaataaatataagtctaaaatcacctgccttattcaggctaaggggctgggattattgtcttcatatacaaaggatagtcttttttttttgtttctattttgcaaagtacccattttcagcacaatacaaaaggtagatataatgctgtgtactttttaaaataatcttttgaatattatacattcatactgtccaaaaattagaaaatataaaaaggaatacagtggaagcctccatgaccccacaggtaaccactagcattattttctagtagtcttttatgtgtttattttatgcagtcttttatgtattttatgtagtattttatgcagtcttccaatttccttatgcatatacaaacataaaaatatattctgatagtttcttcttttgttacacgaaaatggtatactattcatagggttgggcaccttggttttgttttgtttttttttttccatttaagaaaatatattggaaatatttctatatctgtatgtaaagagtttcctccttttctttcttttccttttttttaacaaatgtgtaatatttatatttatgccataatttatttaaccagcccctattgataggaatatgggtcatttttcaatctttcatttttacaaacagcatgtatgaataacttgtgcatctaaatagtttcacaagaatacctgtgggataatatcctagaagtagacattctgggttaatctgaaatattattaatttaccctccaaagaggttttactactttctacttctatcagcactgcatgcaaatgcccatttctccacaactttgccaacagtatgtggaccactctggggatatttgccaatctggtaagtggaaaataatatcactagaagcatccatctcctctaaaattaggaataagacaaggaagctcactattataactactgtacaacatcgtgctatagtacttttcttcttgtgatgagtgagtttgggtatcttcatctagttaaataccattttttggtttgttttttgatattgtatttcttttttaacttttattttaagttcaggggtacaaatgcaggtttgttatataggtaaacatgtgtcatgggggtttgttgtacagattatttcatcacccaggtataaagcctagtactcattggttatttttcctgaccctttgcctcctcccacccttcaccttccaagaggccccagtgtgtcttcttcccctctatgtgtccgtgtattctcatcagttaaatgccatttatatttccttttatatcaatatcccttgactatttttcttttggatgattgattttccttttgctataagtttttagaagcttttttctatgtattttaacatttctgtctgtgatattttgtgtgtgaaaaaaaacacactcaatgtgttttttcctatttttctcacttgaaaacaccaatcaacacagacagaagacttctgtgaccaaatatgggggatctctctgcaagaaaaggcagcccgttctgcagtagacaccagctgggtggcctccaattcagttttgacaccatctatttggagatagcatcagatcctacaggttgagggctcaggccccaaaactggccacccccaacccgccacctcagacacagatgaaagtccagacctccaaacttctgacaggctggctttaagttggggttcccacaacttcctctttgggttcgatcagtttgcaggggcagctcacagaactcagggaaacacagttattggttattacaaaggatattacaaaagatataaggaaaaggtcaaggagcttgcctgccttcttcaggaccaccacattccaggaacctctaagtgttcagctctctgaaggctctctgaaccctctccctttgggctttttatggagatttcattgcataggcatgattgattaagccacaggctattggctatcaacttaaattttaactccctcccctccccagaggttctgaagtagggctgaaagtcccaacgctctaatcccggccttggctttctggtgaccaacccccatcctgaagctggccagggactgccagccatcaatcaatcattagcatgcaaaaagacatactttggagactccaaggattttaggaattctatggcagaaaatggagatgaacaccaaatagaaggccgggcacagtggctcacgcttgtaatcccaacactttgggagaccaaggtgggtgatcacctgaggtcaggagtttgagaccagcctggccaacttagtgaaaccctgtctctactagaaacacaaaaaattagccaggcgtggtggcaggcgcctgtaatcccagctactcaggaggctgaggcaagagaatcacttgaacccaggaggcggaggttgcagtgagccgagatggcgccactgcattccagcctgggcaacaagaacgaaattccgtctcaaaaaaaaaaaaaaaagaccaaatatatatttcacaatatcatagataatgaatggcatttttaaaaaaaagtttgtctattaactgcttaccgtgttcttgccatgtaggttctgtatcaatgtattcttatatggcttctatattttgagtcatgtttagaaaagctttccccactcctaggttataaaggaagtctgcaatgctttcttctaattccactctagcttcatttctcatttatatattgaattcatttacagttcatactggtagaaggtatcctgtttaagttttttcctggaagattatctaattgctccatcattgtttattgaatagttcatttttttcctacttattgaagctattatatattaaaattcccataggtgtggggtctatttatgtaatttttattctgtttaattttttattagccaaaacttgggttttaactattaagactttataatatgctttaatatctaaagggctagtcatccctcattgctttttctgagtttccatggctatgttttaattttctttgtgaacttcagagtcagcttgtctagttccaaaagtattttttaatttttagtattttcattaggatcatattaaatttatttaacttagggagaatttgcaacttttcactgtcaaatcttcctaagaatatggtacatgttcctacttgttttatcttaaagattattttagggttttcttcatatatgtctttacattttttgttaagtttgtttcaggtttacagtatctccagttttcaaaaatgtgtatctctgatttcttccttttgcctatttgcactggccactacttacagtataatgttatgggcagtgttggtagcgggtattcttgtcttatttctgattttagaggagttttcctaataagcatacaggcttttgaaccaaaatagacatatttttatgaaattaaggaaatatccacctttcttattttcttgagtgtatttttttaaatcaatattagttgtttaatctcctgaatgattgttttaacattttttaatacaatcaaattatttttctccttggattaattacaatgattgattacattcatagatttaccaatgttgaacaatctttatatttctcaaatcaaacccatttccttttatgtgacattgaattacttcctgttattttacttacaccttttgcattgatatttacaagtggcattgaactaatagttttattttgggggcaatctttgtcagtatcagtgttacacttaattcataagaagtttttgaaagttttctttcatcttctatgctccagaacagttaaaatagcattagaataatttactcttgaaaagcttggtagaattcctctatgacagtcatctggccctggagcttttatgtttgagaagatggcagtaggagctctttaacaataatttctattattttatgaaaatctattgaggttaatattggcaaattgtagttccctagaaatttcatccatcagacagacaatatcttccaaaaaggcttcccagaaatggctgccaatttcagcagtcagatagctgaacattgggtctcattattgcgacattccaagaaacatacagaacctagcgaaagatttgcattccatccaagttttatatgtatagccaaagaccaagccctatttgtgttgcatgttccaggatgctttggcctgaaatatgctttcctttctcacctgggacatatttacacatgagttatactttacccacttctaaaaagaatctgaggcagtacacttcaatccaattccagcacgaaccaggaacatgtggcagtcagccagcatctatctacattttaaatgtaataataaggaataatcaattcgtgtttgtaaaattctttggaatgacattatcgtaaccaatattactggtgcatttttctgtgaagaacagcggttctcaacaggggcgcatttgcctcacaaggaacatttggcaatgtcgggagatattctgggttatacaagtgggagattaggaatgctactggcatctagtgggcagaggccaggatactgtgaaacatcctataatgcacaggagagctccctacaacaaacaattgtctggcccaaaatatcaataatgctgaagctgagaaacctgtgtaggaatttttctttctctgtttgtgtttcaggattttatagctaccttgggaaaactttcaggattacatggccaggacctttttggaatttggagtaaagtctacgaccctttatattgtgaggtaaaagaaaaaaaaatcacaggttaacttgcaatctgattttatgatttatgcttattttgaaatagatgaatatcttttctttcacttctttatgaatgtattacttatacttcttttgacattgaaacgtaattcacaacttccttatattaacttgaaaatgctgacttctcttttctctctattattatttatgttttcaccctttagaaaattacaagcaaaattgcttttcttctatgagtttccactttagttttttccccccttggattcagtaggagcttatttattttgcagccactcaaaaatgctgggttcctgtccttggtcttaatgaaaaaacaatgttgttataaagaaagaggggaaaattacctgatttccgaatgtagaaataaacaagcaaaatataagccaggctatttatatttgcttaacaagaaagaacttctttcttgctttgcgatgcatttgaaataccgtttgtggccagataaattacgattgcttttcaaggttacatggtgtttctcactcaccatgctccaccttctggccaaaaggagtactctctgttcctgttttcccaactagctcactaaatatggggcaagattctgaccacccacctaattcatattgacttctaactttgaggtcatcgtgagagtctggggggcagcaattacttccgtagttctatcttaataacagatgacacagtttgcctccatccatcctaaagttaattgacccaatcacatgctactttcccagtattttcacttaatcatcagcaactatttcagtgaaaattcattagcattgtaaaagactcttcagtgaaaacaagagcccccatttttgttccagtcataatttttttttcttccttactacagtttgatctgagctattccaaaatgtggtcatgtcatgtgatattttttccaaatctctctcacttatttcctctgtaggtcactccactttggtctcctctttcacgaactcactttctctcactcttaatcctgcctttgaaactgggggactcctaatcaactcttcctaacgggtaataaatattggcacaaggtctcacctgccctgcttgtacttaaccattcatttaacgcatatttaccaagtatccactgtgtgcaaggtgcaggctttcctcaagagtcagtgaactacagccaggtatggtggctcctgcctgtaatcccagcacttctgggaggctgagatgggaggatcatttgaggctagaagttcaggatgagcctgggcagcataatgaggccctacctctacaaaacacttttaaaaattagccacgtgtggccaggtgtagtggctcatgcctataatcccagcactttgggctaaggtgggcggattgcctgagctcaggagttcgagaccagcctggccaacatggcgaaatttcatctctactaaaaatacaaaaattaggcgggtgtggtggcgcatgcctgtaatcccagctactcgggaggctgaggcaagagaatcgcttgaacccaggaagtggaggttgcagtgagctgaaatcgtgccactgcactccaggctggatgacagagcaagattctgtctcaaaaaaaaaaaaaaaaaaaagtgccacgtgtggtggcatgcacctatagtcccaactactcaggaggctgaggtaggaggattgcttgagtcctggagtttgaggttacagtgagctgtgatggccactgcattccagccttggtgacagagcaagacaatgtctctgaaaaaaaaaaaagaaaaaaaaagtcagcaaactagaccttgatgggggtaggggagaatatattactgaaggctccagaaatatattgcctttcctaactggcctctcaggcagcccattcagcttttaaggaaatatcatttaactctgtcaggttcatagaaagatttctaaccctttcataaaggaatgaggtattatttccctactgcacccttactctgcaaaatatgagccacccactgatccagagttaaaccaaaagctatggactgggtaggaatgggtaaattcatttatataagcttttcttctgaaagtcaataccactacttatcacaatatgaagttcttttagaaagaaatggcaggacaagaaagtctggccctactagttcttgtgaggtgaaaaaggataagtcaacaaagaggacagtcatataaatacacatacatttttcttcctttttctttgctacagagtgttcacaatttcactttaccctcctgggccactgaggacaccatgactaagttgagagaattgtcagaattgtccctcctgtccctctatggaattcacaagcagaaagagaaatctaggctccaagggggtaagtattaaaaaatgagaggagcatattggatttgtggttgaatgatccaggtctgagtcattccctccactaatcaactgtgtgatctcagacagttcacttaatcactcttgcaccagcttccattctgcaaaatggggatattaatgatacctacttcatagacagtgagtattaaaatgaatgtatgtattcaaatggcttagagcaaacagtacctggtacataatacactgtcaataaatgtcatatgttagtataatcataactattactcactcaagcccttagttttctatctggaaaatgaaagctaaagctaaatgatcctttccatcccctccagatcaaaaatcaaggatctgtgtctgagccacatgaaaatcaattgtgtcttgtggcctatatgatgaatttttcaagtgggaggtatgacaaaagtggcctgttttcctgaaaccctgagtggtagtcattgtgaaagccgataaaatatatttttcaggctaattgttatatttttcagaccaattatgtgctgttaaaatatgttgcaattgacaagtttataacacagcttgaaatttttcattgacattgaaagctgttgagatttatttatcagtgatgcctcttcttggttagaactggctcttcgtagcacaggacaccctgtcatatgaaggcagacccaggcaagaggatgctggattcttgtaatcaggataagtggatggaagaaaaaagtcaggaccagcaaagacaaggacagatgttggggcttatgagagaaactggatgggcaggccaagataccaaatgaggtgtcagacttagatgtggttatcataggtattaaaactagggataaagaagaagagaaagttcatcatgtcaggttgacgtaatgaggaaagtccaagccacaggagatggtccaagtcaggctgacacacatattcaaggcattttgagattaatacaatcacatcatgattccagccattgacagacactattcaccacagcatcaggacaagtccatcaaaatcccaagagaatgcatagaggcaaagcatattagggctggaccagactgggaggttgttcactgaggctacttaactagggaaaaaattcaaatcactgaccagaaaaggaatcaattatagctagaaaagcagggctgcacaccaggtataaagagtgaggcaagctgtaaccaggggaatgaggtatgaaaccaggatggtcaggagcaaattcatgtgagatgaataaagtaggttggggcaaaaaatttaggacagtggccattaacgacatgaggttgttgtagatctgctattacaaaaatcctgattgcatggcacagagacagacttgatagaaatgtgcaagtccttacttcacattaaacacatgagcaacaagatccagccttgaggaagggagagtctccagagaggagtcttagatggaagctggagtgttggaaaaaattaccaggcgggatacagactgtgtctatgggcagaacccaggaagaagctcaatcttaagtgcttaacaacaaaagatgtagagggtgccttggaagccacataagcactcagcctcatttctggcccaccaggtgccagcagtgtgactcagttgcaagccccatcaaatggtggaagcgggactcttgatttatttcccccaacctagttatggtggattcaggcacctagtccctcacaactcaaagtgcagtctacttttcagcatcggcatcaactaccacctggctagaaacacaggccccactcccaaacgagttgaatcaggatctgcatttgaataaaatcccaacatgctttataccagacaggagttgacagtagtctaatagtagatgtagggatgtgtatgtatgaataagaaatggagttgctccactttcctcatgtttcctcttttatttcccttgcctactagaagattacatttgggagaagccacttcccctctctggatctctgtttcactacctatgaggagattaaactagactgtctataagagtccttctctgagttgttctctgatcttggattctaaaggctggcacttgtatgaaaccagctgtcctgctttctggaaaaagtccagcgccattgttaagcaggaaaatttctcctgtgtggttctgccaaaacaaaagctcagactattattcagatctggctgggcaagagagatttgtcaactacatgtttattgaatgatgaaacagctgcacacattcctgcacagaaaacacacattgtctaggtgacaaagagtaatgtggacacatcagggccatcttctgacctttgctagtttttttgttagtttgttttgtttttgtttctttgtattttttgtttgtttttgtgtctgtttttgagacagggtctcattctgtcctccaggctggagtgcagcagcatgatcacggctcactgtagccttgacctcccaggctcaagcgatcctcccacctcagactcccaagtagctgggactacagtcatgcaccaccatgcccagctaaattttttttaaattttttgcaaagacagggtctccttatgttgcccaggctagtcttgaactcctgggctcaagcgatcctccaccttggcctcccaaagttctgggattataggcatgaactactgtgcccagtctagaatttttatttcatcatttaacttcaggggtgacactgttcagtaagacacacacacatacacacacacacacacacacacacacaccaaaaaaatccctggggcaaatttaggatcatatggctggtcatatcagtgaaaagagagctcttcttgctctaggccagaggttggcaaactactgcctgtatgcctaatccagcccactacctggttttgtaaataaagttttattgaaatacagccacactcattcatttatgcattgtctattgctgctttcatgctaccaccgcagagctgagtagttgcaacagattttttaacccacaaagcctaagacatttactctctggacttttacagaaaagtttgccaacctctgctgtagactagaaatgaaggaagcaaagtttatgtcttcaggtcaatgatatttttgtctagtttacgaagatttaataaaggatacaacagataactttgaagctagctttccacgatagcatgttctaatgattacaaataaaggttttgacacaggacatgctagatttaaagccctccttctctgcttgcaagttgtataatctaatcaagtttctgagcctctccaagcctcagtttcccctataaaacagaatattgatatgccagagcctgaggataatcatgatagtcacccctaatcactcctgggataagggtgtaatcataccagaaccaagaactgatatattcatgaccaaaactgcagcctgactaaaaggcacttgttgacaaagggcaacttgctgatttcaggtggctgtcatggctcccaaaagcttggccacagagtttagcaccaacatggcatgtgaatcaagctaaagtccctaatgcattccacagggcaaccctctctgagatggagggatttagacctgttagacatgtacattcagattatcctattcatcctcaaggaatttccagtatcttatagaaagagcagatacctacctccttaattaacccttttttatacttactggtgtacagacctgtctcttcttactattttatgagtttttggagggcagggaccaggtctgattctcctagcacagtatctggcgcatcatagctgctcagtgtgtgtttgttgagtggactacagaacctgagattatagtcaatctgttaatatcaatgccctgctcattacaactcacacacacacacaccctaacacaccctactggtcattctcagccaagagagcacatgatgcagggtaaagagaccaacagagacaccagatagttacagacatctctgaagcaacatgtccttaaaacaggatctgttttggcaccacaaggtaccccacagccctcagtgcctagaaataggataaatactgtaagctctatatctgtctttcaccacctcaggagcaacagcagttaggtgttcagatgtgaagtgtgaagagcaaaagtttcctctactgaagacagacagaaactcaaatgaaagctaaagatgctggctgtccccccaatagtgacacctagggtaacctggagaaatggtccacagagaatagtccatgatctgtacaaacatccagagagctgctttctcccatggcctcccacaggtctgactgccagagagtagaagcaagaggggtgaaaatagaggagtacctgctgtgctgtcatttcaggtctgctctggagaagaacatgggctaagaattatcttttatgatctgaaaaagctgtctgaagttccttccaagcttatcagcctcctaacctgagctttaacaaaacccggtatggtagagtcctagtgtgccaatccagctttccttacctggctgtgtgagtcacttaatatctttggacttaagattccttacctaaaaatgagggttgagacgtaggattcagtttaaaaaaaaaaaagtatgtaaatcacattacctagcacagagcagatgctcaataaaattagatctttgcccctcttcttaagtcatggcagggagagtccgcaactatgaagtgacaaaaagctaatgaactaaaatagaagcttatgtttggttcagtttggttattgattcatcttctttaaggtgtcctggtcaatgaaatcctcaatcacatgaagagagcaactcagataccaagctacaaaaaactcatcatgtattctgcggtaagtattttcatcttcatttaacatatgtttgttcaagtgtgtgatctcttgaagcacaggacctcatctttttttaatcttcatttccccatctccttgtacgtggtaggcacttgcacaaagcttttagaattaaatgcatcattctgtcctttaagggatttataatctaaactaacaagaagacaaacataaacactatacaaaatgggatggaaataccatgcaggcaagtgctatggcacctcagaaaatctagccatcccttctgttccaagagggtggagaagagaagcagaaaggcttcctagacaaggcagcacatccaacacatcaaaatgaaaggggttagtaagtgctcctcactagtgtgtaggacaaataaagtaaattattaggacagaagtggaaggccaggaatgttgtgtccaaaaagtggtaccaaattagtggatgttaactgtgctgctcaatatggaacctagtagccagaagtagctacttacatttaaattaattatgattaagtagaatgaaaaattaagtccctcggttgtattagccacatttcaggtgttcaatagccatatatagccagtggctactgaattggagagcacagatatacaacatctccatcatcatggaaggttttttagatagccctgatatggagtgtcagaagtttatgctggatggcagctgaagggccatgttgtcctgctgcttctttgtttaattgtagaaagaagcaaggaagcaagggagaacccccctgtcagtgtttgctcagggaaggcagggcaggagtgacaggataggagcagcattttggaaattaattattttatagaataactggatgttgggaacaggatatggtgtagaaagcttttgtgatagtctagaaaaatggggatatggcctaaaattagggcagcggcaggagaggaaaagaagtgagccaggttacaagaaaagctgagtgtgcattctcagtgatgaattggaagtgggtggaagacaatgatgtggaaggtgaagccccagatgaagtcaagatttcagttttcagtggcaggaaggaggtggtcttgggccaggcaaatgtactgattaggcaatgggtttgaaatgccacaggggcatcccagcagaaaacttcagatggcaaagagaatagaaggaggaaagggaagaaggactgcaactcaaagttggagctacatttgggagtagaaagaaaagagagcaagagatcttagaaaaggctttcatcttggagaagccagggagagaagagtctgagacgccaaggagagacacagtgtttggggaaaattctgcaattgtattatacattcaaatagctgcccatggagtctgggatgagcagggaaacaggacatagcatgctgactcctttcactcacatctccatgacaaaaggtttctcagctgtggctggagaaagaaagtcatgttttcattcatgcaagaaggtgaaagaggtgactgaagatgccaggaagtttgtttattatcaggagccctaaatggtatagactagggaaataggcctgggcaggagcagagtgcttcctggagagagataggcctgaaattagtcatttctgccaattttcgtagtgtctaatctgatttctagttttaacttgtggtgtgacttccagcatgtcatatccgtagctcctttttttttttctctattagattacttctaacgccttttgaatatgtgcacgctgccatacagtttaggcagccaaatgttatcccaattttgcagatatggaagttgaggactgcctaagattagatagctaatcagtggcagaaagggggttgaaaaccactcccctataccttccagccactctggggtaaacatttagctttacaattattttaaattgcatcctatacttccttgtattttatcttccctaaacatttaaacctcatatattcttccacaactttaaatcacagatgatgctaatctatagaaaaatataatctagcattaatgtgtttcaaaatatttcaaaaaggcacagcacttaaggaggcttgattcaaatttactttcttccatttggggttatatgacattaagcaagttgcttaatttccctgggtctcaatttcttcatcttttattattatttttaaaattattttattttatcgagatggagtcccgctctgtcaccttctgagtgcagtggcacgatcttggctcactgcaacctctgcctcccgggttcaagcgattctcctgcctcagcctcccaagtagctggatttacaggcccatgccaccacacccagcttttttttttttttttagtagggatggggtttcaccatgttggtcatgctggtctcgaactcctgacctcaagtgatccacctgcctcgggctcccaaagtgctgggattacaggcatgagctaccacgcccagccaatttcttcatcttttaaatgaaaataatgatacatatctaaatcatactgcctagcacaccgctaatgctcaaccaaaatctttccttctctacttattaagtcattgtgggcgtatgggaaatttaattgaatcagaagccatcatggtgctgtacaagtgcttcatacctattgaatgtgaatctgaacaggcgataaaattgatttcaatctctgtagcatgacactactgtgagtggcctacagatggcgctagatgtttacaacggactccttcctccctatgcttcttgccacttgacggaattgtactttgagaaggggtaagtgactaagtgcttttcaaaatcagtatcactggaccttgggtttcattattattattttgggttaagggttgtgtgcctgtttgtctttgatttggttttatattcagagggaagaatggtggtaacaagatctttgctagtcatgtctcttttttctttttcatgaagacttttactggaaaataatatacacagtagatgaaaaaattgggaaatagcctatgtaacagaaattacatttttaaaaaaattaaggtattctaagaagtaggcatgtattgtatatatacttggcaagagaaaaatttcttgatggttatataataatattttttcaattaaagaattcaaacatattcattcagcttctgatgattcatatccacaagtcaagattcttaaagtacaatttctaactggtgtctacctctgtgtgacctggtgtggccctccccagatgaccacagcttagcttgaacccattagaagggtcaaagttagcgtagccaaatgtcccagttcaccagaattgacccatgaaatctggtgttctcagaacatgtgaatttcattgttaaaaccagaaatgtcctggaaaaactggggaagaattgattatcacaccaaggtcataccaaaaatatttatctgctgtgacaacgacattctcattgggaggagaagaaggaggtatttggaacaagtcaccagacttcatgggatattattagtgaaataagagcaaggaaagggctgagttaaggcagtgaccccagagtttgttttgggattagtcagggagatctattttgcccttccctcaaggcattcacaatagctgcacaccaacctgactgtgcagttacatggggacctggctcaaaagagcccatgcttgttttaatgatctgctgtggccatctttaaattgtaataatgtttaaacaatgggccctgtatttcatcttgcaaattttgtagtcttggatgtagctttctggcccctgaatttgtagagtaagaaagtaacagcacagagacttcattctcaaccaatatcttcactgcttacaaagaagtgagttctgcacagttagggacaggtagatacattctttattgaacctctaactgagtgtcaggcacaatgaactagaactaaaatgtggtcttagttaaccttgctctcaaatatctagagtcagcatggagaggtaagacccacaaaatggagactggccaaatagaacagaaaatgggaatgaaacgactagagacataaaaccctctcttaataacaagcccggcacaagtctgcccatcagaaggccagctctgggcacagagttaataaatccaaccaaattccaggatcagcttcaggagcaggcaccatctcctttgggataagacaagagaagctactgactctactcgtacctccctgttctctggtttctggaccccagtggtccagagcttgctttctcagtgcacagaagcattttctcccactgaattgccttgttttacgaccctgagttaaatctatattacaaatcaagtgtggagtattttttcaactgaaaggcagtgacatacagaaaaaattaaccaagggccacgtaaaggtcaagtccaatttgttgttgtattaggattttttttattggcactccagggaaatatcaaaggtgaaacgtgattgcttttaaattaggatcaaggaggcttcgagttaacgaattctgtctaagcctgcttattaggtgatcctgactgtgaagtgatctcacattttcttatgagaagatacggagagagacagaaagagagagtattttagattttcaaccatcttaaatacgtaaacttttcaggttgtagaaaaggtagctaaaaatattcttaaaagatttaattttgggttagatacagagatttaaaatcatagactatataaaataattcattaagttaatattgctttgtttcacttttacattttataaaatgattttatctaaactctttgtactcatctttggcttgtgtcttcaccactaaagccaattttgagtcttttaaaattgtttcccagatatattcactaataaaagataattttgtcttctatatagatgaacctcagatttttgaagtcttaacccaatgaaaattaatttcacacttatctaacagtacaatgcaggtgtacattaatagatgtgattcacacgtggtgattcaggcacccagggttccctctttggacctacggtttcaagagtgctgtgctcacttgcaggcagcttgtagaaaggaatgaaagggtggaggcagcaacccgcttatcaaccacgtcagccttttaaaggggacacatatcatttctgctcactttctactggctaaattagtgacttggtcctacctaggtacaacgtagtcttggcaatgtggtcacttctgagccataattcaattctatggaaagagaataacagagtttgatggagtattggtcatctaggccatatcatcttaagacagaagatgctgttactgaaaaagttattccaagatataagtacccattcataatacatattagggaggtttttgtaagttttatagacatcttattttattttatcttattttattttattttattttatttttattttattttattttatttttgagatggagtctcgctctgttgcccaggctagagtgtagtggcgtgatctcggctaactgcaacctccacctcccaggttcaagtgattctcccgccccagcctcccaaatagctgggactataggcatgtgccaccacacccagctaatttttgtatttttagtagagacggggtttcaccgtgttagccaggatggtctcgatctcctgacctcgtgatccacccgcctcgacctcccaaagtgctgggattacaggcgtgagccactgcgcccagccttatagacataagtgaatatttgctgttactatgtttatatggctttttaaagtgatgttttaaaaggcttgtttataatgacaaccaaaagtagccattgtaaggttacaccaaaagaaggatctctaaatccttcttgagttcccctcctgactccttgattagcaaatggcttccataagcaactcacgctggtttaactcaggttagtttacaccattggaccttcccaaatagtacattgtttttttgagataaagcattgagagagctctccttaacgtgacacaatggaaggactggaacacatacccacatctttgttctgagggataattttctgataaagtcttgctgtatattcaagcacatatgttatatattattcagttccatgtttatagcctagttaaggagaggggagatacattcagaaagaggactgaaagaaatactcaagtaggaaaacagaaaaagaaaaaaaggagcaaatgagaagcctaaaaagaagggaggaggagaaggaaaacccaacacccccacctgcctcccacttcttatccaaaggctcaaagtcccacccagctccctgcaaccatcacttctcaccacctcctctgatttagcatcctggtgcctacctcctatgtccctgttcatctaacaaaccagccctcccatttccaccctgcaaatctctcccgcctgccccagtctccccatttacacacctaaattggctaaaatctccccataagtttttccattagtccctcaactggcatgtaatagtccaagtggaaagaaattcagtggcagttcaacaacacagaactaacagagctctctcctctgcctttgtctgccagggagtactttgtggagatgtactatcggaatgagacgcagcacgagccgtatcccctcatgctacctggctgcagccccagctgtcctctggagaggtttgctgagctggttggccctgtgatccctcaagactggtccacggagtgtatgaccacaaacagccatcaaggtactgaagacagtacagattagtgtgcacagagatctctgtagaaggagtagctgccctttctcagggcagatgatgctttgagaacatactttggccattacccccagctttgaggaaaatgggctttggatgattattttatgttttagggacccccaacctcaggcaattcctacctcttcacctgaccctgcccccacttgccataaaacttagctaagttttgttttgtttttcagcgttaatgtaaaggggcagcagtgccaaaatataatcagagataaagcttaggtcaaagttcatagagttcccatgaactatatgactggccacacaggatcttttgtatttaaggattctgagattttgcttgagcaggattagataaggctgttctttaaatgtctgaaatggaacagatttcaaaaaaaaaccccacaatctaggatgggaacaaggaaggaaagatgtgaataggctgatgggcaaaaaaccaatttacccatcagttccagccttctctcaaggagaggcaaagaaaggagatacagtggagacatctggaaagttttctccactggaaaactgctactatctgtttttatatttctgttaaaatatatgaggctacagaactaaaaattaaaacctctttgtgtcccttggtcctggaacatttatgttccttttaaagaaacaaaaatcaaactttacagaaagatttgatgtatgtaatacatatagcagctcttgaagtatatatatcatagcaaataagtcatctgatgagaacaagctatttgggcacaacacatcaggaaagagagcaccacgtgatggagtttctctagaagctccagtgataagagatgttgactctaaagttgatttaaggccaggcatggtggtttacgcctataatcccagcattttgggagtccgaggtgggcagatcacttgagctcaggaggtcaagatcagcctgggcaacatggtgaaacctggtctctacataaaatacaaaaacttagatgggcatggtggtgtgtgcctatagtcccactacttgtggggctaaggcaggaggatcacttgagccccggaggtcgaggctacagtgagccaagagtgcactactgtactccagccagggcaagagagcgagaccctgtctcaataaataaataaataaataaataaataaataaataaataaataaaaacaaagttgattaagaaaggaagtataggccaggcacagtggctcacacctgtaatccttgcattttggaaggctgaggcaggaggatcactttaggcctggtgtgttcaagaccagcctggtcaacatagtgagacactgtctctaccaaaaaaaggaaggaagggacacatatcaaactgaaacaaaattagaaatgtaattatgttctaagtgcctccaagttcaaaacttattggaatgttgagagtgtggttacgaaatacgttaggaggacaaaaggaatgtgtaagtctttaatgccgatatcttcagaaaacctaagcaaacttacaggtcctgctgaaactgcccactctgcaagaagaaatcatgatatagctttgccatgtggcagatctacatgtctagagaacactgtgctctattaccattatggataaagatgagatggtttctagagatggtttctactggctgccagaatctagagcaaagccatccccgctcctggttggtcacagaatgactgacaaagacatcgattgatatgcttctttgtgttatttccctcccaagtaaatgtttgtccttgggtccattttctatgcttgtaactgtcttctagcagtgagccaaatgtaaaatagtgaataaagtcattattaggaagttcaaaagcattgcttttataatgaacttagaaaaacgtatgtgtgtgtgtttaattagaataaaattcctctaggcagatttcaggagctccctttgtgtttggggtttttgttttagtataacaagatggaaaatattaatataaagtaaaatgatttgactggcttaaatgaacattttacattgaaaatatagtttggactttaccacttcagataaaggtgaagctgtggatggctctgcctcatctatttaagatggaatttgctaaggaaacaccctcaggaagtgcacaatatactagggaagtaaagagatacatactgtacaacatggaaaaaccagggctatgtcttatgactacacagattactgtgggaacaagagttatccagatttggagtaggggaagtaaggaaggtcaggaaaggctttctgcagaaggtagcaactgtaccacgtaaaatcagtttgaggccaggcgaggtggctcaggcctgtaatcccagcactttgggaggccaaggtgggcggatcacaaggtcaggagattgagaccatcctggctaacacggtgaaaccccatctctactaaaaatacaaaaagccgggcatggtggcgggcacctgtagtcccagctactcgggaggctgaggcaggagaatggcgtgaacccgggaagcggaacttgcagtgagccgagatcgcgccactgcactccagcctgggcaacagagcgagactctgtctaaataaataaataaataaataaataaatttgttaccttttcccctgaccctactcttgtctatcttgatgagcagcaatacctggtaacttaggagttattttttaccctaccctctccttcattctccatagtctctcacctcctcttgtaaatctacctgtggtatgtttgcagaattctttccctcaaaacacaaataacaatatgcaggtagagtgaaatatgattaagcagcaaaaaatgttaatagaaagaaaaatgtaagggttgatgtgctgcagcccgctcatacagatctcaagagtggaatgtgtccatcagttcccaactctcagttcaaccacttcacctgggcagctccaatgtggcaggagtattttcaccaaagaaattaaatgctacaaatcctaccaccacaccactggtttgggctcatagaaagtttgttaagagtctgtgacatgaggtggcctctaatacagtgagttcaatatttgaacttctgtaaagaaaaggattagatttattcagtatgatcttaaagagggatgctaggggcagcaggtaaaaatttcagggagacagattttcgttcagtgttgggaaactcctgaggtaagaagtgcccattaggctgggtggccactcaccttagaagagagatactacagagaaggctgaaacatggaagattgtaggggttgagtggctcattagtttggccaccaaatctagcaaataaaagtacaggatgccgagataaatttgacaaaaggctgtaactgccaagtttttgtaattcattggaaaaaaaaaaaaaaacaatacaggacacttaggatgttctgaaaaagccgatacaggaagcaggacaaaatcattaaatataggatatgtcctatatatgcaagatactttgcaaccctactccttagagtaggggtttccacccattaaattctatccataactataagcagtgtttttagctagtgccagtaggctcacttaaccagattccagatcgtatcaattaaattcaccagagtctttgctggaaaattcacaagtctaaggccatagcacattgcttgaaaataataaaatttgtcaaactgcttctttaattccaacattttactaacacattcagactttcttcactagtgctctcccacccccatctcaatgtccaactctaattatttcacaagaaggagacttactagtgagaagtcccagttttctctcattatctttctaaagctgagaatctacagcacaaatacacatgcccaagattcaaccttgagcttcttaaaggcaggatccatacatgtttcctctttgagtgttcagccagtagacaacgcctagaaccttgtgccttcaatcaatatttgctaactgaatacatgtccagccctgcatacctagcatggcttccttgtggctgagctcagaagtcagaagcctggaactcagtttatttataaataagagagagaagctatgaatgagcctcaaaagtgattatactgtagagacccaatcattggccataaacacatttctatgtgccaacatgtctgtagtatttgacttctgttttcagcatagttgttttggcattctcatgttcctccattgctattaaaagcccttgttcaatgatatcccttgttcagtgatatcccttgttcaatgatatcccttgttcaatgatatccagcaccgctcctccctcaaagatgaggccatctgattaaaataactgtttcctcattcttgttgccattatcttcagtttcttggaatatatctcaccatttgctaaagacattggcaacttgctttggtatgctccgattcactcctcactccactcctgccctaaacctaggcaattctgacagctataacgctgacctgtcccatacactgctcaccatgccaatacctaagcctctagatcaagtcagtcacatggttttttcattctgatctgtgagtagagctgaagcaagcaaaagtccaagcctattgtcaccatttcaaacgatgaatgtagacattttattccatcctcaactgagtctctcagtgtttcttggtaaatgtattcacccctactgaacacttttcctactccctgcaggaaggcctgtttgtcccaaaagtctgactccattttgttttctttattcttataagcaagataatctattgataagtcctttaagttctactctcacaatctcaaaaatatctcagtagctttaaccttcctttgctgctgtccctcaggaaaccacattcctccctgcatgggctgacctcattgtgagtgtgaacccatctccgcagtctcctcaggaccccagggaatctcttggctaacttcactttcttcctctgccctggctccttcccttatactacgaaaatgcccaaatatcctctcatcaaaacaccatcaagtgcttattccacctcactctcttcaatctcaattttcttgaactaatgattcacatgttcttgtactattttctcacatccatcttatgctttaactattctgtaaaattatgtccacccttctgtcatctcttttttttttaacttctcttttgaaagccatcagtgtctaattcagtggcctttctttcattgtgaagcagctattagtatccccaatttacagagaagaaaactgaacctcagaggataacatgccacaagtaataggatcaggattcaagcctaacactttccaacatcctatttctaccatatcatactcacttttcattccactgtgtcttgtggactactttcttagaccaatttccaaaaataggattggtgggtcaagataaatgattatttaataagcaatagatttactgagtacctcttatgtactcaatattttcctatgtatcaagcattaagcttgctgagtaaacagcagcagacaagaagactgtccccatatggcttgcagaccttatggagaggaggggtggacgaggaaatgaataattaaatcagccctaacagcaaagtatggtgaattctgcgatgaagggcataaggagaaaacacagcagaggcaattagcctaatgggtcagagaaggcttcttggaggagtgatgttcaaactgaaacctgaaggagaaatggtactaagcaggtgaatgaaggtgaggagagaggaggatgttacagacaaaagaggagaatgcataaaggccaagaggccaaaggcagcatagagcactttgggaactggaaaaagtctagtgaatgtgtggagagctgaggctgcagaggcaagcactaagtgctccataggtcaagttgagctgttgtgctcatggaaaggttttaggcagaggacagatgctgtaactggcttcttgttttaggaagacccttttcagtcattacctgtacgagatctctttgtattaagatacaattaatcatgctctcttttctcagtgtctaggacaatgctctggcaaactcctgaaatattttacagtacaaaggagcatatcatttaaaaataaataaataaataaataaataaatatcacagggagagaaagcatacgcgctcacctgagtcttttctttgttttcaggttcctcattccacattcagtattagccagtatacccaggcctctgtcttctatgtctacaatccttatttctacatctaactgtagaattcttgacctgttttgtcaagctgcctactgatagtctctatcaggataataacctgtctcaatcccacactggagacaaaataaattatcttctctactccaaaccaattcttttttgtggtcccaatctcaatttatcttctcaatcacccaaacaagaagccatgagattgccttgaccacagctcctcccttaccagtatatgtagcctgttactaaagcctgttaattctactgcatctcttgaattccctcctcttcgttcccagggccacaattgcggttctaagccctgagtgtcatattaaaggtattttcaatagttctctatcaagcctaatgtatctccaccatcctatcttttccacagtttttgtttttcttaaacacagagtggttggccaggcacggtggctcatgcctataatcacagcactttgggaggccgagggggtgaatcacctgaggtcaggagttcgagaccagcctgaccaacaaggtgaaaccccatctctattaaaatacaaaaattggccgggcatggtggcaggcacctgtagtcccagccactcaggaggctgagacaggagaattgcttgaacccgggaggcggaggttgcagtgaaccgagatcgtgccactgcactctagcctaggcaatgaagtgaaactccatctcaaaaaataaataaataaataaaaataaaataaacacagagtgggctgtatcacttccatatgtaataattgctgatgacttccatttgccccacgtcaaaccaagcactctaaaaactggcccctggccaggcacagtggctcatgcctgtaatcccagcaccttgagagtccgaggtgggataatcgcttgagcccaagagtttaggacctgcctgggtaacatagtgaggctctatctctacaaaaaatacaaaaaaattagctgagcatggtggcatgcatctgtggtcccagcttcccccgggaggctgaggtgggaggatcacccgggcttaggaggttgaggctgcagtgagcagtgattgcaccactgcactccagcctgagcaatgcagtgagaccctatctcaaaaaacaaaaacaaaaacaaaaacaaactggccccccatttacacatgtggtttcacctccctgaagcctgtattccagtcatgtgtaactcctcattatgtcctaaacatgcccttgtgaaactctttctgtttcatggcaaagtcttactcaccttgcaggtcagctcaattcttagaagactttccaaactctttctctttcaaatagaatacactctgctgactgcaactttctctttgtttcaatagcatttcttttgcacctccattttagtagttatcacagtatcttgtaattacctttctggttctcctgctagacattgagctcctcgagggcagagattatggaacctcagcatccagtacagcctacctggtacatgtgtgctcaccacatgtctagaaaggaaagaaggaaggataaagagcagaaaagcatgttccatcagactgctatgacaacacagcccataaaaataactgaaaataaatttctaaatacagagtcagccatgaaaatagatttttaaggatcactactatctgccttcctcatttccactgagtcctttctttccctcttcaatttcatttagttgccttaaacttatattaaatctatctgcagttctaatgagactgtctctcagggtataacttaaaaccaccttttcgtgatgctaagaagcatcctggcatcatcagaaaatactggactaagagttgggaacttataagttctaagtcattaagttttttctacaaacatttattagtactcgttatgtgccagatactgttctcagtgcttgagatacattcatgaacaaaaaagacaaaagttcctgcctttgcaaagcttgtgttctactagagggagagagggatagataacaaataataagcataataagtgttttggaagatgaggatcacaatggccaatttggggtgaagtgaaggaggatatacaagatgcacttttaaatgggaaggtctcatggagatgagatttaggcaaagaaagcaagggatgtgtgggagagcattcaggccatgataacaggtatagcaaagtcactaaggcaggactgcttggcatgtttgaagaacagcataaggattatgaggccagaagtgagtgagtgaagggagggtgataggagaggaaatgtgaggggactcataggagacagatgatgtggatcctcataaactatcatcattagaactgtagcttttattctgattgagatgagcattcattgcagactttgttttaaggagagaagtggcatgatttgactttaagtcatttgactgctgtgttaaaaatggattgtggtccaggcacggtggcttatgactgtaatcccagcactttgggaggtgcaggtggtggtgggtggatcacctgaagtcaggagttcatggtcagcctggtcaacatggtgaaaccctgtctctactaaaaatacaaaaaaaaattagccaggcattgtagcgggcacctgtaatcccagctactgggaggctgaggcaggagaatcccttgaacctggaaggcagaggttgcagtgagccgagatggtgccactgcactccagcttgggcaacacagcaagactccatctcccaaaaaaaaaaaaggattgtggccttgtggccaggtgtggtggctcacgtctgtaatcccaggactttaggaggctgaggcagatggatcatttgagcttaagagttcaagaccagcccgggcaacatgacaaaaccccatctctacaaataatacaaaaattagctaggcatggaggtgcatgcctgtattcccagttactagggagggtgaggtgagaggatcacttgagcctgggcagtcgaggctgcatgagccaagatcatgccactgcactccagcttgggtgacagagtgaaactctgtctcaaaaaaaaaaaaaaaattacaaaggagaaaggatagatagaaacaagggaacaaataagaggccattatagtgatcctggcaaaagacgatggtggttcaaagcagggtggtggcagagaagaaaagaagtcagtgttgggatatatttttcagtaagaccaataggatttcctgatagtgtaagctgtgagaaaaataaaggagttaaagaagactccaagagttttatcctaagccaacagaagaagggagtttccatcaactgagaagagggaaggctctgggaagagcaaatttggtgtggggaatgaggatggggagatcaagagttcagttttggacttgagattgaaatgcctattagatatctaaagaaacatatcaagtatacaattggataaatgagtcttgcgcttaagatagatgtcagagctggagatttatatttggaagtaattactgaatagatggtttttaaaatcatgagactgataagatcccaaccccaatacaattatctgcttaaccataaccagattatctaattgctctgcttcttattttcctcattctcttaatgataatgtcaggtgaaatcagtgattttcacctgtcttctatgctgcactagggttctgtagaaagagctgatgggatcagagggatgtttgctctcctattgcctaagccaacaagaaaccctatatttttacaatgaaaagacatacatttagagatggtacaaactggtatttatgatgtgtatactatagtggactagggtgcgtgtataggagagtaactttccagatgaaataatgaattagcatctcattacgaaatggccccaaatatctgcttttactggtcagctatcaaaagaatatgtgtaaataaaggtacatattagaaatagtacacagttatgctagaaatgtttgccatagagacaaaatgtgcacaagatctcctcttcaacaaatatttacctaaaaatcaaatttaaaaatcgaaggatttcatttcttttagatccaattgattgcagttgagcattcagaatttcctttgaccctgagaccatggacaattggtaatataactgtaaaaaatgcataaagttagtgctataagaggacttagaaatacttcagctaattaccctcccttttcagtggggagctgaatctcaagggtcaaagtttatgctggaactggaacctaggtcatctcctgactcctagtcctgtgctcttcttagcacacacataatgctgatttcaaggcctctttagcaactcctctgaaatttgcaattaaggcagaaagcaacactcacatgtgatcttcctattttcctaatgcattaattttacattaatacttttcctattttcccacagttctaaaggtcatctttgctgttgccttttgcctgatatctgctgtcctaatggtactactgtttatccacattcgccgtggactctgctggcagagagaatcctatgggaacatctgaacagacagctggataagccaggccaacctcctgtgacacagcatctctcagtggtgccgcatctaaaggacaggcttttgccatgtgggcattgccatcctcacaccctgccttttgaatctgcccagagcagggtctgaactcacagtgacccacaggctgctgctggatgaacactcaggctacctaggtcttctcataatggagtggtagtgcaggctgcttgttcagctagaaagaggctgttatgcataggatggttgtattctctgccacagttgtccggagagaaataagaagccaaactccaatcagccttttacctgcaaagagtgaagggtgagaaggtggacaaagacatagattagaaaaatactggatattgggggaagttagactagaagtattattatacagggtgattcttacgaaagaagacccaatcataaattataaataaactttttatttagct

SEQ ID NO: 36593 - DNA, 31152 bp, Homo sapiens
gcttcgcagacctctggcgcccggcgggttcccagttcccccgcttcttccgaggagacagcggaggcgaggccaccgggctgtcaggctgaagctccgtggccgccgggtcctgcacgcagagaagaccccagcgccggcgcggctcagggctgggcccacgggactccggacgcgccgcgaaagcgttgcgctcccggaggcgtccgcagctgctggctgctcatttgccggtgaccggaggtgagcagcgtgggcggggagggggcgcgcgtagggtctccggctatgcgtcggctgagagacaccgaggccggctcccgccgacactgccaggcttcccaaggaaagaccgttacttgcgcccgcggtcccgcggcacagtgtcccatctcgccaagcgcgtccttcccttttcttttctctgacccctccgactcttctcttcctcccgggtccccgctcgctgcacttcctctgcttagagctgcgcgtttgccagagttccagcggacctcctggagcgcttgaacccaaagccccgtttcacagatgagaataccgagtccccctggaagaagtgactggtacttcctcccctctctctgggtctttcttgcccttctcctctccgctttcctcggtctcatcccagttgtcgctccccgcccccgcgccgcccgcgttccctctcctcccgccgaggctgcagcggccgcggcggggggagctggggctctttccctccctttggtaaacacacccgcccgccagcccatccgccaccgctgcccttataaagtcagcagccgccagacttcctgccgaagtccgagccccctcccggggctggaggggggcaagcgggttccgaggtgcaaagcctggtgccccgagccctgcggagtgagtgaggggcgcgcgggggaggagggaaccgaggagagcccgtcctgggtctccctccacgtggcagctgttggcttggcccgagagactgtagggtcgtgggtcacctgatacggaaagggggagggcttgctgtcgcccggccccagagggaaggagaggtcttggaggggcaactggaagatggggtcgtagggtagccttgaacttgcccttcttcctgccagcttctaggggtctttcctggcgcgagagtccggacatgggcccgcggtgcttcagagcgcgctctgccccttgctgtcctctggggacctgggcagatgcggactttctccccagcagcccggccctgagcgccctggcctgggtgagagaacccggcagcctgctaggaagctgcagcgcgcagacaggaccttccttgtttccgatagtggctcagcgggagccccgtgccgcgtgcacctctggcactgctagtgcgcgcggagccagctccttggcaccggctgggaagcccagggctctatggggcctccatgaggggctcctcgcgggctggcccgagaggtctcgggtgccaccatgatgcaggacccttccctggggccactggggggcccttcacccagcgctctgtttctgtgcaggctcggggccagcatggcccccacgctgcaacaggcgtaccggaggcgctggtggatggcctgcacggctgtgctggagaacctcttcttctctgctgtactcctgggctggggctccctgttgatcattctgaagaacgagggcttctattccagcacgtgcccaggtatgcctgaaaatgggctgggtgggctggggggagggatggcaaaggggcaggtggaagccagaaaaggttaggtggccaggtggacagaaagcagggtcagcagttggacagcctcacttctcgacctcttcaaacttcagggggagattgggtggcactctgcccactgtttcatttatctaatccagtggtcactgaatgccaggtgtcctgctggtcatccagaccctgggactaataggcagagtcctaagcctctgacagcctcaggtctagagctctttgaaggagacgtgctgggagaggaatttcttaatagggctatcataagacaagggagagctgcacaaagtggagtatgaatataaagggccccacatccttcccttttcaggagctgggagcccccaggttttcaaattactcatttggacaaagttacatagcctcatttactctaggagggcattgtggagagtctctggtttccacttcaatcaccttgtgtgagtggccccgaagctgggagtgggaattctaacactctttgggagcagtaactacagccataggctgtctgcagctgccttggggcagggagttaccactgctggtgtctaggacttgcctctgatgggtatcttcctattctgggaaggagagagctgtgctgacaagctccgcctcaggagctgggtggaaatggaattgggctcccctctctttttatcccctttccccaacctctgtgttgtggagtaagcttggaaggaagtttagcttggatttgaatcccagcttccatcacttttatcagttggtgacttcggtgagttccttaaacattgagcttcagttgcctggtcttcagaatggggataataatatcgattccgtgggagtgctgtgagagtctgcagtgcttaataaatgttagtgtccttctcgttgctcctggcttctcgtttcaactccttcctgcacagcacctgatgtggctatggaagaaaaccgattccttgaggggtggagatggggaggtcttgatcactgctctgaacagcggctgctccaccccaggatctgccgcatccagccatggttatctgtaaagatgcaacagatggcaccgagagatggcgactctcccatgcctcctggccccaattatggggtgacaggggctggaggaggtggggttggcagccaggctgggatggctgggtgggttgggaagaagaggcctgacatgaaatgatacacataagagtggctgcaagaaccaagtggagggctattagggacccacatggcatctaagtcccctatgagtttatcctggagataggagagaccctgcctgcccttgacacctgccactgtcccctatgtaacttttttttttttttttgagacagagtctcactctgtcacccaggctggagtgcattggcatgatcttcgctcactgcaaccttctccccctgggttcacgcgagcacgtctggctaatttttgtatttttagtagagacgggctttcaccatgttggccaggctggtctcgaacacctgacctcaagtcacccacccggctcggcctcccgcagtgctgggattatagacatgagccaccactcttggcctaccccttgtgtaacttcttcctgccttctccacctggtgctggtggtgtttctttaaaatcaactttcttgaagattacatcatacattttgatgaggtctgacaaatttatatgcctcagtacccaccacacaatatttagaacctcctcaaactcctgcttctctttagagggctcatccctccacctgcatttttaaatatgtaaaatatgtaaaacagctttattaagatataatttccatgcctcacaagtcacccatttcaagtatataatttaacagttttagtatgttcagagtagtgcaaccatcaccagagtccatttcagaacagtttctttatccccaaaagtaactctgtaccattagcagtactcactcgcctcacccccacctctgcccccaagcactaggcaaccactcatctatttcctgtcatagctttgcctgtgataaaagttagatttacctattctgaacatttcatttaaatggaatcttgtaatatgtagccttttgtgattggctgctttcacttagcataatgtttttgaggttcatccttgtagcatgtatcaggacttctttttattgctgagtaaatactccattgtatggatcaaccaccattctatttatccatttgtcagttgatggagatttgggttgttttcacattttggctattatgaataatggtctggctgggtgtggtggctcatctgtaatccaagcttatttcaaggctaaggcaggaggatcacttgaggccaggagtttgaatgtgcagtgagctatgattgtgccactatactccagcctgggccacagagtgagacccaaatgttcttctggactttttttttttaatttttttgagacagggtctctcactcagtgacccaggctggagtgcagaggcacaatcacagttcactgcagcttcaacctcctgggctcaaatgatcctcccacctcagcctccagaatagttgggactacaggcccgcatcaacacatccagctaattaaaaaaaaatttttttatagagactgggtcatgctatgttgctgagactggtctcgaactcctgggctcaagtgatcctccctcctgggcctcccaaagtgttgggattataggtgtgagccaccccgcctagcccttgtaaagtttttaatgtcgaggtatgctttcatttttcttaggaattgctggtcagttgcaagggtaactatgtttaacattttgaggagctaccaaattgttttccaaagtggctacactatttcatattcttaaaaaaattttttttttatttttgagacagaatttctctcttgttgcccaggctggagtgcaatggcgctatctcagctcagggcaacctccacctcctgggttcaagcgattctcctgccttagcctcccaggtacaggcgcccgccaccatgctcggctaatttttgtatttttagtagagatggggtttcaccatgttgtccaggctggtcttgaaatcctgcctcaggtgatccacccccctcggcctcccaaagtgctggaatttacaggcgtgagccactgtgcctggcctcctttacatttttttaaatttaattttaattttttaatttttaatttctcatatatatatatttttaagactagccaagtgaagcagtgggagtggaaaaggaactggttttgatcaataggtgtaaacaccactgcactgggaccagcctattttacattcctgttagcagtgatgagggttcactttctttgtagcctcaacaatatgtgtcgttgcccatctttttttttttttttttttttttttttgagatggagtctcactctgttgcctaggctggaatgcaatggcatgatctcagctcactgcaacctccgcctcccaggttcaagtgattcttgtgtctcagcctcctgagtagatgggattacaggcgtccaccaccacgcccggctaattttttgtattttcagtagagatggggtttcaccatgttggccaggttggtttcgaactcctgacctcaagtgatccgcccacctcggcctcccaaagtgctgggattacaggcatgagccaccgcgcccggcctgcccatcttttttttgttatagccatcctagtggatgtaaagtttttttgtgattttgatttgtgtttccctactgatcaatgatgttgagcatcttttcctgtgcttattggcttttggtatatctttggagaaaggtctattcaggtcctttgcccactttaaaattaggttatctttctattactgagatgtaagagttctttatgttctagatataagtctcctacatatgatttgtaaaaattttccttccattattgggttgtctttcactttcttttggtgtcctttagtgcacaacagtttttaatattgaagtccaattttctatttttctcttttgccacttgtatcttggtgtcatgtttaaggaactattgcctaatctcaggtcacaaagatttacacctgtgtttccttctttccttccttccttccttccttccttctttccctccctccctctctccctccctccctctctccctccctccctccttcccttcctccctccctccctccttccttccttccttccttccttccttccttccttccttccttccttccttcctttgtccttctgacggaatcttgctctgtcacccaggctggagtgtagtggcacgatcttggctcactgcaacctctgcctcctgggttcaagcaattctcctgcctcagcctcctgagtagctgggactacaggcacacaccaccatgcccagctaatttttgtatttttagtagagacggggtttcaccacattggccaggatggtttcgatctcctgacctcgtgatccacccgccttggcctcccaaagtgctgggattgcaggtgtgagccaccatgcccggcctgtgttttcttagagttttgtagttttagctcttatagttagatccttgatccattttgagttgattttgtatatagtgtgagatatccacctggtgttgtaaattgcccagaagtgggtatgcttctaaatctggctgttagggattactagaggtgaccaaagtgaattttttctttgtttctttttttttttggagacagagtctccgtcacccaggctggagtgcaatggcttcatcttggctcagtgcaacctctgccttctggtttcaagcagttctcctgcctcagactcctgagtagctggtattacaggcgtgtaccaccatgcttggctaatttttgtatttttagtaaagatgcagtttcacctgttggccaggcttttctggaactcccggcctcaagtgatccatctgcctctacctcccaaagtgctgggattacaggtgggagccaccgtgcccagtccttttctcagaatttatttgtttttttttgttttgtttcatttttgagatagggtctcactctgtcagctaggcaggagttcagtggtgtgatcattgctgcagccttgaacttctggactcacgtgatcttcccacctcagcctcctgagtagctaggattacaggcatgtgcttccacacctggctaattttttaattttctaggacttatttgtccattcttgcaaagcagggtacaacatgcctatctctacctacctctcttcccttcaagggactccagccaaaatccttgaggctctcgggctgactgtgggtgctgttgcctgatctgcctcagtcatgctgcatgatcaaaagtgtccgttttctgcttcttggaactttattcactttgggtgtcagtcttcctctgcagtgtcccaagaacacagaattagaccaggaatctgtgttgccatagtgtgtggaaagaggcagacttccaactccgctatgtgctgttgggtgattgaagcttaattttctttctatctttctttcttttcttttcttttttttttttggagatggaatctcgctctgttgcccaggctggagtgcagtggtgcgatctcacctcactgcaacctccgcctcccaggttcaagcgattctcctgcctcagcctcctgagtagctgggattacaggtgcatgccaccatgcccggctaatttgtgtaattttagtagaaacagtgtttcaccatattggtcaggctggtctcgacctcctcacctcaggtgatccacccgccttggcctcccaaagtgtcgggattacaggcgtgagccaccgtgcctggcacttaattttcttaatacctcaattaccccatatggtaaaatgggactagtaatccataccttatagcgctgttgtgaaaatgaaatgagggtaagcagataaaatttcagactacggatgggattgttactacattctgaacctggctttgctgttatttgctatgtgaccttatcttctctggatctccattctttccaagtctataaaacaaagtggacaattgtcaacctttcttccaaagagcaatgatttaaggatcaaatgatgtcatttaacaaaaatatgaagagctcaacaaatgaggaactcattattattattacaattattattattttagaaatagggtcttgttctcttgcctaggctggagtccagtggtataaacacagctcaatgcatcttcagcctcctggatacaagtgatcctcatgtctcatccccctaagtagctgggaccacaggcatgtaccaccacgcacggctaattttttattttttatttttattttttgagacagtcttgctttgtcgcccagactggagtgcagcagcgcaatcaccgctcactgcaacctccgcctcctgggttcaagtgattctgctgcctcaacctcccaagtagctgggattacaggcctgtgccaccatgcccggctaatttttttgtatttttggtaaagacggggtttcaccatgttgcccaggctgatctagaacccctggcctcaagtgatccccctttcttggcctcctaaagtgctaggattacaggcgtgagcctctgcacctggcctcggctaattttttattttttgtagagacaggttctcactatgttgccagggctggtcttgaactcctgggctcaagtgatcttcccacctcagcctcccaaagtgctgagattacagatgtgagccactgtgcctggcctggaactcattattgaagcattcactagtatcaactttggggttacctggccacatcctctgacctacctataagggtatcacagctaacggagcctctgtttctcagaatttaggcagaagcagttcaatttatcacaaactactctatatccagcataagtgcccaaataaaacaattgctaaagttctttaggcatttactgtttgttagttagatatttagtcctcactacaaatctgtgatacaggtattatttttattaaccccattttatagaagagaaacctgaagctcagagatgctaagtaacttgtgcaaggtcacacagctagtaaagggcagagtaaagatttagtttcacattggactccagaacctttctactgggactcatgggaatagtgtggatgtccctgaccttcagtggcccagggctctcctgggggaatccagccatagacaagacaccagcgagagcccaatcctaagattttgtttgtttgtttttgagacaaggtctcactctgtcaccagactggagtgcagtggcatgatcaatgctcactgcaaccttgatctcccaggctcaagcaatcctcccacctcagcctcctgagtagcttggactacaggtgcacaccaccacacctgactaattttaaaattttatttaattaattacttactattattttttgagacagggtatcactttgtcacccaagctggactgcaatggtgtggtctcagctcattgcgtcctccacctcccaggttcaagtgatcctcccacctcagcctctggagttgcagggactgcaggtgtgcgccactatgctcagctaatgtttttattttttgtatagatggggtctcactatgttgccagggctagtctcaaactcttggactcaagcgatcctcctgtcttggcctcccaaagtgccgggattacaggcataaaccaccacacccaacccctaaggtgtttttgctgaatgtgaccatgtcagaggcaggaaagggaagcatcatggggttaggaaaggaacactgagcagggagacaaagaaaatgggatcattttgtgagtgttcgctgtgtgtgtatgtgtgacaattctcagagccagcctctcaggtggttgagaccacagtccccatttcccagatgagataatggagcctcagagagtttctgcagcacagctagtggaattagaatttgaacccggctcttccagactccaggtgcttcacaaccatcccaaacctagtcatttgcagtttaccttcatgattttaccatttccctttgccatagctagtgttatttacttaataattccttttgaatcagtctgcttaaaaaaaaatagcttcattctaaagtgtaatattcttggaatatcgggtttgctgttacccacccccacacgttatacatatacatgtatgtttctaatacatatatatgtacgtatatacgtgtatcgttttttgttattttttttgttgttgttagttttttttagatggagtctctctctgtagcccaggctggagtgcagtggtgtgatttcggctcactggaacctctgcctcctgggttcaagcgattctcctgcctcagcctctggagtagctgggattacaggcacccaccactacacccggctaatgtttgtatttttagtagagacagggtttcaccatgttggccaggtgggtcttgaactcctgatctcaagtgatccacctgctttggcttcccaaagtgctgggattataggtgcgagctactgcggctggccaatgtatgtttttaatacacattcaaataacgaataactatgaaacctgaaaaactgctccatgttacttcctgaacccatcttgagtgctcacatgctgtgcataccacatattgggaaacactgctttccctggcttccaagcccagcttaatcactgtcccatcctatgcttcgctttatttgtctataaatgttggggttgggggttgatgccaaagaccttttctgttgtcattaacatggacacagctctaagaggtcttggcatcttgggctggctctccttttagttcagaatttggatttttatccaactactcagagtgatcaagccttccttatgaatgaactcgttggtcaaactcataaaaggctgatcgataaaacaggaatgaatgtatgaattgacactaagtcattagcatttcacgggaatggattctccgttagtggaagagcacatgtcctttctggcactgatgtgtgcttgggaaacttactgagctaactggcccatgtaacacagaggccctttggtgcagtggaaaactgttgactttggagattatcttgagtttgaatctgagcctgcctgtaagaagctggctaactgaattgctttgcttcttggacccttaccatttataaaatggggaccattgtactcaccctttagggttattgcatggattaaatgggattctctatagaaaatattggcacaaagtaggtgtaaatttgcacgctagtgggattgtttgtgagggaaattgtcatttgattatcaaagacttaggagcaggaacagtgtctaattcagggactgcaaatggaaatgccagctgaggccaggcatttgctaataattgggtaaagcagggcaggtgtagaatagcaatgtctgggaattaaaagagaggtgaggacgtgtatgaccttgagaaggcaagccctggcaaaaggggatggcctccactcagctacagtcatgcctagatcttctaactttttatttttatttttattttttgagacggagtcttgctctgtcacccaggctggagtgcagtggcgcgatctcggctcactgcaagctccgcctcccgggttcacgccattctcctgcctcagcctcccaagtagctgggactacgggcgcccaccaccacgcccggctaattttttttttgtatttttagtagagatggggtttcaccgtgttagccaggatggtctcgatctcctgactttgtgatttaccctccttggcctcccaaagtgctgggattacaggcttgagccaccgcacctggccgatcttctaactttttaaagagaagcaagacatctggatttttatgtgataactcctgattttaaactggcacccaattataatttacaacactataagggtcaacattgccagcagagcaaaacatgggtgggggcaactgctggtcaccggtgtgcagcctctggtctaaaatcatctttgtatttcttcttgctttacgcattgtcccagcacagtgctgttgtatagtaaatatccagtaagtgggtgtagaatgaataaaccaatgcagataaacctgtagagaggccgggcacagttgctcatgtctgtaatctcagcactttgggaggcccaggcaggcagatcacttgggcccaggagttcgagaccagcctgggcaacagttgaaacctcatctctacaaaaaatacaaaaagtagccaggtgtggtggcatgcacctgtagacacacctactcaggaggctgaggtgggggtatcacttgaactcgggaggtcaaggctacagtgagctgggaagtcaaaggtgcagtgagctataattgcaccactgcactccagcctgggagacagagtgagaccctgtctcaaaaaaaaaaaaaaaaaaaacctgtagagaaatgacagtgatcataaagatcactaaattatagggctagcctgatccccaaaggctgtgtggtccaacccctaagtgcttcctggaggtgtctgagcactttccccacctccttggcagctggtactgaagaagactctctgttgtccaggacagttccttccatggctggtcaacactcaggatctgccaggcctttgtgttcttccttatgtcaacacacagattcctttatctttactcttctgccaactgcatgacctttggatatgtaaagtcaggggtcattttcactactgagggcagatgtcctctaccaccccctagtatccaggcattatcacatccccttgtccccttgttggtttttttgtttcctttttcttttcttttcttttctttttttttttttttgagacagggccttgctctgtcacccagactggagtgcaatggtgtgatcatggctcactgcagcctcgaccgcccgggctcaagcaatcctcccacctcagactcccaggtagctggaactacagacatgcatcgccatgctcggctgatttttaaaatttgttttgtaaagacaaggtttcccaatgttgctcaggctggtcttgaactcctgggctcaagagatgcacccaccttggcctcccaaagtcctgagattacaggtgtgagctactgcacctggcctggtttgttcttttagcagcacctgtcactctagagctgagaacttcctgtctcatgtagtgtggatgcccagctcctagagtacgtgcttaccacatgacccaccaggagggtcagctaccccttcctcagatccttcaggagcactttctctgggccaggcactgtgcaaagctctttgtttactgtctccaatttaatcctcctaaggaggtcgtgggttaggcattctttggtccggtttacagacaagaagaaagttacttggtcaaggtgcacagctagtaaggctggtggtgggaattcagaccctggtctgtctgcctgctccaggtgcaccctgagtttgcccttggcagtgctgccaagtgacaacttggaggcctgggggcagccacctcatgactcactgagcattgagtaaagcgaagcagccctttgtctcctatcactagcttttctccttaacttgtcacaactccaagttggcagtttaccgttaaggacaagtcctccaagtggacttctagaggggactggagggcagtgcctggttctcattctgtgcctcagcttcatcacctagggaacgggatactttattaactgacttatggggctgttgtgtttagaacagtgcctggagcatagttaagtgctcaataagtattagctattattttatcagactatcatttatcgggaaagcttcctctaagttttagtgttctttctaaatttcttttttttatttagagatggggttttaccatgttgcccaggctggtctcaaacttgtaggcttaagcgatctgcctgtctcagcctcccacagtggtgggattacaggcatgaactaccacgccgggccattttaatgaattcttgttatagccattagagtaccactcactgcctttgcctttgcctctagatatgggggcacttcttgttgggggtccacaaccccctaagcttggacactgagtgcatattacaacttagtaaatacttttatgtccagtatttcatttgagctagttgaagcctcaggctgtgtgtgcacaagactctcccagggtcaggtactaatggctgccatttctggagcagccccatcagaggagatgtgactctagggtacccccaaaggcacttggcatgggatttgaaagcaggccgcctgactgtgggctgctgtctcctgtgcccagctgttcctggtgtcatgtgctgagccctcccttccccctcctcagctgagagcagcaccaacaccacccaggatgagcagcgcaggtggccaggctgtgaccagcaggacgagatgctcaacctgggcttcaccattggttccttcgtgctcagcgccaccaccctgccactggggatcctcatggaccgctttggcccccgacccgtgcggctggttggcaggtgaggtggctgggctatggggaacgggaggacagggaccgtgctgcagggggaggggagggggggtgctcacaggccaacccctcgcccttccctgtgtctccacagtgcctgcttcactgcgtcctgcaccctcatggccctggcctcccgggacgtggaaggtgagttgtctgtcctcttgtggccccacaagaaaagaataggtgggatgaaggcggatgtttaccccagctcccgcccttggcttcccacagctccccaaatgccctcatctgctgctttcccctttccagctctgtctccgttgatattcctggcgctgtccctgaatggctttggtggcatctgcctaacgttcacttcactcacggtgagtgtcacaggcctggcctggcagcagagttcccccgagtggggtgagggcagagtgagtggggtgagggcagtatgaatgggctgggggaggggcctgtggacgcagatcactagatcaagtgagtgtgtgagaaactgtgcaggtggctgcaaagagcaggtgtgaggctgtgtgtgtgtggatgaggctgtgtgtcggggtgtatgttaatgtgtgtgtttgtgtgtacagagcccatgaatgtccatggagctctgttctaggtcctggactacagcacaatcaggactgaccgagtcatcctccctgctggaggttacattttgggggtgaggggcacagataacccaataaacaagtaaactaataaattatgtcagtcgtcataggtgctgggaagaaaataaaactgggtaacatgatcttgagggggagggagcagcttgagatagcgtgtgcacgcttgccatgtcgtgggagagtgggtgtgtgaccccgtccctgtgaaagccatgagttggtaggtgtgtttgtgagtgtactaggttgaaccatatgaaattgtcgacacctcgtcgtgcacatggcttgacctattacatgtggtgagtggtgtatgtgtgttgctcaaagtgtgtttatttatgtgagtgtgtaaacgcgttaaaggcttaggagtgttaaaggcttagggaggttggaggggaaggttcctggccgggctggctcggactgtttatctctgagaagggctgcctgactgggtggttttggctgaatttcacctctccccagcagccgcctttaattccaaccggggacatttcacagctctaaaggaaggaagcggatccctttctccccgcccctctgcgcagccccttctccctgctgtgcaacttggcccagggccctaaatcccttctctccggcgcttgacctcagaccctccctggcggccgggtggggcttgtccagcggctcctccctgctatgtccccgcctcctgtaatctccagccaatggcagggtccggcgctggcaccgcccctcagcctctccccgctccctctggccggccccgccccctgggccgctgctcttggcccagacttggacgaggacgtcccgtgctgagtcttgcgggcccagctgctgttgccacgcacgctgcaaggccgccagcccggggttagccggccggcctcgccttacccacggtactgggcgcagacagcgtttgtggccccttggaggggagggggccctgcccctctccaggcctggcagccttccgtggcgtccttggcagtggtgcctcacggatgcagggtgcaggaaaacctctgcctgagtgggtagaggtttttcctgagccagccacttcaggggaagggggaaggataatttagttatatgtgtttaaacaccattttttttttttttgttgagacggagtctcgcagtgtcgcccaggctggagtgcagtggcgcgatctcggctcactgcaacctctgcctcctaggttcaagcaattctcctgcctcagcctcccgagtagctgggactacaggtgcacgcctccacgcccggctaattttttcgtattttagtggagacggggtttcaccgtgttgctcaggctggtcgcgaactcctgagctcaggcaatccacccgcctcggcctcccaaagtgctgggattacaggtgtgagccactgcgcccggcctaaacgccttttttaccagagctgttgaggcctcccttcagagtctcagtttccccctctgtggagtgtgtttaggctttgtacggatcctaaggtccttctcagctgtgggatctagtgacttggggaggatggtggggccagaggagggtgtgtgcgaagggcatcctgactttgccttcccctgccctgagggcttggctgaggcaggtgagtggaacacatgatcaattaaattctctcctggtgtgggttctgaccctgctctgcgtcagagccacctcctctggagactgtctgccctggctcagttccctcccttatttccaccctcacctcccaggatgtgatttgtcctgattaggcagaaactgggctgggacgtcaaccgagagggttaagaggcactgcctattaccgggacacagccatggtcacagccttgggttagggctgggacaacgacaatggggagaaagccattaatgtgctctgtgaacttgagtacacttttcctccctgggtctcaattgtctcatctcaaatgggttggacaagatcactgtttctttcttttcttttctttttttttggggggtggggacatagtctcgctctgtcacccaggctaaagtgcagtggtgcgatctcggctcactgcaacctccacctcccaggttcaagcgattctcctgcctcagcctctggagtaggtgggattacaggcgcatgccaccatgcctagctaatttttgtatttttggtggagatggggtttcaccatgttgtccaggctggtcttgaactcctgacctcaagcttcccaccagcttcggcttcccaaagtgctgggattacaggcatgagccactgcgcccagccaagatcagtgtttcttaagcacctattccatgtgtttttcagaggtgttacgtaacaaacttgggaaacctggaattaaacaaaattaacaaaatgtctctctgaggggtgtctgggagcctttttgaagctaaagggcactgtgactgtgtaggcagggggcagagtacagtttcccacattgatttttctgtttgttttaccttggggcttttctgctgcgtctcctggggctattgtatggagcagggctgggaatgctgggcaagggtcacggtgtccccacctcatgggtgctgctttccctcctcagctgcccaacatgtttgggaacctgcgctccacgttaatggccctcatgattggctcttacgcctcttctgccattacgttcccaggaatcaaggtatgaggccacctgggttttctttttgtcttgacacaagaaccgggtggggccgagtgagcagcagctagtgctgacccacgggtctgacttctccgctctcctttctctgtcatcatcccaatgcaggccttccccctctctcctgggccacagcaagctttctcagctggtctccctgcctctgattctttttctctgtactctgtcactcacgtgacttccagaaagatctcagatggggaactggctcacacactgctgaaaaaccttcagtggtttagcttcacctacagaatcaagtccagccccttcacatgcgttcaaggtccctgactctctggctttattcagcctttggggccacatttttccacaccttccagagaggatgggtggtttggtccaaggtcacaaagtgagtttatgccaggctggatcctggacaggtcaacctggtgtacctcgaagccaggggaccaaagttttagctcagtgcaagatgggggcctcaatttcctctgtcaaatatcaaaggaccctttgactgagccatgccatgctcctcaacctccacggtgggcagtaccaaactgcataccgttttgcactttacaaagagtactaaagaaggtacttttgctcagtgtctccaaaggagtttgagagagcgcatgggtgggggggccatcagttgttctggtgggcaggcatggagggtgggcagttctcccttcttttcaactgaagtagtgtttgaagagccagatcttacctccacacatttgggggtgtggccctttgaagctctgtcctgcccctagggaggaaaaggcaccaaggtccaagactgcagagaaaaaggtttgagcaggagcctgaggggagagcagacattaattatcctggtcagatggtatggggaggacaagaggacagatggtgcatcagcttcttccataagaagggctgacacatttgcacagaatctcattcaattgagaacttacctgccctggggttgagagcccttgggcagagcacttgcacctccctctccccaacccccccagttgttgcacgtgggaggacctgggaaaggtgagaaaaggctgagcatgagcagtctgggtttgccttttcccctggggaatgtgccaggaaggggcaggataaacacgattaggcccggtaaacctagagcactaagtttcctttgtacgtactatgaaatggacatttttgtgcgaacatgaacatgaatgtttgtggagtcataggcaaaaatgtatgtatttttttaagataatggaaatttcagagatattttgagccagtggccagcaacttcaggctttgtggagactatttcatagctctctagggggcctcaagtgaaaaagaaaaaggaatgatgggtcttctgagtctgactctaaacttctggtcttggtttcctcatctgcaaattgggcacaaggacaaggggagaagagaacttctttaaggcctctgaggcctgggatctaccttggtggggtctggggccaggcagtctcccccacgggcctgccccctcctctcacagctgatctacgatgccggtgtggccttcgtggtcatcatgttcacctggtctggcctggcctgccttatctttctgaactgcaccctcaactggcccatcgaagcctttcctgcccctgaggaagtcaattacacgtgagtggctggagtgggcagagactctccctggggcagagagggctgtggtgatatgatagacggaattaactttggattcagagagacctcggcttggacctctgcttggcaaatcgcttgagccctccaagctctgctttctcatctgtactatgagcctgttcctacctacccacaggtcgcttttgtttgtttgtttgtttagaggcagtgtcttgctctgtcactcaggctggagtgtagtgtcttggtcctggctcactgcaacctaaaactgctgggctcaagcgaacctctccctctgcctcccgaggagctggggttacaggcacacaccaccatgcccagttaatttttttattttttgtagagacagggcttactgtgttacctaggctggttttgaactcctggccttaagggatcctccccccttgcccttccaaagtgtccgattacaggcgtgagccactgtgcccagcctcccatgggtgtttttaagtaatacagttggcacataacaggtggtcaaaacatggtaaatatttatttatttatttatttatttttgagacagagtctcattctgtcgcccaggctggagtgcagtggcatgatttcagtgaactgcaacctctgcctcctgaatagctgggattacaggcacgcgccaccacacccagctaatttttgtattttttagtggagacggggtttcaccatgttggccaggctggtcttgaactcctggcctcaagtgatccgcctggctcagcctcccaaagtgctgggattgcaggcgtgagccaccatgctcagctcatggtaactatttatgtgggtgcaaaagtaattgtggtttttgccattaaaagtaatgggccaggcgcagtgggtcatgcctataatcccagcactttgggaggccgaagagggtggatcgcctgaggtcgggagttctagaccagcctgaccaacatggagaaacaccgtctctactaaaaatacaaaattagctgggtgtggtggtgcatgcctgtaatcccagctagtcaggaggctgaggcaggagaatcacttgaaccctagaggctgaggttgcggtgagccgagatcgtgccattgcactccagcctgggcaacaagatcaaaaactccgtctcaaaaaaaaaaaaaaagtaatgacaaatactgttttcatcctttctgggtttggaggagatctgagtaggaggcacctcagcaatggcactcgatgccatgtggtcccaaaaagagggacataaaagaatcaagcaccccatcttttgtggagccacctgaatgccaactttttccagccccctgtcagttcagcagaggcaagaggtgatactccacaccaagcacataaggtgacattacagaactgacagttatgccaggcactgtacttagcccctataccatcctcaaacagctgtatgatgtagattgggtattaaccccattaataacaaaagtacagggaacaaagtgactttccaaaggtcatgccattcaaaggagggtgaatcttaggttggacgcaggctgtctgactctggagtctgaggtgttaatgctgcctcctccatgggaacagcccaagtgaaaaacagctgatccactcttcatttacttggcatctgtgctaagctggtccctgagccaagctctgagcaacagaaacagaagctctgcattaggagcttgtgagcatgtcaatgccgggtaaaggagtgctggaaaccgctgggatggccgccgagcactaggccgttgaaggtgggctctgtgtgactggttcctctacactctggcctggctgcctgcaggaagaagatcaagctgagtgggctggccctggaccacaaggtgacaggtgacctcttctacacccatgtgaccaccatgggccagaggctcagccagaaggcccccagcctggaggacggttcggatgccttcatgtcaccccaggatgttcggggcacctcagaaaaccttcctgagagtgagtgtctggtcaaggtgccggccttgggggatagtgatggtgggtcctcatattcagtgagcactcatggttgagtatttattcgcacccctcttcagtccttacaacaccccatgatgtaggtggggcatgctcctcatttacagatgggcacatcaaagctcagctaacgctgggaagttcagattcagggttaccctgctggattcctgggattggggagggaggagcttccaaaatggggacaaggtctctgggcctgtcgggtagctggtttcctcagggccccttgcaacctctgagcttattgcatcaggtgcagccaggcccgtgagcctcctggcaggggtcctccacacctggctgtcttttgccccctgctggtcacaggaggagctgcagcacctgcctgggctgcttctcaggagggtacatgaagatcccaggaccgccagctccatgataagtggaaggagctccttggagtcaggagcgggagttgaggagtttgagtcctgctctccagttataggctatgtgacttgtgtagatcacctaaccttgctcttgatttccttacctcttaaactagcactaaaagcaccccacaaactgtaaagttagttgtgatgattgaatgacaccatgggtgtggaagctctttgtaaagtgcaaaacggtgtgcagtttgagggtggttacccccagtgccgattctcagagggcaacatggctaagggcacgagctggagttaggctgacctgctgcttccagccctgtgagcttgagcaagtcatttaacttcctgagctgcagtttcctcatcagtaaaatgtgataaggatagggttgttgtaagattttattaaatggggtaataaatgtcaagtatgtagcccatagtgagtgcttcagagtttttttcttttgtttctttcccccccgccccgagatggagccttactctgttgcccaggctggagtgcagtggcatgatcttggctcactgcaacctccgcctcccgggttcaagcaattctcctgcctcagcctcccaaatagctgggactacaggcgtgcaccaccatgctcggctaatttttgtatctttagtagagacggggtttcaccatgttggccaggctggtctcgaactcctgacctcatgatgctcctgcctcagcctccgaaagttttgggattacaagtgtgagccaccgtgccctgccaggtttttttttttttttttttttgtaaaatagagacagggtattgctgttgcctgggctggagtgcggtagtgcaatcatagttcactgcagccttgacctcctgggctcaagtgatcctcctgcctcagcctcctgagtagctgggaatacaggtgtgcacaaccatgcctggcttatttttttatatatatatatatatatatatatatatatatatatacacaaaattatatatattatattattatatattatattatatattatattattttttatatataaattatatatatatttatattatattttatatatatatatattttttagagatagggtcttgctatgttgaccaccaggctggtcttgaactcctgggctcaagcaatcctcctgcctcagcctcctgagtagctgggaatacaggtgtgcaccaccatgcctggcttatttcatatatatatatttttatatatatgtatatttatatatataaatatatatataatttctgtatataaataaataaataaatatatatatatatttttagagatagggtcttgctatgttgaccaccaggtcttgaactcctgggctcaagtgatcctcctacctctgcctttcaaagtgttgggattacaggcgtgagccatggcacctaactgagttatttttaccacacgaagcataggacatacatccaaaaatgttctgagctgagcaagagcctggaggcaagtgaatctgaactttcccgtctttgaagaaaccagtctctctccaaagtcacatagttagtgtcactccccccaagaactgcatgagctgggacaatcagagggcagtggaaggtctggggctcaggggcgccccctgctgtctccccagggtctgtccccttacgcaagagcctctgctcccccactttcctgtggagcctcctcaccatgggcatgacccagctgcggatcatcttctacatggctgctgtgaacaagatgctggagtaccttgtgactggtggccaggagcatggtgaggcaccgctgaggcccctgggggttgggggcacaggcgggtcaccctggctgagctcccctcaccatacgtttccctacccacagagacaaatgaacagcaacaaaaggtggcagagacaggtagggctatgaaagcagggccctggctcacgcccaccccactgcaacccgcttctcagggggcgggactcctctaggcctgggcccacccaggtaacccttttgtgggatgtaagagtctgggttcagaggaaggctattttggtgctctctggcctccgctggaaggggtgatagtgtccactgagtgccagttcctgaccccactgcccttcccatcctgcccagttgggttctactcctccgtcttcggggccatgcagctgttgtgccttctcacctgccccctcattggctacatcatggactggcggatcaaggactgcgtggacgccccaactcagggcactgtcctcggagatgccaggtgacctgcctgtacagggatggtgacagcaagtggtcaggcagtgcttttcattttctctgtgcgtttacatccagcaacttgttgctttctcccaagaaccctaggagatcaggggtacctccccattttacagatgaggaaactgaggctaggaagggacctggcttgcttaataataagaatagctaatgcagagtgctgactgtgcacttggcaccttgccttgtttagtcctacaacacctctttgaggtagatgcgttaatatcttcattttgcagttgaggaaaccgaggtacagggttgcacagttaggtcattcacccaagatcacacagctttcagtggcagcctccagaacctgtgttataagggtacacgctaaagtcttgttagggctagaataggtagagttggtatattagatatttattgctgtataacaaatcaccccaaggcttggcattttaaaacaacaaacacttctcatctcatacagtttctgacagtcagaaatcagggagagactcagccggctgattctgagtcacagtctctcatgaagacatagtcaggctgtcagccagggctgcagtcatctgaagggctgactggggttggagaatctatgtcagttcaattacccccatggcctctccatagggctgctcaggacacagcacctgctttcccttgagcaagagggctaagcgacagagaccccgtatcttctctcacataatctcagacgtagcataccatcacttctgttacgttctattataggcacagagcaaccctgatatactgtggaaggagactggacaaagcaggggaataccaggaggcaggatccttgagggctgtcttgttggctggagaccaccattgagggtttttttttttttttttattgagacagtcttgctctgtcgcccaggctggagtgcagtggcacgatctcagctcactgcaacctctgcctcccaggttcaagcgattctcctgcctcagcctcccgagtagctgggattcaccatggagtcttgaacccagattctgtgactgcttttgctctttttgtgttcatccaaacagtccctgtttatcctaagaggatgggagaaagagactgggagagaaggaaatccagtggcctccctccctgctagcagagcctggccctggcactgagccttcctcctctaccctctgctcctaatggtgagggtcccctagcagggcccttctgtccaggacacatgggccgcctgtcctcaccccagcctactgacctctctcctgggctggcctcagtgcccttgattgtgccggagagaggaagcgctggacagtcaggccaagctgctgtccccaggagggcatctgcttatgtctagggcagggacaccttcctgaggacttctgatgagagacggtgtgagagcttcccacttcccaccttccttcccatccttggttctcaaaccttcaagtgtgcatgagaatcacttagtgggggatatttgtccaaatgcagatttgcagatatccccgctgagattctgagggccgagatgaggcctgtgaatctgcatgttaagaaagcacccgctttgatgcgtgtgtcattgggtaggggagcaacactttgagaaacatggagctagagaacgtgggtttctatgggtttcccatagaaacatggatttctgtgttttctgctgccctgacatcgaaggcacatctgaagggggaggggccaggccaagaaccagggagtcctgggaacgtagaggcagcagccagtgacttcccgtactcctcagggacggggttgctaccaaatccatcagaccacgctactgcaagatccaaaagctcaccaatgccatcagtgccttcaccctgaccaacctgctgcttgtgggttttggcatcacctgtctcatcaacaacttacacctccaggtacccaccttcatccttcccctctccctgcctcccgaggctcctccaaagggatggtccatccagcacctgccttccaggaagcgcagttctggtcttctgatctggatctattttccgggttctccaggaagtgtttctagtagattgggttggcgagggggtgggaattgaggcccagttggcctcttcgccctacccctccttcctccagcctccacacactctcctaacctcttcactctctctttttggttttagtttgtgacctttgtcctgcacaccattgttcgaggtttcttccactcagcctgtgggagtctctatgctgcagtgtgagtctgttgggctgaaatgccttcctgagctttgcaaccgtgatcagagaaccccagggaagggttgggagggccccaggcatcccctaatgcacctctctctgagaccctctgatggcagggagctcacttccttaaaggcagcctatcctgctgtaattgactccccctgttggagtcttcccttagaggaagctgaaatacctggcttgatgacactttggttctatgtctgctgtttgaaacggcccccagaatggcctcccctccatgcccaccctgaagaaatttcccaagggcagccatttgccttataattttcctcttcatgttggacagtccccacttgcatctctctcctggtttcccctgctgggcgctgctgagggactctcccctgtgtatgtgatggagtaacaggacattacaataatgatgacaaaatgacaaccattatcaagtgctccgttggtgcaggcagcaggcaggatccttgaccatcactccctgagttcagcctcactgcagcggtctcggcagagggcagctctctttccttcatctgctcaagccagaaccctggagtttccttgatgtttctctccctcacactccatgttcactccgtcctcagtacagccagcagcagcttctacacaccccaaatctgacccttcttgtcacctccactgctgcctctccagtcctagccaccaacatctctagcctggattattgtggcagcctttagtctcccacatctgccctggccccgctgtctcagtctatttttaacacaggggctgcagtcacctgtcaggacataagtctcttcacatcactctgtggtgtcctgtctcatctgtctcagagtaaaagccaaaggctttactatggcctaaaaagccctgcaagctctggccccagcacttcactcccctctagctccccctcctccattgttcactctgccacagccacagtgcttcctagtgctccggaagtctcaagtgtgttccctgcttggcatctttgcatgtactagtccctgtttctagaacattcttctccagatatctgcaaggtgcccaatcttaccttctctccttcttcaggtctttccctgactgtcctcttctcagtgaggcctcccttggctgtcccatgtacaattgcaacctccctactgcccgcttctctgcttggtttttctcagcgtttatcactaacactctgcctatctcttgcttattgtctgaccgccacctgctccatgggaatgccacctcctcgatggcaggaatctgttgacttgcttgatcgtggtatctccagcacctagagcagtgcctggcacatagtaggttctcagctaaatgtttgttgacagaatacagtggacagtcctgcgaggtcaatgccatccctgttattagtggaggaagtggggctcagggagtttgagccacttgccaatatcacacatacaggaggtgtgagaacccagctcagtggccctgaagttggagcatttgccctcaaggctggggaccaaagagcccatgcaaagagcccgaacgcttaagcaccaccctgcctggccagcggggaccatggtggggaggggataggagaggtgctggcctgggctggagagggccacacacccctgatactccccgtctcgtggacaggttcccatccaaccactttgggacgctgacaggcctgcagtccctcatcagtgctgtgttcgccttgcttcagcagccacttttcatggcgatggtgggacccctgaaaggagagcccttctgggtgagagcgagggttggtgtggggggagcaggagccactctcctgggggcaggggtagggccttgtatgtggtgccatccctcactcatctcagccagaggcacctcagaggtctctaatctgcaggtttccaagttgtctgccttttagaacccctcacggagtgttaaaaatacagattccccagtcccctgaatcaggatatctcagcctgactgtaggagtctgtttttgtttttaatttattgttattttatttatttatttatttttatttttattttttgagacggagtctcattctgttgcccaggctggagtgcagtggtgcgatctcggctcactgcaagctccgcctcccgggttcatgccattctcctgcctcagcctctcaagtagctgggaccacaggcgcccaccaccacgcccagctaattttttttttttttttggatttttagtagagacggggtttcaccatgctagccaggatggcctcgatctcccgacctcgtgatctgccctcctcagcctcccaaagtgctgggattacatgccttagccaccgcgcccggccctattgtttttttttttttgtagagaaggtgtcttgttctgttgcccagtctggagtgcagtggtaaaatcacagctcactgcagcctctgattcctgggctcaagcgatcctccggccccagccttctgagtagctgcaaccacaggtgatggctaccatacctggctaattttttaaaaaaaaattttgtacagataaacagggtcttgccatgttgcacaggctagtcttaaactcctggcctcaaatgatcttctcaccttggcctcccagagtgctggggttacaggcgtgagccacagtgcctgacctcctaggagtctgtttttagtaaactccaggtgctttgtgaagtggccagtcctgactcttgggcctgtgttcaggcaccattggtccaatccagttctacctagtgtgggatcctgtctccagcacccctgaaaggggacccttccctcttagcttagataccctcagtggtagggcacccactcctgcacgaggcagccctgctgctgttagtaagtcttttccttacattgaactcatctgcctccctgacgctgatctttcatctgccctgtggggccacccacacgtaaaccctcctcccaaagaattgtgatgaaataactgcttctatttaccaagcactcactatgtgctaagcatgatgcatacttttttttaacttacatcttcgccacaacagccctgagaaggaggcactcagtaagaattgccattatttgcccaaagtcacacagtgagtaatgcagagtgggatgtgaaccgagtcagagcccgcgtgtcctgggccttccaagccttctgtccaccaggctgtgcatcccagttccttgaactgtgtctgagagcctcctctcgccaccctgaacgggatcccattggttaacatctccaaaggtcagaggggtgagcccagaaggccccatttcgggagcagcctgaccagcccagactcctacagtgctgtgccttcctcatacctacctagtgagtgccatatggtgtgggcacccaccaggccctgccacttgttatacctgagaagtctcatctcagccactttgcagaattgctgaacattaagtgagatactggtggaacaatgactacacataataagtactagctgtatttattctggctcaggacctggagaaaaatggccgccttctcctccctgtgggaggctaagggcagatgactacctacttgactctgtttctctctccttgccctaaaggtgaatctgggcctcctgctattctcactcctgggattcctgttgccttcctacctcttctattaccgtgcccggctccagcaggagtacgccgccaatgggatgggcccactgaaggtgcttagcggctctgaggtgaccgcatagacttctcagaccaagggacctggatgacaggcaatcaaggcctgagcaaccaaaaggagtgccccatatggcttttctacctgtaacatgcacatagagccatggccgtagatttataaataccaagagaagttctatttttgtaaagactgcaaaaaggaggaaaaaaaaccttcaaaaacgccccctaagtcaacgctccattgactgaagacagtccctatcctagaggggttgagccttcttcctccttgggttggaggagaccagggtgcctcttatctccttctagcggtctgcctcctggtacctcttggggggatcggcaaacaggctacccctgaggtcccatgtgccatgagtgtgcacacatgcatgtgtctgtgtatgtgtgaatgtgagagagacacagccctcctttcagaaggaaaggggcctgaggtgccagctgtgtcctgggttaggggttgggggtcggccccttccagggccaggagggcaggttccctctctggtgctgctgcttgcaagtcttagaggaaataaaaagggaagtgagag

SEQ ID NO: 36594 - DNA, 247939 bp, Homo sapiens
gggacacagagggaggaagaagcggcggcggcggcggcggcggcggcggctcctctttgcagagggggaaactcttgggctgagagcaggaataatgcggtaggcaaggcgggctgctggctcccccggctccggcagcagcggcggcagcccgagcagcggcagcagcagcggcagcaccccaggcgctgacagccccgccggccggctccgttgctgaccgccgactgtcaatggagctggaaaacatcgtggccaacacggtcttgctgaaagccagggaaggtaagaggcagggccggtacgtgcccggcgcgtccgccgcgggccagggtgcgggtgtcgggtggcgtgcgggctggggctgcgcccgtgcaggatgcccgctgccggcgagtgggtcgcgagcaggacacttcggagagcggctctgcagacccttcagggttcctgccttggggctcagagaatctggacttgggctgagaaggttgcagggatttggatgctaacatatctcctagtttccagcgctcgccctgcagagcgtgccatctcggcagctgttgaaaggtcagttggaaaagcattcattcggggagcgacgagcaaacatgcacataaaatagcgtttcaagtcggcccgggatggttctgtgtgaactggtgtgtgtgttcgaggggcgggggtggaatgagcagaagccaagtctttgcctgcgcaggctgagttgatatagactattgctggaaaccatccgctgggatgtttcttagggaaatcccgtcgtgtggaaggaagccttttaaaggcaaagtcagatgttgaggaattagccttttcatagaattatcaaaggatggctgtacagaccacctagaaaataattcagtatttcaggtttttcttttctgggagtgtgataactgaaattgttagattttggctcagttaagaaaagaaaggtaagtgtgctggtgctttagatacgttttctatgcaaatcattagatttcctgcatttagctggcaggaaatattgtctaaatggagtgtgtaagatcctgagtcaaaccctaagaacgcatattttgactcttccttttgatgaaaaacagaaaaaaggggggggaggcagaaacttgggtgcttcctgaaatgattgtgttgtgtccatgtaaacatatgtatttaggaatacctggaatttatgtcgcatattttccttttttttttctggtcaagatttgagctctagtgtgcgacctttttcataaaaggggaagaggtttttccctttcacgggagaacgctttatttgatacaaggtagaaggcagactgagtaagggcttgagtttagaaggatactcggtgagcagcccatgaaaatgtcttacctgcttaatattttcattcacctactttgatgaatgaagggaagaatttctggccagcaataaaacgattcgtgtttattcagcccgttccatcaccttgtggctccctacacactgtgggggtaggtgatgcatagccttccgtgggcagcgtttcagcaactcaacccggcattcgtgtcttactttcgtcgtcacttgtcactctaaagcagccagtgggcaagaaggtttatttcagaagccccgaagggaggcagtgctttgaaaaccccagcagagtttaaaatattcaggttagtctccctcccattgcttagctttggtgggaataaatttttaggagaggcttgttacttggtgacttcaggttctaaggcctgagctgtgtgtgtgtgtgtggtttttttttttttttttttttttttttcctaacctgacatttttagtggacaggatctaggtgggtgctggtaggctctcctctgggttggggaatggtcctgaaagggaggaagcagagaaaacagccctccacctcccccgcccctctttcagcctttgcagctggccacctagtggtgggacacggttgtgtatctcaggattcgggggctgggaaagttttcactctcgctccattctgaaattatttcttgggaaatcactgggtctgatggtactggagccttgcaagtttcgctggttcctcctgttgcccagggaatctgcccccgacatttgctgctgtagatatttgtttgcctgatagatgctttttttcttccctgagcatttggttgcttcttttataatgctttgcttagagtgggcaaagtgatatcaattccacccgccccctccaaattgttctccccagtattttttcaccaacgtgaatttactgtctgatattgttgttcgttaggccaacaaattgggtttttttcccagagccttggagaagagagctgcaggctggaagcttgtgtggagtgaccgactcccattggggcagaattacagtgattgaaagtgctcaagaatgtgcctttcacttttttttttccttttaaaggctttttcaattttgctgtgagagtttggtcgtcatctcatggtgagaaaatagctcttgatgatgccttggaaatggagagggcctgcggaagcagggagagactgacacgtgaacaagaaaaattaatcatttaatggaaacctcatttacaatttgcatctctccccttctttctctcttatgcctagaggaaagccatgattttaagtgcttccagtttcttttggctgggcctttattagagacttgagcccatatatcctaattagtgtggacacttttagaaattaaagcaatttatgtttctcttctcagttctcatatatttgaatttattttactaaacttagtagttctccaaataaccatattatctaaatattcagaaatgaaatcttcagtcagtttagtgaaatatctaatataaaacagtatattaaaaaaatctgagttgtttaaaaggtttaaaaacacttcttaaagattcttgtcagtggttacagatgagaaatataattggcaaatgtgaaatttaatttagttcacttaacaaaatacaccgtaagcaatttaaaatttggctttcaagtaaaagtcacatttgtcccaaacaatagagaaacagaccttgaagaaagacaggcacactttgaaaatgctgtaaaataatttgtagttgtccatgttggtgggtaacactgggacctatcttttctttttgttttgcattaaagacagatggctcctaaattcactgtatcttcaaagtcttaccgtaataagacataatataaagtggaaagcattaatgtagcaataaaatagaaagcctgtaagtggattagagtaaaatgatggattgttagtaattagaaaatatagcaagcaagcttcatgaacacttgtgataattattttaaaataagaaaaggtagaggtatgggttcaagattttgaaccacggaaatgtattttggggcctgtttatttgtcctgggtctcatgagaaaacatcaactcgatcactcttaggaactttagattgctctcctaaaaagtgcttaaggaaaaaaagaaagaagttgagactgaattcatggcaatttatgggaatgagctaagtgattaagcatttcatgaaaaagaggcccagactaactctatctatttatttacatttcagaatctcagaaaattggcaggcgacctaatgttgaaataataatgagaaggagagtttgctgagtgccttttgtgtgtttctttttggttttattgttgcagtaaaggtttttgtgtttttctcatcttctagatctgttgcctttcttctgagtgaacagtggtgagaaaaaattttgcaaggccccgcttttcctttcttcacaggccagcagtagccatatctgatcaaaaaagatacctgaaggaatattgatcacattttcctgaggccctagcaagcacaggaattgagaagttaggactggaacaactttgtcatttgtcacaattgccaaacattagaatacacaggaaccgttttttcaggtaactctgtgacttggctggatcttcctgatcatcaagattagcacctcggggcctggaagaggttagggagggcaggaagaaggagtgagccagcatccagctctgcgtggggcaggctatggcgtggacagacttaacattccacagcacggctgaaagccctggacctctttcccttgcacccctaattcatggtgataaaaccaaaacatggtgaattaggttattagaacgttggaacatctctgaagctcaaagccctcttatggctatgtgaaggcatacgtggaggcatacgtactccaccctgaagcttctccttcaattttaatgttaatcttaccaagcgacagctttcatcctggttaaggcagctcggtgtgtgtaaaagcagcctggcctgttaaacacaatgccgttaaatcaaactgcctttctttttttttttttaaagtttccttttcagtactgacaacttggaggtagagaaaccaaaagcaatgttttcagaaggccttttgctttcttaaagatttcaaacgatgattgtagttaatctggctgcctgtttgaaaaaccatcagataaatgcccacaaggctctcatctttcagtagcttagctgctgcttgtcagattctaaactccaaagtgcttgactcttccagtgcccaaactaatccttgtttaaattatgtcttcagaagctataactcttatagtggcttgctaaatgataccctttggatctgggctgaagacttccagaatgcccaagtgaatttcaggagcgggctcaatgtttaaccaaattcacctttaccaagggctattcaatccatatctgggatgttttaaataaaactatccaggactgtgggcaatattcaaagttaatatttgttgccaatatgtttggagtgcaagataaagcattataatgtctagacatttttgaaataaaaaagtcttctggttaccaaaaggcattattgtcataggtcatgcaactcagaggtgaaacttgagaaaacagaaagtgactaccaacaggtgacacattgagaagataattaggaatttcctcaatcatacagccctcagcacccatttctcacatcaaaatagaatggtggagccgagtgcggtggcacagcctgtggtcccagctactctggaggctgaggaagatcatttgagcccaggagtactggtctggagcgaactatgcctattgggtatctgcagtaagctcggcatcaatatggtgacctttcgggagtggggaccaccaagttgcccaaggaggggtgaactggcttggtgggaaacagaacaggtaaaaactccatgctgatcagcagtgggactgcatctgtgcatagccactgccctccagcctgggcaacacacaagaccctgtctctaaaaataaataaataaatgaatggaatagaagagaatattgaagacaaggggatgaaggcatgattttaaatgactaaaatggtctgggcatggtggctcatgtctgtaatcccagcactttgggaggccgaggcaggcggatcacctgaggtcaggagattgagatcagcctggccaacatggtgaaatcctgtctctactaaaaatacaaaaatcagcggggtgtggtggtgcccgcatgtaatcccagctactcggaaagctgaggcaggagaatcacttgaacctgggaggtggagattgcagtgagccagtattgcaccaccgtactccggactgggtgacagagtaagactctgtttcaaaaaagaaaaataaaaaattaaaatgtattatggccttaaataatagggttgatttccactttaaaacatatcctgttatatttcagtgaaaatttttatttaaaaatattctaaatattgaaaagatgtattttgggggggcagagataatgtcattccttttattaccatccaaaaactggaagaagcatttcattttgtgaaaactgtgctgcttttaaaagagaaagtccttacttcctgactggacccttcccccacccctgcttctcattttgaggaaaccattcttgaataggcttctgaaaatcttacaagagtaaaatttatttgttcagcatttggttgttgaaggacccagtgcggaggtgacattcgggtgtcagcctcagataatacaatgtgaaatgactgaaaagatgcaattgggcactgccgttctctttttacatgtttttttgtttgttttttgttttgttttgagacagagtctgctctgtcgcgcaggctagactgcagtggcgcagtctgggctcactgcaacctctgcctcccaggttcaagcgattctcctgcctcagcctcctgagtagctgggattacaggcgcccaccatcaagcctggctaatttttgtatttttagtagaggcggggtttcgccatgttggccaggctggtctcaaactcctggcctcaggtgatctgcctgccttggcctctcaaagtgctgggattacaggcatgagccactgcactcagtctcttttgatgttttttaactgatcaactaggtgtgaacagaactggatttttttccccgaagagctgaggctgactggggtgtgacctccttagctgtgtagactgcattgactctactgtgcctagaatttggacaatggcctgagggaccagtatgtgatttaagcataattaaaaggttatacttgagggatagacctgaatctggaagacaactgctaattttctggggcactgaggggtttttgttttgttttgttttttgagacagggtcttgctgtcacccagtctgtagtgcagtggtgccatctcagctcactgcaacttcgacctcctgggctcaagtgatcctcccacctcagcctcctgagtagctgggactataggctcgtgccaacatgcctggctaatttttgtattttttgtagagatggggtttcgccctgttgcccaggttggtctctaaactcctgggctcaagcaatccatccaccttggcctcccaaaatgttgggactacaggtgtgagccaccacgcccggccaacactgtttttatgaaggtctgttcctagaaatggaaaccattaaaaacaatggcaagaagaccctttggttgaggaatgacaagatccaagaggaaaactggtgtgccatggcgccttccaggcagagcaggtgttcagggcagaggcctgggcgggtagacgggctgcagttctggagtgaagacggtggaggctgcattcttttctggctttctgttgggattggcctgggtatgtcctttgacatagcctgtcacagggaatgaccgaaaagattaaaggtacctgttcctcttcaggggctctgttcaacgtagtagccactagctgtatgttgttatttatacttaaattaattaaagttaggaattatgttcctgaagcatgcaaaccacatgtctagtgctcagtagccatgtgtggctagtggccattgtattgggccatgcatatagaacattcccatcattgcagaaagctcatcgggacagagcttctctagaggattctgtgcatttagtgagtgtgataaccccatgacttctgacatgaaaaattagggaaaattaaaagaagcagagggaggcagggagttggggagagagacagtgtggaggagggggagaaggagagatgagagggggaaatgggtaggagaaggagaaaatagggaagggggtgcggagagtgaggaagagactgaggaaggggagggggctgcaccatggaggaggggtgaaggcaggggttgggagttgggactgactcacctaagaggaaattcaggtcagggacaatcatggatggtggcgggggtggagggggttaagctaccatatcctcccccaccccctttttcaatatcttgttgggaaatttgcctaaattgagcaactgactttcctgattcaaattaagtgcatgatatagatacatacagagccccatgttccttcttgaaattcttaatgtggggctattttaaagcagtcattttatttaaaaaaacaattaagttgcataagtgcggcagatctacagaaagaatagaaagaaacctccacaggcaggtgatctaaaatgggggtgaagacaggcaaaaccattttaagggttttcattttttctgagctgggaagacatcaggaagaaggtatacttaaagatgccaaagaaactcactgttcttgtatccacttgaaaatggttttctccttaaaaactgtttcttgtgagatttgaaacattttaacaataactcagagcacacttagaaagaaagtgtttgaaacaataaaacagttcattgcttgttccctggtgtccgaagcaagggagtctatctgacgtaccagagtcaactggtgacatcctcctaaactaggccagttttgatagggcctactgtgtttctaagaacttgtaatctgtggaatatcaaaaatttttttaaaaaggtaatgatgaaatgaaccccaaggacagcttctggggcctgtgcagaaagcaagggtaaacagataagctgagataaacagataagaacatgcctctgtcctgaagtggcagaggccacagggccactggtgcctcggcttccctgagccttctcagctgatctgctgccctgtcctctgtttccggcatagaggttacccttggtttaacggatggggaaactgagatgaaagaaagggagtcagggccgggtgcagtggctcacgcctgtaatcccagcattttgggaggctgaggcaggaggattgcttgaggccaggagttcaagaccagcgtgggcagcatagcaagacccctatctctacaaaaaataaaaaataaataaaaatggccaggcgtggtggctcacgcctgtaatcccagcactttgggaggccaaggtgtgtggatcacttgcggtcaggagttcaagatcagcctgaccaccgtggtgaaaacccatctctactaaaaatacaaaattacctggatgtggtggtgggtgcctataataatcccagctacttgggagactgaggcaggagaattgtttgaacctgggagtgccactgcactccagcctgggtaacagcgaaactccgtctaaaaggtaaaataataatttaaaaaaaaacataaaaataaaaaaagggagtcacttgttcaaggtcacttgaactgtggacttttggggagcaattgcaagtggatctcccctatcctccaaagtgcttttatgttccaaaataaatctttcttccttcctctcataatatatgccaaaacaacaaactcttctcgagatggtagggtttttaagtgtaaatacccatgaggttgtaattgtggaagagaaagagtgtctttgtcagattccctgggaaaaggggcaaattgggaatataatttctgtctcagaccgtgatttcagctgagggccagtttgagagcagttgggtaaattaattcctactaggttgtaaatgactgataggtgaatcctcaaagtagatgtttccattttaaaagtagaactgtgtatcaatacaactgaatctgtgtttgaggacaaggcaggatgcctacatgccatacataagtgcctgtacacacataagcacatgtgtacgtatgtggtatgatcgcctgtggaggcccattacctgtactctctcgctgcctgggcccctcctaccaacacatcggacaagcgaggccagcctcttgcgttatttttcccctcagcatggctagtggccaacgaattgcccccaagggactggatgtgaagccccatgggtggtggtggtggggacagtcatgggagtttaggtgtgggccacatcattggcagcagcaccacctcctttccttggcagaggcaagaggtgggcagcgggcatgccagttcctgctggctcaccacacatagctcccatctgccctgcaccctgcttccctggccgcttactgctccttaggaggttctcgccctcagttacctctgcctgacagtggtaccttatgtgcaggctcaggtttctgcagctctctttacttactacccaagtagggggttagagagggggaggcgaggagggtttttcttgcagattgcagggcatccccaccccctcaccaaagagagggtatgaagtggccttttcccccagaaaagctctctccggatgaccccttgccatttttcagtggtaaccttgagtgtttgcatttagaaaccatgtcaacccgtttgtgtgtgtgtgtgtgtgtgtgtgtgtgttgcgttaatgttgcaactctgcttttcagggggctttgtgaggcaagggagtgtataagagccatgcacttccttgggggtccacagtcagacttgagatcctggtgggaaggcagcctggtgtcgctccctgatgatgagggtacaggaagccatgcttttgatctgctcctgcagagaaggtgtagctctaaacttacccactccaggaagggaaggggagggggtaggagatagaattacccaactgctggatggagagaacccagccaatgtaattgctctgcaagtctgataaaaagtcttgtgaaacctcatttgaaaatggaattccatcctggcatgggtcttagcactgcttctgaaatggaaacaagctggagaaggtcgacaaatgtcccaggaagaacagctttaagtggctgatgcagaaatgggtcctgcttggtcttaatgttttctgttaatgcactcaggaggggcttgttgggatatgtagataacatcccaggagaaggaactcctagctctaggaagaataggggtggagtaaggacaaaggattggaccatcgacttgaatagcaaaggatacctgagcatccaacttttctcaagccaaatgctgttgtgggttgatgccactacccctgctgtcacagattagggagagtgtgtgtctaatgaatatgttcctggaacatagtaggtgttcaaaaatatttccagaatgaatgactgatgctacacagcttgagtatccctaactgaagaatctgaaatccaaaatctgaaactttttttttttttttttgagacggagtctcgctctgtccctaggccagagtgcagtggcacgatctcagctcaccgcaacctccgcttcccgggttcaagcgattctcctgcctcagtctcccaagcagctgggactacaggcacgtgctgggatttttttgtatttttagtagagagcgggtttcaccgtgttagccaggatggtctcgatctcctgacctcgtgatcctccctgcctcggcctcccaaagtgctgggattacaggcttgagccaccatgcccggcccaatatctgaaactttttgaaagccaacatgatgcatacaaaatgatcattggatctgttgcctaggctggagtgcagtggcaccatcatagcttagctcactgcagccttggcctcctgggctcaagtgatcctcctgcctcagcctccaaagtagctgggactacaggtgcgtgccaccacacttgactctttgcaacattttggattttagattttcagatttgggatgctcgaccagtataatgcaaatattccaaaatccaaaaacatcagaaatccaaagcacttctggtcacaagcatttcagataagggatactcaacctgtatttatgttatgtgatggtgaagaagagagccgagaaagtgatatcctcaagaaatggccttggggtcacaatagatggtacattaggatacgattcaacatggttaagaaaggttaactaaggttatagggcaaattggaaaatgttttccaaatgtttgtcttaactctgaaaaatgtttggcaaactccccctcccccctaatttggaagtggtttgttttagtcgttttggaagaaataaatatttgcattagaccaaacatttggggcaaacagttctccccatttctgaggctctgtgtgagtaggaggagatgtttcatgccgataacactcatcccttttttggccaaatcgaaggtaactttcgatgtgagcttcacatgcttttcacataactgctagaatgaggttgagcaaatggaaagaaaagaggaagccaagcagcttgatccttccagacctagggatggctgatgacctggcatttgaaggatgtaatcgttaaagaaaaattgcctttctgctcatgggcagggaggctggatccaattaagacaaggaaaacgtatgttaacttggaggaaaaatttctaaacagtcaattctgtaatcctctctgaagaggaagaggccaacatgatgaggctttatggatggtgccaagccctgtgatatataataattagtaaccactggttattttgccgcacacttattctccaaaccactaaccattgcttgggatggaatgcaccaggcctagatatttgccccagatgtcttcccttcagcagtatccaattagagggatttttacaaattaaagcttaattctctataatatatagcaaaatataaattaaggaaggagaaacccgatttccttggttggttccatgggttacggaggtgagggctagtcttcaggtgcacctcttagtttatgcttcagtggctagtggtgactgttctatatcatggtccttggtatttttgctagtctttttggtagcttaaaaacatttcagaggcgaggcatggtggctcatgcctgtaatcccagcactttgggaggccaaggtgggtggatcacctgaggtcaggagtttgagaccaccctggccaacatggcaaaaccccgtctctattaaaaatccaagaattagccaggcatggtggcacgcgcctgtaatctcggctacttgggaggctgagacaggagaatcgcttgaacccgggaggcggaggttgtggtgagctgagatcgcgccactgcactccagcctgggtgacagaggctcaaaaaaaaaaaaaatttgcaaaggtaatactcactaaagaaagtccaggccagaagtggtggctcatgcctgtaatcccagcactttgggaggctgaggctggcagatcacctgaggtcaggagtttgagaagagcctggccaacatggcaaaaccctgtctctactaaaaatacaaaaaaattagcctggtgtgatggcatgcgcctgtagtcccagctactcgggaggctgaagggagagaatggcgtgaacccgggaggcggaggttgcagtgagccgagatcgtgccactgcactccagcctgagggacaaagtaaaactatatctcggaaaaaaaaaaaagtccaaaggaccatgtaaagcatctctctctgtcttcccatgcacccctgctaccaatcccaccactcagaaataattagcgtcagcatgtaggtgaacgttttcccaaatctctgtatatgcacatacgaacatctagatagaactttacacaaaatgggtcccagtgtacacactgttccgcagctgttttcagtccacaatatgctgcagagcctttccatatctgtgtttatagtttcccatgaaatggatgggtgtcaggaaaaattgtgaaagactttggaagctgaatgctgtttcaatggaatgctgggtatgttctagcagactcttaggggttatccagttctaaaggggtctgtgtttttcattgtctttgactagttttataatatatttaaccaagcccctagaatgagccatttaaattctctaatttttaaagataatataaaggaatatcctacccatgatatattcatctttatgcacttattttaaagacttctgtttttttcctgtgggagtatctgcctaataacatcccctttcctctttgggaagaatcataataatttgtgaaataggcttcagtgaccctagggatgtacaatgtagattttcttatgagaaaggagcatgatacatgtgacatgacatttctgagacctttgggacttaacatccctcacctctgagtaatgagtcatcttttctatggtattcaaagtttgaattagggaaattaaggttgagttcagtcaaagactttagttgtagatgacttttcagttgcccttggattttgcatgtgtaaatcaggcagggggtacactcagaaaacaagcccacagcttcgtaaggtgtcttggatctctcactgtggatcatcagcacaaccctgtgggcctgggaattgtttttgctgttgctgttagtattattctagtttgagaaagaaggaaaacaagctcagagaggtgaagtggttttccaagatcacataccaaggagccacttccccttgtttcctgtggtgccaatccattgcttcgtttttcgtgtttgagagcttttgcgtttcattgtacattgtacaattctagggagccattgttcccatcctaaagctggtagatgtgtaaatgtatcaggtcggggggcagaaagtgtcttgaggaagggacgccccttcctaatcccctccaagtgctgcctgtgctggtgtcagtcctcctgaggtcatttgccctgtctttgatctggcacagtatcctcctctgtggaattctgtagctcttcctctggtaactgctttcactaaaggtttgcatggaatttacctagacaagggccctacggttcccacctgagaatagaaaacgcccattaaaaacagcaccacacaaaacaaatcagtggcccctcctcctgctctgcctccctccgagataagcttggcatgagggcatagtccagagccccacggccttcagtaattttgttaacaattggaggagaatggcattttcttctgggaaacatttgcagatgtgtgagctagctctacatggggaagggctgccccttcactgcgtgctgaggctacgggctccgtgtcctgtcagagtgtgggagggagctcctcacactgaagccagctccttccttccgcaaagaagggatctgagggccaaaaggggcccgcatgggtggccgtgcaggagcagaaagaggctccaaagcaggatgggtcccctggcctggattttcctccagggcagctctgcaactctaacacccatccccaggctgtgtgtttcctagggatacgtaataaagtgccaccaactgggtggtttagaacaacagacatctattgtcgcacagttctggaggccagacgtttgaaatcaaggtgtgtgcagggccgtgctccctctgaaggtacccggggaagacccgttccaggcctctctccttggcttgttggtggctgtcttctccctgtgcgtcttcctcttgtgcatctgtccctgtgtccagagttatcctttgtataaggacaccagtgctattggatcatggcccacttgaatgacctcatgttaacttgattacctccataaagatcctatttccaaataaagtcacattctgaggtaccgggggttaggacttcaacataatcttctttggaggacgcagtgaaccctggaacacaggccctgcctgtactgaagcagcagcttttggggatagcctgtatttttaaaacaggaggttctgaggatgaaccaggcgtgggaactgctgctctatagaaccctggagctggtgggttttctgagtgccttctgagattatcttggacatccagactactctgaccgggtccccaaataggactctgcaggttccctggcagttggtttctgtcttctgctcaaatatttctagagacggggagctcataccttcttctaagcagcctatccgattttaaaccactggattaaaaatatctataataatatatatatattatatatatctatatatattagataggcttcttgcctcacccactaaattgtagacttcctgagggctgacaccagggctttttctttgtatcttactggaactaacgagatgctaaaagtaaacccaagtcggcctgtggagacctggtatgtctggtgccatgttaacccattaggtcctggttctgctctttggaggtatccaggataaatgcaccactctttgcctgagggggcccttctaatattagaagacaactatgatacccactgtagaactaaaagcagaaccccaagtccggcacggtggcactcacctgtagtcccagctactcccaagccaggaagatcacttgagccaggagttctgggctgcagtgtgctatgcactgcactccagtgaatagccactgcactccaatctgggcaacagagtgagaccctgtctcttaaaaaacaaacaaacaaacaaacatagccagaaccctgccctccagattcccagactgggctctcattgtgcattgcagccaagtaacagacataaccaaccttaggataggatttattagcaggtgggaatgatgttgttgctaacatctggcaaagctcaaggcttcataacttgccagaagtgagatccagtcacccactatttatttattaatttattatttatttatttatttatttatttatttatttattgagacggagtgttgctctgtcgcccaggctggagtgcaatggcacgatctcggctcactgcaaccttctgcctcccaggttcaagcggttctcttgcctcagcgccccgagtagctgggattacaggcgcccgccaccatgcccggctaacttttgcatttttttttagtagagatggggtttcaccatgttggtcaggctggtctcgaacttctgacctcaggttatccaactgccttggccttacaaagtgctaggattacaggcgtgagccactgcgcccagcctagtcacccactttttaattttcgaggtaatatggtatcttctcctgctgtgcattgaggcaagatgtttccattccattgaaagcttgatcaaggttctatgagaagttcaaagggaaaaggagagtgtgccactcatgtgctgtgtggctcctctccaagcaaaaccatcctcagctgcataaatgtgcagcttggccaggtgatcctggagtctcttctcacccttcaaatcttgagaatttgcaggtgcattttccactgataattcaactgtgggtacttcagaataaaatttgatgttaatttgaagagcaggcattacacattaaaacaaaaattaccccaagggaagaatgagagccaagaggggttacatttgtagtagaaataaacaggaaaaaaacccgccactgctaattgaactgattctcgcaatccaagaaaggcaaatgcatgattctaatgttttctttagtagattacagaaaggaagattaaatcaaaagtcaaaaataaacagtttgattatcctacactgtattatcttaataaactgtcttcctggaaagtttaaaaatacacagtacttcatctggccaaagaaaacagtaagtaaatattgttgagaaaatgtaagaattttccatctagatgtgaggggtggaaatattgccatgtggacttcaagacatcccacaaggagtgagagagtgataggtattacctaccttttaaggcttgttgtcggggacactgttgtcacatacgggggaagaggttgggaggggaatgggccctatcaagcactcttctgggctcctggcaaaacctcacccagttctgcattctcctgcaaggtttgtctagatactagctgtatcctgactggtgatgctcagatttcatagtttagggtgatgtggagaggactgctgattttcttctctctctctcttttttttttttttttttgagatagagtctcgctctgtcacccaggctggagtgcaatggcgcgatcttggctcactgcaacctcctcctcctgggttcaagcaattctcctgtctcagcctcctgagtagctgggactacaggcatgcaccactgtgcccggctaatttttgtatttttttttctttttttttttgagatggagtctcgctctgtcacccaggctggtgtgcagtggcatgatcttggctcactgcaagctccgcctcccgggttcacgccattctcctgcttcagcctcccgtgtagctgggactacaggtgcccgccaccatgccttgctaatttttgtatttttagtagagatggtgtttcaccatgttggccaggatggtctcgatctcccgacctcatgatccacccgcttcagcctcccaaagtgctgggattacaggcatgagccagcacccggctaatttttgtatttttaatagagacgaggtttcatcatattggccagtctgggctcgaactcctgaccttgtgatctgcccgtctcggctccccaaagagctgggattacaggtgtgagccactgtgcctggcatcttcttctttttcttttttttttttttaattttaattttttttttttttttgagatgaagcctaactctgtcacccaggctggagtgcagtggagcaatctcggcccactgcaacctttgcctcccaggttcaagcgtgctgattctcttctgcttaatttttctacagttggaagtagcaaaaggtggagactagtgatgtgagttctgtcctagctttgttgctaacctgccagagaccaaggctggtaactttgtgtctctgtatctttttttttttttttttgagacacagtctcacgcttgcccaggctggagtacagtggtgcgatctcggctcactgcaatctctgcctcctgggttcaagagattcccttgtctctgccacctgagtagctaggattacaggcgcctgctaccatgcccggcttttttttttctttttcttttttttgtatttttagtagagatggggtttcaccatgttggtcaggttggtctcaaactcctgacctcaaatgacccatctgcctcagcctcccaaagtgctgggattacaggtatgaaccactgtacctggcctgtatcttttcttttgagatggtgtcttgctttgttgcccaggctggagtgcagtggcgtgatcttggctcactgccaccttggcctcctgggctcaagtggttttcctgcctccgcctcccaagtagctgggattatatgcgcccgccagcacatctgactaatttttgtatttttagtaaagacgtttcactgtgttggctaggctggtctctaactcccagtctcaggtgatccgccctccttggcctctcaaagtgctaagattacaggtatgagccaccactactggcctgcctctctgtatctttatcatcacataggaataatgccctattgatcacagagaccaaataaaaaatgtaaataagatggggagtccagatgcaaaccctagtatatgtaaaattttagtatataataggctgggcacggtggctcatgcctataatcccagcactttgggaagccgaggtgggtggattgcttgagcccaggagtttgagaccagcctgggcaatatggcgaaactccatctctactaaaaatacaaaaattagccgggcatggtggcgcatgcctgtaaactcagctactagggaggaggttgaggcaagagaatcgcttgaacccgggaggcagagatttgcagtgagctgagatcgtggcactgcactccagcctgggtgacagaacaagacttgatctcaaacaacaacaacagcagcaacaaacaaacaaacatggtagccttgttacagccaggaaggatggagatagtaaatggggaggtagtttctaaggaaaaaagcaagtcctggttagacaggtagtatgtagggatccactacacatgaaaagatgctcgatctcactagaaatctaagatatatagaatcttagtttggcaataatttaaaacattgataaaggcttatttaaaaagtgtgggtgaataggttctttcaaacattacgatcttgttgctgactagagtgtaaattggtaagtctttgtctcaagaacattttggtaatatagacatcaaaagccttaaaattgggtaacccttgaccttgaagttccacgtctaagattttatcttaaggaaaaattagcgtaccaatgacgtgcaggaagttgttcagtagatgatgtttataatagaggttaattggaaacagttccaatgaccatctgtaaaggatcgatataataaatcctggcatattcaaatagtagactcatacatagctattaagaattatggagatccagactgggcagcatggtgaaaccccatctctacaaaaaacaaaaacaaaaaactaaaattagctgggcatggtggtgtgcgcctgaagtcccagctactgtggaggctgaggtgggatgatcacttgagcctgggagttggaggttgcagtgagccacgatggtgccagtatgctccagcctgggtgacaaagtgataccctgtctcaaaaaaaacaaaacaaaacaaaaaaccaacccgcccccccgcaaaaacgttatggagatctagttcgagaccagcctgggcaacatagtgagacccaatctctaaaaaaaaaaaaaaaattaaaaaacatcagcaatcagccaggcatggtggtgcatgcctgtagtcctagctacttgggtgggaggatcatttgagcccaagaattcaaggctgcagtgagctgtgatcatgccattgtgctccagcctggggtgacgagtgagaccatgtctctgagaaaaaaagaaaaaagaattatggagacctattcttattggcatggagagacgatcataacatagtgagcaggggttaggaaaacccagattatgtacaacgaatgtgcgttacacttaataattagaagaaaaaagatgtcttttttggggagggggtgacaatgccttgtaaatgtaaggccacttgagaggactgtacagaaataaaatccttaaagaaaagtaaacatgccaggtcttctgaatctcagcaagggttggccttcttagcattcctccatgggagattctaggattattccagctgtgttacttcaaggattcttgaaactcttcttggacccatttgttgactgactgctttgatggactgtaaatacacatcattaaggctagatgccttaacgcatctagcatactgttttgactccgctagatgatgacatgtctttgtctttcaaatgcgaatttgatttttcggaaaatcaaattttgttaggcttgatgcgtaaagtggccattttggagctggagagtaaggggcaagaatggggaatgagaagactgggacctttcccagtgccctgtgctgggttggggtttataaaaaaccctccaaggcattggctttgttaggctgggctcttctgggtgtgcagcgttgtgtgtttgttttaatagtaaccaccattattttataataaaatgacggttggtggaaggtgagcactcctatccttggttgacaagctgggcagttgatgaagagatactctgtctgtaatcctttaaccagggatgtgcccagtagaggctagattcctgttatctctgtctagtgaactagtgaccaactaatgagcagggaggggtgctttagcatgtgcaaaatccgagtcaattgaactgacatgattcaagacctcctgggtgtgtaatgctggctggggtacttcaggaatgcaaagatgtgagattctgctcttcctcttcaggaccttccagcctagttgggggaaaggcaggtacatgatcaactccattacaaagtaatctaagtacagaggcagccttgatggggggcagggatcagtaaagctttcatcagagaagtggtcttgagctgtgccttgaggacaggtggctggtggtatgaagacagcatttacagggcccctaactggtgcaggctctgtgaaggaggctttatagagatagatgtatttttcaccacggtccaatgcattaggtttcattgtcttttgcacatgacaaatctgacaggctaaggacacattcaggtaggtgttggagcttggctttgagcttccagcctgtgctgtggggagaattccatcttatgaggttacggggtgtgagggacaaaggttgttggcactggggaaagccaaatggtggtgacttgggaacagcttgtggtggccccatttttctggagcctggagtagttgtgggggagcagggagcaggaaggctgcagaagaatagggtcatatggggaggtctctgagtgtcaggctagaatttgggagttaaggttttaggcaaaaaatagccggccaggtacggtagctcacgcctgtaatcctagcactttgggaggccaaagtgggaggattacttgagcccaggagttccagactagcctaggcaatatggtaagacccatatattagtccattttcacactactgataaagacatacctgagactgggtaatttatgcatgaaaaagggtttaatggacttacagttctacgtggctgggaggcctcacaatcatggcagaaggcaaggaagagcaaagtcacgccttaggatggcagcaggcaaagagagagcttgtgcaaggaaactcccccttataataactgtcagatctcatgagacttactcactgtctcaagaacagcaaatacctgtccccatgattcagttacctcccactgggtccctcccacaacatgtgggaattcaagatgaaatttgggtggggacacagccaaaccgtatcaccccatctctacaaaaaataaaaaaattagccaggtgtggtggtgtgcacctgtagtcccagccacttggggaggactgaagcggatcacttgagcccagggatgctgcagtgagctataattacatcactgtactctagcctgggtggcagagtgagaccctatctcaaaaaaaaaaaaaaaaaaaaaaagagccactgagagtttttcagcagaggaggctcaaaaactacctgtacttgaagacaccagatctggcagcagaagctgtagggccaaatgggcagtggttcttggaagtattgtgggggcttccagggttctgcaaaaaagagggagaggggtgggttggagcagctttggggagactaaatctatagcacttggcacctgataggacatggcggtgagtggaaggacaacactgtaacttttgtgcagcaaaagaaacaatcaacagagtgaaaagacaacacacagaattgggggaaacatttgcaaactgttcacctgacaagggattgatacccagaacatacaaggaactcaaacatctcaacaggaaaaaaacattcctattaaaaaatgggcagatgatctggacagacatttctcaaaagaagacatacacaccactaaagaacttactcatgtaaccaaatactgctgtaccccaataacttatagaaaaattaaaaaattaaaaaacatctaaacataaaaaaagaagacatacaaagatggccaataaaaagtgctgaggccgggtgcagtgggtcatgcctgtaatcctagcactttgggaggctgaggcaggtggatcacttgaggtcaggagttcgaaaccagcctgaccaacatggtgaaaccttgtctctactaaaaataaaaaaaattagctgggcgtggtggtggatgcctgtaatcccagctacttgggaggctgagacaggagaatcgcttgaacctgggaggcggaggttgcagtgagccgagatcgtgccaccgcactctagcctgagtgacagagcaagactctgcctcaaaaaaaaaaaaaaaaagaaaaaaaactcaacatcactaatcattaaggaagtgcaaatcaaaaccacaatgaggtattatctcaccgcagttaaaatggccattatcaaaaggacaaaaaataacaaataccggagacgatgtagagaaaagggaactcatacactgttggtgggaatgtaaactagtacagccacgatggagaacagtatggaggttcctccaaaaactacaactagaactaccatatgatccagcaatctcactactgggcatttatccaaaataaaggaaataagtgcatcaaagagacatctgcacccccatgtttattgcagcactattcacaatagccaagatagtggaatcaacttagatatccaacaacagatgaatggataaagaaaatgtggcatatatacacaacgggaatctattcggccctgaagaatgaagtcttgccattcgcagcaacatggatggaactggagggcattatgctaagtgaaataaaccaggcacagaaagttaaatgctatgtgttctcacttatacgtggaagctaaaaaaaagttgattcatagaagtaaaaagtagaacagataatactagaggctgggaagggtagggggaaggggatagagaaaggtttgtttaacaacacaaaattatagctagataggaggaagaaactcctagtgttctatatctgtagaatgactgtagttaacactaatatgtagtttcaaatagctagaaggaggatattgaatgttcctaactgatatggtttggctgtgttcccacccacatctcatcttgaattcccacgtgttgtgggaggggcccgtgggaggtaattgaatcatggggggcaggtcttttccatgctgttctcgtgatagtaagtctcacaagatctgatggttattataaaggggagtttccctgcacaagctctctttgcctgctgccatccatgtaagacgtgacttgctcctacttgtctcccaccatgattatgaggcttccccagccatgtgaaactgaaagtccaatgaaacctctttcttttgtaaattgcccagtcctgggtatgtctttatcagcagtgtgaaaagagactaatacactagcacaaataaatgataaacatttgagatgacagatatgctaattaccctgatctgatcactgtacatcatatgaattgcaacatcaccatgtaccccataaatacgtagttatgtgtcagctaaaagataaaaaactataatatttgcacccaggtgatgctgcagggcagtcaggagatgtggctggctctggggaaaggtgtcagcttggtctgggcctccctcagtggccaaatggccagtgtgaagtcttggagggtgaagggctcctccatgccagaggcaagcacctggcagtagctttgaagaaatgtgggagcagacggtgtctgttgtttttctggcccacatctaccccctcttcttctggcaacagcacctccatttttcttgggggaccactcctccctgtatttaatccacaaggttgggtggagatgatgtctcattggttccatcagtgagcacatgactcagccctggctgtgcagagccttgattctctgcttggcctcagggatggggatgggattcttggttccaaaagggctgctcttctgctgctggggttgccaagctggtggagggaaacttggagctcttggtggccgttgccacagcctatctgagaataaaggcggcatagcacgatgttgaatcaaaggctgatggggtgggggagagagagagagtcctcattgcattgtttcattttggtgtccagccattctgggggccagatgtacccccctggtttcctgtttgggtgaacgtgtgacttgccacttacagtcaaaggatcctgactcattcagggttaaaagtcacatccttaggggatacctgccttaaagaacccaagacagcaggccagagacatggggcctgggtcaggaggagccagccccctgagtcaaggaaggctggatgtgcacctttgtcccaggctttgcttgagcagagggccaggtgtatttgatatttgccacaaagaatacaatccttaacctggctgcccttgtgagactccaactgtagcaaagaaagattaggaaacaaacatcccagtcaccatggaaatgtgaacccaaggtgttaggaacaatagctgtgtgagtccggaagtggattctgtccacacacatgttggtttgatcccccatctatttccttgtgggggcctgggcatatctgtgaacgtatgatatagccagctgctctagggctgggtgccacctcccattagccttggtttcatcatcaccaaaatagctgtaaacctaatacactgcttatgcatgtcagaacctccttacagcctccctcggaggtaaatattatttttatcttaattccacagatgagaaaacagaagctcagggaggttcctaaactttcccaaggtcacagttgttgatggaagagccagggtttgaacccagcccgttgagtctgtgcttttttaaccaccacgttcctcacgttggtgttgacaaaaaatattactaaaagtagttcattcttactctacatgtcttatttcaattctgccacaaacctatgaggcaagtacaactggttaattccatcttataaacgaggaagctgaggcacagaagacttaggaatcttgcccaagttccaccgtcagtaggaggcaaaagtacatttgggggttacttttttcaggtggatttgaaatgataatgtgtcttaaatttaatttggaagccaagaatgggtgataactgtaattttttcttttcttttctccttcccctcccctccttttcttttctattcttttcttttctccctccccttttttcttttcttttctttcttcttttcttttcttattattttttgagacagagtcttgctctgtcacccaggctggagtgcagtggcacgatctcggctcactgcaacctctgcctcctgggttcaagtgattgtcctgcctcagcctcccgaatacctgggattataggtgcacgccttgtatttttagtagagacagcatttcaccatgttagccaggctggtctcgaactcctgacctcaggtgatcagcctgcctcggcctcccaaagtgctgagattacagacatgagctaccacgcccggcctaattaattaatttttttgagatggagtctcactctgttgcccaggctggagtgcagtgacaccatctcagctcactgcaacctctgccttcccaggcttgggtgatcctcccacctcagccttctgagtagctgggactagaggtgcacaccaccaggactggctaatttttttttattttttttatttttgtagagacggtttcaccatgttgcccaggctgggataagtgtaatttctaaatctggctttcatcagtggtgatgttcttcatgtgtagatttatactagggaaacaaatcaggagggggaacaaggtggacagagaataatagcaacttgatttgcctattatccctggaaaaccatatcctggaactcactagcatgtaagtaattggaaaatgttaaagcaaaagagccaggtttagaaacaaaatcacaccatcaagtctatgtaaatgagttcctcggtgaagagaaaagcaaatgcactgctgtttgtgggctggctggctgtgtcccaagtgctgcagagtgggagtctgggaccagttgttttttcattgagggccccttacaaggcacactcgggttgttcagactccatgaagctcatgaattggctcaataacaaaaagcatgaatcatttgaacgtgaaggtacagggacatctgtttgagtaatttctgacagtttttttttcctttttgaaaatgtgttatatttaggatttacttgagaaataaggtggacttggggactgacagcccatcagtttcatgggaacagggcctgtgtctttttattgctctttttgtgtatgtctgtagacaataggtgctcaataagtactttgtgtaaatggtgactttaggagcacctggattctgccccaggagattcctgaggggctggcaggtaaccaaaggctaatggaggtttacagccaagttccagatggttcaggggcccgaacccctgggtggagcctctcttgggccatatacccattcccatgcctggctgtcccccatcccttagaccgtggctgctgctgctggactgtgttctcttgtgcagatattaacggtgccaaatagtgccagggcccaggttgcagtgggctccttattgtcctgtaatctcagcactttgggaggccgaggcaggctgatcacctgaggtcaggagttcttattgtctagcccagaggttgcaaactgacctacacactattttttttttcttttttttgagacggagtctcgctgtctctcccaggctggagtgcagtggcgcgatctcggctcactgcaagctccgcctcccgggttcacgccattctcctgcctcagcctcccgagtagctgggactacaggcgcccgcacctcacctggctaattttttgtgtttttagtagagatggggtttcactgtgttagccaggatggtctcgatctcccgatctcgtgatccgcccgccttggcctcccaaagtgctgggattacaggcgtgagccactgcgcctggcccctacacactattttaaaaatcgggaaatttcacgtaacctttctgatttaagacttcttttagataattcaaagttttggcgacattaggtaagaatttttgtgtagcagcatttgtctgcagttaatttttttcttttttttgagacggagtcttgctctgttgctcaggctggagtacagtggcatgatcttggcttactgcaacctctgcctcccaggttcaagcaattctcctgcctcagcctcacaagtagctgggcacacgccactgcacctgactaatttttgtatttttagtagagctggggttttgccatgttatccaggctggtctcgaactcctgacctcaggtgatccacccactttggcctcccaaagtgcagttaaatattgattgtctcttttgtggcaagattccagtctcttccttttaccacaggccacaatagttcctcttgtctcatatcaagtcccctttactcatttatatcacctgaccagcctctggtttcagggcctgtcttctgtagtgtatttgccttaccttttttttttttttttttgagacggagtctcactctgtcactcaggttggaatgcagccgcgcgatcttggcttactgcaatctccgactcccaggttcaagtgattctcgtgtctcagccacttgagtagctgggattacaggcatgtgccaccattcccagctaagttttgtatttttagtagaaatggggtttcatcatgttggccaggctggtctcgaactcctgcactcaagtgatttgcccccgttggcctcccagagtgctgggattacaggcgtaagccatcttgcctggcctgtatttgccttacaaactgcaagtgatctaaaaagaacaaattctcatttgaaaaaataagcactatggccagcacaggactgacttaaaacataatttcaataggcactgattttgtcatttaatgctgagaagaggcaaaaaccctatatggattcttagaaataggactatgttggaatggaagagatggcaggcattgatttggagtctccagcatactaaagggaagggctttcttcaaggaaatgaaaagtgataaagaaagctacttgatagaagtattcaggggcttgaaggcctttcaacttcagggagccggagagggggagggaactgaggagggcaggtcgggtggggtggggaagagagagagacccttccatctcagccttccccactccccatgggaacactggaaaatagaaaggacaaaggaaatggaagcaagtgcgctgggaaatgcccaagtttcagcttgaatgatgctgtttacatgttcttacaggaaagactattatgggccagctgttaatgggttgtctgtctgtcaagagagagagggatggaggaaggggctggagttgagggatggaggaaggggctggagttaaggcatggaaagggctctaagccttgcttcttgcatttcctgtctttaaacttacgaactaaagggcttgagggtgagggggtgctgatctagggaggaaggaggttgctttctgtgtgcgtgtttttctgtttcatgtcctgactatttcctgggtccagagagggttttctggtctgaagaggagagtgtgcccctcacagtagatggggtgacagacagttctgccctctgctgtgctggtgacagccgggagggtcagactttatcagtttcctgggtggagggtggacgggaagcggggggccttctgctgaagatctcaattaaactttggactggctcatccagggaggtggcgcgatttcctctggaggtttaaaataaatagcaggtacttgatttcatctggaatggagggtgtggccctgcctggcactgggatggacccaatggtctccccagccttctttgttctgatactacacaccccacccctcaaccgcctgagaaatttctggaactgcgtttagtctcagtacattaggattattgctagaaataaagcatccctggatcctttggcttcttggacaatatgcaggaaaacacccgccttctcttagacatgtagggttcgcgccgttgacctgagcttcagtgccagagagtcgagcaaagagaatatcacttttacttaaaagtgaactgcacgggggttgactctttcaaggcctgagattgatgcactctaatttgccatctggaattggttagccacattcttctgggctctgatgagaaatgatgaccccggagaagggtggtcatatggccagtgtcaggattaatagaatcccctttcattcttgaaagggtccctgtttgggcaataaagttgatggttactctaccatgaaagagcagaaaaagctgagcagaaaactttgttttggaaaagggggtgttgaagccaaggcattagagaaacgtgatttttcatttaattatatatatagttttcttttttgtaatctaaatgacatgtgcaaccttcagagcctgactccttgctggaaagagagaaaggaggttttgttactgagaagcttattttaaaagtcaagtcgggtataataaaataaatgaaataaataaaagagctccccagttaagggcctttcccatgctggggcttcgggataacaagagcttgaactgccttctgtcacatggggcaggtccttaaggagcagaaggttttttttttttttttgagacacagtctcactctgtcacccaggctggagtacagtggtgcaatctcagctcactgcaacctccgcctcccggtttcaagcgattttcctgcttcagcctcccaagtagctgggactacaggcacctgccaccgtacttgactaaattttttgtatttttagtagagatggggttttgccgtgttgccaggctggtctcaaactcctgacctcaggtgatccgtctgcctcagcctcccaaagtcctgggattacaggcatgagccactgcactaggcctggtttattattatattttaagttctgggatacatgtgcagaacgtgcaggtttgttacataggtatacatgtgctatggtggcttgctgcatccatcaacccatcacctacgtttggtttttctcctaatgctatccctcccctagccccccaccccctaataagccccggtgtgtgatgttcccctccctttgtccatgtgttgttattgttcagctctcacttatgaatgtttggttttatgttcctgtgttagtttgctgagaatgatggtttccagcttcattcatgtccctgcaaaggatgtgaactcatccttttttatggctgcatagtattccatggtgtatatgtgccatgttttctttatccagtctgtcattgatgggcatttgggttggttccaagtctttgctattgtgaacagtgctgcaataaacatacgtgtgcgtgtgtctttatagtagaataatttataatcctttgggtatatacccagtaatgggactgctgggtcaaatggtatttctggctctagatccttgaggaatcaccacattgtcttccacaatggtagaactaatttacattcccaccaacagtgtaaaagcattcctatttctccacatcctctccagcatctgtttcccgactttttttttttttttttttttttttttttgagacggagtctcactctgtcactcaggctggagtgcagtggcaggatctccgctcactgcaagctctttcctctgggttcatgccattctcctgcctcagcctcctgagtagctgggactacaggcgcctgctaccatgcccggctaatttttttgtatttttagtagagacggggtttcaccatgttagccaggatggtctcgacctcctgacatcatgatctgcccgcctcagcctcccaaagtgctgggattacaggcatgagccaccacgcccggccttcccaactttttaatgatcaccattctaactggcatgagatggcatctattgtgtttttgatttgcatttctctaatgaccagtgatgatgagcttttttttaatatgtttgttggccacataaatgtcttcttttgagaagtatctgttcatatcctttgcccgctttttgatggggttgtttttttcttgtaaatttaagttctttgtagattctggacattagccctttgtcagatggatagattgcaattttttttttaagtgacgtggtctcaccacgtatcccagtctagacttgaactcctgagctcaagcaatcttcctgcctcagcctccctagcttccaagtagctaggattacaggctcaagccactgtgcccagccaggagcagttttgaaaggcaaaaggaccatgactgaatgctgcatatctagaacatccaggaatgcagatgcccaggccaaagggctctggggtcggagcaggcaggattgtgccgggggctctcaaccctttgctgggggccacttgttctctccttaaccgtggactattgcaaagggtggagatcggagactggaaaaaaatccgtgttctagtcccttgttgcgtgcttcctggtggactgacctgtagcagatagccctcctcctccggcctcagcttcctcgtctgtgacgtgggcagggtgccgtcatctatccccggggcttctgtgagaatcaaatggagaagagcaaaggccacgtgaggggttggctctgtggtccctgtgctcatagactgcggtttcctacgggcaaaaggggaaagtgaccctagaacacctttgtgtcagggatgcatgccagatggcctttagtgcactctcttcccagccctgtcagcaactgacaggttcaataagactttgccaaaatgttcaactagcttttcctgatgcgggtctttcttcaaattctgtcccacaccgttaactgcaaacttctttcagaacacctttcacgaaaatgaagctggcatagctgtggaaagagttgatggtagtgttgtatataattgtgaaaattggcatagtggtgggcacataggggatgttcattcattcacccagtgagcctttcactgtgcccaggccctgagacagtcggggtggctgggaacatggtctttgccttgattgtggaattgcctgcttgagggaatggcctgcaaatcacacaggtggagaggaggaagagccgttttcctccgccctcttaggttcattggttgggggttacaaatgaagttgacaaaagattaacaagagaaaaaatggatttaattggattcttaggcactggagttcatagggaaatgtggctcaaggaggcagctaggatttggggcttatataccatcttaggctaaaaaagaaaaggagttttgggcttctggagggtagggaagccatgggaaggtaaggggaggaaatgtatggtaaataagggttgtttagtaggtaagagttgtctcaggtgctaagagttgtctgcttttcttcctgctgtgggggaggagggagacatctttacaagtagaaatttatgccctgcttttaggcagaagaagggcagagagctaattgccttcagctgaaaacaattcttatgccaaagtggtatattttcgggtggcatattttggtcccctttattaataacttacaccctattaaagaagaataacgactgagtgaccagagattgaatgctgagtggaaaagttttactgccaggtggggagcccgatctagcttagtctcagctctgagggatggaatcggagcgggggcaggaatgatgtaggtttttcatagctgaaagcccacaagctgtgctgcattgacgtcaggaaggcagtcttgccgagcactggtgcctgcctggccacacctgagcttgtcagtgagctgggtacctgactggctgacagtgctctcctgcatccaagagctgccctggcatcatggtgcccagtgtgtctgctgcacacgagatacaccaaagcaggtgatatggttagggctttgtgtccccacccaaatctcatcttgaattgtaacccccataatctccacgtatcaagggagggacaagttggaggaaattgaatcatggggatggtttccaccttgctgttcttgtgaactatcttgtgatagtgagtgagttctcatgagatctgatggttttatgaggggctctttccccttggcttggcacttctccttcctgccaccttgtgaagaaggtgtcttgcttcccctttgccttccgccatgattgtaagtttcctgagctccccccgcccccagccatgctgaactgtgagtcaattaaacccccttcctttataaattacccagtctcgggcagttcttatagcaatgtgaaaacagactaataggccaggcgcagtggctcacgcctataatcccagcactttgggagggtgaggtaggcggatcacctaaggtcaggagttcaagaccagcctggccaccatgatgaaaccctgtctctactaaaaatacaaaaattagctggacatggaggtgtgcctgtaatcccaactactcaggaggctgagacaggagaattgcttgaacctgggaggtggaagttgcagtgagctgagatcacaccactgcattcccacctgggtgaaagagcaagactccatctcagaaaatggactgatacagcaggattgtggcacccagggaggtgtgctctgtgtcggcatgttaggtggccaggtcgagtttgtcccatctgatgggttatgtacctattaaaataatatagaatcatgaaaaataatatataaactcataaatgcaagaagtagaacattacaaaatcccaactatagtgcttagaaaccctttgacagcaactgatagcaactcaaatataattagtgtatacaaaaaagagaatttatggattcatatgtctgggagtattcctggatttctggatccaaggattcaaacaatgttcccagtttttctttttttttttttttttctttctgtccctatctctcagcttgcttgtctttcctctgcttaattcttggctgggtcagggggtcaaagaacagcttgcttaacaaccccaaggcaaatagagcttcttttctgaaaaccagcaggaaagtcacggaaaggactctcttgggaaggatggtgggggtcatgtggaatgacttactgaagaaggggatgaaggagtgccacacagtgaaaaccacaactgtgtgagcacgaggcacccctgataggacctagtggttcatcagtcacttctctgcctgagtggtaggagcctagattttatagttgttttcaatgacaaaaatcatagtttataaaagagcataatctgacccagaggtgtcctttctgtcacgttatgattggggacaaagtagacatgctcttcagcttgatcatatagtagctaccagggtttagtacactgtctctataaagggcagatgataagtagttaaggcttatgagccatatggcttctgttgcaggcactcagctctgccattgtagtttgaaagcagccacaggctatacctaaagaaatgggcatgacagtgtgccaataaaactttatttacaagaacaggtgttgggccagatttggcccacaggccttatcttgccatccccttgatataaacatgactgaaaaatttatattctaatagaccataagacactgctctaaagtaaattgtatatttttaaatcatgtgtctgataaggagttaagatgcaaaatatataaggaactcctactattcaataacaacaacaacagcaacaaaaaacctgattaaaaaatgagcaaaggaattgaacagacatttctccaaagaaggtatacaaatgactataagtatatgaaaagatgctcaatatcactagtcattagaaaaatgcaaatcaaaacctcaatgtgttgcctgggcaacaaagtgagacccccatctctacagaaaaaacaaaaaattagccgggcatggtggcttgggcctatagtcctagctacacaggaggctgaggtgggaggatcatttggacccaggaggtcgaagctgcagtgagctgtgattgcaatactgcactccagcctgagcaacagagttgagaccctgtctcaacaaaacaaaacaaaaacccaaaaaaccacaatgagctgtcacctcatacctgttaggacagatattataataaaaacaaaaaataacttgttgatgaagatgtggagaaatgggaacagttgtgcactgttggtggggatataaaatagcatagtcagctactatggaaaatagtatggaggttcctcaaaaaattaaaagtaggattaccacatggtccagcaatctcacttctgggtttttatccaaaagaattcaaggctgggcgcggtggctcgcacctgtaatcccagcactttgggaggccgaggtgggtggatcacgaggtcagaagatcaagaccatcctggccaacatggtgaaatcccgtctctactaaaaatacaaaaaaattagctgggcgtggttgcgtgtgcctgtagtcccaggtactctggagactgaggcagaagaatctcttgaacccagtaggcggaggttgcagtgagccaagatcgcactactgcactgcagcctggcgacagagcaagactctttcttaaaaaaaaaaagaattcaaatcgggatctcaaagagatatttgcactcccttgttcattgcagcattattcataatagccgagaggtggaaacaacctcaaagtctataggtaaatgaatgaaatgaaaaaactgtggcgtgttcgtgcaatggaatactatccagccttattaaaaaggaaatcctgccatagccacaacatgtatgaacttgtaggacattatcgtaagtaaaataagctagtcacagaagaacaaataatgcacaattccattcatatgagaaatttatagtagtcaaactcataagagaatggtggttgccaggggagagggaaatggagaattgttgctcagtgggtataaagtttctgatatacaagatgagaaagtttgagaggtctgctgtataacattgtgcttatagttaatcatactgtgcacttaaaaatttgttaaggccgggcgcggtggctcacgcctgtaatcccagcactttgggaggccgaggcgggcggatcacgaggtcaggagattgagaccatcctggctaacatgatgaaaccccgtctctactaaaaaaatacaaaaaagttagctgggcatggtggcgggtgcctgtagtcccagctactcgggaggctgaggcaggagaatggcgtgaacccgggaggcagagcctgcagtgagccgagatcatgctactgccctccagcctgggtgacagagcgagactccatctcaaaaaaaaaaaaaaaaaaaaaaaaaagaaaaaaagataaatttgttaagagaacagatctcatgttgtgttttttaaaatcacaataaaaatatacagttatcccttagtatcctttggtcattggttccaggtccccccttatatactaaatccatggatgctcaagtccctgatataaagtgacatagtattcacatataacttatgcacatcatcatccaaactctaatctctggattacttataatacctcatacaatgtaaatgctgtgtaatagttgttatactgtgttgttcagggaataatgacaagaaaaaagtctatatgtgttcagtacagacggctttttttttccccctcaagagttttcagttggagggtggttgaatccatggatgtggaacctgtggatagggagggctgactgtatgtgtataccaaatcatgtaaattttataatagtttattttttgttcctgatgtaatgggaagcatttggaaaacataaaattgatcccatcacaaaagaggaattaagattgccttgggttaagggttaagtaatgtcctatcaccagttaatctgccaaggatgttggtcatggccacattcaagaagtggtgtctggaggccacaatgagatggcccagttcagacatcggctagaattgtgtggcagagcgtacaattatgtcacgaatttgggattagcatggcatacctagttgaggtttaaagctccctcctgcaccttccaaagcaggtgttgcttggggttgaaaaccttcactgtttggtcaacagaaggccctcacagctctgatgggaatgtcacctgagaagggctggtctcctcgtggatttgcatttccgcaccttcagacactgcctcagccagctgctgttttaactggcacagagggcctcgctgagagcctcttgggttctatccagatctgagaaggaatctgggatgccggggtcagatccgtgccctggcccgaggatgggattttgtaccccgttgctttctgcagttgtgatgaggtggtgcttggcaatggcctggagctcggcatctgagtgactgtccgtcctagggcgtccaactccagacctctcttacccaggccagcggagggcggaaactctgagaacattccattagaataagatacgtttaataagagcaatggaaaatggtaaacctgacttggggaaagggaatgtgctctttcatgtaaaacaaacaaacaaaaaatgtgactgtgagaagcatccagaaaaatacgatgacctggaggctggatttaaaattggcactgagggaaatctcatttccacagtcgatgactcccccttcagctatgttcatgccagtggagcaaaccaaaataactttataaattaaagtttatgtagtcaggaaagctatgcctggactatcacacaccagatgaaacccttgaaggctttgtttacaaccgacatcctggggttggaggttaatagtgtctggagaaggttaggtcatgcacatgtttaatagcaattaaaacaaaatcactggtgatggtcaaagagacacagctatgtttatttactatagtttatgccacctttgtttgtttgtttgttttgccctctggaaaaaatgtctttgtcctgccataattaattgtaaccagcttttgtttagagggggccacatggaaactgctcagagagctcaaagtgtgttggcaagtggtgacttgtaactagtacctcaatcattttcttttatgatacacataatagaaggatgcatttgggatgtaaaagtttcaaattataggggcacatatatatacagacaatcatgaaagtcccccccaccctgcctggctgctgacatttggtgataatctttccagacatctttctaaatgctgactgtttatatgtgagtgaacaagtgtttatatccatatgcacacaaatacgtaattagctttatttttattttaatttcttttgagacagggtctcaggctggagtgcactggtgtgatcatagctcactgcagcctcaacctcctggactctagcaatcctcccaccttggcctctgaaggagctgggactataggcatgtaccaccacacccagccaatttttaaatttttgtgtggagaaagggtcttgccatgttgcccaggctggtctcaaactcctgggctcaagcaatcctcctgcctctgcctcccaaagtgctaggattatagaagtgagccactatcgctggctgttgtcgttatttttgatccataaaaagagggtcatgatgtgtgtgttgatgtacagcttgcttttttcacttacacatccagagttccttcacactggcccatgtgcagatgacatttttttaatcctgcagggcgttccataatatgaattctgttcctaatttattgagccatttcctcaccctttctttttgatactaaatgaagcaatgatagcatgagattatgaatgtgccttgtggagcttagactgcctggctttgaaacaggacttagactagatgagtgacctagggcagggggtggcaagctatagcctccatggcaaatccaccccgctgtgtttctgtagggcctgtgaggcaagactgattttttcatttttaaatggttaaaaaaaaaaggtaagtatttcctaatatatgaaaacggtgtgaaattcaaaattcagtgtccattaacttgttttgttgaacagcatgctcatttgtggatctattatctagggcttttttcatgccacagaattgagtagttgtgacagagaccatatggcccacctagaatatttaccatctggccttttacagaaaacatttgccgacctctgacctagggcaagttactaatctctccatgtctcaactttcttttctttaaaatggagatactagctgggcgcggtggctcatgcctgtaatcccagcattttgggaggctgaggtgggtggatcacctgaggtcagaagttcaagaccagcctggtcaacatggtgaaaccccgtctttactaaatatacaaaaaaattagccgggcatggtggcgggtgcctgtaatcccagctactcaggaggctgagacaggagaataacttgaacccaggaagcggaggttgcagtgagccgagatcgtgccattgtgctccagcctgggcaacaagagcgaaacttcgtctcaaaaaacaaaaaacgaaaaacaaaaaggagatactaataatacctaccttgtagggtgaagtgacttaatatatatatcaaataaatatcatatgtagaatacctactttgtaggcttatctaagttacttagtacatatatcaaataaatattatgtgacacaccaggtatatcatgtatcaaatatgtatgaattgtgtgtaaacactttaaacattttattttattttattttacttatttgagatggagtctcactctgttgcccaggctggagtgcaatggcgcgatctcggctcactgcaatctccatctcccaggttcaagcaattctcttgtctcagcctcctaagtagctgggactacaggtgcgctccaccatgcccatctaattttttaaatatttttagtagagatggggtttcatcatgttggccaggctggtcttgaactcctgacctcaggtgatctgcctacctcggcctcccaaaatgctgggattataggcgtgagccactgcgtccagctgactttgaactttttaaatgctcaaaaaagtttactattactgtgtcattgttattgtaagtgcataactctttgtgcacgtgtgcaaggatgtcacagatacctggcagtgggcttaaagatgaagggtcttaacaaattgccttccagaatggccccactaagtcatgctcccaacagtggagtctctgctttcccgcattcttggcaactctggatagggactagggcttagaaaagaacactgaatcctcaaagagcctctgacctccacagaggctcttcagagtctaggagtgctgtgcccagacctgtggggtgaatctccctggaaagccttcagtcagaacatgctcattgtttgttgagtgagagtctcttctgtgttaagcctttgacctgtaaattttcattttacagatgaagaaactgaggggctcagagaaattaaatcacctgctccaggtcctgaagctacttgtggatgtagggtttgaactcagttgtgggggccttcatacaactttctttgccattctccctaattccaggaaggataaggcaacgtcagagatagtcattttctttaactttttctttttcttttatttgaggcagggtctcgctctgtcacccaggctggagtgcagtggcgtcatcacaacctattacaaccttgatctcccaggctccaggcatcctacagcctcatttaaattttttttttttttttgtacagtcaaggtctcactttgttgcccaggtcttgaactcctggactcaaatgatcctactgcctcggcctcccaaagtgctgggattacaggcatgagccactgtgcctggccctacaccacatattccatccacactttttccttaagtcagcaccttgatgactggatcagagctacacacaaaattggaagtgaacgttggagaaagtggcttagtcatgacctgtgtttatctcctcttgctctgagtaaagaggatgtgtaatagagtatgttactatatttttcatatcccgatgccatagcctgtgctgcccagtcacactgagaacaatgcagttctcatagataacccgttgttgggtgatatgtctatttctaggcatctccacgctctcctatcgagggcctttgcaacagtatttcccatgttccatcagcgcgtctgcaaaacatgaagcagcttcattcacccagagactcctgaccttgtgcatgaggggaaaatgtttctggttttgtgtgtgttttcaatgacgaacatttgcattctttcctcccctcactttttttttttctcacgttgacattaagaaacaacaacaaaacgctgcttgctcccaaactgtttgaatttaaaactctgaatcttaatttgcatagacagtagttctttacaaggaatgtgaaccatttgacagaatttcctgaaggaacaaagagccatgatttcctgattaaaaccatgttaaaacaaaaagcagactataaccaaaaggctctgtaagagtatttcttgttcaatcagatttcaaaggcagcacaagctggatgtttatggcatcaccaatgcctttctgtgatgcctgagcttttcaagaacatactcagaactttgtcttaagcctgtctttactcggagctgtctcccgaagccttggccttcctctccgcagcttcagttactgagtcactggaacagaggaagaagcccaggcttccattctgacaggctgcgaacatttatctggagttgtaattgtcatactcccacgttattttcttgctgtcttctaaagcgatgatgaaagatgtctgggggaaagaaaataaaacaaaaaaccttctagcatctacacacctaaagcagggtttgtcaaccttgacaccgttgccatctggggctggataattctttgtcatgggggccggcctgtgcgttggatgatgtttaacagcatctgtggcctttagcttcatagttatgacaaccaaaaatgtctccagactttgtcaaatgtcctcttgggggtaaaattgctcctggttgagaaccactcgcctcgattttggtggtctagaatttgcaagctgcttctccgccctgtgcatatccaatcctcagcccttccactaaggattagaacttgattttcttcttttcatcccaccctccctgccttgagatattgctgcatctggacagatgtgccaagtacaattctggctcaggtgactgaagtctaagtcagacatatgtcttcactctccctgaccatccctcttgctgctggcctgcgtggcgtgctcgtgccgataggggcagctgtgtgagtagcaggaccatcctggagacagccatgcaaagggaaaccatctgggtggggtgagcttgccagccccagctacaggtcctggtggagttgacagttgatggatcactgtgctgtgacctctgggcagcccaggcctgcgacgggcagagagctgtcttgtttctccttttggaacctgaagggcagagacagggtgaagttgccaggagaggctttcagctggatcctaggggccagcgtgcagccctttcccagggctgggggtaggggagaagtgtctctctctgggccgtgtggatgggccagaaccctgagctgggtgcagagggctacgctggagaggcggggaagggcactggaccgggtgtctcgagacctgggcatggttttagttctaccccgggtagcagcacgatcttgtgcaaatagtgtcttccttctggtcctcatgtttctcgtaaagctgacttccaactagaacagtctacctttctatttttctcctgatttgtagaaaaagatggtgctgttaagagacggaaatgtggccttcctaaatttgctttgagtcctgagttcctgatttgggggcaagtgtctgtgaagggcttggggtcactctgtggcttttgcctcatttttatgggtcgtagaggatacctcaataaatagcatttttcttccctgaacaaattgagagatgaggccatggttgaaactttgaactttggaacttgcccagatgtatcaggtcagtcaccctcctcccctggggccaataaaccaagtgttccaaaggccaggtggtcttagggaaaatgatggaccctgaagggtgagggtcatggccagtgtggactacagaggatcccctagccacactggagaggggacagtgccctggttttcctgatacgcccccttagtgctcaaggctggtttcaaccctgctgtactaatctgctgatgagggagagttggtggctcagtggtgacagcacaggtttgacagagggtgtctacaccacccagtgcccccttgagctcacatctgagggtctgttgagattacagaggcccttgatagagtccgaaatttgaaggacaagcaaggaagattggagcatctgtgaactatctccagttcagcattgcattagaaaaggaattacatcaggtcactgatgtcttctcctaactcagtgatctccacagccccctggatcctgccaggcctgtggagaagagggacaagccagcctccccaccacccctgccctccgttccttttatatttaaatcagaagcttaggctcctccgtgtagctgctctatttttcatgcctcttgcctgggtctaagccctggagcttagggtgctgtgatatgcttgcgggatgctgccccaccacggctggaaccagggcttcagcccggcgcacacccagctcgtttggaggtcacggctcaccataaaaatggtgtgagtggccagctcttttttcactgtggctctgggcagcccagcccagctccggggtggatgcaaggcctgagagtgaactttgttgtgaatgatgacacaattccagaaaaatgcagtgtctcccagatacggcttctggagctttgcctggggtggggggctggaggttgtttagtgtttgggttcctggtggttctttgccccaggggtgtgtgtgtgtgtgtgtgtgtgtgtacacatgtgtgtgcgtgcatgctttttcatgaggcacacttattttcagatgttcacatggactctttttgagattccccaggggaaaaggagaaagtacagaaagccgtgacacctgatggaaaatattacgctttagtcaacagggctgatgtgtctcctctgactttgcctttaaaccaaaccacaccacagcggggaaagatgagccacacatgaggcctgctgggccggtgactgtcccctaaagtgggactcttgtaattctaagcgcctttgaaaaatgctttcagaatcatccagtacttgagttgtagggggcctgaaaggtcatcttggcccagtggcttgttttaaaggaggaggaaactgagggccagagaggacctatgaccctcccagggttgcacagctagaactcaaatcctgtctcttgatcctcagagaagggtttggtctgttctgttctgccctactttagtttttagacagtgtattgtgataagttttagatttttttttttgtactctgctcttattcattcaacaactctggggatttactggggaacaggcagacctggtccttgtgctcagggggcttacagcctaatgggaaaggcagcttggaacaagaaaccgtgcatgggatttgtagcgggtgtggctatcttatttctggccagtatggggagggagaaggggtgggagttgatggctggggcacggaggatgtcatttcagctctgtggcctgggtcaggtgcccagcccagcaatctgagtgtggatgactctggactatttctccaggaggaggtgggattcacaggcagagacatatcaaaacagggaccttgggatgtatgatgtattttgtaagaaaaaaatggaaaaacaggccgggcacggtggctcacgcctgtaatctcagcactttgggaggctgagacggatggatcacctgaggtcaggagttcgagaccagcctggccaatgtggtgaaaccccatctctactaaaaatgcaaaagttagctgggcatgttggcaggtgcctgtaatcccagctactcaggaggcttaagcaggagaattgctttaacccaggaagccgagattgcgccattgcactccagcctgggcgacagagcaagactcagtctcaaaaaaaaaaaaaaaaaaagaaggaaaaacagagtagagcaggaagctctgtgtatgtatgcgcaggtaaggtcgtcaggtgggaggaggccaggagatgagccatttggaagcccggaggtggccttgacttccctgatgggaggagagagagctgctgggagagataggatccagggaggggtgtggcacaggcttctggagggacagcagctatggccagaggtggatctcttattctcaggggtatcagggacccaggctctttccacttggaacacaagatagcaggggcctttgtcaccagcaggatggaagctgacacacaggacaccccttccaggaagctttgtcacatcgacttcacctaactccaatgacctctcccttctgagtccctctgcacttagaggctctttctgtttggactgagtggtggttttggaaaggctcttgtgtgattttcactggcgtggactcttccccagatgctcactttgtactaacaccgctggctcattatcacagagtcatggagcaggcactgagactcagagagctctgtggctgcgcaaggtcagggtaaaggtgggacttcagcctcaccagactccagagcctctggccgttcccgccatgcctgctgccccctgtcctggtgtgttttctgcccattctcccagacacgggctccttgagggacaaggtggtgagttagccctcttgcttcgagccatcatttatcatggattgtgctagcagtcgtaggtacacagacgagcaaggcctggctttgccctcgagagctgaccgggttgtagaagctgggatgcagggagggctctgggcccagggaacaaccacttgaggcagccagggaaggcttcttggaggaatgacacaggagctggcttgggctatatagtctctcactttgctgaacttccatttcctagtaagtaacttggatatgactgtgaagttattgcaaccattgtgtaaaatagttattcaagcaaaccagtttgaaaccctttgcaaatagaagacaccgagacttggtattgacagtcctctgtcaggagaggatcccagtcttggcccagcctccactgcacactgtcccaggaaagcctcccagagccaccctctcgctgcctgcagggctgcccttcagtggcctcgactcctgtggagactctgcattcccggccagatttgcctttccctctgggcggacccccccacacacctcacagcaccagcctgggagcttgggagggggcgtgaaaccagcaggtgggagtctggagtcctggctccggtagtcgccagccacttcttgtcccctggtccctcatcctccatcctctaggcctactcttctctttgcagaaaggctccttggggttcagagaatgtaggaaacttgttggagctcacacagctgagtaacaaccaggccctgctgcctcctgtacacagtatttcctgctgctctctgggtacatggagtgggaaggggaggccctgggccacagcaccccacccctcacctctatcgcaccccacccttcacccctattgcaccccacccctcacccgtcgcctctttattctatctctgaggtcgtgactgtgtctctggtaatgaatattttgctttggaacatcccccctctttttattgagagataattcacgtaccataatattctccactttaaagtgtaaatttaatagtctttgtacattcacaatgttgtgcaaccatcaccactatctaattccaaaacactttcatcaccatcaccccaaaaagaaaccctggatctaatagcgatcacttcccacttgcccctaccacggtccctggcaaccgccaatctgggttgtctctggatttatctattgtggacatttcacgtaaatgaaataatacaatatgtggctttttgtatctggttaatttcacgtagcatagtgttttcaaggttcatccatgttgcagcctgcatcagtgattcattactttttgtggctgaataatattccattggatggatgtaccacaatttgttaatccactcatccactgatgctaccttcgttttaacttcagttacagcctcctgctgtcccttgagttctttggggagtgttcttatttttaatttctctaatggaaactttggtcagtgttctccacctgtaggctgggtattttgacatgttttccaagtggcttctggaaacacggaagcagtgattctgaaatggaaaagagaacattctctcccataggcccccctgtctgatataactccctggtggcacgcctcagtgagggtggcaccatcgcaggtgggagggagtatgtctatttcaaaagtgctggggcaggggccgggtacggtggctcacacctataatcctccactttggaaggcggaggtgggtggattacttcaggccaggagtttgagaccagcctggccaacatggtgaaaccctgtctctactaaaaatacaaaaattagccaggtgtggtggcggatgcctgtagtcccagctactcaggaggctgaggcaggagaatcatttgagcctgggaagtggaggctacaatgagccgagatcatgccattgaactccagcttgggcaacagagcgagactctgtctaaacaaaagaaaacaacccccaaaaaagtgctggggcaaagtggctgagcccactggtgaaaaggcgctgtggatggggtgcctccgacttgtgtgcagctcctcagttatggctatgccctggctgtgacaaggacaggattctggcacagctagtctaagatcatgttttggggtccttgctcagagtgttgccttcattctcttttatttttttcccatttatttagtgaaaatgtaatttatatacagtaacatctgcctcttaaaagtgcatagttctgcgtgttgtaactgtgtacaccacgtagttagtacacatggtgtcatgtaactaccaccacaatcaggagtactttcatcaccccctgaaactcccccagactcccttgtagttacctcctactcctagccccagcccctggcaaccactggtctgctttttgtctttacaagaatgtcatatacatggaatcacaccgagtgtagccttttgagtctgatttctttcacttagcataatgtatttgagatttgtctgtgttgttatgtgtatcagtttccctttatttctgagcaagagttcagggtttgtttattccccaattgaaggatgtttgggttgtttccaatttttggtgattatgaataaagccactataagcattcacgaacagttttttctctgaacacaagttttcttttcacttgggtaaatatgtaggagtgggattgctgggtcacatggtaggtgtatgtttaattttataagaaacctgcaagctgctttccaaagagctgtaccgtcttgcattctcaacagtgatgcatgagcattcattatctttcattatgttctaggctctcacattgatcagaggcaatatgggcttggcgttttaattgcaaggaacaaagactctgcctcccttgcctgttttagtttaggttccccagaagtggactctggtgcaatgatttgagtgtaagtagtttatccgggggtcaatgccaggaaactccccccacctccagcaggggagtggagaggggagaggaaaaggaaggtagctggtaaagggtatgtcatcaggcaggaagcctagtttctagaatccatcccctgtcagttattgactgagggctcctgcgggagtcttgtcaattccctggcactccagcctgcccccttctcaggagagctggctttgctggctttggcagccagtctcaggtgaagggtatttggaagtctggcccaggtgcaacagtgacagggcactcttcccaggtgatagcggttccttccatcctctttccatgacactccctctttctttttctttttttttttttttttgagacagagtctcgctctttcgcccaggccggactgcagtggtgctatctcggctcactgcaagctccgtctcccaggttcacgccattctcctgcctcagcctcccgagtagctgggactataggcgcccaccaccgcgcctggctaattttttgtatttttagtagagacggggtttcaccgtgttagccaggatggtctcgatctcctgacctcatgatcctcccgcctcagcctcccaaagtgctgggattacaggcgtgagccactgcgcccggcctaacactccctctttcatcttggctctgtctactggtggcttccttttctgcatcatactttctgctcattgtgtttctcttcatatgttcccactaccagctaactgaatgttgacaccccaaagagagaaaaattggttggtgagttagtcactgcttttctcttggacagagccctcaatttaagtcatctggtaggcacaccagtcattgttggctgcccttgggtcaagtggcctgccctgggccaaccagctgtgaccagggaagtgggtcagagagttcagagcagcgctgtccaatggaaccttctgtgatgatggaaatgttctgtatattatggtagctactagccatgtgtggccattgagtgcttgaagtgtggcttgtgctaccaaggaactgagtttttaatttcatttaattttaataaattaagatttaaattcacatagctgcatatggctagcggctaccatagtggacagcatagctctagaacatgggcccagtttttggcgattatgaataaagccactataagcattcacgaacagctttttctatgaacataagttgtcatgttcttggcctcttctctccactaaataatgtggtataacattctcttgagatcagttgtttttttttttgagacggagtctccctctgttgcccagactggagtgcagtggagcgatctccgttcactgcaagctctgtctcctgggttcatgccattctcctgcctcagcctcccaagtagctgggactacaggtgcccaccatcatgcccggctaaatttttttgtatttttagtagagatggggtttcatcgtgttagccaggatggtctcgatctcctgacctcgtgatccacccgcctcggcctcccaaagtgctgggattacaggcgtgagccgccgcaccggccaaggtcagttttttaaaaagccaattaatatctgatttgtgattctgaatctttaacatatttaaccgtctgctttttttttttttttttttaattcacagatgacatggtctttttttttttttattgatcattcttgggtgtttctcacagagggggatttggcagggtcataggacaatagtggagggaaggtcagcaggtaaacaagtgaacaaaggtctctggttttcctaggcagaggaccctgcggccttccgcagcgtttgtgtccctgggtacttgagattagggagtggtgatgactcttaaccagcatgctgccttcaagcatctgtttaacaaagcacatcttgcaccgcccttaatccatttaactctgagtggacacagcacatgtttcagagagcacagggttgggggtaaggtcacagatcaacaggatcccaaggcagaagaatttttcttagtacagaacaaaatgaaaagtctcccatgtctacttctttctacacagacacggcaaccatccgatttctcaatcttttccccacctttccccgctttctattccacaaaaccgccattgtcatcatggcccgttctcaatgagctgttgggcacacctcccagacggggtggtggccgggcagaggggctcctcacttcccagtaggggcggccgggcagaggcacccctcacctcccggacggggcggctggccgggcagggggctgacccccccacctccctcccggacggggcggctggccgggcggagacgctcctcacttcccagactgggtggctgccgggcggaggggttcctcacttttcagacggggcggctgccgggcggagaggctcctcacttctcaaacggggcggctgccgggcggagggtctcctcacttatcagacggggcggccgggcagagacactcctcacctcccagacggggtggcggccgggcagaggcgctcctcacatcccagacagggcggcggggcagagacgctcctcacttcctagatgggatggcggccgggaagaggcgctcctcacttcctagatgggatggcggccgggcagagacgctcctcactttccagactgggcagccaggcagaggggctcctcacatcccagacgatgggcggccaggcagagacgctcctcacttcccagacggggtggcggccgggcagaggctgcaatctcggcactttgggaggccaaggcaggcggctgggaggtggaggttgtagcgagccgagatcacgccactgcactccagcctgggcgccattgagcactgagtgaaccagactctgtctgcaatcccggcacctcgggaggccgaggctggcggatcactcgcggttaggagctggagaccagcccggccaacacagcgaaaccccgtctccaccaaaaaaatacaaaaaccagtcaggcgtggcggcgcgcgcctgcaattgcaggcactccgcaggctgaggccggagaatcaggcagggaggttgcagtgagccgagatggcagcagtatagtccagcttcggctcggcatgagagggagactgtggaaagagagggagagggagaccatggggagagggagagggagagggagagggagaggaccgtctgctttaaaaatgggaaatatcagtatttgaggcaatgaagtcaaaattgacctaatgagatgttgatacgattcttttcctgaagctttaatacatttacatttttatttttggaaactcactttcattctgtacatttatactgtacctattttgtgttgtcagatgtacgtgtgtgagttactgattttcttcctcacacatggagacacttggcagccaatcagcccaccaggaaataggtctgaagtactctcttagaattcagaagcacaagtggtgcccctgacagcagcctaagtgtgagtttctgaagtcagagccaaatagggttctgtgcagcctgaagattatatatgaatgtttttaactttgggtttttttttttttttttttttttttttgagatggagtctccctctgttgcccaggctggagtgcagtggcgtgatctcggctcagcacaacctccgcctcccagattcaagcaattctcctgcctcagccccccgagtagctgggactacaggtgtgcgccaccacacccagctaattttttaaaaatatttttagtagagatggggtttcaccatgttggccaggctgatctcgaactcctgacttcatgatccgcccacctcagcctcccaaagtgctgggatttgggcgtgagccaccgtgcctggcctaactttggttttaatattattttgccttggcttcaggaaatgaccaagagatgcctgattaagattattttggaatcattataatgggatggagcttcgagtagcattggacagggagtcaaggaaccagggttcctactcaagctatgccactgacttgctggctttgtgatctttagcaagtaactgtaattttctgagcattgctttctccatctgtaaataaggaattttgattacacatgcatctaaaaattattccatggcaccccattgcaggagatattaatagatacagctgaggaaaagggttctatggtcaaagttgttgggaaatatttcttactatatctcttggagattcacaatgtacattttttttttgagacggagtcttgctctgccatccaggctggagtgcagtggcgcgatctcagctcactgcaacctccgtcttctgagttcaagccattctcctgcctcagcctccccagtagctgggattacaggcgcgcacaccacacccagctagtttttgtatttttagtagagatggggtttcaccatgttggccaggctggtctcgaactcctgacttcaagtgatctgcctgccttagcctcccaaagtgctgggattacaggtgtgagccaccatgcccagtccacaatgtacattcttatatcaaaggctctgagaagtcctgcagtggaaaaaaaatttttttttcattgtattaacagactttggttaatatttaagcatggaatctcacttgtgtgtgtgtgcatgtgtaaaacatctcttggcatcttccagaatacagttatacaggcccatcagcttggcaaacagggatggatgattctttggcttttctgagttaaatgtctcagtgtccttggacaaggaagaagttaagtctcttttcaatcatgttctcagctttttctctcctctcttctcttcccctctcctccaagtattaaaacctagttgaggccaggcgcagtggctcatgcctgtaatcccagcactttgggaagctgagatgggctgatcacgatgtcagaagatcgagaccgtactggctaacatggtgaaaccccatctctacttaaaaaatacaaaaaaattagccgggcgtggtggcgggcgcctgtatagtcccagctactcaggagactgagggaggagaatggcatgaacccaggagggagagcttgcagtgagctgagatcgtgccactgcactccagcctgggtgacagagcaagactccgtctcaaaataataataataataataaaacaaaataaaaaaataaaaccttgttgataactaattgtgggtcttttccttttccctgacacacattctgcaagagaagacagatggcaggcaggaggcagattggagagaggttctcagcatgacttttctcaaatgtgatgctcctcaagagagtctatatttgttatcaaaatgagccacgtgcttgcatgccaccttgaatgctctccattgacatttgcaacttgtttctgtgtaattttgcagcctggttctgctcagttccagcaaggtgactgtcattaggcagatctctttccattacaggtgacagaagctcaactccaactagcttaagcaaaacaaataaacaaaaacctccagggcatttgttggcacatgtgcttgggaagttgagtcctgggtggggctcaagtcctaccatctggtgtttgtccttctctgtttcctgcctcctgcttcctacagctcttggctctgctgctttctgagtgttggcctctctctcctactaccgctcatccttctccccatgacgataaagatggccagtggctgtgtgtccttaaagttagctatccctcagcaagaaagaccacctctcccagcagctgtatgtcaaacatcatcaaggcatgattctcatcggggcttgggttttgtgtacacatctgaaattgatcgtcatggacaggggttcacgttctgtgcttcgtgagatctgagtcctgtgtgggtagcagggccctgatcagcagcctggcattgtaagtggggtaggactattcttcagcagtgggagggaccctgggtggactaaaaccacacttacccactacatgccctgcccactcccttttcctcctggccagggtgccctgagtagccttggcatgacgtgcctcactgtcatctgaccaatgagaatcatttgttcagaaaactaaggtccatagagcaaggcacagacctgtccctgggagctcagtgtcctgttgggaaggccgactcagagacagctttcattcttttgtgttactccgtgctgagctggttggggctcacagcggcctctttggacaggcagcagccttgcctcatcttaacctgtattgccaggaacccagcagccttcccacatgaatcaagttcatgtttgttatctcaaagtgctccccaccagcctttaattttgggggcctgctcaggtgctggactctgtcctccttgctttctgttcgttagtttttatcttgttaattcctttctgagtcaggtattaccagcctcttttacagatggggaaactgaggctcagggtagagaaagcctttgctgaggcccccccgcaggtgagtggcagatcaaggatgttgacctaaagttggtgctatgggcctaatgtttttgtgcccacacaattcatttgttgaagccctaacccccagtgtgaggtggggcctctgggaggtgagtcggttaagatgaggtcatgaggatggggcctccatgatgggattagtgcctttagaagaagaagaagagagaccagagctcgctctctctaccacatgaggacgcagtaagaaggtggcctgcactgaggaaccaaatgggccagcacctagatattggacttcctaacttttagactcacgggcaatgaattcctgctgtttcagccacccagtctatggcagcctgagctgatcagtacagtcggagttctcaacctccattggagtgagtgcctgggctccactgtactaaaagcaagtagtcctcctctggaagggcgtatgcatatttccaggcattttggagcctccagggaaaccctgggccctgcaggttcttgtccagaaccactggccacacgccctctcagccgcactcaatgccaggagacctctatggctgctcaggagtgggtccctgcctggggctgaagtccgggccctgggatctgcgttgggtcctgctgtcatggactgagctgcctcggttccctctttgggccccactaacagagaggttctctgaggacccccatcccttcagctgaacctaaggctaccaggagacagagggcatctgtggcctcccccagaaggctgtcctgaggttgtgcccattgtcttggggagtttactggaggaagctgcaggcctggactgtgcagtctgatttctttacctattttaggaacgatgctggctggatgggcgcgaaggctcacacctgtaatcgcagcactttgggaggccgaggtgggcagatcacctgaggtcaggagttcgagaccagcctggccaacatggtgaaacccagtatctataaaaacacaagcattagccaggcatgatggtgctcatgcttgtaatcccagctactcgggaggctgagacgggagaacgcttgaacccaggaggtggaggttgcagtgagcagtgagccgagatggcgccgctgcactccagcctgggcaacagagctagactccgtctcaaaaaaaaaaagaaatgatgctggttgttatcaagaagagcccttcccaaacacccagctaccttccaatgggcttttccttcccttcataacttgggtgttttcaagggtgaggaagtttaagtagtgaagccggtggggctggccaagggaacccgctgtctaatcctgtggctggaggaggaagcggggaaggtggattcttcatggagtcaaggaggctttcactgctttttcttattgcttctgctgatttcccactaggcttggatttggccatttgctggggttgggtgggtgggggggaagagttttttttttttttttatggagacagggtcttgctctgttgcccaggctggagtgcagtgctgtgatcacagcccactgcagccttgaactcctgggctcaagtgattcttctgcctcagcctcctgagtagctagcactgcaggcgtgtgccaccatgcccagttaattaaaaaattatttttgtagggctgggagcggtgactcatgcctgtaatcccagcactttgggaggccgaggtgcgcggatcacctgaggtcgggagttctaaccagcctgaccaacatggagaaaccccatctctactaaaaatacaaaaattagccaggcatggtggcgggcgcctgtaatctcagctactcaggatgctgaggaaggagaattgcttgaacctgcgaggcggaggttgcagcgagccgagatcacaccattgcactccagcctgggcaacaagagcgaaactctgtctcaaaaaaaaaaaattctttttgcagtgacagggtctgcctgtgttgcccaggctggtctcaaactccctgctttaagcgatcttcccaccttggcctcccaaagtgtgggattacaggtgtgagccaccgtgcctagctgtgttttgttgtctggcgctgctttagatgacccctgctgctgtcagattgcccgtctgggagctggggtcatacttgtggggtcataacagggccttgggcagcagactcctcaccgtggccaggcaagggattcccaccctgggttgggcagccctctccacaggatggcaaggggctggaggctcagcggacgggccctgttttagggattgaggacatggcaggtagataggcaataaaagcaccgaaccagccttaggttctatagcaaggaggtccagcaccgctcgtggacccaaactgtcctccaggaaaggcgggaggcagcttaggtgacctctgcacgtgttttcaaagctgtggttttggttgggagtttcatgctggctcagccacacaaacaatgacatggaacagggaggcgctcccatgtcagaagatgggtcctctccaccccagctcctccacactccccaccccccacagcccagccaggtccaaaaccctacatgctgcctcataggaaatggggtcccctgaggagaaggacaaaagcagacaattcctgaggacaagaggaagaggaggacggagtctcccttgtttgtgctgattcccagtgagcatcctctctggagcccactggggtttgggacttgcagggtgtgtcactaaatggcaaggaacaaggtagagacggctggcactcactgtctctgttgtggacactggcctcacccacagctccatgcacacgcctagatgcagaaattttctgtattggttgtttatccatcaccaacttctaaagcagcagatgggaaaatggaatgaacaaagtcaactttagaacaagctttgtgttaaattgagtacacataattcgattattttaaaaacaaagcccaagcagtgtttttctgtttttttgcatgcagtgttttccggtgtaaagagaattcactgccggagaagccccagcttagcttccttctgcccctgggcagccccgttggtttcagcagatggtcctgatgtctgaggacctgccacagtttgcgccagtccttccttttgctacttttgttgcccaagacgaggtgtgatttagtggttaaatgccagaatgctgggctggctggatttgaaccttacctcctttgagattcaattaggatgtgacctccgacagcttaatttccctgagcctctgtgttttcatctgtaaaatgggtacgataatagggttgttgagatttggcaggtgataaatgctgaccaagtgtttgctgttgcagtagttgttatggcagttgtcgtcactgtccccaatgtcatcactatcattctcgtcatctcaggacactgaggaaaggctgagctagtaatgaatagggttggactggtgctgcctctttagtgcctaagaaacgctaccctggccctgtctccaggccttgatctcaaggtgggattcatccatcatccaccacggcccaggagccagctgtcctcacttctggggtgacttgtgagtagataacaaagggggtgccctcaccctgcagcggagtccccatgggccttggggcccagagggagatggtatctgtttcccatgggcttcctgtcacaggcagatgacatctgctctctgctcagggtagatttgggggcctctgccactggctgactggaactctcttacctcattctagactcttccaggcagctttctgtttgttctctaacagaaacatagaaacaaaccagcatcttttctaaacaaagagggacttttcacaggaagtttgatgacctgacgcgttccccctgcttgttgaagcacgagcctcttctctgacagttagggtgacttgctggagaacaaacaatagacaatagttgtggcctacttcccgtgagaagcaagaatggtacaggtggatgttgggagcccccaaacccatggaaggggtttcctgaggacgtcctatagtccctgaacatgcagccgagggttcctggggtagcagcacccgtgtggttagccctgtaatgggctcacattatgaggcttccgtgggtaggccctgttcagagagctttgcgtgctctcatcctggggagtcagggttaggtttagggtcaagactgatataatggccaggcacagtggttcacgcctgtaatcttagcactttgggaggccaaagcgggtggatcacctgaggtcaggagtttgagaccagcctggccaacatggtaaaaccctgtctctactaaaaatacaaaaaaattagccgggcatggtggtgtgctcctgtaatcccagctacttgggaggctgaggcaggagaattgcttgaacccagaaggcggaggttgcagtgagctgagatcgcaccactgcactccagcctgcaagatggagtgagactccatcttaaaaaaaaaaaaaaaaaaaaaaagttgctgagttggctctccaagcctctttctcagagccaccttggagggggccagccagctccaaagcctggggtgttggcctttgggagggagggggccttgtgccagtcccccacactttgtctgctcctccagcctccttggagtaccttgaatgtaccttcctattgctgttccctctgcccagagtcccgtgctctcctctccacattccttcactgctcattggcattcagggttgggcataaatattaccttcttgggggcctgttatttgcatcctaactagcagggctcctttgcagcccactgccagccctgccattcttcatcacagtcctctgttcatctctttgccacttgtcaccaaaatgtgtaattgtaccttcattgatgtccagtcagccttctgtatctgcaactttcacatctgtggatacaactgaccgcagattgaaaatactcagaaataaaaggatgcttgggtctgtactgaacatgtacaaacattttccttgtcattattccctaaacaatacgttatagcaactgtatacacatagcacttacattgtattaggtattagaagtaatctagagatgatgtaaagtgtataggaggatatgcatgggctttatacaaatactacaccattttatatcagggacttgagcatccatggactttgccatctgaggggggcaccagaaccaatcccctaagaaaccaggggacaattgttcacctccatgacaggcccataagctgctctgtgcaggtgcaggtctgtcatgcggcccacagccctctctgcagaagaccctcaaatgctgggggaatgcacaaattagctggggggcagtctctaggagattttcagcagtttctcctgagaggtgtgaagctgagagttaagtagggttttgtaggtgtaacaataggcattttccttccagcagctcaaactgcagtgtgcttggcacgttagtgcaaaggaaaaaaactcacttcattcttaagaaagctctggaaatttcatctgtgtttgagtgagttggcatgctgggcccctggcggaacacaaatgtggaatttgaactctaccctacctcagagagcaaggctgaagcgataggatgaaatgcatttaaatgtcatgagtgttattattagtcgtaatcttatctttgttaataataataacaggacccgcctagaagtgactgaatagcagaccgggctttcgtaagtaagctcacactgtcagatagcaccaggacctggggtggcgccggcgccgttagggagggagtgttcaccggaaacctgcccgggccacacgtgtacagccacatcctccacgccctttgggcgctggtcattcagagaggccctctcagacacgcctggcctctttagaggctctctcatcccctcgagctgccaacacaatcaagggtctgcaggtttgggaactccaaggcagtttctctttaccaagttctctgcatagccttttgccttctattgtttgctgtcccagagactggctgaaacaatgtgtttcctacagattttgtttgcctgcattgacttctttgtttagctctagtaaacagacatttagcatatacagatctgcacacttgacaaagaggaatttggagccctggacggggtggctgcactgagtcaccagctccttgaacctgaagaccttggatggtccggagctcgtaaatgactcaccccatcagtgctgggctggtgtgtgcggggttttgtcgccacctttggcaatggaagaggggaacgtggggcctttgactcgtcagggaaaaacaggtgtgtgagcactaggttggtgacgaggtttagcagcaggtggactctggagcgtgactctggagttgccagtcccagctccagcactttgattagctgtgtgacgttggggaagttgcttgcctaatatgtgtgtgtttcctcatctgtgaagacagcactaacctcgtaggtactcgggaggctgaaggagttcatctgtggaaatcatttggcatgatgcctactcttattccttgtctgtggggccctgttttgtgggcttgccacagtctcatgactctgctgggaagagccttcctgcgggcccccttgagctaggaatagaacctggatttctggccctgtaggctgacgcggccctcctagatgtagtggtgatgccccgttcagcagagatggttccaaatgttctgaacttctgccttgtatgggaccctgtgccggctgaatcgcatggtagctcagggcatagatgctaaatgggacggtcctgggtttgcaccctggcctctgctctcaccagctgtgtgagcttggatgtgttacttgttactcagagcttttctcatgtgtaaagctgagtgcatgaggccgggcgtggtggctcacgcctgtaatcccagcactttaggaggctgaggtgggcggatcacctgaggtcaggagttcaagaccagactggccaacatggtgaaaccctgtctctacaaaaatacaaaaattagccaggcatgatggcgggtgactataatcccagctactcaggaggctgaggtaggagaatcacctaaacctgggaggcggaggttgcagtgagccgagatcatgcagttgcactccagcctggatgacagagcaagattctatctcaaaaaaaaaaaaaaaaaagaaagaaagaaagaaacaagaaactgagtggatgagatctctatttcatggggtcgttgcgagcattaagtgtgctagtgtttgtgaagagcttgggcggggcctagcacagagccctgcatagtagaggttttgccctgacccatgagctgagcattggaaataccacagaatctggagtggggagcagaggaggtgtcatggtccttaaggcctgacctgtcagatattcacagttgtctgtgtcacttgttctcgcattgatagacctggagggacagggaggccagcccgttgtggaggggactccgcaggctgagggttgattctggctctgagcaggcttcaagcagaagctggctagccccttggcagggaggtggcagtccctctctgacgccttccaagtcctccccagtccttctaggattcttttacggaaccaaagataatagtcccctttgataccacatacaagccagtcgtattccatgcctcggaatatgaacaaaaccagaccggcgatggcttaagcctcattgagaggcccatttggatagcaggagattacatggggtcatgagtagacagaatgtggatttccagaaggtgcctcggcagctccactgtaggcataaagcaggtgattttgagatgtgtccactggcacctgttctgaggctggtggtgtcgggggttgtggtcatcacaggttgcattaaaagggggctttgatggggtcttttccagatggagctgctttgtgggattctgctgccctgccttgggatagcaggtcagcagagggtgagctcaggagctgcaggctacgtgtgacgtttaaaacatattctacataaactcatccatgatctattcatggtgtaatggatgtctggggcagggtgctagcttcagacgctccagcccaggctttctcaagccctcccaaggtgctgagacatttggcaccctcaggccacaagtgtggatgggccgcggctttgacccacaggggaactcatctccccaagctttgtccccatgggtcacctactttgcaaccctagtttcgtgatttggttaatggtgtttaagtggctgagccatgtatctggggtttttcagtgccgtcactattatttcttgttgagatttttgcacagtctccttccctcaatcctatgtgttcttttttttgatggagtctcgctctgtcaccaaggctggagtgcagtggtgcagtctcagctcactgcaacctccatctcctgggttcaaatgattctcctgcctcagcctcccaagtagctgggactacaggcacatgccaccacacctggctaatttttgtatttttagtagagacagggtttcaccatgttggccaggctgatctcaaactctggacttcagtgctcggattataggcgtcaactaccgcgcctggcctatgtattcttttaaacttcagctcattagagctgggtttgtgtcataagtgagagagccctgaggtgcttggtttgaagcaaagcttggttagccatcagcatctgattggagactggtcccaacccacccatgccgctgaggaggggacatgggtgctggccagcaccgagattagaacactgacccggtgacatgggagactgtggtttccctcatggtacagaaacataaaccatacttgtttttgagatgtctgaccctgacaagactgggaaatagagctagcgactgataagtgttcaggggtggggctgcatgtgggcattgtaggaaaagcgcactggcgagaggcgtacagagggatcccaggcgttagcttccattcccagcttctgtagggcacttacctgtgcttccttcagaaggtgaccaaccagtgaactctgcatgttaccttggccttgtatagggtggctgggtcgtcagaaacctgggaggctctggacagttgactttacttggctgttctttggtgtttgttccattcagtgatgctgctgtgcctcttgaggtgcaggtgcaggctgggtatttctccctctagactgttgcccacagctggaggcaaagggagtccattcatttttgcctgttgaatgaagttagagttttcggtttctctgtccccttagctgaggggctttcacatcctttaagagagctggcgccctctgggtggaacactgatcgggaagtcagcacccaggggttccagccttggttccacctctcactgggtggcctggggcacttgtggcctgtaagtacctattgttatgagagagttgctgtgcaaacaaagacccttttagtttaaaccttcttggagacagcaattttgcaaagcagtaagaacctgggatttgaattatggtttagccacaagctagcttcctaagcactcagcttcctcacctgtaaaatgagctcatgatagacccagcctctctgggtttggggaagattgagagcatgcaggcccaggagcatggttcctggcacatgggctcagcttcgtaggtggtggctcctctattactaccctcatgagtgtgatggttttattaccaccagagtgaagttcctgactgtgaggtttcagacgggataagcgcctggagtaaagtgtcagggcacatggttgatcagtatcttgggtttctcctctccaagcagtgacctggacttgacctactagaaatgggatcaggtctccagagagaggaaccaccttggctctttgacctcggtcaggcttggataccgggcctccaggtgaaagcctcaggtgctgttatcacttcctgagacagccagtcctctcacttctgtgtttcctttattacactttactatgaaggagaattgatacagaggaagaaaaacatacagtgaaccctttatttcctatgataaatgatgatttttggaactggggtccagtctgaattctctaaggcatgcttgtgcgtgtgcacgctctctctctctctctctctctctcgcacacacacacacacacacacacacacacacacagagtaatggttttaaagtcatgacatactgtgcttttggctgctgctgtttctgactgatgaccccaatgagactccaaaaaattagatgggtgcgtttggaaggcattcagaaattactcattggaagaaaaatgcagcgtttggaggaaggggagggctgagcatgtgtaaaaatgagtgttatgcgcttagtgttccgaattcaacatcagtgaggaaagggagggccgcaggagtttggggaccgtctcgctaagcaatactgcaaacacagacagtgacccgattttccatagctgtgctagctcctcaggaggttttgagaatccccctcatttgggtttgaaggaggtctcagtgtccttcctcctctgtttgccagattaaagtttcatacctcagagctgggatacgctgggttttgattgtaaaggcatgcagctcagactctgttgtaaatggtgagtttttcttttttttattacactttaagttttagggtacatgtgcacaatgtgcaggttagttacatatgtatacatgtgccatgctggtgtgctgcacccattaactcgtcatttagcattagatatatctcctaatgctatccctcccccctcctcccaccccacaacagtccccttcctgtgtctatgtgttctcattgttcaattcccacctatgaatgagaacacgtggtgtttggttttttgtccttgctatagtttactgagaatgatgatttccaatttcatccatgtccctacaaaggacatgaactcatcattttttatggctgcatagtgttccatggtgtatatgtgccacattttcttaatccagtctatcattgttggacatttgggttggttccaagtctttgctattgtgaatagtgccgcaataaacatacgtgtgcatgtgtctttatagcagcatgatttatagtcttttgggtatatacccagtaatgggatggctgggtcaaatggtatttctagttctagatcccttaggaattgccacactgacgttttaaaagtgaaatcagagagtgtttttggttttcttgaagctgcctttgacattttagcaacacagctgggagggtaaggtagaaaactccaagaagttggaattcaactgtcaaagtcaaagcggggatggacttttgggagtcctgccacagcgggacctgaactcaagtcttaacttctcctctagggctcttgtgtgaaagaggaatagcttcctgcagttcacaagggtcgtaccatgatcaattattattacgttacacatcacttctgtaccaatttatattggcacatgaagttaatatatccctatatccatgcattgcctttgtgatttgggaaaatccgatgccttggccaaacctctgaatcatgtgaccacgttttagcctaatttggtgaacaaatctttaacctccatgtcttcaagtgcagcatcagtgggtcatggatccagaaggttggctgattgggattctcttgctgggtgctgccgcaccttgtgtgtcgggtgccgacaccttgatcatttcggccagacccccaagagagcccacagaccaccatgctgggtggaggcacccaacacctggctgactgcgtgaacttcttgcttcccagtggctctccaaactagttgtggaggacgcgaaggggtttcctgatgtcaaaataaaaataacgatgtctgtagtttcccaggaggaataattgttgatgttgaggcatgatctctgcatgcattctgtacctgctccagggtgccagtggaggctacacccctctccccctcttctgctctctgcgacacccctgccacaacagaccttgactctccaggctgggacccaggaatccgtactctttcaaaaccactttattgagtgtaattgacagacagtaagccacacatatttaaagaatatgatttgagaagttaggatatatccatacccgtgtgaatctacataccacaaacaagttatccatcactgctgaaagtttactcatgcccctttataatcctgccctgtcatcccttcctgtcccctgaaccctaagcagccactgttcttgctttctgtcgctctggattcgcttgtattttctggatttgcttgtattttctggatttgtctatagatggaatcatatagcaagtaccctttctcatgtgcctttacttactcagcatgaagattttgagattcatctacactgttggcgtatcagtagttcattcctttttcttattgagtagtgacccactgtatcgatagaccacagtttgtttacccactcaactgtttgcgcaggtgggttgtttctagtctctctatggacagagatttccttttctcttgagtaaatacttaggaacatctggatcatatggtaggtataggtttaacttttccagaaattgacaacctgttttccaaagtggttattctttgggacaaggaatcgttgtttttagataagcttccccaattctcctgtggcctctcccttcccgagacggtctaatggccctgagcgatggctcctatgtgcccgtctccacctgttctctcagggctagcttggccttggcacctcactgcaggccgcccctctgcttggggtgctggacaagcagaaggggaacactcaagttctttctctccataactgccttcgggaagccatggcagatgcgttgactctctgtagggctggcaagctgtgtggcgagtcccttatccaatgtcgctgtgtcccacagggaggtcttaaagaggcagccgacttttgtggcctccttgtgaaagcttcgatgcctcagggatcatttctgagctgactgctagttggacttgggcccactgaagagacagcctgggatcggatgtccagaagagacagatctgagcacgtctctttcctctccctcctcttttcttcttagcccttccacctatcactcattcattgccccttcctaggttctgtattcatttgctgggggctttaacaatgagacgttattttctcccagtctggaggctggaagttcaaggcctaggtgccagcaggattggggtccctggagccctccctccttggctaggagatggccgcccccttgctctgagcccacatggtccttcctgtatgcacctgcaccccggtgtctttctgtgtcctgacctcttcttttttcttcaagacggagtctcgctctgttgcccaggctggagtgcagtggtgcagtcttggctcactgcaacctctcactcctgggttcaagcaattctcccacctctgtctcccgagtagctgggattacaggcgtgtgccaccatgccaagctaattttttgtattttttttagtagagacggggtttcaccatgttagccaggatggtctcgatctcctgacctcgtgatccacccgccttggcctcccaaagtgctgggattacaggcgtgagccactgcgcctggcccctgacctcttttataaagatatcagtcacactgggctggggcccagcctaatgaatggcctcatttttgcatgatctcctctttaaaggccttatcctcaaatttctccaaatacagtcatgttctgaggtgctgggggttagaacttcaacacaggaatttgggggcatacaattctgcttatcacaggtgctgagccctgagtgcagtgcttatgatagaaagatgagctggatagttcttccccttgtgcagctcagcatcctgggggagagaaagtgggaagatccagttttctgatgaaagaagatggaaggaggagggctcggtgctactaggggggtgggagtggatggttaagaccaacttgactccagtgacagcagcaagggctcctcattcctgttgatggtgtgtccttcaaaacgtgccgtggttctcaaggagtgagtggcggtggcctgcagccctctggcactttgtggccgaggccagctccaacgctgcagggcaagaagagccacgctgcagggcaagaagagccacgcagcagcactgatgtgcgtgccagtaactgcctggtgttctagtgagtgctctccctcgaggagcctactccattctctaggggatcatgtgaaaagtagagcagctttgggaaagtgtgaagtctctgttgtgtctctggagaagttatcgcctggtttgcacatgctggagggtggggtggtggtggaggaggagggcgcatgatgcctacaacctggctacactggctcttttcatccttgaattcctgcctcaggaaccctacaaacccagtgcccagagtattgcactggggccagaatgggaagagccctgaatacaagagaactgtggtattggggctatacctataagcatcaggaagtcccctgctctgtgcccagggagttggaggccttagtacccttatctctggaggcttctccctggccgtgcagaacagctgcaggaaagggggaaagcaacttaacaaaaattggtccagggacaaattatgcttagtaatggattatcccaaacatgctttgtctgagtgtcctgaggccatggtgacaaaaagttagtgccgtaacacacacggaatcaattctctgagcctgtgcactgtcacacttgttgcctcaagctcacaaatggagtttttcttgttggttttaatacctgcaggaacgtgaatgtcggctctccagccagcaaggccagcgcccacccatccatccctctgccatcctccataggtggttctgatggctctggtcagctgtcattcgtcctcccatctctcagcctttgtaggatagttgatacctgttttattcttttattgttattttaggggtctcagcatggaaatatattggtgtataagtacctgttccagtccttgttttcacttctcttgggactatacctagaattggaattgctagatgctatggtaattccgtgtttaattttttgaggcactgccaaattatttttctcccagaatgctttggaggcaatgacttcctgtttccttccttccttccttccctccctccctccttttcttttttttttttttttgagacagagtctcactctgtcacccaggccagagtgccgtggcccaatcccagctcactgcaacctctgcctcccgggttcaagcaattctccttcctcaccctcctgagtagctgggattacaggcgtgcgccaccacgcccagctaatttttgtatttttagtagagacggggtttcatcattttagtcaggctggtctcagactgctgacctcatgatccacacgccttggcctcccaaagtactgggattacaggcatgaaccaccacgcccatctgatttcccgttttctgcagggtaaagcctcagggccggcccattgctttcaggacttttctcactctgtccccagcacaaggatcttctccatctagatggatttgccaccatgtgctgcctccatgcttgggctgggtcattctgctcacatggacacctcttcaccttcctctcagggactctgcacatgctgccttcactgcctccttgggaaaaaattgctcctcccggctgctcccaaagcagttcttgtgggtctggccagggacccccctaaccctactttactaactaccctgggttggcagtctctgccccgagctctcctgttcctctcccctgctcttgagctcccattaggtgtcgagcacccagaagtggtgatggctcgttcattttggccatgtctgtgcacggctcacccctggtgcttgtatgcggatgcttgtgaccacacagcctgtatttgagccactgttctgtaatcagcctctcctgtggtggcatcttcttcacagggagggatctggccgacctcgggtcttagcacggctgagcctttgaagctggcaggttgccctgggttcccggggtggtggttggccgcctcttctcttgggcccctgcccatttggaagcgtgcccttgagcactgccatccccgagccaggccatcaagtcatccgatcccccgaggtggctgagaagctggctgaatgtccctgctgtgaaccagtgatggagaaccaggctgctacttagctttgtagatggattcggtaaagactaaatctcttatttctaagacgtgatctcattgcacagacaacagcctgagtggcctgtcacccaagcagaaatcctggagacatctgttgagcctatcctgtttctcattgccattggtgacctccctcctgggcatctgtcccttgccctcccctccttggtctgcgtctcttgctctgctggccactgtcgctttctgtgtgatctccccatgccagtgtgccctgctgtgatttgccttttcacacagcacctcttccttgagttcggacccaagctgcactctccaaaccactgacttcacttgctcctccccccactcacattttggggccctaaattactttagtatcgtgagtgagcactgggctgtctctttcacagtctagatttgcacaaacctttctctgagcctggaccattctcccaggtcttcaccaggccagttcctcctggagctccagactgcagcagagctgtctcttgctgggatgggagacacttctctggccccagtgctgctgttccccctgctagttttccccctttccttggcagcccgtctcaccaggctgtcttgtaacagtctgttttccttgtctgtctccctcaccaacctgatgtgtctgcactgctgtgtcctcagctcctagaccagggtcgggttccggctggggcaggagaggcgtgtgctgcggccctggatgggctcatgggcagatggactatcgagcagatggatcaaggccccctgtgggtccaggtttctccccagagcctgaagggttggccccggtggtctgtgacagcttcctgctctggtggtcagcagctgggcacagaactacctggagtggaggtgagatcccaggagttgtcaggagagtccagggttggcgggggccccagaggcttccgggaggcttctagaagctcttgagcgctttctcctgcccaacatgaatgtcttgtcttaaaggtgaggccttgtgagaaagcaggactaggtgaggccggaggagtgacagtcgcccagttgatgctgtggagttctccaggctgctggcccatccagtccctcctctaggccctgagttactgtgtcactggggcctggtcctgctgcagagttggggcacatctcagggcctttcagagctgataaggggcctggcctgctttcagttttttggttttgttttgaggcttccagttcattaaaacaattaaaatgccctaagaaagctataaatattaatattatggtattttaaactggtaacctttgtcaggatggtgttttttttttaaaccaaaaacaacatagcaatataattagtctagtcacaaggtaatgctaggatttataggaaatattaattcatagtgtgctcagtctgggtggacctgtgatgggacgggagtgtcctccagccctgcagctcaacatggtcacatttggagatgagatgaagtatttgactttgaggcttctgtgaaaatgaatccacaccccattcccacctcgtcccctaacctgcacccctccaagccctgcaagtccttcttctaggctgggaaatgaggacataggagtgaggctgcagggaaggagtgagacatacacgttcctgaggccttgagttccaggcttcaggaacgcctgcccgtgcccgggctctgtattccctggccagtgctgatggtgtctctggcaaaaatgcaagtacccttggaggctaggccttggggtggagctagctcagacacctgccctctgggaacattgccttcttctgctttctaatgctgatggcttccctgagatcccagagtcatcaagggtcaccctgcagatgggaccatgagccccactccccaaaatgtggcttgctcaaggtcacataggtagtagcaaagctgagacgtgagcctggcccttcaaagcctaaattggggataactctggcaagagaatgtttcaaggttcatctttgtgtccccagagcctggcatgtcatagggagatagaaagtatctgttgaatgagcaagagcagccaacatggatcgagagccaggaactgtggtaactgcacatctgtctgatctcattgattcctccccagctctgggcagtgtacttcggtactcggatcccctgtgggcagatgaggaggaagctgggtacaggtaggaaatgaaacctgcccaacatcaaacaaccagtcaaggaagctgaggtttgggcccagatggtgtatgtcagagccactgtctaggccagcgctgtccagtggaaataaacgtgagcctcttatgaagtagaaaaaattctagtagccacctttagaaaagtaaaagaggaacaactgatattattttaataatattttaataatatattttatttaatccagtatctgcaaatggttatcattttagtatatcattaatataaaaatccttttcttttttgtagaaatgttgcctgggctggtctcaaacagttctctcaccttgacctcccaaagtgctgggattacaaatgtgagccactgagcccggctatttaatccgatatgtacaaatgatcattttagtacaccatcaatatgaaaattattaacaagatattttacattcctttttctatgctaagcagttacaatccagtttatcttacctcagagcacctctgaactcccaccagccacatctcaagtgctcctcagcttctgtgtccaggggctttggcgcagaacaggctgctgtggcctctcagtcgtcagtgggtgaatattgggagttgttagccatttggaggtgtgggaagcatgaggaggtgatgaaagggcctaacagacagaggtggagggtcaggcctgagcctgtgtactgggctgccagtgacaccacgtgtctctcccaagtgtgagtgctggatgcaaggctgccgtcctggcaaagggatgtctcactggggcctctcgtggaaatggaggggaggtcctgggcagggctctgcagagcacaggcatccgagctccccatcctgggctgcctggaggacttgccagtctgcgtggggatctggctctgagctctgttgcttttggccaagggctgttgcaacactcccggagcccagaacaggtacgatgtgttcctcatgaaaggttatgaggtttcagacataacagaggttctgaggatgcaaagagaggaggtctcagggctcatgtctagagtgaagtcatcagacctatacatcatgggttcacgttggctggcatctctaagcgcacctcaggctgggggcaaccagtactaggggcgacaaggacagactttggtggaggtagggggagcactaagggactcctgttttctcaaatgggtctctaatgaaagaggttaaagaaactgtcacttaaagcatttcctgggttggtcctgagtacagtgggagggtgggtggtaagaagaaacctccctgggccaggctccccaaggctcgattcctgggttgggggcagagattggaggaatctgtggccagccctggcccagacagtttctgaaaaagcaaatcagggtttgtaacagttaagtctgtcccggggaagtgttccattgcaccttgatttatgccactggaaacattttatactgaggactgtccattggccaaacaagccttggggccaaaggcacagcagggaagatggttgctgtgtgaaccatcagctctactctgcttgtggggaccatgggcgcagttcttaaaagcccgcactgggtgatgcagaaatggggcggtgacacggtaaaaggagcggtggcaggcaaaaacttttaacaacaacagtaaaacctgttttataaaagccatatccgtggaggtaggaattgggagcagggagccgctgagtgctggggctgggacctggccagagtagggagggatgaaggacccctgtgatcaaggtcaagtcctcacctcatgacttcctggcagaacgtccttgggcaaggctcagcttccctgtctgcaaaatggggctcataacccctcctttccttgcaagctcatattagatgctgcatgtggaagtacagagcaaagtaccccacaaatccagggggttattctttctattaaccccactgtgaatgttttactttcatttttattaaccccactgtgaatgttttactttcatttttatgtattctgtagcctttaggtgtcatgttactttatcaggattttaaaaacttttcattatgaagcgtttcaaatgtactcaaaaaatagagaggatagtgtaatgaacaccctgtaccctgcagccaccactacaactcttaactatttcatcagggcaatttgagctcactgttacagtaatccctttcattaattgagttcccaaagtgctttaagtcctttgaagtaaaatcttcactgcacaagttggctcaaaatctgcccccttgtttgggaaaaagagtgtttttgtatgttaggtttttttgactcattcttgccacagtctgtgattggatttttcagtaccatctaattgttggttgtacaatatagagacagtcacacgtgggggtctggagggccccagggcccccctcagccttccttaagctaccagggcaagttcaattctctcaggagtttgggggcctctgttgactctgcttttcaatttgctataatttgaagggaaaaggttgttctggagtggctggcaggaataatgaagggctgggaagtttgttgtctccggtcagcccgcctcccctgttgcagcccgccatgcaggcaccccttggaagcggtcactttggggctggtcacccattcccttgcctggaggcagaggttttggtggaaaaggtggggaggtgaggggtcaggggatgaaggccgattgtttttatctgtttgggatcaaaggctcagtgtgtataacaagcttctggtaaaactctttttcttgtccgtaagatggcattggtgatgactctgggcagttgtgaggatgaaatgtaaggtccaggagatgtcctgtctgtcttgttcactaatgtgtcccctgtgtctagaacagtgttcgcacagagcacatgctcaataaatttatattgaagaataggagggaagggagggaggaaagaaggaagaaaggaagggagggagggagagaggaagggagagaaggaaggaagaatggagaaggcagggagggaaggaagcaagggagggaaggagagaagaagggagggagagacaggaggaaaggagggagagaacagggagagagggaagaaaggaagggagggagagagggagggaggaagggagagaggaggaagggaaggaggaagggagggagagaagaaagagggaagaaaggaagggagggagagagggagggaggaagggagagaggaggaagggaaggaggaagggagggagagagggagggaggaaggaagggaagaaggaagggaggaaagaagggagaaggtaaggagggagggaaggaagaaaaaagggaagagaggaagaagggagtgaaaagctacatctgtccgtccattattaataattcatcacaaatctttcatttcaggataaggaaatgtcattaggccctcaaggaaaaaaatgcctgttttcactctgggcttagaattcttttctcttcttttttttcttgtagaaattatatttccatctctggggcttagctcaactgatatctcacctcttaaattgttttggccttcctctggcaaagtccagccccccacccactcccacactgctgtccacacctcacaaagcagagaggaggacggctatgactgcaccgtatccagcgccggggctatgtggtcatgggatgtgtgtgcaaggctggcacagtcatctcccccataccatagaggacgctgaggctttcaggtgaagtgagttgcccaggtagacacagccaggaagcaggcttagatccaaacacttgtctgatcccaaagccctgctcattccccgtcctccctgctggccctgggttcatcctaaccctttgcttttagttccccctctctggactggacggtcctcacaggtagaacggcctgtgcctgtgtcctctgctcttagggttagcccagagcggggaggccgtgggtgtgcagtaatcaaactgggcacatcctctggggctgcacctcatgttagagacagtggtgtgggctctgttcccctccccaccctttctgcctgcagagcctccctggagtttatgagtcctgatggaggtggggaaggccgtggcttaccgtcgacacacatcagtacccggcaggagtggcagaaggtctgtggacagggcataggggtgcagggggaggagaaagtggaggggctccaagcacccgaacataagctccatggcagccaggaccttgtctgtcttgcttgttgtagttctagtgtctggttcagggtctagcaaatagtaggtgcttaacaagtaggtatcgactgggtggcctccgagccctgcttccctgtttccccaaagctttattgtgggttctttagctactgctgagatgcagataggccaagctgagggaccatcccgtgtctgtgaccctgccctggagtggaccacatctctgctgtacctcactgtgtcactgctgcagcaacatggtgggctcttggctggctggaacgtgaccccacaccctgcgtctggttggacaagcatccctcagcatggactggcttaggtgtgtgtggggagtgggggtggttgattcccagggcagcaggccggctgctcttcctcctccctgctgttcctcacccacccggcctcagccactccattcctggatgcccatgtcccagtggcggctggctggtcatccagaggcgaatgcggaacatggtgtctgagctactaacctcccaccttgggtatgcccttgaacttttctgtaagccaggctttccaacccccaacagcactcaggtcacattcccagagagcctgcacaagagggctgagtctgtttatttttcaagatttcaaaaaacatgccttttccccctctgaccttaagcaaaacttttttttccctccaacacttgtatttttaacttcatgagaaaatatggtaaaagggagcagattttattttcagaaactgtgatttttcaagatttttttttatttaaaaaagaaaggctttgggggatggggagaataaagatttttgttttgttttgttttgggtgctaagggggcccagagccacttctctgtggcccctgctcaaactcctccagagattctggcatgttgaggctgcagctcttttggttattgtgatcaaggatttctgggcacctttccttccccttttgaagacttaggactggaccagctaagggctgtaaacaagcatttccctcccttggcaggaagtgcttaatgtctttgcttttgggaaccggtgttctgggcaggctaggaggccgcacctgacctgcctgtggctctcttcccactgtgggggtcagaagatggtggctgcctatgtgcatgtcacagatcctcacttccagctggtggatgtaggatctgaggcccagagagggttggtgacttggccatagtcacacagccacctggatagagatgagtggtgagtggtgaacccggagaaacatggcttcttgcctccttggtctttgtgcacgggcctcccgcttcccgagtctctcctggcccagcagtggtttgctgaaggctgttttattttaggcaccggctgagctacctctgatcttgttgggttagcctaggtgtggttctttggtttttcagtttgtataaccatgttctttgttcagctcctatcagggttagggaggtcaaacacctatgtgtcaggatacgcctgacacacactatttaaaactcacactgttttaaatgtatagtatttaaaactttatggtcagctgtacttaccggctgagtacagaactaggaaagctggtggctacttgcaaggagcagctgcttagtagcggaggttgagtaataaggaccccagttgctgaacagctcctggaagactatctgttcccggctgggcgtgatggctcaagcctgtaatcccagcactttgggaggccaaggcgggtggattgcctgagctcaggagttcgagactaccctgggtaacatggtgaaaccctgtctctactaaaaatacaaaaattagccaggcatgttggcgggtgcctgtagtcccggtgactcgagaggctgaggcaggagaatcgcttgaacctgagaggcggaggttacaatgagctgagatcatgccgctgcattccagcctgagtgacagagcgagattccgtctcaaaaaaaaaaaaaaaaacaaaaaacaactctgtccccttctccctgtggccgtcacctctaacctctacggctgttattctggttcagtctcatttcttctctcggacttttgcaatagcccctaaaatgctgtcctcctggttttgctgacatcgtgacgattttaaagctgcatctgaccatttccttttcacaaagtggttctcacttctgcctctagaaggcaggcactgtcttcccttcccaggtaccccgcaatccagccattcccaaggactcacacagcccttggaaacctttctgcttagaatgttgtcctgtcctcttctgcttggtggctacctacttgtccttccgagtccctctgagacatcccacctccggggagccttctagattccttgggctgggtttccccttctgtgtgtgtgtagccttctgctcacatcggtcctgcaacagccctgtgttgagacataatcatctcttccttgtttgtctcatcttctgggctgggctcctctaaggaggggctgctttccatccttgtgttcctggcagcaaagccactgcctgtccaagtcagagacaggagcatgattattcagtgaatgagcccaggatggagtgaggaggattgtgggagaacaggagggtcagacagattgttctgtagtggtggctttgcagaggggcaagacttctgcaagtcagtccttgagggatgagcggacattagattggtaggtgaatttgggatgggggatgtgctagaggccccagagccagccgcagggtatggggtgatctggctggttgtacatttttctccatgatcttcatgtttcgtgtagactgatcccttctactttctgaaagctgccattggaggtgaagcagggctcctttggatttgcggtatcaccaattcggcaggagatgcagtgaagctacacccagctagacccatttagctacacccagggttgggcgttcagcctggcatccttggaaaaacaggtctgggtgcaggctccctgtggccactggcaggatcctttgttcagtctggagctgggtgtgatggtgtgaccacggctgcctcgggcgctggtgggtgcagagctgcttcctggagccaggaaggaactgctgctgctgcctcctcctcctcctcttcctcctcctcctcttcctcctcctcctcttcctcctcctcctcttcctcctcctcctcttcctcctcctcctcctcttcctcctcctcttcttcctcctcttcctccttctcttcttcctcctcctcttcctcctcatcctcctccttctcttcttcctcctcatcctcttcctgatcctcctccttatcctcatcctcctccttcttctcttcttcctcttcatcctcttcctcatcctcctccttatcctcatcctcctccttcttctcttcctcctcatcctgctccttatcctcattctcctctttatcctcattctcttccttcttctccttttcctcctcatcctcctcctccttctgctcatcttcttcctcctcctcctcttcttcttcctccttcttttcctcctctttttcctccttctcctcctcttcctccttctcctcctcttcctccttcttctcctcctcttcctccttctcctcctcttcctccttcttctcctcctcttcctccttctcctcctcctcttcctccttctcctcctcttcctcctccttctcctcttcctccttctcctcttcctccctctcctcatcttcctccttctcctcctcttcctcctcctcttcctcctcctcctcttcctcctcctcctcttcctccttctcctattcctcctcctcctcttcctccttctcctcctattcctccttcccctcctcttcctcttcctcctccttctcctcctcttcctctttctcctcctcttcctccttctcctcctattcctccttctcctcctcatcctcctttcttcctcttccttcacaaacacatggtgcctcggcttcacagggatagcccccatgttcatctgctcattgcttctgggttgctgccttgggcaggtggctattttggggtctttcagataatttaaaaaaacccaataccctaaacctccccaaacctaattctcaccctcagggcctaagtacatttgaaattgcacacaaacttaaggttgctgtgtgctagatgggatgcggtgagggacaaggctctccaatcatagtttttcctaggtgtctgtgagggattggttccaggacctcctgaggataccaaaatctgcagatgcacaagtccctgacagaaaatggtgtcatatttgcatataacctatacacagcctctggtatattttaactcatctctagatataatgtaaatgctatgtaaatagttgctatactgtattgtttagggaataatggcaacagaaaaagtccatacatattcagtacagatacagtttttttttttttctgaatgttttcaatccatggttgattaaatccacaaatgcagagcccgtggatatgggaggccaactgcgtgttgactttatgttttacaaagcaccctctaatcattgaatactgggaaacttcaagctctgggccaggcactgcactcagcatttggtggcttcatctcctgtcatattctggagccgtatgaacaagaattttcccatcttataaataaaagagcgaagacctgaagaagttatgtataagctgttgtttaaggttatgcagccaggaagtggcttactctctttgaatcttaccccattcttgtgaaacaggtggaggacatatttttatctcccatttaacagacaagagacttgaggtggctggatgccgtggctcacacctgtgattccagcactttgggaggctgaggtgggtggatcacttgaggtcaggagtttgagaccagtgggtgcttttctctggcgacgcccagtctgtttcattagctaacagatgctaagctctaccatgggatagttgtaaaaccttgaatgcaaagcttgaatacaattgaggagcagagatggggtatacagcaagcactctgtgtattaagtgattgttgttcctcgtctgtcttttgacctcccagtgcacagccatgggtctgtcactctggtgacctttggccgtgggcattgggaggatagtttatgttgactgcggattgccaggtaccaagtatcaggcaaattggcttctttgtacattcctccttccggatagaccttgggcctcctcgtcactgcccaggagatttgctgggaatctaggagggagtggatgatggcctggatgcctgggtggtgctgcctctgccccgaggcagcagtcagtgccagggtggggctgggtgggtgctgccatcgcctcggggtggtacccgagtctggagtaggaacaatactctattgttacgttaaacctgaaatagacgccttcagatggagggggtgagtatgaatctattacgatctaataatgacaagagcactctgtgtcttttcagatgcttgacaatcacctgctaatcccgggggtctgggagctgagcattttcaacctccacccccacctctgctttgtggagttggggaaaaacagagacccaggagctgtgaaatgagggaggctcagcttctccacttactttcatggtgtgaggagacgcatgtgtatttgcctctgacccctcctgcagggaggaaagcgtacctggatctgggtgagaggcatgtgtggtgatgagaacatttcacagacccaagttcaaatctctgctctgccactcgagcatatttcagaacctgtcctagtctcaatttcttggtaaggtgagactataaccacttttaatgggtccacaaggcctgatccaacccagcaggtgctcttgcgggtgaggaccacatctcggttggttagacgtgtccccccagccctctgccaggacctaggagttggggtgaggggctgggttgcagggaaatgttgaatcccaaaagcagatttcccaggcaggcactgtcctgacccaacctgccgccagccacctgtcaagctggacctctgggcttttctctccaaatgctcttgttctcaggaaagggccaagactcaccccaggcacaagataagtaggaatcaggtgtgagccagtggtcaggagatttgggtctagactctgtgtggccagggtcattgctcaggttcgcagggctaaggaggagggaggcagggggagacatataatttctagaacttctgaggttctaggacaggggccagcaaactgtgacccttaggccagttctatttttacaaataaagttctttagttcttttggaacagagccatgcctattttttacatattgcctatggctgttttgctctccaatggcagaacagggtagtcttgacagagaccatgtggtctgcaaagacaaagcctctttatagaaaaagtctgggcagggcatggtggctggctgggtgcagtggctcaggcctgtaatcccagcactttgggaggctgaggtgggtggatcatgaggtcaggagatcgagaccatcctggctaacatggtgaaactctgtctctactaaaaatacaaaaaattagccgggcgtggtggcatgcacctgtagtcccagctactcaggaggctgaggcaggagaatcgcttgaacctgggaggcggaggttgcagtgagccgagatcgcaccaccgcactccagcctgggcgacagagcgagactcagtctcaaaaaaaaaaaaaaaaaaaaaaaagtcaaccagtccctccatcagatcacaggcatcttaagggcagagaacatatcctgtttgtggggccctagactcaacactggtcaggacacagttggcgctcaatagatattagctgaataaataagtggaaaacccatcaggcattgctggtgggaatgtaaactagtacagccactatggaaaaccatgtggaggtccattaaagaagtaaaagtagaactaccatttgatccagcaatcccactcctgggtatctacccagaggaaaataagtcattatatggaaaagatagttgcacacgcatatttatagcagcaaaatcatggaaccatcccaaatgcctgtcaatcaatgagtagataaagaaactgagatatatatatatatgatggaatactactcagccataaaaaggcatgaattaatggcatttgcagcgacctggatgagattggagactattactctaagtgaagtaactcaggaatggaaaaccaaacatcgtatgttctcactgatatgtgggagctgagatatgaggacacgaaggcataagaatgatacgatggacttcagggacttgtggggaagggtggggggtggtggggcataaaatagtaaggtgcagcgtatactgcttgggtgatgggtgcgccagaatctcacaaatcaccactaaagaacttactcataccacctgtaccccaataacttatgggaaaaatattttaaaaataataataaaaaaagaaaacccatcaggatgatttgggcttcaagaaataaggcttgattacaaatggtttaaacaatagcaaatgtttatcatcccacattagaagaagtctggagctaggtggccccaggacgagcttggcagctcagcagtgccatcaaggacccaggctcttcttatttttctccaccagcatcctcgacatattggcttggttctcgggcttgtcccttcatgtcacaaaatggctgcgacagttccaggcgtcacgtctagtcccatttagatgctcagctgaagaaggtacttttggaaaagaacctttcctaaagctccccagcagacaccctccatcagttctactagccagaaccagatcacatagcaaatgccctaactgcaaggtaggctggacaagtgaatatttggctttttctgactctgtagttgaggtggactctgtccacaggagtaaagggagaggaaccactggctggtgaacaggcactgttcaatgtctgccacaaagttctgctgcagatggaagaagagatgtttagttgtggctggggagggcaggcaggggtggcagaaaaggtttcttggaggaggtcctggaacaactggtcaaagtgaaggctgctgtggaggacgtcatggtgcatcattaattctggttgctggtaggaaatggttcccatggctgacagactctgatgagcgtctctcatggctttggcatattatggagtttttcctcctaaaatcagttttgcggccctcatagaacaacccttgaggggggttgtatatataatctttattttctagacaagtcaattaaagctgccagaagtgaggtgactcgtccacaagcagcacgttctgtggacagagcctaggactgactgagtccaagcgcagggccccacccccagtgctcttgtgcagaaagacatactggtcaccctgtgggcagccacctgacctgtgagaacttggattctgtcctggtatctggtggccacagctgaagctggcagctcccctcacaccaagataggagccttctgggagctggccagccaggagagcagcctcagtgaggagcttccaaagggatttggtgtcattaagggctccctccttcgggacactgcatggagactggaggaaggagtcgggagttgtatgggcccagaccctgccatggggttggtttggaaatagaagctaccagagagatctcattctttcttgggtgtaatttcaaagtcatggtgagaaaatgaaatgtgatgaagctgtagtgttggcctagaacaggatctggcatttagaaagtttggcgaatgttagtgcagttgttcccattatcactatcaccataattgtcatcaccacctctgttgtatgggagccctgacagcctgcagatgggtgaagagtctggcctccccactgtacagaggtcagatgtctctcccatcctccaccaggctgctctggcaaaggactttgctatggtttgaatgtccctgccaatactcagttaaaatgtgattgccattgcgatgatactatgaagtagaactggttaagaggtgattaggccatgagggctctgccattatgaatggattaatgttgtcaactcaggagcgggtttgttatgacaagaataggttgttataacaacctactcctgtttggccccctcttgctctcttgctcttgccccctcttgcccttctgccttccaccacagagtgatgtagcgcgaaggcccttgccagatgctgaagtcatgctcttggacttcccagcctccagaaccatgaaataaataaacctctgttgtttataaattacccagtctcaggtattctgttatagcaacacaaaacagactaagcagacttctgggttgaactcaatggaaacttcttgttctaaccttatgatctctgagcagcatttgaaattgactcactgtctttgcttgaaattcatttattgctggggctcaggaccctaccctcactgggacctcactttgtctttctagctatgtttcttcctgaaatattgacagccctggactcaggcctcagcattctgggggaagtgcctctactcagagttaacatttattgagcacttactgcatgcatgtgctatgctcagcactgtacatatcttgtttaatcctcatgatgcagctctctgaggtcagtactatttggtcatttattcactcattcaccaagatttttgggctcctactatatacaaggcacaattccaagtgcctaataaggcagatgtgttcctacctctggggagctgacacctagtgggaattattcaggttaacaggaaacagagtggagacctgaggcttcttacccagtcacagccctggtgggcagaggagccaactctagtgccgtgctcttgaatgctttgtttctggtcccaccgatggccgtgaatccctcacttccagtgcacatatctctcttgatgccattgactctgccagggtgttctcggcatctcaaacttagcattttcgataggttttattgctagtgttgtttttgttctctctgaatgtgctctgccttttcaccctgcatccacaaatggcctgggagcctgtctcaacaccccctcccttaatctccaaatcctgttatcaagagtggtcagatcagcttcttcagtgcacccccaggaccccattcttactcttcctgccatggttccagccccgcacttcctggacacccttcgttcttttcatgctctggcatgttcagctttgctttctcttcactgagcctttgcacatgctgttccctctgccaggaattccatttaccccccagccacatcccccactcctggccaacttcagcctttgctcaaacactgcctgccacagggcctccctgactctccctgcagactttccccatgctccctgcggtgtgcacattcaaccctccttgagtcacaccttttattaaagtaaaggctggcacatccacttcccaccaccctgggagacggggaccaggccctgtctcctctttcatcttcagtgccaagaatagcaggtattcattgaccagcagaatgaataaatgaatattggagtaggtttctgacagaggcctaggaggcttgaaattatctttcggccaggcgcagtggctcacctctgtaatccaagcactttgggaggccaaggcgggtggatcacctgaggtcaggagtttgagaccagcctggccaacatggcaaaaccccgtctctactaaaaatgcaaaaaattagccgggcggggtggcgggcacctgtaattccaggctgaggcaggaaaatcgcttaaacctgggaggcagaggttgcagtgagccgagatcacgccactgcactccagcctgggtgatggagcaagactccagctcaaaaaaaaaaaaaaagttatctttcataccaggagagacagtaaaatcctgggtttcctttgtggagccttaagttcatctaactcagtagtttccaaacttgcttaaatgtcttagaaacctgttgtgcctcactttagtggttctgggatgggggagttgtccctagggaatcctgcagggtcctgttgaaagagtttgagaactgcagctgtagtgcaaggcctcattttctgcaagaaggaagtgcagagaaggaatgggttgaaggtgcccttgaccatatagtgactgagcctggagtagcgtgctgggctcttggctccccctgcagtgtgtcacagactcttcatttaagcagatgtgtgtgtgtgtgtgtgtgtgtgtgtgtttaatacactttaagttctagggtacatgtgcacaacctgcaggtttgttacatatgtatacatgtgccatgttggtgtgctgcatccgttaactcgtcatttacattaggtatatctcctaatgctagccctcccccttccccaccccacgacaggccccggtgtgtgatgttccctaagcagatgttcttaaggggaagcagccttttcttcctggtgtactcagcttccctggcatcaagcattccctgcaaaaggcttggtggggatttttctttaaacttaaaatgttgttctccctaaagaaaaatgcgctgctgagtggaaaaatctgcatgtctcatgaccctgggtgccgctgtgccacaggtttttatgagttggcaaatatgtttttaaaatggagaggtgtgcaggaagtgagccagcaaggaaggagaatataagtcgtcttttttgcaggatgcaaaattgggtttatttgcagactgatgtgttaccttctaaaggactagccacaacgtttgaccctcaatctaaggtcaacactgctatccattgctcacagaccagagtgcatctcccatgaggcaaaagagcaggtgtgagaagtgggtaagcagtctgtatattgggggtgtggtggatggcataggggataactcagtctaatgaaagacatcaatgtgccattgggaaaggacagaggttgccccctctttcccccagatagtcgcccagcttataaatgcatagatctgggacagagaataaggttcacctaggttccccctaatcacaggcggaactaggactttgggagatgatctcacctgcctttcatttccaagagatcagtagcacttgtattttaagaggtgagtccttctatgaatatcttgaccttgaggtttacaaaggacttccagaccatggggtttgctttttatcaagtcgtactgtttacataaagaagtgcagaacctggctgggcacaatggctcatgcctgtaatcccagcactttgggaggccgaaggtggatcacttgaggtcaggagtttgagaccagcctggccaacatggtaaaaccccgtatcaactaaaatgcaaaaaaaacaaaaaacaaaaaaagctaggcatgatggcgggcgcctgtaatcccggctacttggaaggctgagtcaggagaatcgcttgaacccaggaggcagaggttgcagtgagccgagatcgtgccactgcactccaacctgagcaatagagggagactcagtcccaaaagaaaaaaaaaaaagtgcagaacccatagacatactgctggatggtttttcataaagtgatgaagtgcataccctgtggaaccctagtcaagaagcacgtcatctacaccccaggaccctccgggagccccttccaggccccatctaccttgtggtggttctaacgccatgggttagtcttgcctgcctctgaactctgggtgaaaggagccacgcagccttggcccttttgaggctggctcctttcactcaccattgtctttgagatttgggcctgtggctgtgtgcagttgtgtttggttcattctcgctgctgagtcctattcccctgtctccacacatagtgggtgttcacagcagccccacgaagtacacagggtgtggactgttcctcctgttttataagaaaggaagcccaggcttggtgttacccacagcacagaggtggctctagagcacgccccatccgatggctgctgaggaagtgacttgatctttctaggagcgtcttgtcctctgcccaagaagttgccagcagctttctctttagtcttccagaagcccctggctctccttttgagtcactttgaccacgcctccttaccagtcaaaccgtgggttttctgaattcctggaagtgctcttttagctgcttttctgatccctgaacagcaaacacttatcgtgggtagcattttcctctgccaggccaatggcagacattactaactaattgtgggactcctgttcattgagcctggaccctgtcttgagttccaggattcccggcagccactgccatctttttggagctcattcacttaatgaaatctttctgcttttgtagtgccaggtggtacaagcagagttgcactttctgctgaggagacttgatttcttatgaaaataccaagcaatgaaggaacgctgcatttctaaagcattcgttggcttcctggactttttcccttgcaggtggggtggcagggagtgggtgatggggcagtggctattctggacacagaaatccacattcctttaaggtgtcatttactgcttccagaatcccactttcaaggagacttgaagctagtaaaatgaataactgggcttcttcccagcctgtggaggcctcacagtggtagcttgttagcagagtcctcagaatatatccaggataaaaatgtgactttgtgcaagtccccagcttgaaacagggttacatcctgcttcctgggtgatgctacctggcagaggagcccaagggcagggggcaggctcctcgtatctgggtgtggtgccctgagctccttgccctgctgtttatttccagagcagaaccttggggctcactggagcagtgaccacctctaatcacaagagctggttgtactttttcttcgcaggctgcatagggtggaggatggggctggggcctctggagagtggcgattcctccctcagccccacatttctacctgctccccagggcaccttgttattacagttcaactggctggggtttgtcaggcctcaagccagcctacctggtggtttcaaaccagacttaatcaaaatgtaaatacttcttggggccagaaagcaggactgtccaggtgtttgatcagaggctgcagagcctgggaaccacaggagagggtgggggcctggcaggctccttccacacagaggcctggggttccctggggcctctctgtcaggggcttctggagcagcttctgtccccacgtgaccaacatcaccctctgccctactgctgtatatgcacgctgtcactggggcaaaggtagtgctggtgatgctggtgacagcacctgctccccttctccatccctgaaggaagacagcttagaggttgatggatcgaatatcttgcattttagagaggcgggacctcaaggctcagagagggtctgtgaccctcgtgaggttgcacagtgggcaggagcgcagagaggtgcactcgtggagggtgagccatgtgtccggtattgttctaggatcagcagtgaccagggcatatgcagagtctgccccgggggcaggatggtgaattgagagtaaaacgctagttggacgagatcatgttatatctgtaaacagacgatctatacatgtgtaaactaataacgtctgatagtgatgagtactctgtagtggatgaggtgtagcaggattagataagagaatgagatagattcagtggaggtggaggtgttaccttagatggggcctggggagcctccaagtgtgggtgtgtggaggtcatattagttgagacctagttgtcagaaaagggatggtcaggcaggggcacagccagcagggcgaaggctgtgcgatgagcatgagccgcaagggtctccatgggccgggaggagctcagagtgtctggagtggagtgtgggcctggggcatagtggttgtgggggagtcacgggaggcatttggacttgattctaaacctgttgggaagtcattagaggatttcaaatgagagaattccatgagttgctttgggtttgcataactctggctgctgggtggagatagtttgaaaggggcaagaacggaggtgggaggggaggaggctggtccaggtgaggatgctggcctggtccagtggcagccctggggccatagggagggggacaggtatggatttcactgcagagcccagacttggggatggatccagtgtggcatggaaggtgggggagggaaagtgaaggaccccagccgtcccttgggtttggggctcaactagggctcctttgatcactcatctcccactgcatggtgtccctacagccagactcagggtccttgcctaccctaaagcgccagggtggtgctggccctgcgtcttcaggatcatctggggagggctgactcacctgcctttctggatccagaaggcggagggtgtggtgttacctggtgctggggatgttggaaaactcagaacctgggctttatcttgactgtgtttaatgactcagcacaaatctagagacatgaccaagaggcagctttgagcagccctggctgaaggaccagagcagtgggatgatgtggcctgtggaggaaggaaacctccacctggaaccttgaggggaaagcagggcaacagcagtatgctaactgtgtgagctgctttttttttttttttttttttttttgacagggtcttgctctgttgcccaggctggagtgcagtggcatgatctcagctcactgcaacctccgcctcctagggttcaagcaattctccctgcctcagcctcctgagtagctgggattacaggcgtgtgccatcgcgcctggctaatttgctgctgtctgttgagtgctcactgcacatgggcttctgtgcatttccccgtcattcctcacaaccctaggcggcaacattgacattcttcttcccattttgtggatgcagaaactgaggctcaaagagcttttggcctaaggtcatccacctagcgagcagctgagctcacccacaggcccctgagtcccgatttagggagtctataaccagcacccaacactgtcgccagtgcaccacgctgcctgctcaccagccatccaccaagggctggctctgtgcctgtctctgtctaggggtagggcatgagaaccgaccccatgcagtccccacccagagatgcttgccctgtgcacgcagatgcggaccagcagggcatttgcagaaaggcagttgttcgcttaatgagaggtgtttgggcaactccctccttctgtccctccctcccttgctcttttcttcctccttttcttcccttccttcttccctacctgtttttctttcatctctcccttccctctctcctctcccaccccctcccttctcttctttccatctctccctgcagtttttcttttgctgacacctgtttctgaaaaatcttgggtgtctggctgtggggagctgcaggaaagcccagatgaggtctcctgagcttcaccttgtggttggcagcgaggacttgacctagagcctctgaccttccacctccctgggctctgagctccagagtcccgtggtcctccaaggctgtgggaacccgtggtcccctcccttgcctttcctctcttcgctgacagaacaaggggccggcagaggacatgtcaggtgtgtctcagagacctgggggaagatgggctcaacatgacctgcttctggggtgacacctctgctcactcacttattcaagcattcactcgttcacagacatgtcagaggtctgctgtgtgccaggcacatgtcctaggcactgatgagcaaaatggacgtggtctctgtcctcttgggtggaagccccataaaggcataagtgaaaatttgctgacaaattttgatagctgctttttcaaagccagacactgactgaggagtggtgggagagagctgtgtgggtatgacttggattgattgattggggatgatcagggaaggacaagaccctaagacctgaggacttggccgggtgaagtaggggcagcaataaagtgccactccccgggagacacgtgtaagtgcccagagcaacgtcatttgagaggtaaaaacctggaagacctaacctacgtgtctctcaacaggagagtggatggaggaattattttgacaaaacctgtgggtatgcaggtttaaagaaattttgttcccattctgtaagcttgaaatgtttcattgcaaaaaagtgattctggaaatgtgtatctagcagaggaaatgacatatgcaaaggccctgaggcagaaaataactcccagtgaggaagcaggtgacggcctgaccactgtacttccggtatctctgctctcagccacccctgagaccatggaaaggctccgtgttgagcccttggaaggcctccctgggagtcctgggtgtcagctggaggactgtgtgatggtgagggagttgaaccactggggcagtgcccgcctgggctggatttgggggaggggggagccttttggatgagtcagtcctctctggttggaaacagcagagtctagttgaggctctgccaaggacccgtggtgattcttgtcgccttttgtggagaaatttgcccgctaacaggccatctgtgtgaggtgagtcactgtttcccccgttttgttgattgcagacacctctgtgtgagtctgttcagcctgaactgcacacaccgataaacttcagtgcctggatgagcaagcttcctgtgtgcttcagcttggggcgcatgtgcgcttcttctaggattttctgaaacttggtcaggggctcctggatcatgattgcagattgagagccactgagccattccaggtcctgttttctgatgtgaaatggaagcccagagtggggatgtgtccaaacccacactgagatcacacagcgagggaaggaagccggggtcctggctgacacttgcggggcagagcaccttctcttggccccgaatatggattttggtgtccctagtcaagatttgttctgctgacttctcctggggaaagaggtgtcacgtctgcctgagcccctgagcctggtgggtggggtgtgaggatctggccggggccgctgcacctgcaggtgtttcctgcagacattctgctggggagcacttcccctcttctccctccaggtgactcactgggtgcagtgtcctctagcgtctactgggtgcagggcactggggagacatgggggatgcttctttgggctcgtctgtactaggtatggttatagggtactgggggttgcctaaaaaaatgctgtgtgaccttgatggctcactttttctccctgggcctctgtgtctccagccgtcagtgaggagcaggcgtgggtgatcagcaaggttcctctcagctctgatgtcattcattctgagttaggtggagagtaggggataattgcagcccttattcactgaactttcttaactatgctaaatgctttacgtgcatcagctcattgatgcctatatctatgtggttacagaggagccagttgaagcacagagaggttgagtaaatttcctggagtcacacagctagtaaattacatacctgggtttaaacccaggcagtctggccctggagcatgcagtcttaatcactgcatgattaaggctgaatcatggtcccctaaagatgtcgtatccgaatccctgcaacttgtgaatatgttacctacctgataaaagggccttttcagatgtgattaagttaaggctgttgagatggagaggttatccagggatatcaggtgggcctgattagagggagagtggactgtgcctgtgaaaaggagttcagagtgatgcagcttgagaaagacctgaccagcgactgctggttttgaaggtggaggaagggccatgaattgagccaaggaatagaggtggcctgtagattctcccctggagtctccagaaggcacactgccctgccgacacctggatttagcccggtgaatctgattccagacttctgacttctagaactgtaggataatacatttgtgtctatagcactccatttgtgccgttaataacttgttactgaagcaagaggaaactcatgcagccatgctctactctggtctcctggtggcgagccctcctttctgcatacacactggattttgaattctgaggggtaacaacctcatcttgccaacagagccctccttggccatttcacaattcaagaagcattttctaggaagccttttaaagccccactgccttgccccagcttgctctgttgtgtcacaggaatgaggtggggagaggacagagggaaagggtcatggggaacctggggccccagcctataccctgcctctatgaggctccatctgagcacccacctctccaggcatcgtccttggtcccctgggagtgggcacccatggcgggtctgcactgtatgcccagtgcgcctttgtaggccgaacctgcagggtcagagctgggtctaaggctgctccccaggtccttgcaggaacataagtgcccgggtttatctttgggcactagagctgtgcccacagcagctcctgttcagatctggatcagggtcaggcccccatcactgattgcgcaccccaggcacgcctcaccctgccccggcctcagcttcctgatctacaaaatgggtgtcatgctgcagccctgccgaaattgtgtgctcatggtagaagtgactgggaagaactctgcgtgtggcaagggctctcgctgctgcttcggtacagtcatctgtagggtcatctgtgacgtatgggccaggcgtgtgccccctcagaatcctctctgggtcccctgactcctccccaggagcagcccactccatggagcttcccttggccccaagtgcttgaagggaaaggtgaacacagtcgggatgacaaagttaggaggcgtgtgtttttcttcccggtgacgttgggccggtcagcccgcgtcttcgtagcttcaatggcttctcctgtgccacgcggtgggggagctttcttacgcctcgttctgaggattagagacaatggctgcacaggcactgtggctgccatgctcaggcctgccctcgctcctgacccccaggccagctgcttcctggttccagggggccaggaggaggatcttagtgttagcctgagatcctgggcaggtccagttctgaggcaggggagccctgtatggatttgggggaatgctggcaggatggcctgccggcccttttctccccacttcccagacggagctgaagggaaaggactcttccctgagggaggcagatcttcccagggcctgtctgggagctccctccagtgaggaggctggtgctgaggctgggagggctggtgcccagggcccgggctcttgagcctagatggaaactggggccaccttcggagttcttgccacatccctgcagggctggtgcgtgagggaccgtgtggtctctaagaagagagggttcagcccaagggtcacctccttcaggaagccttccctgattccacaggcagggttgattgtgcctcccctgtgccccctcagcccctcttcctctagtattgtcacctggcatgggtcagtgccgcccacgagcctgtgagctcttgtagggcaggggccacgtgccaagcaccaagtaggtcctcgatatgagtctgcacagtggatggaagaactctgggggaggcagagccgagctcagtaaggccttggtgggagggaagcatgctgggaatgcagggtccaatgggagtgttgagggaggttgaatcaaggacaaggaagggtcctttcaacccccaggtcctgtgaccctatgtgagatcaagagtcagggcagagtaatggcgacagctcacatttactgagtgctaaccacaatctcactttggccctagcagccttcttaagagggtggtgtttccccattttacgcttgaacaatctgaagctcagagagggtaagcagcttgcccagggtcacagagctatggacagagaccagatgtgaaccctcatctctgtgttggaatcctctctacaggtgcctctgtgctgtgctggtttttgcttctgtggcttcagactttgggggaacgttcttaggacccagctcttgcctgtcccttgagccagcatcatccttgtggactgggagttaagaactaggcattcttaggctcaaatcccagctcagcctctcagcagctgtgtgcccagacccctgtcctctctgggcttgtttcctcctctgcaaaacaaatctactttactgtagggtcatgaggcccagagactgtggaggtggagcatggaggccacagcctggttcgtcctagtgtctccgtggcgcaggcttcccagaccatgtgtgtacacggtcatgtccacatggtaattaatgtacctgagtgctgagcaggttttgattggccaggatctctacagcatttgtttagcttctttgaaataggggatgcaaaaattctggggagagcggaagtaattagtactcacaggaaaatgcaaatatttttatgagtatcctatgaaaaattgtatttttcctgagcaagtagtcctgtttatttctccaacagaattgccacagttgcagcagtggctgacctacgactgccaggagcatttctcaggtgtccacttatctcccttcccctggctttctcttccccttcaacccagagaaaacattatgaggcaaaagtgaccaaatttgggccttgctgagagaaggggattactcttgtagtgaaaagtccatttttgtggccagacttttctcaactgtgaaaaccagtgtgggcaaaaacatcgtgagcacaaaaatacattaaaaaattattttgcttggaaagaactttttttttccagttctgctacttcttgggaaaagacatttttaagaagatcaatagtgttgcaagaggactaggggtctgctttctcctaagagatgtagagggatagagggaaaaggagggaagccccaggcagggcggggttggggagttgggatacagagcaagagggcttaacatgggatgagtgcccacctcgtgcctcacacagtgcgagggcttcaagcacattttcgaatcgacccttataaagggcatttggttattaagccaattgggaaactgtggttcagagaggttggggaagtggcctgtggttattcagcttgtggacagaagagtcagcagcccagccctccccgtctgatgagaaccccttctctttccacactgccctagaagaagggactcttgatccagggctgggtcaacagacagagtgagatgggaagaggcacacccaggggaggggctgtgtgtaccttccgccttgctgggaaggtggttgtattccctttttcagagcagaaaatggaggctcagagattatggtgtgcagtgtggcttatttgttgttgtttctaagtccatttggaaatgatctcttcccttccggtcctgcctcgcccatctgtttatccatccatccattcatcagagattgatggagcttttgctatgtccaagcactgttctaggtgtctgagagacaggagggaaccaaacagggatacccactcacatgaagtctgcattccaacgggagatgagacagagcctggcaggaagcaatgagcagaataactcagaaggccacgcagaacgcttgctgcagggtgatgtgtgcctgggaattagaaattaacagtaaaagaaaggcagaggggtcctgagatgggggcagtgggtgggggcaggttgtagaattaaaaagggcgagtagaggcctagcttggtgacttacacctgtaatcccagcaatttgggaggccaaggcaggtggatcacttgagctcaggagtttgagatcagcctggcaacatggcaaaaccccatctctactaaaaatacaaaaattagctgggcgtggtggtgcacacctgtagtcccagctactcaggaggctgaggtgggagaattgcttgaacccagtgagtggaggttgcagtgaactgagattgctctaccactgcactccagcctgggtgacagagcaagactgtctccaaaaaaaaaaaagagtgagtagaggattttccttcctagtgacagaaatgttttaaatgttttggaattaaacggaggtggtggaagctcaacactgtgagtgtactgaatgctactgaattgttcatttttttttttttttttttgagacggagtctcactctgtcgcccaggctggagtagagtggcgcgatctcagctccactgcaagctccacctcccgggttcacgccattctcctgcctcagcctcctgagtagctgggactacatccacccgctgctaatttttgtttttgtatttttagtagagatggggtttcaccgtgttagccaggatggtctcgatctcctgacctcgtgtggtgatccgcccgcctcggcctcccaaagtgctgggattacaggcgtgagcctctgcagccagcctaaattattcactttaaaatggttaatattcagtgaatttcatttcaataaatgattattttttaatggcgatcagggtcagcctcatggagaacgtgagagctgtgcaaaagctgcaaggaggccaaacctgttaacccaaggctgttttctcccaaggagcaggaggagggttccaggcagagggagcagctggagcagccagagcagcgagaatgagaccagctgcacctcgagagcccaatccggccactgcctgtttttgtaaatgaagttttatgggaatacagccatgctcatttgtctacatactgtctctgtgacccagagaccctatctggccctttgcagaaaaaatcctcaggcaggaacatgcctggggtgtttgaggagaagagtgtggctggaatggagtgagtagaggtgagagtgggaggaggtgaagtcagggaggcagtaggggccgaatcatggtgcccctgtgagacttcctgcttcctgtggcacccctggcaatgtcgggacagacgctggcatcatgctgatgtggaagctctgggagtatgtgtgtgtatgtagggcatagtagggtagagacatagctgaacttagagtcagatgtcagaggacctagtcttgagacctgctgtttgtcccttgccagctctgtgtcctcagttctctcacccacagagcctgatagtagtggtgatggtggtagtgatggtggtaatggtggtgctggtggctgtggtgatggtgatgctgatggtggtggtaatggtggtcgtgacggtgatggtagtggtaatggcagtggtgatggtggtggtggtaatgatgatggtggtggtgatggtggtggtggtggtgatggtggtgatggtaatgatggtagtggtgatggtgatgatggtaatgatggtagtggtgatggtggtggtaatggtagtggtggtggtgatggtgatgatgatggtggtggtaatggtagtggtggtggtgacggtagtgatgatggtggtggtaatggtggtggtgatggtggtggtaatagtggtgatggggatggtggtaatggtggtggtgatgatggtggtggcaatggcagtggtggtggtgatggggagggtggtggtgatgatggtggtaatgagtggtggtggcaatggctacatttagtggcacctatgaggtgctaggtattttgcatatggtgctaatccttaacagagcaatgccaggtgggtagcagtgtctcagtttgcaggagaaaacacggagggacttaaccaaggccacacaggtggtatgtagcaaggcttagatagcagtgcagtgacacccgcttacattgcagtgaagatgtcatgaggcagtggacggttgtgtcctggtgaacagtgcagctgtcagggaggggaggtagcctttgtgggggaggtggcctggtgtcagcaccaccctccctggaagggtttcctgggagggactgtccccagcctctccacctcccctgggtcacaccagagtgctcctctctctcaggccccatgtgctgggaggggccctgtccccatccccatggcgaccagttacccagcctggtgttggttttggttttcctcatttgaggttgtgggatccctctggttgaggctgaggtttttctgctttggaaaccccaactgtgttgtggccgtgaggaggggcctggaggtgctggcacctgcccacagaccgcaggccccagatgccccgggccgccccacgcgcctcacaccatccagccaagacatttcagacactcatagctgagaactgtggcacagggaactttctggggtcaggagaactgtgtctttgctccccagttccgctcctgtagaggacagagccactgggagggctggggtgtatgatgccccggttcgcatctaccccgtggcttttgcccccactttgggtggaatccttgagcatagcaagcccctgactgagcggcaggcggccagcaggcccagaaagggttccagcccctctcgccgcctcctggcctgacagttctggcagctgctccctggcctggctgtgcccacatcagagtgtcagccctttgaatggaacctggggctggatcctgcacaactcggcccattccttaggtctctgaagtggttctcctcatgtgaaaagagccagtccccaccaagtggtgaagctggtggtgccagccgcggaatgcacccttggacagggagaggctctgtgccccccagaccaccccacttccctctcttgcctgccacctggggtcctatgctcagctaggaaagtgcgggatacactcaaaggcagcaggaccatggcgcctaaaagctcctgatgcttcctgccccagggaacagtggacccatgccatccagaggcactgcacaagccccatctcgagagattctgggtcacaggtattttggcagcccttcatgttttcttctaaacctctcaatctggggatagttactgggagcagtctcctcctgacgccactagaccttgacctcgcagctccagcactctggggcagcgtagtaatggaggaaccgagggcaggatgaggactgaggctggattccccatgattctggagattgtgcagaaaggctgtgtagagaaggtgcaccgagtcagggacccaggcaggggctggctgttctcagaaggtgagagccatagagacagaacgagacccttggcctgtatctgccccactccatcccttccctgccttgcccactcagtgggctccccatcgtctgtctcacttatggggatcttcaagaaaactcttgacagaagcggctctgcgccctgtcctggtgtaaccctcctggatctcaggtgaagaaactgaggccagaggggtggtgctttctcctacccccgccccataccaggggcctgtctccctttcacagtggttgccaagtgcatcgggttggagaaagtaccctacaggctgaggtcacctcaatacacttggctggagtcatgttgcttctgaaaaggcttgagtcactcggtgacgcagcccctgatcaggcctgtaattgggatctcgccttgttcgggcctggatgaaaagagacttagaatcagtgagaagccacatgcccacctcatcagtttcagctggaggtgcctctctgggggtggcaaaggtggcagagccctggtggatggaaaataagcatcagtggaggggagggaggaacaggaggcagtagacacaggggtaacccattctcatcagaacagctggccgcctccactttgcccaggccagatctgactctgagaacacccacagcctccccacggtgatattttctggaaatccagccctgctggcagcacagtgggagctgagtcctgaaagcccacctgggtagaaaagaactggatggagtctttagtcctgcagacatcacaggcagaattgtgacactgccttccactctgcagatgagtcatcggccttttgtggctgggaacgcggtagagtgatccttccacatgcagtcactgcgacacctgagaccctcccagactgattcagttgcgttgagagcagcttctccggttttcagggctttccttcctccccctccaaattcatagtcgaaagaccccgcttcatgacatagtttgggtttctaacaaatgtggtcccctgcattagcataatgctgacttttctgaaccacaagccagtttctgctgggaagtcctggggtctctgtaacctgtgcccctcgctaccccatgtccttgtgcctttaaccagcagtgcccccagactattctggaaatgggggtgatagtttctgtggccccattcctgctacgtctggttgtgcctggccccaacccaggggcttctgctctgagctgagagctgggctggccatgccatgtcaccctgccctctccatacaaggaccagacccactgaattgtttcaaactctagagtcacctgtgacatgtggcctggagagaaaagatgagttggccaatcagatttgctccttgagcctttggaatcaggattctgggagatgggtagtgagctgggctgaagggtgctgaaggttcctgaagacatagcagcctcaacagctgcaacacagttctaactacccaggattagtgcagacatcacaaatgaagagcacagtcttcacaagaccaccctcactccaggcacctgccacaagggtgggggtccccaggccactggcacttctgaccacggcaacagattcagggattcccctgaagctctcaggttggataattcgctagactccctcgcagaacccagtgcagcgctacactgacaattacagttctattgttgcaaaaagatacccaaacccttgacagggagaggtgcccagggcaaggcctgagagtcccagatgtgaagctgccatggatgtgccacctcctggcacattggtgtgtgattaccaggaagctcacccaggcctcagtgtctggagtttttactggagcatcatgattttggcatgattgatggaatcactgggcacatggtcgaacccagtgtctggccccccgtccctccctggaagtcagggtgataccacgtggcccaaagcctcaaccttctaatcccatggctggtctctctgacatgcccagcccccctcatgagtcatcttgttagcgtaaactcagatatggcttcaggggcctaccatgaatgaaaaagacactcctattactcagaaaattccaaggacttagagactacctctcaggaaccagggacaaaagccagtcagattctttattatacagtgacaagttggggcctatgcaaagacgtgagagtgtcctgatctgtggagatgccaggagtctgccccagaggagtgtggcccatgggaaaacaggcccccacttattcagggtccagaaagcacggcaggtccactgcggatcctgccttcccatccccagggatgactctcttttctctgggatctgtaaacaataaaggtccaagggtcaccagaaggcaaagaggcattcagtagatgggtgtgtgtgtgtgtgtgtgtgtgtgtgtgtgtgtgtgcccaaaataggtgtgaggcttgaggtgacttctgcccaacttcacagggagatgatcagggcctgggggagagttggggggaagcggcccctgaggctgtctcattggcccggacccctcaaggccgcagctgagcagtgctctccctgcagtctcccttaggctttccggtataggaggggcctcatacggtttgccctgcccctgtgagtggccctattaatggctttaagcctgccaggcatcctgctgtgagaagaatgcctgactcaagtcaggcaggacgcagcgaccttgtcagagtcagagcccaggatcaccagattctggagctgggaggaatatttttcagtcaacttttccaagcgtgtgtgtgtctcttcaggtcctttttagaagacgtagacagggcagaaataacaagtcagagaggaagaaattcctagaaagagtggtcccgtcattccttttctcactgatttccaggcactttctcttgacttacagcagtggttctcaaagtgagagtgcatcagaatcacctgcagagctcattaagttactgatgctggcccatccccagagtgtctgattctgtaggtccagggtggggcccaggaagctgcatttctaactggctcccagcgatgctgatgctgctggtccaaggaccaccgagaaccactgacttaagggcaagaaggaagctccttccaacaaatgcatggaaccttcctcagtttcccccgtggaacctttctctgatcgattgcacatttgtcaccagggaggaaaagaacattagactaagagtcagaacagcagagccctggttcaggttatgatacacactccctgattgaggcaaggttctttcctttctgggactctatttctgaatctgtcaaacgggttcaatactaggacctacgtcacgggggtgatgtgaggattgaactagatgacatgttactggtgcaaattccctgactctgagggtacagcaaaggccatataagcagtccagggtcagttgttttgcacaggtctatcccatccctcccaaggatggtatgtgaacctgttgggcttaaaggaacccagtaagttagaccttagaccgtccacatcaccagtattgcgggctttgtcagtgtcctttggaggagggggctgggctggcagttccactccactgtgccaggtgatcacagggctctgggggctgtaggccgctcactgctcagaatccatcatcgctgcaccccagccgcatcccactgggctgacactgccacagggacaatgccttcctggagctcaggtcgtcccactgccctccccacaagcactgcacctcccccatcctcagcttctcccttctgttctccacaccggttcatttcagcccctgccttgaaaacacaaacaccactctcagaaacagcaaaggcaacaagaataacagcaagccagtttcttcccccaccaagacagcctcttctcccatggcagttttttgggtggaatgataccgttattcttccctgggttagccacaggagcaaaagaaacgctttagtctctcagtagctcactgtgacaagtgcttggcccgtgcttaagaatcagtggctttttattattacttggcttctgccttccatcaggcactcctttccctgataggacatgccctcctcctgcggggcccccaccctcctttgttggccactctccttcctcctgccctgccttccccttaacatacttccccagtctggcaggagggcacctgctggaggacatcgctggcagctggcagccgagggggcccccagggctggagaaagcaggagtgagagtgggattggacaagcaatgccctccctagagtctgtcccttctaaagggccagtggcagcccgagccatgaatcaggggacacgccatcttgctgttgtccgcctttctccaggttttgtcttggactccttccgatccgaggccaccttggtcctctggtgccttccccagagcgggagcccccctgatcggccctgggcctcggtcactgccattttcccttgcctggcggggcaacccttctccatgcaacctctcctacctgcctggctacaaccccagctgtcttgctcatctttgctctttgatgcatggaatgagctggatgaggtcagggaccatgtcctcttccctgactcattacgggtacctggaaggtaaaccctgaacagcagaggatcctttgggaaagcaaataaagccggaggctcctcgggacaggaaatagcggtgagccagtgccagcagaagattgtgctcccgcctgggtgtgtggcttattccctggctccattaattcctctccctgagcctcagctttctcatctgtgaatagggtcagtacctcctgaatgagggccaaatgtacagtgcccaggtcagtgctcagcccagaaggctggcagggagggaggttgtcatttattcctgcaagcattcatgcctttacccagtcagccaagtaacttaatggaagcttgcaattaaacaagaattagctgcacccgcctccttcccgggagcaggtctgacctgagctgggagaggatgtgatccagacagggggctctgccttttcagggcagcatgagaagggacactagagctggagcttgaagaacaagcattcctggcagagaaagccatgcctgtagggtcggagtgggggaacaatgatgtatacagggattggaggggctgccaggtggccaggtggctggatgtaaagcatgacacttgcattcactcagcagatactgtttgggcttctacagtggaccaagaagaaggtgacagagaacaaagaaacccaggtccctgacaccacgggtccgctatcagcacaggggagactgatgacgggcaaggaaacaaataagtgggaagatttcaggtggtgatgagagctgtgggctgggtctgggagtccagcagtcacttggcacgtagaggttgaatgagtccatgaaaatgtgctgcatgcgttgagagaatggatctgtaagctgatgtgcagttcaacacagagacagacagactgaccgaccagtgcttcctacacacttccatggcacgtggagaatgggcctgcttcacaaccgagctcagaggagacctccaggaaggtagaattcaggctaagactggaagtgtgggtgagaaacattcggaaaggtaggaagaaggtgctcctggcagaatgaacagtgagtgtaaaggccctgagagcagaggcagggagggaaataaagcttaggaagacagtcaccgaggccctgaatgggaccaaggagaacgggctgagcctatgggtggtcaggcctgggaactggccattcctgctgctgggacctgagcacgggggaggtgggaggtgatggccccagccccttgtaggcctaacacccctccccagcagtgaggtgggcctagggcagcgggggccgtagggccaggtcacaggaggaatttttacagtggcatggctgggccctgccccctctcaggatacagagaaacaatcaagtcctatgaaataataaacagtgccaatacttcagttatcaaatatgcagcttcacaaccccgcagcagcttgagagccaaacatttgtctagacgtggtgccttctctgaggcaggttttgtttgttgttaagaagtgaaaccttctcccagcccatctgagtcaggaaggttgggtttatttcatggcacttttagaggaactggaagccagatatggggtgagaggccattctggggtctgctgtcatttagggggatcccctgctgagaacatcctcgtattagcttcctgttgctgctgtaacagattgccacaagctaagtggattaaaacaccacacatttagtatcttaccgttctggagatcggaagtctgacgcactctcagtgagttaaagtcaaggcatcagcagggctgtgttccctctgggggctccggggagaatccttcctggcctgcatgccttggctcgtggccccttcccatcttccaagccagccaatggctggtgagtcttcgtcacattgcatcactctgacactggttgctctttctccctcttccacattttaggaccctgttggtgacagtgggcccacctggataatccaggattatgtccctatcattatccataatctcatccacaaacttaatgctcatttgtcatggaacctaacgtattcacaggttctagggattagggcatccctgagggcgttatcctgcccaccacagtccccctgccctattctggaagctgaggaaatagggttgaggaggaaagtgagcccaggccgtagctggagagtctgcaccctcggcttggggctgcctccaagtggcttacctttcccaccgcctccaaccccaccacagctgccccatcactaacagatctcccccaacccctgttcttttcctaaatgttggtaaaatggtcattaagtaaagcagcattttttccacatccctacccttgacttactttttcttttgagatggggtcttgctctgcacccaggctagagtgcagtggcatgatcatagctcactgcagccttgaacttctgggcccaagcaatcctcctgtgcgccaccacgcccagctacttattttatttttatttttaatagagacggagtcttgctatgttgcctaagctggtctaaactcctgggctcaagcaatccccccatcttggcctcccaaagtgctgggattacaggcatgagccaccacatcttgtcccaacccttgacattttagagccaaccatgctttgttccaggggtctgtcctgtgcacagcgcaatatttaaccacatccttggcctgcacccactagctgccagtagcacctctccacccagtggtgacaattaaaaatgtctccagacattgccaaatgttccctgggaggccgtcgctggggttgggaaccactgaggtaacgcgttggatgtgtctgtcttccctgctagcgacactgtgtccggcacctgcagagggcctgccgcttagtatgtgctcaacacatattggttgaacgaatcagtgaacctatgttaactttcttaatgaataaatctataagtgtgcatgtataaaatagactcctgggttccatagactggctgcctgagagtcacctggggatccttttaagaagtcacattcctggggtccaatcacagaggattggggtacagcctagcaatctgtattgtcaagagtgcttcatcagttcccccaaaacttaaacatatataccatataatccagcaatttccctcctgagtatatacccaaaagaatggaaagcagggacttgaacagatacttgtttgcaaatatccatagcagcgttatacgtaatagctaaaaggtagaaacagcccatgtgtctatccacaaatgaatgataaacaaaaagttgtatacccatacaacagaatattattcagccttcaaaacaaatgaagttctgacacatgctccaacatgggcgaagctcgaggacattacgctaagtgaaagaacagacacaaaagaacatgtatgattcccttatacgaggtatctagagtagtcacaatcacagacatggagtgtaggagagaggttgccgggagctaggaggaaggagggaatgggagttaatgtttaatgggttcagagtttcagtttgggatgatgaaagagtcctggagatggaaggtggtgatggttccacagcaatgggaacgtccttaatgcagctgactcgttcacctaaataatggttaaactggtacattttatgttatgcatattttgccatatgcaaaaaatggtgcttcatgcctgccaggtctgagaatcagtagtgtgcgagaggaatggggagcaggggatggacccgtcgagttctaacgaccctcccaggccttgcagctgctgggatggggacatcagactctgctgagctagggtttaggctgatttcttgagagggtggccctatctgggcgtgcacagaagaacctctaggctgcctgaatgagggctgcggctagatgaggattggcttgtctggaggccacatgtgctgtcccccgggcagctgctgcccagctccggctgattcttgccatgtggggtgcctggctgtgggagagacgtccaaggtctggatttcgatgtgaaatctcctcatttttatttatttcaatagttttgggggaacaggtggtgtttggttgcatggaatgttctttagtggtgatttctgagattttggtgcacacgtcatctgagcgaggtacactgtagctagtgtgtagtcttttatccctcacctccctcctccccttcccccaagtcccctgagtccattatatcattcttgtgcctttgtgtcctcatctgagctcctgggaatctcctaatttttcaatgttggcaactggttcagtgaacaagcaagcagacaaacaagccacctaagggtcacactggtgaccctgcgggcctccggtctggcttgcagcttttctgggagctcacaggctgggtccccagctagatccttgctcctgctcccgtcatggctgccgcgtcactcctgaagtctgacaccagctttctctttgatcctctgagaatttctcttgtattcagggcacccaaaatggtggtttacagagagaatagcaagagccagggcccagggtctggattctgctcaggctggggtcttggctctgccaattatgagccacggggccacaggtgacttgctacctttcccccatgccttgatttcctcatctgtcaactgggtatatcatagttcctgccggccaggtgcagtggctcatgcctgtaatcccagcactttgggaggccaaggcaggcggatcacttgaggtcaggagtttgagaccggcctggccaacatggtgaaaccctgtctctactgaaaatatgaaaaattagccgggtgcggtggtgcacatctgtattcccagctactcgggaggctgaggcaggaggatcgcttgaacccgggagaggcagaggttgcagtgaaccgagatcgtgccattgcactccatcctgggtgacagagtgagactctgtctcaaaaaaagaaaaaaaaaagttcctgccttgtagagtaagggtgaagcctgcaggtgaggggcttggccccgggcagggccagtgcatggctgagcagtatgcgcgtgtatgtttatatgtacatgaaatgtgtgtgcacttgtgtgtgtggcccccgttggcagaaagagtgagcgtggcatgggtgatttcttcctcaaagagtcattctgaggattaaacaagataatgtacaggtggagcctcaccacggcaggtgccgcctcaccacggcaggtgcccaatacgcattccttctgtccctcggagtgtgaggccttggccgtctgtggagatttgagaggaggacactgggctagttggagaggagggagttgggttgaagatgcaatgagaggagaggagagagactcctccccatcagcactctctcctgcttcctggagcaggagcagagttctggtcccattctcagaggcaggtgcactggctaatcagggctatgaccttgctttccaggatagcttggatgacagttaagaatccccagttctgtgcctacttttaaacacatgctaccttgttttccctcctttcagctttgggaggaaggccttactgtctccacttcatggatgaggactcagagagggcgggtgcttgtccaggcttgcctaggcagcaggggatggccacagggccagagcaaggtggaggacaggttgggctggctgggagagggctggagctgagtgccactgggctcccctgggttgctggtgtgcagaaggggccttgtcctgcccagctggttcctgggagggtgacagagtggaggggctgcatacccacccggagcaagcagacgagctacataaaatcctgataaccaaggggcacaaagggctccatgacctgtggtgagtcatggacagatggtggctaagcgccactgtaagggtggagagtgggtgacggcaccttggtccccaggagccctctggccacatggcacagcagtgccttcaggtccaaggcccagatgctggtgggctcagggacactgaggcccagagcttcaccccatcgctgtttgcgcctgtgcaccctgacacctgtccatcatcccttggaccaggagtgcaaggatgacgggaacacctgtgtgcgcctcatgtggttctgcacgttacacgtgactgttcattacatgtgttcattactagtgcacattcattgtgcgtgtgcatgttcatcatgtccacgtgctcagtactcgtgtgcactggggaggatgtgaggcagggcgggcccctcaggagtccctccttccttccagcctcggagactctggggtttgtgaggagcaagaagaaggcggtacttgacaagtggaaactgaagttcttgtcccccaacatctagcctccagctggggaaggagactctccacagaaagcaagaggacaaaacgagggccatgaggggccatgggcacctgcctgtgcctctgccccacagggatgccccaagctaaaggggatgttcagacgtggcaggcctggcccctgctgtgggaaggctgtggtctagtctaggggaacagccgtgggggatgcctggtgtgggtggggtgcaggggagccctaggcctcactgctagggggccggggtcaggcaggactgtgcgggatactggggctcacagcccacctgggaggaagagtgtgtgtgtttgtgtgtgtcttgggctgggggtgtgtcactggcttggcctacagcccgtccctctgtctctcagcccaggaggctggtgggcaggctcactgcggggacgccgcaggctctggagcctcagccaggcatctttttccccatctctgcagggggcggaggaaagcgcaaagggaaaagcaagaagtggaaagaaatcctgaagttccctcacattagccagtgtgaagacctccgaaggaccataggtaagctgtcctgcctgggggctgtgcggggagtgagtagcaggtgatccgccaagccgtttgtgcattaaggcaaatgggtgagccgccaagctgtctgtgcagtgaggcaaatgccaatcagtggacacagtattgtgcttccaggtaggggctccaggctgacctttttgctaatcaacataaacaggcaaccagtattcattgaatatatggcatgtgccgggcagagtgacctcctcccagttatcctttgaggcaggtgctattatttaatatttcacttcacctttcagatggggaaactgaggcacagagtggttctgtaacggcccaaagtcacacagctgatgggagggtggtggaggtgggccaggcccaacacagagccaccgctcataacttctcccctttcttcctggagcctgtgggtcctgccctcagggggcagcccaggctttgggagctgagagtcaggtggggtgggggatgtggggtgaggtgggggaggtagggctcccctttccacttgctggggatgtcagtgctcctgaggagccactgggctcagtggcacagcttagccccctgtatccagcacacacacaccaggcacctccaagagcagccaaccaagtgggtctgtgcctggtcccacgcaggacacggctgtggtgaggaggcctgggtgcctgggcgagagcgcccaggggacaggcatgatgtgaggccccactccagagtgtttggggtcccggcccttctcccctctgtgccctggggtgggtccttccccatcactgcctgagggctccccatccgcttattattgtcagaggtcatggacgtgctgaacacgtttaagaagactcaagtccactgaaggctgggcacggggtggtgctgcccagaactccataggcccagcttttctggggacttctgcccagggcctcgggtgagctgccccgtgcctgccctggaattcaaggccacatgtagccatttattcagcttttctaaatggcctcttcacggtctgtccccaccagtttccagggccggggggacttacctgccacccccaggcttgctccgtcctggccctgggccactcagtccacactccatgtttataggtgataggaggccatctgtgccccgccccacgacggcagacatgagcaggtgaagcaaggtgggatcctgaagggtcaggaaacgtccttaagacccaccttccatccctaaaatcccaggcacatcagaatccccatggtgttctcgggccgagaatgctgctggcctgagggattgggggctctgggtccaggcagacatgggttcagatcctgccctctctgctggccacatgacaagttactttatcctgctgagcctgtttccccagctgtaacactgtctgtgaacccagtcatagggtggtggagtgggtgagatgagaccatgtgtgtaaagggcttagctggtgccctcgtcgggagaccaggggcccatgcccctctgcacactggcgtgctttccggagttcccacagacaccacggtgccgtggatgccgtgtgcacccttgatgatcagcttttctgctggaggcagtcgaggtcgggtggaagagaagaggggctgtgttcctggggctgtagcttactggggaggatttgaccactgagactttgcagggggccttcagagaggggagccagggagaacccctctggtgactagccatttcctcatgggggaccattttgttcttcatgctaattttggctcagagagaatagggcctgttgtgggactggggaggagaccttagttgccatggttgcaactcacccatgtgtgcccagcaagtaccccctttctggtgagccaagccttctctgtcattttcatcctgggtctgctggctgccagaaagccattcctggatgctgagcccagcttctcccaaaagagggatgttacctcacaacccattcactgtggccccagggaacgtcttgcactcatccacagggccacagggctgctcggagagacctttctggggtgttgagttggaggtgagagcttacaacaggaggaaagcatctccaaggggagcaatgtgagaagcgggcacctgcgcacagccacgctcacctggcagggcggtgcttcccggccctggctaaactgtctgcaggtggtgatgccaggagtgctatggggcacagccagatgtgaaggccacttcctcagagaagcctcttttgactcctgaatttaaatgagctccagaccagagtctctcagagcacctgtcctcttctgccagagcacccttcctcagggctctttggggaggaactggattgttaaaattcaccactgcgtagttggtgcctgcctcacaggaggggcacaatagatgttagttggatgaacgagggaaggaaagaataaatgaggtgtaagtgaccactcaacttatgaagtgtttctaataaatagaagaagagcattgagagccagatactgagcattcatgtatctgccatccagatgagagaaatcttaacattttgctatattttattcatgtgtttctcaaaaatataaaagatgaaaatatgaaatataggatttatggttccagacaagagggagtagatgcggtgtttcctgtccttcccgctaaggacagtcaaaaaccctggacattatgtataaaacaaacataagattttgaaagccgggagagaagaaggcagactggctggggacctcgagccatgagggacgacacagcagtgagcttcctgggtttcttttttatatcccagagtggatactagacaaacttgcaacccacaatgccagtgggtgcagactaaaaagctccttccctcaagaccagcctgaccaacatggagaagccccatctctactagaaatacaaaattagctgggcgtggtggcgcatgcctgtaatcccagctactcgggaggctgaggcaggagaatcacttgaacctgggaggcagaggttgcagtgagccaagattgcgccattgcactgcagcttggggaactagagtgaaactctgtctcaaaaaacaaaaacaaaaacaaaaaaaacctccttccccctgcagaaaagcttttgctggcatagctggttactgtagaactgtcccgtttctgctatggttcacacgccagcaacgcagacacctactttttttttttttttttttttttgagatggagtcttgctctgttgctcaggctggagtgcagtggcgtgatcttggctcactgtaacctctgcctcctgggttcaagcaattcttgtgcctcagactcccaagtagctgggattacaggtacctgccatcacgcccagctaatttttgtatttttagtagagacagggttttgccatgttggccaggctggtttcaaactcctggcctcaagtgatcagcccatcttggtctctcaaagtgttgggattacaggtgtgagccactgcgccgcctttttctccttcatgtaacctatgtcttagcatgggctgctttaacaaatacccacagactaggtggcttaaacaacagacatttatctctcattgttctggaggtggggaagtccaagatgaaaatgccagcagatctgatgtcctcatcagtttttcctggtttacagttggctgtcttcttgtatccttgcatggtggggcgggggagggagggagggagagagagagagagagagagagagagagagctcttgtctctttttataagagcactaatcctattcatgatggttccaccctcatgaccaaatcacctcccaaaggcgttacctccaaataacgtcacgctgggggttaggtttcaacatgtgtgttgcagggaggatgcggacattcagtccatagtctaggactaggttcagtgccaacctattcctagattcaaagagccagtgcaccctggctttccacctctcccctgagacacagcttctcatactttgagattaactagccctgccaaggcctggtgtccctcccagccccctcctcccaaattaagactcttagatctaggatgggtgtgatggctcatgcctgtaatcccagcactttgggaggctgaagcaggcagattacctgaagtcaggagttagagaccagcctggccaacacggggaaaccctacctctactaaaaacacaaaaattagccaggcatggtggtgggtgcctgtaatcccagctactcaggaggctgaggcaggaaaatcgcttcaacttgggaggcggaggttgatttcctcactctaggcctcctccccataagcttccaggcattgccctgggagcacctgagtgtccctcagcttccagtctgcctggccccacctcattcacttccactgtgggggacctgggagcacaggatttggctctgagcttttttctgtccatggaccacccccccgccgcgaccatgggccccagccctgtctgtccttctaggtccataaactggcctcttggcagggcccactcccctgggatggtgtgaggaacgtgcgtgctggcgtgtggaaatggattcttctgttctgccggagggtattgaaaaggctctgtgtgtgagtgccgtgggagagaggcccgggaagggcaggaaggctgacgtgagccgtggggctgcagctcgtggccacggggccagggtctgggccttcccactgtttacagtccgtcgctgaggtgtttgcccagtctctgctggggtcctgctggaaggctttttaaaataaaattctcatttctttcctagaccaatacacaaaccaaacagtggccaataccgcatttatttttcttgtggacacatgagctcactttctgaagttctttgggaggatgtcctgggacaggctttgtgccaaggggacagggcccctttagggtgtgaggtggtgccatgagaaggctcttgatcagagctgagggcagaacccatgaggaccccaggatgccgccatgtctggatggccccgaacggtggtctgttaaagccctggccttctgccttcagccctgccctggacagtcatagaccatctctacctagcagccagggtgatttttgaaaaatgaaaactggaccctgtgaaatcattctcctgctgaaaccaacccaacagctctccattccactcagtaaaacccagactccttactgtggcttgtaagcactttgccctaaggtgaagcctgtagaccccttatcagaagaatgcttttatagataaaatagaatacatagggttacagaggaaactgatcctttttaaatatacttactacatacttctaaaatttatgatacagaaatatatgtgcttctttgttaatactttataaggtctaactgtgggtctaatagctattgtaattttgatttttttttttttttttgcctcagagtttgactctgtcgctcaggctagagtgcagtggcgtgatcttggttcagtgcaacctctgcttcctgggctcaagctatcctcccacctcagcctcctgagtagctgggactacaaacgtgcactaccatgcccagctaatttttgtattttttgtagagacgggattttgccatgttgcccaggctggtctcaaactcctgagctcaagtgatcctccctcctcagcctcctgaaatgctgggattacaggcgtgagccactgcacccggccagctattgtaattttgaacttgtcatgaacctgagtgagcttttcagatatctgcaacaactgataggaatggatctttgatttctgccggtgacaagtccccggcactgctgacatcattgtaggttgttgtctacattcataattgaaggaagtgcaaattttcagttagaggttggtgaaaagaaagatgacatttttctccaccccagtccatggactctctaaatcctatccatggtccttttggcagtgccctgcctgtgctgccctatgtgagctggccctcaccttcatcttggatccttccctcctcctccattcacaagctggtctcccttttgtcctttgaataacacacgcttgtctccagcccagagcctttgcacctgttctctctacccggaatgttcttcctcacactttttcttccaggggactttaaggtctcagtccaaatatcatctccatagagaagccttctaaaaaggaaccataccctccttctaattgcatcctttcccatagtgctgtttatttaatgttcttacccataactccgtctgaagccatcttttcgtttacttgtgtattttctgtctcccacactgtactagatgttctatgttaattgcaactgtgtcttgcctgtttcactatgagaacagtgtctggcacataataggggttcattaatactgggtgaatgaaggaatgaatgaggtgaaatatttgaaattagagctcttctaaaaaaattggtgacatgtgtttgctgtacccatttaaccttagccagtagtttacacttaaagtaattaaagtctggccttaggaggcactgtaggtagcatctgctgtaacccacccctccccctgcccaccatcctcaccatctggatgaggcagctcagcatggtacatgactcagccacagtctcacagccactaagtggggaggggaagctggtggctcctggggcaggttggtttcctctgaagctgtagtcggagtcatgatcacagtgatgtcaggttttcacagaatccttagctcaggggactggagagcatcttgtccaccacccattggtggtggagtaaacaggcttcaaggggagagtgacccgcccaggagagccaggtccctggtctggagtgacaccttgcaactccccatgagcatattgctgcataaacgtgtgggcagggccccagccagtactcaaggcagggagactacttaggtgctcaaaggggtggacgtttctgtctctcttgtatcttgtaagtgtgtgcagcgagttcctctgcttattcaatgcatgtttagtgagcactgaaaacatgctgtccacgggggagctgagcggatcgctgatctcctggagctcatccaccaaggagcatgggagaccaactgaaattaagatgagatgacaaatcaagaaagttccacagggtatggagcaggttgctgagctgcagaaccaaggcaaagatctatccccacttccctggaggaagtggcgtccctcctggcttaaaggatctctctgcgagctccctgagggcctggaccacaggctctccatctgggcgtctccattgctgtagcagcatgagtgggtggatggatgttgccttctcttcaacctggaagccaggactgtgagtggcagccatgagcactgagacagattcctaggccaggtgcagcggtgcaggcctgagcattgagacagattcctaggccagctgcagcggcgcaagcctggaaccccagtgctttgaggggcggaggcaggaggattgctcaaacccaggagtccgaggatacagtgagctatgaatgtgctgctgcaccgctccagcctaggtgacagagcgagaccctctaaaaaaaagaaaaagagagagagagattccttgccacccatctctctgcttccagtgtgagccccacgtatgaactaacggattttcaacagaactggcacagggcagacagaccatgagaggaagaaggggttctctaacgtctgctcagtgaaacatcaaatagtgactttattagttaatgggataattgttcatgggagatcattagagagcccaaatcaaagaatttcttaggatgtccgaaacttggaaggctggaatgtcatcacgaagataaaagattgttgaggtctgcaaatatttctcagtgacgcagaaaggtctgttgggcaaaagtgtggcatttttatttatttagctcaggctcattgcgtactttattctttcattaaaaaaagtctgagggggcttgagtgaaagagttgattattccactgtttggcaatatttctgtaggaactgtccaaaagctatataataaatcaaggccccctccccaccccccaacaggactgacatttatgaggaggctgttcacagaaagtagctgctgcgtctggcgtgccacagcagtgccccgaaccctcacagacagacaggggagatcgaattgccttgtgggagagcctcttgccaaagccttaactgtttccaggagcagaagtcccaggctgtgggggattcctagaggaaaatgtagaatcttttaacatgggggaaaaaaaatcatcttcatagtgtgaagatttccttgaagtagtctagtacttggttattcacccaacattgcctgcctgcctgctttgccctgcctgccttgcctctctctctctctctctctctctctctctctctctctctctctctccccctctccctctccccccacctcctctttctttctttcctcctttccttctttatctttctctgatatttattttttgagacagaatcccactatgttgcctaggcagggctcaagtaatgttcctatatcaaccttctgagtagctgagactgcaggtgtgagccactctgcccaactgccatgttcccttttttgtttttttgagatggagtctcactctgtcccccaggctggagtgcagtggtgtaatcttggctcattgcaacctctgcctcccagattcaagcaattcttctgcctcagtctcccaagtagctgggactacaggtacctgccaccacgcctagctaattttgtgtttttagtagagacagggtttcaccatgttggccaggctggtctcgaactcctgacctcatgtgatccacctgccttggcctccccaagtgctgggattacaggcgtgagccactgcgcccagcctgcgcatgttctttaaaccagacactggctaacagatacttgttaagctcctcctctgtgctaggcattgctgcagtcaccggacttgtgtcacaggccacccttgtccagcagcgagggctcctggaaggatctctgtcactgtcatcaagatgaagtggtggtgctgctgctgccagccctgtgactttgagcaagtagcttactttctctagtttgcagtttatttgtgtataaactggagacactaacaccaacctggtagagcctctgggaaggccagcagagtgttgcacacaggccatcattgtcatcagcatcgtcattgtcatcgtcatcctcacggcgatagtggtttgagggcagaggttgaggaccctttgagagggttttggagtttcccagagaagctgaatcggctacacatgatggatgaggccagctgtttttgtgctgaggtgaagtgggttcagtgtcccagagactgttgccttggagtcatcggaatcctcctcttcctagagcactgcctccagcttcctcttcttggaagcctgccctgattcctgcagtcctcagccttccttcctccccacggctccacagtttgcccagggaagctggaagcatcacactctgcccaggcccctgctctggcccagtgtgtttccttgaaaggacgtgtgtcatctagaagcctgcagccccgagtcctaacaatggttacccccagggaaggcgtgaaggtcagaggggacactggctttatctgtaagattgttttttttttaaaaaaagaatgaattggcatgttctttgtctaattaaaaatcaaatgaataaagaccaaataccctgcctgattccacagtggggcagagggaatggtgacactgtttccccctttccttgttagctttgtgccccctgatgagtctggggcccctgagaggatgatcagaatctcacacgtcttggtgacccagtccccttcaggcctgcctggctggcacgtgagctcttgatttcatcgtcagggaaaccaagtctctgcagacgtcattgctgtccttggggtgataagggcgcgtcatgtctgtcgttctgccacctagccgtgctgtgataaggcacagcatctgcttgtccttggagggcgaaataaatttagatgtgtcgggtttggaacatcaggtgacctgtccgcagctggagctctcaggagggaagggtggccccgctgtctttgcggtgttagtctcacctccccactacggccggaagctccttgaaagagaaggcacgagctcaggcacatgcaagatgcccagcgatactgtccgtgggtttcttgtttggacagtcttagaatggagtggtggcagggattttacagatcacctggagttgtggttttcaaagactgctctgcagggagagtgtgtgatctagaccaggcttttacccaattgggctttattttaccttttatatttgggcttccgtgtcagatttcattctagggctaaatttgagtttgaaacgcactgttctaggccaggtctcccatttccagataagtgaactgagtcccagagaaacaaggtcttgccagggtcttcccatgatttgactccaaggcaggctctctcccctactgcgttagtttttcctgaggttgccatagtgaaataccagagaccaggtggcttaagcagcagcagtttattgtctcacagttctggaggctggaagtccaagatcagggtgtcagcaggtttggttcgttctgaaggctgggagggagaagctgtttcaggcctctcccgtggcttctgtgggtttgctgtcattatttggtgttctgtggctgtagactcatcagccctatccctgtcttcaccttcactcggtcttctacctgtgtgaatgtctgtctctaagtttcccccccacttttttctctttttttttgagacagagttttgctcttgttgcccaggctggagtgcaatggcacgatctcagctcactgcaacctccacctcccgggttcaagcaattctcctgcctcagcctctcgagtagctgggattacaggcacccgccactgtgcccggctaattttttttatatttttagtagagacggggtttcaccaggttgccaggctggttttgaactcctgatctcaggagatcctcctgccttggcctcccatagtattgggagtacaggcgtgagccaccacacctggccaagtttcccctttttcatgaggacaccactcatattggattagggcccaccctaatgacctcattttaacttgattatctctgtagcaacgctctttccaaataaggtcacgttctgaggtaatggggattaggacttcagtgtatcttctttaggggatccagttgaacccataacatattcacgtgctcatgtggtctggtggagttaaaggtagaggggtcagggatcctgattcccaccgggtctgagggtggacactccttctctcctgagcctggtggggagttaaccactgcagtcccaggctgctcacttccccagtggaccacaggaatgtctgtgggaggagcaattgttttccaggccatgttgcagctttttcaatctccctgtttgttattggttaagtcatagtaattggtaaattattttgctaaaaaacacagaaaattataaggaaagaaagtcaccgctaattttacatctcagacagagccatagttaacgccttcatgtaatttcttctagcttttttccccatacatatacatgtggttttgtttcttacctcttttcttaacatagtatcaaaaatgttttcccttgtcattaaaatcttcataaatgtgatgtacatttttccatttgatgcatatttagtgagtgtcaggcatggtggatacatcagtgagcaaagtgcaaaacttcccatctcatgggctgccctcctgcaggtgaaatgacatactgggccattgggagctcacctagtaccctcaacccagcatccacccaggcccccggtctctcccaacctatggcttacttcctgttggtgaattcttcctttaagcgatcttgaaaataagcccttgcttattttcaaatgaataaatgtgaacccagaataaatgtgatttgtaaagttctcataactatcacatgtatatattctactatttgggttttttccacctagtttttgccattacaattaatgttcaaatgaacatctttgtacttcattgtgacattttgatctatggctcaaagtaagaaagtccactgtctttttgaaggccagaacacagcagcctgtacagtgctgtttgcttcctctggaatgttcttttcatttccagctttgcacttgcatccacagacaccattaacctgaaatgtgatggggatggacaaagtggatgatgtttggcgagcggcctctgcctggcttgcctgcctcggttcactgcagtcagcaggtgtgagaaggatttttctgtctattttaaggcccctcactgaaaatgggaaaaacaagctcgtttgtgcgggggacctcaagccaacacaagagcccagccaccctgcagcagcctgagcgtgacagcgttctgccccataaagagatgctaggaaaacacttttaatggtctctgcctagactctgtttacggaatttatttgccagagctcaggccattcagcagtaccttggcagcagggcccagcaaagctgcaactcctgtctcccctccacgtctgcctgggtgtattaaacccccttgttctgaacaccccagagctagtacccgaaaggcaggagtggggggttgcagggaagaaaagccatgggttgtaggatatttggggccaatataaacttccaaattcaaaaacaaaaactagctaggctcggtggctcactcctataatcccagcactttgggaggcagaggcatgtggatcgcttgagctcagagttcaagatcagcctgggcaacatggcgaaacctagtctctactaaaaatacaaaaaattagtcaggcttggcagtgtgagcctgtagttccagctacttgggaggttgaggcaggagaaattgcatgagccagggaggcagaggttgcagtgagctgtgatcacaccattgcactccaacctgggcgatgggagtgaaactctgtctctattaaacaaaaacaaaaccaacaaccaaagaacaacacaaaattaccctccaaagagctaggggcatgagctactgttggctgctagctgtggccgtttccagccagcagtagaaaggaagatgtaaaatcctgaagcattttgagtactgctttgttttttttctttcctgtttgacgattgatgctgaaccatctttaaagtgtggtttttttgtttgtttgtttgttttgttttgttttgttttttgagacagagtctcactccgtcacccattctggagtgcagtgatgcagtctcactcactgcaacccccgcctcctgggttcaaatgattctcatgcctcagcctcccaagtagctgggattacaggtgtgcgccaccacgcccagctaaattttgtatttttaatagagacagggctttgccatattggccaggctggtcttgaactcttggcctcaagtaatctgcccacctcagcctcccaaagtggctgggattacaggtgtcagccaccatgcccagccccaaaacttacttttaattccttttctcattacaaaaataatatatgtcaatggttgcaatttccaaaacaattttaaaaggggaaaataaaaactgccaatgagataaggataaacactgttaacactttggtctgttgcccttttgtagtttgttctgcttctagggagagaattgtaccagcctcgactatcatcttccttgcccagacatcagatatcatttaaaatggaaacctgtgggttgtagaatcccccttggactgggaggcagaagacccagtttcttgtgttaccacttggtcctgtggccttgggaaagccacttaaccttgatttgctcgtctttaaaatggggactcagtattcctcaccttagcagatggagtggccaaaggtgtttctggcagagagtgctttgcaaagtgctgtgcaaattgctggccagttttgatgtgggtgtgtgagcctttggttggacaaatggccagagtagttttcctgtcttcttgggggaactgtgaccctttctcgtaaagctgttctgtctctgatcctggtgaacatcaccagcttcctctagctgcccagagctgcccctcccctctgccctgccgtgtggcacctggcccagtgcagtgtccagtccctctccaggtcccgatgcctcggcctccacagtatctcctagtctgcccctctcgccccatctccaccatttccacttgatccttgtccctgcctgaactcctgtgtcagctccttgctccctccaggcgcacctacttccaaccaagctccatgcagcagccaggaggctctttctgaaatgtcagtctgctctcgccaccacctgcttcagtagctttccactgctgtcaggacagagtccagaggtcttgctgaagctgaccaggcccggcctctccgcccttgctgactgcttcagcttcacccctgccgctcatctcctgacttagccattccttcatgtttcttcttttctccaggcctttgcctgggctgttccctctgctggatacacttccctaaccctgcttggtaatcaactcaaccttagtcccctgcttcataggtcacctcctccaggaagccctccctggtgacctcacctagtcagggtttgctccccaccctcatgctgccactggccccactgtggttgtctgatgactcacctttgtcttctgtttggctgtgggctctgtgagagtagagcctgggtctgcctgactgtgttttgccagcacccagcatgagtgtctaccctgtaccaggcacttgtagaatcttgtttagatattttgttctcccctggagatggaaaaacactcaatcttcccaagtgttagactgattgctgatgggtcttatttttctctctgagttcttttaagagtcctggaaatgtggactgagaacagctgtcgcatgtcagttccgaagtagccgcttttatcagaaacggtttagagagagattcctagttgcacctcccgccaagggcagtgaccccacttttctctccccttgcaggcccctatccgacctcaatgggaggcgtgggagagttatggggagtacatcccaccggcacagctgtcatgtcagccctgtctggctgccggagttcgactggtcaggcgagatgggcacaggcacggctctgctaaaggccttggctgagcccagcttggggcagagcaagccactgagaatggctttgccagaagactccgtcatcaggcttgggtgtccacagccttggagtgctgaacagctggaacatcctgaggcatgtggcgggtcagttgggacaaagccattgagctgctaaaccaaaccggtgctgctggattgggacggagacagcagtgaggaacatgagctccagtgtcagagggacctggttttcatccaggctctattccttactggttgtgactttgagcaagtgattagatttccctgaacctcagtttccttatctgcaaaatgggaactggagtgttgcaaggattgagtgaagatctgcatggggagggctgcgtagggtctggcctgcagcaagtgctcatgcagcatctgctttcccgtcttcctcttcatcctcacagccgttcatcatcgtggttgtcatcaaccgtcccgtgcggtgcagagctttgcttcttggttctgcctgcttggtggttgccaggtcccgccagcttaagtttatctgttcgttcattcattcatttatctgttaagcccctcttccttcttccaggccagggagccagggtgctgccaggtggtggggagcggctttcagaagtggctcttggcagcgcaggctgggctacatttatggcctttatgtaacccctttgccctgagccccattcctgcccctcagatctttatttactgactctcggcagacttagaggtcctgaaaggcaccccccaacgccctcatctcattcatccttctgcctccaggcaggagggtcctcagccatggcagacatgtggggtgatagccaatcccagccatgagcccctattcagctttcaccctgggcaagatcctgtggagggtcccagtgtggggctgggggagggatgtgggatcagctgagatccttaggaagctgtctctagttgggaagacagcagaaagccaacacgtgacactgggtgacagccctgtgcaagtgtgcaaggcgggtggctgccaaggtccatcttcagtactaagagcccaagggcggggtggggaagggggacagagacatctgtgtggcagggaaggtgccaagtgaacagatgagagagagagagagagagagaacacttttgggtcagcaggttcagcgttatccaaccagcaaacatttcctggatgcttactgtgggccaggcaccaggctatgtgctttgcagacacacactcgtccaatcactacaaagccctgtggggcaggtgctgccttccccacccctattttagggatgacgatgcagagactcagagaggttggtaagttgctcacaggcacagatctctgaaggaagtggagcctggattcacacctgggcctgagtcgaggccatgctggctgtggatttcctccatattggccatggcttccccgtggacgtggaacaatatgggcatgtttgggagaggaggtgtattctgctttggtgggctctatgcagaggtcatgaggcagaaggtcaggggaggctgggttgggcccgggacaccagccatgcctcctgtctgaaaggtgaggtccttgccccgcagatagtagggatccattgaatgttcatctctgatagccgctgtctgcagtcatcctcagggagagagcagagagcaaagggaagccatggacagagcaggcgggcttccaggctatatgagatgcagttcctccttctccaaattcttattaacccactgtgtacggcgtttctcaagtatccagcccaggacttgggatgtaccataaacagcctccacttctgatgacggtagcgctaaggctcaggtaatgccacaggaggcaggagcggctggagcttctctctcctgcagtgtcaggccagagcaggtttttcttttttctttttcttttttttttggcggggggtaacagatccttttttattttttatttttttggcctatgcagcagttattttattttattttttttcagtatttttattttatatttatttttgattatactttaagttctagggtacatgtgcacaacgtgtgggtttgttacatacgtatacatgtgccatgttggtgtgctgcacccattaactcgtcatttacattaggtatatctcctaatgctatccctccccgcttcccccaccccacgacaggtcctggtgtgtgatgttccccatcctgtgtccaagtgatctcattgttcaattcccacctatgagtgagaacatgcggtgtttggttttctgtccttgcgatagttcagagtaggtttttctttgtgacgcccggtcgcaggatgtctttcagcaccacctgtcagagctctccaagccggcagctgttcccgctgcccacctgtcccttccctgctctttttggggatggtttctcgctcccctgctgtctgtcctctctttcccctccccctgcagggccttttggaaggtggcagatgggcatgaatgtcacactggctgtctctttgcctgtgctgtgcgtggggccgtctagcccgagagatcagctcaggcatattccaggtgcggcttatgttggtgagaagttctcataacctgagctgatgggggtcagaatgtgcgtgtggggtgcagagggagcttcccacccctggcagtcccctgccctcctcccttggccagccagccacaagacccacccttccttccttccttccttccttccttccttccttccttccttccttccttccttccttccttttcctccctccctccctccctcgctccttcctttctttttctttttttctgagatggaatctcgctctgtctcccaggctggagtgcagtggcgccatctcggctcactgcaacctccacctcctgggttcaagcaattctcctgcctcagcctcccgagtagctgagactacaggcgcccacaaccacgcctggctacttttttgtatttttagtagagacgggatttcaccgtgttagccaggatggtctcgatctcctgacctcatgatccgcccgcctcggcctcccaaagtgctgggattacaggcgtgagccaccgcgcccggccacagactcactttcttggggtttggcaggtcagcaggttttgtgctcatttggctttagcatgagaggagtggttcccagccccgcaatccagctgcagtgttaacttcccactcatctgttacctggatccctgtttcccacaggggcttcctagcctcaccgggtagaaacttcagaattcgcccatgggttggatctgtcccctcttctccatccttggtacttgtcttcctgcatggactggtgcagtagcctcttctttggtcctctgtttctagctggtatcttttttcttccttcccatttattatgactttcttgcttgctgttcttaacactcagaagattcttgacttctctgaagtcgtgaaacttgacactcctagcagatatcaagggtctgtccactgcctatggttccttcaccatatacttcccctccaccccaccctgccagcagacttcaggcccttggggaaacccagcagcagcatggtgggtaatagcgtgttttccaagttatggtgtcaaatctctgctcttctatttaggagctgtttgactttttttttttttttaaacctctctgaactgcataaacagaaaaaaacagattttcttcttgcttctaggtctttggtacagctgcatcctctgtcctctccacctggccaagctttacctccaatgtcagtggatccctgtcccaaataaccacccaccccctcccccaaggccctagagcattccacatgtgtccccaccaaacattcccaaggaacccttgccatggggagcaggactaggcttcaggtgtctgttttcctagaaggtgcgtgtgcctcctccacctttgtaagcctaacccctgttacaatgcctgggctctgcgggagcccagaagtgtgtacaaaaccagtgagcaagcaagggaatcagtgaggaaggggaaggaggaatgaatgatgaggcagcatcgccgcagcggggccgaggagaggtcccccggagcatgcccgtgcagccctaggggtagctcctccctggagcaggtatagctcaccccctagcctggcagccctgtcttcacacctccacagtctacagggtttcggcatttgcttcagttatttactgaccatgatctcctaggtcagatttatcatttactgggtcaggaaagaaaaagccccatggggccaggtttatagagattaaatccactcatgccgaagctggcttcctgcttgggggatgctgcagtgatgcctcaggcctgttcctggagcccgtcagtgccggctgctctgggagtggcctgaggtctctctgggacatgtgggctggagctgcaagctgggtgccttctgccagctgcacgtgccacctggctggccatcagaatgccatcagagagggctggctggctggctcctgggcctcccaggaagaccatacagggactggagtcctccctgctcaccgggtcccccaggctccggcagaggcaacgggaggaaccagttgatcagaaagctgagcagattgagctggcctttcttgttagtttcctccaacagtggtcccctctgagggcagagctggacaggcctcctctcgggcccgtgtggagggtattgcatagaatctttctcctaggaactgacggaagtaagtcttacggagattagactgatttgctgtgttttgagttcattttctccacccaggcatcaagatatggttacgatttctgggaaccatttccttagactgctcagtcctgagggctgaggtgtggccggcacctggtttatctgagagggcctgggctcatgcactctgttgcctctcggccttccacaagagtctgcagggattctctcttattgatgggacacagattgtcctcagccaggccttcatgaaacaccacagtatttcatgtatgtgtgtgtgtgcagtgtgtgtgtgtgcacatgcaagtttgtatgtgtccgtgtatgtttgcaagtgtgcatgtgtgtgtatacatgcaagtttgtatgtgtccgtatatttgtgagtgtgcatgtgtgtgcgtgtgtgtacatgcaagtttgtgcccatgtgtgtttgcgagtgtgcatgtgtgtgcgtgtgtatacatgcaagtttgtatgtgtccgtgcatgtttgcaagtatgtgcgtgtttgtgtgtgcatgcacgtgcacgtgtgtgtgtgcacgcccatcaccagactgtaagtatcctgaaggcaaggtgttggctgtcttaggtcccttccacctcaacagatatcaagggaaatgactctgacctggagacaaggccgggacggcaatggggtgttgtggagagtgtcccaggctggaaccagatggcctgaattctaccacagtccccacttaccagccctgggccttaagccaggcctggttcccggcccccgcacatcgtgcatgagaagcatggcccttgctggaccagtaggcgtgtctgccttgcttcagatagtcatctctgaattaaggaagagctctcctgggacctgagtcttccctggggggcagggacagcttggtaggcagagaagggagcctcacctgccatggttgcagtggggtgaatgccgaggctgccaccacttgtccctttctcctccagtgaccaccccccaacctttccttctccacaaaggaggggcagagtgacctcccataagtgggcttctctcatccgccattgttgttctagcccttctgtctccctcaaggacagggccgtgtctcagtcgccagtgccccagtgtgtagcacagtggctgcacaccgtaggtgcttgctatgtgtgttggcttaatgaggagtccaggggcctggctttgagtttctttctactgctggccacccacatgcatccctctttcttcaaactgctgggaagcccatagctcagtttgatgtcaaaagcaaagctctctttcatctgatgtcatcgggggagctcatttgattttcccctccctcttttgctgtttgtttcctgttctttgtcttttatggaacaattgaacatgtgcctttattggaagatgctgtggatcgttttgggaagtaagcaggcaatgaataagtcagtgcgttagaaacgaaggggagaagaagctccctgctcggcctaggaagcaggcaggtctgagccttgttcctcctctctggagaatggacatatgggcacctgccctgtagaccttgaggaatgagaacagaatgggttctggtggtccagtgtgctgggcagcaatgggcatgtccttcttccagggctctagaaggtgggtctactcaggcaggacgatgctatgtggctcagggaatgggctgtgctacaaccagcctggaagaggccagggcttgctgggcgggcacagctggcagctccccattctggaggaaccagccaagagcatgctgaggcgggccaccagtgagtgctttggggggaccaggtgtcccaagtttgagcaccaggaggccagcgctgttgctttgctcttctccatccttgtccaaaaaaggagttcgctccattaagaggtataaataggagtgctgggggtggccagacgacagggccgctctgctcatatcctcgaccaccacaggagggccgctcttgaagtcctggccagcagcaggagacatctttttaagatgttggcaagaaatgagagttaggcaatcttccgtcaccctccgccctcctcccacccaccgtggccatcataacacagaatttcaaagaatgagctcccagtggggagaggttaaacactgtggatttgttgtttcagggaagaactcgtggccagtgacctgctggagaagaggcaggaggaaggaaggtgccgtggtcagcatgggagggaggcagggaggggctgagaggcaggatttgcagtcggtcaagcctgggtttcctcagcttcattgtcacaaaaaagcagagagggaggacagccgctgaaggcagaggcatggctttgagaggtggccgtagtgatgctgtgtccagctctgtgtctgactctgcccagtggttctggaaggaaagcagtaccttggaagcaggcatgggttcagttccttgcccctccacttactcattagatgtccttgggcaagccctcacgcctttggaggcagttacccgcctgtactgtgggacaaataaataacgcctccccagggggtctccatgggcaccagccaagacctgtgtgggaggggagggcctgtgcactcagggcctggggccttcgggtggggaacatggctcaccaggcctcgagatggtcttgaggggtgggcattgggtctgcctctctgtaggcctggtgacagccctttctggggtcattagcctgcagccagcttttttcccagctaagtctgaatggtgaaagccggatctcccatccaggactgattcagtggccaccacttcctacgcttgaggaaggaagaggaggaaggcctcctatcatcctcagaaccaccacctgcctttggtggttgctcatacgtgggcacctgccatggctattgctgcgagtgtgcctgtcttcactccctgtggaaggtgtgggctgctgtgcagcttgcaaagcgcttttcacactccctgagcccaagttttcattcttgttttacggaccaggctctgagaaattgcctcggtcacccacttataggcaaagcctgagccacgacagcttaaccacaggtgtgaccagctcatggccagaatgtgccacaggatggggtaaggatgcaggctgggacggggctggaggcccagcccatgactgccagatgggcctgttgccagtgccggctgccatctctgatgggaccctccagctccagcccctttcacatgtgggtcctggagtctctggtcccaagcagctaccgcctacacctgtcttattttttcagtgcggcatttagccatgggagggagaggtggtgggagaagtaagttaccttcaagtctgagttggcatgaacttgccaaataaaacatttaatgtattgccaagaaacattttgcttgcttacttcttagcagaccaagtgcacaattttccatcaaaacttttccattgctcaaaagtgtctctgacaccgaggctggatcctgcagcatctttgtcacagctcacattttatttggaatctggtgttttcagaatgtcaccacctcttgctttgcgtttcccgatggaaacatttcacaagaatcttttcagctgtcgaagtggtgcaaccctctttcagaaggttttatttgtccagcgcagagaagaaccccttttttgtgaagtccctgccacgtttcactggtcagttcagatcttgccaggctgccatggagtggatcaaatcccattacagcaaaagctgtttgagtttcatggacacgtttgtggaaacaattgcagactcctctgttgacagtctacttccagtgtgtaatgtttgatagaacatgcacgcagcacagcagaagaatttggacagccctcagaatgtgctggaatggaatttggctgggcctgctgtccaggtctctgatggggctgtgggagaatgtttgcccacccattaggcagatattcaatgggctccgtctgtgttgcagatactgggctaatcacagagataagtgcaacccaggccccaccctcagggagcctagtcagtagggaatggaagagacatctgcattttgttcctaaatatgtcagaatcatgttaggaagtggatggaatgtgttatgcatttattttaatgtatgtcattaaaaaaatccagccactgcaacagtaattccactatgttattacttagaaagactaagttggaaaaagacaggaggggcagttaattacaacctaagttaaagaaagatattgagtaaatactgtaatggtggtaactctttgatatggtttggctctgtgtccccacccaagtctcgtcttgaatcgtagctcccataattcccacatgttgtgggagggacctgatgggagatagttgaatcatgggggtggtttctccattactgttcttgtggtagtgaataagcctcaccagatctgatggttttataagggaaaacccctttcacttggctctcattctctcttgccggccgccatgtaagatgtgcctttcctcttctgccatgattgtgaggcttccctggccatgtggaactgtgagtccattaaacctctttttccttataaattacccagtctcgggtatgtctttatcaagcagagtgaggatggactaagacactattataggtggtaggtaaaaaccatgacagcagctcatgaatgactggtatctggaaaaaataagttcaggtgtattttgtgttgattggttgccaggggctttacctctgttctcatccagtccttgggaaccctggataatggtagtgtcagatggtagtcccaactgacagctgataaaagctcataaagttcaaagaagtgaaatgattcatccaaggtcacatgactagtaagtgagggaacttgaatttggatccaggtctgtcaactcctgatcctgaactcttagccactatgctatatggcaattgatcaaattaaaaagtgatccttccctctgcagagtgtaatccaggaaagcttcctaggggaggtggcctcaactgagtggtaggctttagcaagggaagtttgggtggtaaggtagaatgtcccatgggtcagatacccataattattggctggatggtttgaattatagtgacttaaacactttttcctcatataaataaaatcttgagttaggccatgcgttggctcttctgtgtcatcagggtcctaggctgcttttatctctcgattccactaggtgtctcatgatccaagatggcagatagagctccagccacaatattcttgttccaaagaagtagaaaaagataagagggaaagggtaaaagtacatatctcccaatgtgtgagccccttgaaggagcttttctggaagggaaagctaacaagttattcttgcatctcattggctggccctggttattagggaggctgcccactgtgtgctcagcatatgtgaatggaggacaaacatcctgccctcaaggtgcttacagcagatcgaactgcttctcgttgaagctgtaaaggagactgcagttgagtgggtaagaaaaagcctcctctaaccagacttgcctctggagtggccccaataagctcctgggtctgttttggtttcttcaacacatttatttggtgtttaattggaggggaaagttgcagcgattatgtcacctgcccaaggcagcccctgcccaccatctcatcaacccttctgaaaagacaagagtcactcttggtacaaaccagtctcattccaccacctgccatcctctggtgcaattagagcaagagcccactttccacccgaatcctggattggtgtcatttaagctcagcagagccccgtatggtggtgaccaggcccaagttctgtgcagcttacgggcaagagtaggacctgggcactgtgggccacccgggctccgtcctccctctctctcccctgaggacctgggtttgcttttcacttcttatctcaggagggtatgctggccagttgccagaaatatcaaaagtttggagagttctttaaaatcagtggagccttctgggttgccaatgttgttccggggactggttcagagatcaaatcttgttcatgtgaagaagccctctctgctgggatttgggttcatgtgggtatgaaatgcccttttcactttttgggaattgggatgctagaccatggaaagaatgttcgggctgaaatgggagccaggggtgggatacagcccctgtttctccatttgcttgctcaggagacttactccacctggttggaggcagagatggggagagatggcttctgatgtcctcagccaggcatctgcctttgttctgtaattacctccaagtaaatagtcttggaaggaagtttagagagatgtttcatagggtgttagaaatcaaactgctattaatatactaattacagtaggctcaatacttaccattgaaacaggtcctggagagcctctccttggcaacactgttagacattctgttcttgaaatagaaagtccatattctttggtgaaagctctaaatccaggctttccctatgaacagccagcccttttctttggattcagtaggttcagctgcggcctctggcagcaaaggctgggtggagtgaggtggggagaatttgacgcactcagaaagcagtcagctcagcagaggtgtccaaaggtgctggggccccagaggtcccagaccagctacctgacaatgtcattgtacatctaagcattatttttagcaatgacatcactgctactggttttatttttagattgatgctgcaggtgctgtttggaaatgtcttttttccccacatcacttttgtcctggaagtacccagtatatgagggaaacaaaatggcagccaccccaccaagggcaatccattttttctttcttttttttttttttttttttgaggtgacttatactttattagtgtgacttcattcatttttctgtagaaatattactatgttgattttggggatgtttgatatatatgacatatatagattatatttctaaaatctgataagttctgaattctgaaatacatgtgatctcaagggtttctttatttaaaaaaatgtctataaggtagataacatgatgttttgctatatatgtacttagtgaaatgattgctacagtcaagcaaattaatacatgcatcacctctcatagttacctttgtccgtggagtggggcagaaaggttaagagtacctaaaatctactctcttagcagatttccagtgtacagtacgatattattaactatagttctcatattctcatagtgtacattagatctctagacttatcctacataactgcaactttgtgccctacatctccttttttttttttttttttttttttgagacaaggtcttgctctgtcactcaggctggagtgcagtggcgcaatcatgcctcactgcagcctcgaccttccaggctcaattgaccctcccacctcagcctcctgagtatctggggctacaggtgtacaccgccatgcctggctaatttttgtattttttgtagagacggggttttgccatgttgcccagattggtctcaaactcctaggctcaagtgatcctcccaccttggccttccaaagtgctgggattgcagctgcacccagcccatctcctccatttttaaggctgaataatattccattgtacagttgatccttgaagagcacaggtttgaactgtgtaggtccacctttatgaggatttttttcaaccaaacatggattgaaaatacagtattcaagggatacaaaaccctgagtattggaaaggctgacttttcatatactcaggttctgtagggccaactatgggagttgagaatgcatggattttggtatccatcggggactggctctaggactccccgagaatgccaaaatccatgaatgctcgagtccctgatataaaatagtatatttgcatataaccaatgtaattctcctgtatactttaaatcatctctagattacttctaatacctagttcaatgtaaatgctatataaatagttgttatactgtattgtttagggaataatgacaaaaaaatacaaagtctgtacatgttcagtgcagacacaacaatccatttcctgtcaaatatttttgatccatagttagttgaatccacagatgcagaatccatggataaggaatgccaacagtatatcacaatttcattattttttcatctgttgatgaacacttagattgtttctatatattggctagtataaataatactgctagtataaataatgctgcaatgaacatatgagtacaggtatctctacgaggtgcttattttatttcctttgggtatatatccaaagagggcttgctgggtcatgtggtagttctgttttccaatgtggaaaatattaaaaggtataacccacataaataaaagctcctggctaggtgtggtggctcacgcctgttatcccagcactttgggaggccaaggtgggtggatcatgaggtcaggagtttgagaccagcctgaccaacatggcgaaacccctgtctctattaaaaatacaaaaattagccaagtgtggtggcatgcacctgtaatctcagctactcaggaggctgaggcaggagaattgcttgaatctgggaggcagaggttgcaatgagctgagattgagccactgcactccaacagcttgggtgacagagcaagactctatcacaacaacaacaacaacaacaacaaaactcctttgggatctataataatttgtagaggtatcaaggtgtcctgagtccataaagtttcagagtcactgcagtagagggaagaaaaggacaacagaaacagtgaaacttaaatagcatttcctgagccctgagaaacaaccgatgctatatagttattttttcactctaagataactcaagatagaaacttttaaatctagagagctgataaagtaagataataatacattctgcaggcctaagaaccctgatctggaggatcaagactgggtcatgcatacattgcattagacagcgacacctaatgaacaacaatggtattacaacccagctctatgaaaccagggactagcaagagtaaatgctgtattcagactaaaggacatagataagagcacattctgtcaggcagagtatttcattatttgatattcttagacaaaacaaattctcagggtgtggagggcaatttacaaaatatataatgacagttcatttgcttagaccttcttccttagttaagttgaatgttagtggtccatcagggaatctggagcatagagtagaatcacaatcaccttggacttataagaaataattcaaagactttatagaatcagtctctagtcccagaattttatgtttttaccatgttcgtggctcatgctttcttgatttctggcatcctgtctgatttctgagtttgggctagctagagtcttgtttgtctatcttcttgatgcccaataagatcagcccctttactgtgcctggatttctatatccagcattacctaaatccaactttacacaggctttgggctcttccagttcctcttctgccctttaaccccatgtgtgccccagaaccatccacaaggagatgccaagaatagagaagatgaacaacaacaacaacaaaacagaactgcagcccttctgtatgcttcagtctctagcaggctcagcccaagccactaccgatcccttttctcacaagttttcaatgcaatctacaggaggctttgtattctcatataggaacccttctcaaaactgataaaacgataaaggctttgctttactaaaatttgctgtgccagccctctctttagcaactgaccagtgctgagctatctcatgctacctctatggcattgtcaaagaaggcagggaatgtctttgcccaccaaagaacagcatgtgtgtgaggcccatgctagggaagaaaaaattcttaacaaagtgaggtgtgaaggtggctgggggccaactggaccctggagcccaagcgaagtgaagtgatgccagatgccttgccctatcaaagtaatgaaagtgatctggaaatggtgttttttctcattttaatgacagagcagggctgggtaaggaataactgtaagtgcagatgaagcttgtttatgctccaaagataaagtcacaaatggggggtagggtgggctgtggccttcccttgctctaggcaaattccctcagcactagagaaggtgccttccaaagggcctgtgttgtgtctgcagttctgttcccagggaagtggaagctgaggcacctgtggtaaagcccctcatgggagcgggggtcagggagatgtttggaaaggctgtggctgataatgagacgcgggtaaccctggtggatatcgttccatcctggtgcgtgccttcctggttgcctcctgctgcctgctcctggggagtggagtgggggaagcattagtctggattgttgttggcttggttgccttccagaggcctgcatccaggtgccagggaaattctgactgaagtccattcaacaatagcaatagcggctcacactcaggcctgctggccccaccattgacagctttgcatgagcttctttccatgcaagagggctgtccccaggttcactccccacttcttgttctgctgcctgcattcttggccacgtagttaagtctccctccctttgtgccccctttatgtctctggtcttctccaacattagccatgccattggcagggtgggggtgggtggtggggcacgcttcctgactcggatgccttgaccccacagggactgagttttggacaaggtgcagcggcagcctcccaagccaggggtgggcagcgtctgctgagcagatcctggtcctctcggggtggctgcatcaatcacacccaaaggggagaggcctcagtatggaaagtatgtgagccttggatggaatcacggatggcccgaaatggcttggccccttgtttctaaggccccggctggtttccccattgtgcagtggggagggagaaaggggccagcttgcctgagttcctggagcacgagtgagagtccctgagccacaggtaggtgagggcaagggtggcagtgttttggggtgtccacgcagcatgcatggctggtcctagctcggatgttgtctgacagtcacccatgaggaacaggagtccctcccattactcagccaagggcacagagtgattatgcccggggtgtagcaaatgctctgcaaatagtagctgctctgaccatgtgatttgactggcattgcccagatgctgagtggtggtgccaggattggacctgtatccatctcatgcctccacccaggccctccacccggcagcctggccgccttctcctggtcctggtccccttgcccccaggaattgaggcgtgcatggtgcatttccatctcccaaatcatggtcctgtctgtgccctcatctgctcctcttccacaggcctctcagggaggcaggcagggcagagtcagcagccccattttagagaccaggaaactaaggcccagggattcctcagaggtcaccaagcttgtaaatggcagcactgagcctcaagccttgctctttggatcatccactttgtattagtctgctcaggctgctatgacaaaataccacagagtgggcggcttagacaacaggtatttctttcctcacagttctgggggccacagttcaagatccaggtgcctcagggctggcttctgcccttgctggtttgtagatccactgtcttcctgttatgtccttgcccggcctttcctctgagctctctggtgtctcttcctctcctcctaaggacaccagccctatcagttagggccccaccctgaagaattcatttaaccttaattacctccccaaagccccacccccaaatatagtcacattgggggttagggcttcaacatatgaatttggggacaacacagttcagttcataacacaccctgagccccctccactgtttggagtcccctaggtcacaccaggggggttgctggtgctgtgcatcagaggagccatttggagagactgtgccagaggccaggggtggggctggggcaatccaggaaggcttcctggaggagatgtgtgtacacacgagagggcttgggggcagtacatgcccttacgggggcctatttcagggaaccccacatgtaatccacaccagtaactcagatgagctgtagctgttttccaggagccactttctctccatggttatggcaagaggggagcctccgggtcctgcgtggcccagcaaggcagctgtgggttgatgcagcaaagcaggttgtgtttccaggtcattcgtgtggaagggaatgggatcccaggtgggcagggccaggcaacaaaggccagaaatcgagctgagcacccacgaagccttcctcagagcaaagacctgcagaggggaccactgcatgtggcagctgccccagatgctgtggccctggctgctgtgggagggtaatttttgttaagatgaactaagttgggactgcatctcacacagtggcctttgtataaattcgcttgccttcctcatccggtatctgtcccctctttggttcacaccctggatgcaggtgttcgggggaatgtgcattgccacacttagaacattcaagtttctgccatccctgtgtttctggagtgacagtgatgttcccgggggggaggtgtgggttcatgcagcaagtcccatgcagagtccggggcaaattcaggtcctgagtgaggtcgtagtgggtacctggctagcaggctgaagggaggttgaggagattgaggaggctgagggggcttgaggaggctggggaggctgaggaggcggagggaggctgaggaggctgaggaggtggagggaagctgagggaggtagagggaggtggagggagactgagggaggtggagggaggttgaggagatagggggaggctgaggaggccgagggaatctgagggaggcagggagggaggctgaagagtctgagggggtgaaggaagttgagggaggctgaggctgaaggaggctgaaggactctgctctttgggtagaacttcctgtttctcatgtttcctctctgtagaccacagtgcccagccctgccccaaagcagagccagagcttgtgtccatttcttgggtgtgtagtgtgcctttggcttctctttagttgtgccttggaatggcacacggggctgggtgggattctggaggcgcttagtgggtggcttctcagagctcaggccacagcccttgtgagtgggaagagtctgtgtgagtgggaggagcctgtgtgagtgggaggagtctgtgtgagtgggaggagcctgtgcgagagggaggagccttgtgagtgggaggagcctgtgtgagtgggaagagcctgtgtgagtggaaggagcctgtgtgagtgggaaaagtctgtatgagtgggaggagcctgtgtgagaggcaggagcctgtgtgagtgggaagagacttgtgagtgggaggagactgtgtgagtgggaggagcccctctcgcagctccatggtcaagtgtttgaggctaagttaggagaagatggtctgtccgtcctcttcctccctcctccctcctcctcttccacacccggcccggggccctttgctctgggtcatgctctgttcccaggccctgtggggatgctgggaaccctgggaacacagctcccttcctgcccgaggccctgagcgttctgagcctgtggccgctgcttctctggtgggaaacggtggtttcctcttgagggaagtgttagtcgctgcctttccctccctctgattcccaaggatgagtctctttgggacagcaggtgcctctgggaaggtctcctggctaggtgggctctggctccctgggagtactgtgggctttggagccaaaaagacctggacgcagatcccagctcctccgctgatgcactgtgaccttgggcaatgcacagaccttaaactggctgtgccctggttttctgtccagcaggaccgggcagtgctgtccactctacagtggaatgaaggcagagaatggcgcatcagaggtgcggctcatggcaggtgctaaacacttgggagtgtctgggcgcctggtgcgggaacatgagcagaagccccaccccacttggatgtctggtggtcttcgctgctttctgactgcctagatggggaggcctcgaggccatcatgattcaaccattctcttactcagcaagccctgaccaccattcattcattcatccattcacttccgagaacctgccgcgtagtaggccttgttctctgcactggggcacacaaccatggataagacagaccaggacttgtgctccaattctatgttgaaggtgagggaagaagttaattaagcaatcagccaagcggatttcaaaggacagctgtgctgcacgccactgaggagacgtgagaggaatcctggctaggggcctatgctgggtgcccggcagtgggggaggcgcagagggggttcagaattgaaaggctgggtgcggtggttcatgcctgtaatcccaggactttgggaggctgaggcgggcagatcacttgaggtcaggagttcgagaccagcctggccaacatggcgaaaccctgtctttactaaaaatacaaaaattagccaggcgtagtggcgtgcacctgtaattacagctgctcgggaggctgaggcaggagaattgcctgaacctgggaggtggaggttgcagtgagccgaggtcgcaccactgcactccagcctgggtgacagagcgagactctatctcaaaaaaaaaaaaaaaaaaaaaaaaaaaaaagaattgaaaggcagccttgaccttaggaagtgtgctcaccagctgcaagctgtcccacctccatactcagtgattattggaggtgatgctactacaagaaggaataatattttaaagaataaagtcagttcttaggaagccggtagtaaccctgtaacaatctggtgtttaatcatttagataaagccatagcctggggtcaaagattggctggaggtgtgcctggagcattaagctcatgctcaccaccaaacttcctgtcccttgtaagtaagtcagtgtcatcccaggtgctggcatggccagtttaggatcaccctttgcctgtgcctttggggaaccccaggacacttgagtctgaatggcctgatgtggctaggacaagggcagtcttgcgcaactcttccatcttgggaaaacaaatgtgattcctaatgtgttgcctcgagttcctggaaccagggtgtttgttttatgtaatagacagcagagaccattctgttgacttcagagccttcctgcatctaaactataactcttcataaaatgtcctttcaatgtggtttatccaggatatcgcagggaaggaagactaaatagtgtctcacagggaagaagaacattctgcatttcaggtcaccaccttgagatacgaacacgtgcttttgagatttggggaccttaattcctctgggaaactcctctctttgctgagtgctggggctgcccaagaagcatgggacccttggagccttattatagccccatgggtcagactgaagatcaggtgggtacattgtgtttgaagcaacatctgtatctcccaagccacggcaaaggagcatctgaaactcatccagatttagtagatgagactaagctggtgaacactcagttccatttaaccccttattggcagcctatgctcacactctttcctggttggcaagtgaagaaggtgggtataggggattttggcaaggatgttagtggatagagtattttttgactgggcatggtggctcatgcctgtaatcccagcactttgggaggctgaggcgggtggatcacctgaagtcaggagttcaagaccagcctggccaacatggtgaaaccctgtctctactaaaaatacaaaaaattatctgggagtggtggcagacgcctgtaatcccagctactcgggaggctgaggcaggagaatcgcttgaacccaggaagcagaggttgcggtgagccaagattgcatcactgcactccagcctcggcgacaagagtgaaactgtctcaaaaaaaaaaaaaaacaacaaacagtagtttctgaggacgaaccttgcaccaggagctgtgctaagtgccttgattgatctgtaccttctagataggtcatactattattatttctattctaggaccagggaagtaaatctgagaaaaggtcatgcagctagtacgtggttgtagaaggcagagtataggttcagctgctgtagcaaagacctagactaacattggcctaaacaaggtggaagccggtttgtccctcatggaacagtgctggggttggggtctactagggctgctatggaaactctgtctgcatggtcacccagttcccagtctttttctggccttacaatgttgccctcgttgacatgggccaagatggtgcccactgtgtttacattctagcctctgggaagagggaagctgggaggggaagaaggggcacaccttttctctttaagggtgttactcagaactaacttggatctgttgtttctgttcacattccattggtcaaaatttggtcacctagccacccctagctgcagaggtggcagggaagtctttcttttggagctaaaaatgggagatctattactatagaaaacatgatgaacagctattgggtgacagctagtgtttctgtcccagaggtggagctgggatatgcgtccaggaggactatgcatgggttcacgcctctccctcttcactacctcctcctggaggacatctaggtcagcatcaaggaagaagagtccggagctagaccaagatccttgggcaggggtggcgggtatttctgctgatcctcggattctctgggcctagcacagtgtagggcgcaaagcagggttcagtaaatccatcttaaagaaagggagggagagggagccagccttgcagatccaaccccagcccaatgagctgagcaaacctggatgtgaatctaagggggctgggaactgagacaccaatagccagaaggcagctgggtctggaggggttcccttgggggtggagctctgcaactgctttgggctggaccagaggttcagggtatccttttggctcccagggcttaaccccaagattgaaggacatctgtgagctttgcttccagaatggaaattttttaagaagccacctttgggaggaactgaatctctgtcctggtggtggttgcttgggccatgccatatactttctgaatttggttgcagctgcttgtaggtccgtgtttgtcagctgctgcccccaagtaaggctgtctgcaaggaagggtctctgcctccctcctgctgtaccccagctgcccactttagctggccctgacttatctagtacaaaatgcagttacggtctgacctttcagaaccccgggcccccatgaaggcatccttgaagggctttcaaaggcagcatactgcatatgaggagtttaaagtttgcctgtctctgtgactgtattttctgagcaaagcttttctccatgcaggtgcgcagaaggaaaaataagtaagcataagaggttccagtttggaatttttcaatcatctgaatgttgttcttggcaaggagtaatttaaaacagctgttatgggttacatttttagaccagttagaaataagggtttcaccacaatcatattctttgatcatcctaattatttttttttctttttcccagttatctctcttgtgctgagtaactgaggagctacctatcaggtttagcgtcagttacagacctgtttcaagcctggcagttggagggaagagaaaagcattaacacggagcagcagcgccccaggctgagacagagcttacaaggtctagacagttatgaaatatgtgggactctttaaaaagaaagaaagaaggagagaaacgcacatgttttaggttctccatgcttgtattctgtatttgtatagctgagaaagctttagtttaaaataagtggtatttggcaagcagtggtattgcatgctgacaaattgattgtgctcttttacttagataaaaatgaaaatgcatgaggcatgttgcttttttccccctcttgatgattaaaaaacgtctacttggctctctgcagagacagcccttgaagatttatatgaaacacctgtgtggcatcgatcacaggccttcaggctgacagaagcagctatgcttcatggcggttaaaatgccaggtcctgggagggggtttggaaagacctgaataagggtctgtatgccaggcttgggtgggacccttcggtgagggtctttgaattttaataaaggacctccccacgctgttcataatgatgtagggcttagagcagctaggcaggaggctaagcatgccctggggtgatgaacaagacaaaagccttcccctacccggcctcagtttccccaccaggaagatgaggccatcagactagctttcctttcggttttctacaagctctatgactatgttcccctcaacacaccctttcttaggctctggcgttattgggccataaaggatgaggatgtcagtgcagacaaggcactccgcttcctgtgtagcagttcacagcctgggccagcacagggagaaatttggaaacaagtatgttatgatgcagccatcagctgcagttgatgtgttgggtcatgaattcattcattcattcactggtcaaacgttattgcaccccggctctgtgccaggttctatgctgggtgccaacatgtgcagggaactaagcgacctggtccctgactgctccaagtcgggtccaccccatttgggcttctgtcctgttggcttaaggacttgccctggtgtaggtctcagcacaggaatgtgctgtgaaatgcaattccaacaccctattaaagccaagcatttacttctggaccccggggactttaagacacacccttaaggagcaacggatttgttttgacaaaaggagtgtaaacaggatcctggtgaatagctttctcatggctgctcctgctttcatcaattgcatatttattggtgacctcataagtgtccagactgtcctgggctctacaggggaggcaaagggggtggcggaggagagagagaatttacagcttagttggggaggcaaggccagctctcaggatagccagcgaaggtgtgagacagcacatcagttacatgatcacacatgtggtgcagctcacagaactgaaggaactcagggcaggaggggggcagctactcggctcagcttttctttttgggaagagcaacggaagaaagggcattccagatcattctcctggcccagccactagatgttgaggcccagttgatagccagccccaaagctgccacagctttcccatgtctttctatcctggaggctggagcacccctggacctgaggaaattgattgaccaataggtcattggtacatctaggtgacaggggtgcctcctccccaccgtggacccctagaggttgccagatggtgccactgatgtgatgtcatccacctctcagggtcccgagtctttgtctgctgctgccatggatcccttaaaagttaaaagatgcagaataattgttctgctgtcagcaagagctgagttcacatcccagctctgcctcttgctagcctgtgaccttgtgccatttccttctcagtgtctcgattttaggcatctaaaatgtgggctgatgatagcacctgttctggaaggctgttgtgaggattgcatgagacatgcatgtagtgtgcctagcattgtgcctggtacgcaggaagcacctcattcatgtcagttgctattgtttccattattgttattataatacatcaggtggcaaagtggaaaggccagtgtctgaaccaaagctcatgtctttctgaaaaccagctctaccaaactctaaagatccgtgtcgaaaatcccgacaccacgagctagaattctgctaagctctagccttccctgtgttagattctgctgaagcaatgtgcctctcccccatctctcatctggagtgtgggcattggtgagctcgtgtgcctgtgaaacacccatctcttcctccttcaggacacgaagcctagcccttcttgagtctggggccaagctgagcaaagatggaaggaggcttggcaagagttgatgtcatttgacatttaatcaccaaagacccagattgggtcccagcgagttaaacccactgcgccctgttcttgggcagacagggttggggtgtggtcacatggttggctgggagaatcggagctgtatctaagactctaagagcacagaataattgctttcaaacatttgtcctctacatcccaagaatgacagccaaagggcagtataacagaaagacaggcttggtctcaaaatgggaatggcctcacagcatggtgttgataaagagtattggatgctctgcaggtgaagtgcttcctgtccctgtgagtgcacacgccagggctggctgagcccttgatggggatcatgttgggaggattaagggtggctgggggtcttgggaccctgagacatcaggactttcaggagaccatcagttgcctccaccttccgaggcattcatttctccagctgcttttggccagcacagccgtgatcctcgctagaccccggccagtggcccaggaagaagccaggcgcctcggcagggccagggcaggaagagccaggtctgcctggaagctgctatttgccttggtccctggcttgcccagccgtttcctggcccggccctccgtggcttttgcttgattagctcatagctccaggggaagccagaccccgggccctggaaggcaagatgggcccccagtcctccctggcaggccagggcagcgtgcaggaaggatgggctgggcattgccatgtgaagtcaacctgaaatgcacttgggagagactgaggcactgagcggaagtaaagactcccagatttcctgaaatgaaagccagggctccttggcgcccctcagagccccaggcctctgcgaaatgctgcctttaaactcatgcttgtgttgctccagccgtattgccacgtcgcaggtgcggggtggtgctgggggcgggggatggcagctgggtgggtttaaagatccccagcagtggtgaaccctccttggggctctgacgctggagaaaggccccatgccctgtgatgtctccattcccaccaggctcacagccccactgtgaagctaccgaaatgggaggcatttaagccccccttgttcatcagccctattttgtaaaaggggaaaccaaggtccagagagaagaatgatgggtcagaggtcatgcagggtcagacgtggagctggacacaaagcccaatctcctagccccagtcccatgcaccgatgtgctttctcgaaaggggcatgccaggcagggcccctgggctcagaccgcctcacttctgggggctctgggcttactgtgctgcagctctgagcagcaggcagcctggcccagccttgcctccgcccagggacctgagcccagggagccatgctgaccctttcgttgccttggacagaagccaccttaggcacagccctcatcatctacttggttcagggaggccttcacttctggcagagcatcaggagaacgtgggctggagatatatactccccagtttggaagcgtgtggcctccctgtcacagtgatctgtttgttggtttgttcaatcattcattcattttagataaacacctgtgctcctgcctgggccgggcactgatccaggtggtggggataaaatggtgaactggaccttacagttaatgcagtgttggaatcacctagggagctttttaagaaaatactgacgccctggagatttgatgcagtcggtctgggtgtggcctaggagtttcactttctaaaactgcatgtatctggatgaaatttctttacaaggagaaaaaaggttgtagaaagaatgtccttctaagtggatggtgtcccaggtgcttttaggcggagcacaggtgaggaaaggccctgggtgttcaagacacaaacagtggtcatcactgaccaaggctgtcccaggtgccccgtcccggctcactggaaggtcccgccacaggccacgcagggtaaaacaaacccgaagttcttctgagcagctgcgcattccccaggccccgcacggaaaggagagctgtctggcagtcacagttctttgctttccaggctcttcctgatctcagtgattttgcagctgtgcttttaggagagctgttttcccctcatttgtaaaaactcaaaaatatggaaaaatagaaacaaccacaggtcacgcatgggtgtgtttcctttttgccccggctcttaaagcaccagcactgctgatgcgccaggtgccttttctgcggacgcctctttggtgtccccaggctagcacaaaagtggaggttgcagtcagcctgccgggcttccgggcagaggagagggctcagagcacagtgctttggaccttctttccgatatgccaggccccttccagcgactgcctgtccagcatcaggatctacctgccaagtggtcctgccgttccctcagtccacccccacccctgaccctccgtttacccagccagttctttgcccattcccactgcaaggagatatctaaattgtttgccttttttgtccttggtgatagaggtcactgccggactctggcagctccattactgctcatggtgatggtatagtccatgtcctgtccatctcagcccccagcccttccccagactcctggatacctccctgactgcatctgatgggttcaagccagagacctggaccctcatcagagaggcaggggcccgcacaagcacccttccacccacccttttcttccttccacagacccacagcctagagccttctttcctccccactgtccccgccacacttcccctgcctggcagcccaggcccagacaccctgcgattcagtggtttcacatgtggcttctccaagtgccaccaaactttgtgagacttgggcttaataatttcgatcccacagaaacatgtgacaagcacaagacattccgtaaaactagagcccagaacgagagggacgaatggcacaggaagatggcagggcttggtttgggtgtgtttgtgtgacacaccatatgtcattttttattcacacaaaaacatctttcttgaagtaatagaaggccactcagctgttgctaaccacataccaaatgtttcctttttcctctcctgcgccttccaaggggcgggctgggaagctctgctgttatccgtgatgccatctcgcctttcaaacgtcagagagctttttcctcggagcaaacgcccgattgttttttccagctttggcaggaatttttaagagaaagctgttttcgaatcacttctctgtttattgtttcaaacctgaaatacggcagagtagagggctggcagcctctgtctgatcctctctccccatgtccatttcctaaattgcattaggatctatcagggacccccttctctgccacagccccccgtaacctggtattttgggaaaatgaagttaaataaaataaaataaaccttcagttggtggagagatggttccaggcatccctttggacacccccctccttccacccccccgccccactccagcctcacaacctttacaatcaacatgtggtttcatttccaagagccccagtgttagcatttccatttcctcaggaagccgcgttccgtccttgctcttacttctgaaattgaacgtgtgttttccttggcccgagctctaggagtgcctggggcaacaatgcacacagtcccaagcaggtttcagtggggtggacagccctccccgcacccgggctgcagcttctccccgctccccgtccccagggatggccgcccactctcccctagcccggtgggagggcctggctgtgctcgggccccgtggccatccgagggaagctgggccgccctcactgcctgtgtcctcgccacctcctattgggaaactctggttgccctccaagagtccacatactgcaggctcttaattaagaaagtatgttcccatttcatgtcactcgaaaagaatgaaaacagtgacagcatttatttatcttaactatcaatatcattcctgtttctcagtccgctgggggtatgagtcttgaaggaattgactgggttatgagatttgaacctcgggcatgtgctggtgggacacatgtggcctgcttccgagaaggagccttgaaggaagagcaagcaggctggcatggccctgccctgccctgccctcccggagctcagggccgaagggctcggtgacagtggggaactcctgcctgctttggtgctaatggagagtcaaggttcctttttcaccagctacctcctatctcctttctcagtcatcggagaagtaaaacccatcatttcctgagtctgatagaggagataggatctgtccagtggctgctgtttctgtggcacctactgtgtgctgaggctgggccaggtgctcacatgcgttgttgccaatccccggcagcaaccagctaactctgatggcctcaggtaaagggacttgcccaagaccacacagccatccagagttgctccactgtggagacactattgccatttggagcagaataattatgtgtggcagggagctgtcctgtgcattgtggggtatttagcacatccctggcctccacccactaatcagtagtaacctcacagttgtgataacacaaaatgtctacagacattgccaaaatttcccgctgctgaaaacctctgagctaggggatggaggtaggattcagacccaagcctgtgcttgttcgccaccctgtgctagctctgaagaagtcctcacccaagcaaggcaaccctgcttgcctttaggatccaggcagcgtggtagtgctttggtgtttctgaactatgtactaatcagctatagatataggcattctagaatattcatgaggatccaacttcgtggtggaggctgaggacagaagttctttaatagtactgccccatcttgctgtggtgtcctgacagtgtagcactttactgcaaagcctttgcatataggttttcattttgagtcttccagatactcattatatctgaaggcttattactcagcaccaataaattgcaagggactgaaacccaactcaaactaacttaagggttagaggaagtctgttggtttatgtgactgaaaagtccaggggtaaatctcatagcttcaggtatggctggatccaggtctcaaacatcatcaggacactatttattattctactttctacagttttgatttcattctctgacaggttctttctatatggccacaagatagccaccagcaactccaggcttacatggtcctaagagttaaaggcttcaaataaagaaaaagtaactttccttagagtgccaaaaaatgttcaagtaaagactcagattggtaaggcctgggccctgtgctcatctccgagcttggtgttggcctcacccaaagaattattataggggaagggatgactctccaaagaaaggaatacaagaccttgtgtttctagagcagttcaaagtgtggttcgtggactgattttactggtctgtgataagtacagagatgcttagaaacactcatagcaattcgttgtggctgtagcatccaggtgtgtgatcagtggactcatcttgtggaacaggtgataaagcagttggctgttgtcagactcacgtggaaagttgggaacaatggagatttacaaaagtatcagtccgtgatggattggaaatttaaaaaactggttcttttccatagatagctggaaaagcactgctttaaactggagagtatgttaaaacacagatttctgggccctaccagtggaattctgattcagtcagtaggtgatatggtttggctatgtccccacctaaatctcatgttgaattgtagctcccataattcccacatgtgtgggagggacctgttgggaggtaattgaatcatggggatgggtctttcccatgctgttctcatgatagtgaataagtctcacaagatctaatggttttataaaggggagttcccttgcaaacgctctgtcttgcctgccaccatgtaagacgtcccttgctcttctgtcatgattgtgaggcctccccagtcacgtggaactgtgagtcaagtgaacctctttcctttataaattacccagtcaggtatgtctttattagcagcatgagaacagactaatatagtaggtctgaagtggggtggggggaatgagaatctgcattttcagtaggctcccaggtggaatattttgagagttactgaaatgtgacacagacaggaagttcgcacatgctgttggggaaatgaaaatggtgcggatagacttgctcgacacggggttgccacaaaccttcaattcatataaaaaatgcaatatctgcaaaagacaataaagtgaagtgcaataatacgagtgtgcctgcgtagtctgcggaggctttcactacaacagcgagctgaatcgttgtgaaagagaccatatggccctcaaactactaccatatggctagtagtaaatatctcccactagccctttacagaaaagtttgcctacccttgccttagaaccagggggtgagatgcgagatcaggaatccctattgaggttggatggaaacagtttttggaatcctggttgaaactgacctccaaggttgatcttggaatctggtctaagtccctgtaatcatctgcatttgtgaagctggcatgccaagaaggtttgcaggttgagaaggggcttagaggttattattcgaacccccttattttatggatgaggaaactgagaccaagaaaggggaagtgacttgtccaaggttacacagagaattgatggcagagctgagaccgacccctgcccagtgctcatccactgtggtgtccttggcaacaggcctggggtgtggtatctttagtggcttacaatgagaataggctaagaggcaagcgaggtctctcccaagcacccaaacctcaccaggtgaaggtggtgaggacaggggccccttggcttgctgtgccctctgttggttgacgtaccctctgttggctgacaacttggcaagtgtgagccctgtcctgggaagggcagagttggaagtgagttggctgtgcccaggcccccaagacgtgtgttgcttattgtatgtgcatgtgtcttagcatgtggattttcagccagttacattcattaccaaggaagtgtacttgctggtacagtttggatatttgtccctgcctaagtctcatgttgagatgtaatccctaatgttgaggtggagcctggtgggaggtgtttgggtcatgagggcattgttggtgatagtgagttcttgtgagatctggttgttgcagtgtggcacctccccttcaactctcctctggccatgtgacatgcctgctcctgcttcaccttctaccacgattgtaagcttcctgaggcctcccctgaagcagatgccagtgctatgcttcctgtacagcctgtagaaccatgagccaattaaacgtgttttctaataaattaaccaggctcaggtatttatagcaatgcaagaatggcctaatacacttgctggccactcacttaacactacttgctggttctcgccccttcacgcctcacctcccatccctgagtgacctaccactttctgtctgttttctttaggacagtcttgaagatccactcagtgacatcctatggtggtctcagacctagcccagaattcttgtcctaattcaccttctcccacacttcagcacaccctgcaggtcctcctggcatctcacctggaggtttcacctccccactgtagcttctccttgcccctcctcccagcctcaagccccattctctctggctttgacctttttccctcttcttcacctggactcagcttctccccctgcctgcattgtctgctcattcccatattctagtgtgctctccatggccaccacccctgaaactgacccagcatcatgagaggatgtcttgccccctctgccacgacaccttccaggacacttcccaattgacttatgcagttttgttacatagacattgttatgtggcttctctttccagtgttatccatgaatgtgcctccctctcacactggccagtgagcaaactgctaaggacaaggactaagcaagtgtctggtaccttgctaaagggactgcctgctgggtagacatggttctgtctgagcgcaaggctggaattcagtgtgttgcaggaaggtgtggcaatcccgccttcccaggccagctgtgggcatgccggggaggtggggagtgtcaatcccttgaagaaacaaacaacacatgtcgttttcttgaagccagttcagtccagctgctcaccaaagcaggatcccagccgcaggagctggtagcctccctgcccaaaagctggggcctgagcccacaggccacaatagctcccaaaccaatgacttcctctgtaaatgtctcagacttgccgccaccccatttttgtccccttttctgtggactgcacgtgaatcatttttgctctaaattattgatttaccagtgagacactgaatccattccagactcctggcctgagagtccagccctttcctgtgtgagtccagcttgccttcccagtgtatctcccagcaccctcctgtgtgcataagtaggcctagcccctcccagggtgctctgctccttagtcaagggcacagctcagtgccctgcagcttatgatgggctttctagacccttcccctttcccagtcaccttcctcttccaaatgtcacatcacagagatgatgtcctccattcttggccagctgttaattccaagcctgttgctggatcagtaaccggccagtgggtataagatgtgtcccttcccactgacccacccacatatccccacgtgttgagttcaagaagatacccttaacatcaaaggaaacttctagtatcaaaaagcaggagacctcagaagagagtttgttgagtgaatgaaggacccaaaatagcaaagttagaatggctggatgatttgtggatacttaggggccgaggagctccccataccctactccctaatgccttttttttttttttttttttgagacacagtttcactcttgttgcccaggctggagtacaatggcacgatcttggctcactgcaacctccacctcccaggttcaagccattcttctgcctcagcctcccaagtagctgggattacaggtgcctgccaccacgcctggctaattattttgtatttttagtagagacagggtttcactatgttagccaggctggtcttgaactcctgacctcaggtgatccacccgcctcggcctctcaaagtgatgggattacaggcgtaagccaccgtgcctggccactactcccaaatgtcttacataaagcagcctctttctggcttggaggaaaagatcaatgaggcacatggaaagcaggagttccatgttctagaagagcaagtgcgcatgcgcgtgcgtgtgtgtatgtgcgtgcgtgtgtgtggacagtgtgtgtgtgcctgtgtgtacagcatcccagtgttctcccacccctaaagatagatttggagacagagagaaaagtcttctgcccttgtcctaggtgtttctcctcaccaaccccaacagaccacactttggagaaagattgtgggcaggcccccttccaagctggatttcaacaacattgccagcttctgttgaaacagatccgaaagggtccactccaagcatgtatcgtagaacttctcatgcttccaacttcaatgtcattgactttccagaagcaacctatacctcgggtttgctcttgatacatcaagaactttgatttgcgcctcctcctgtcaccttgatcattcccaaattcgtattcttccttctgtggcctccttatccatttctataggaactgtaaatgttgcactagggatgattttgtttttgtgtgtgtgcttgctcagaaaatgaacccattgatcttgatttgaggtgaagaaagaaatctaaaaagatcattactggtccttttatttctctctaggcttccaacgagtagtttttttgcctgggatcctctctacagctgggagaggctcggaactgaggtgctgacagcttgtgttggaatcgcatggtgtttactgtgctgggagtttataacggccttgtttccatactgacagcaaatgccatatggagagaaaaaaaaatctgtcaaatgaacccttaagggatcacaatatggcacatgaaatctcaaaactgcttttggaaaaggtgggggtagaggggtaccttgcttaaatcacataagcagcatggtgctctctcccataattgaataaaaatggaatttgacacaaggtaatttactttggttctgtgtttgtgctgggaaaaactgattgggaaaggatgcaaagatttgttttcctccccttgggggattgtgttgagtgggaggcaacgggaatgcaggctgtatctgcagggcattgtgctaacaggtgcaggctgcagacctgtcacaggccgctgagaccaggttccctactgtggctgatgatcacactcatctagcttgacattttattactgtcatttgagatcttgtctgttcacccacacacactcctgctgacctctccaatctgagtccaagctccctgcgggctgggaccacatccctaggtacccctccccgtcagaacctggcacacactgaggctaaatgcttgttggagtggctatttgtgaaccatctgtgctgggagcggtggagactgcgcccacggctgaagggcagagtttaggctgcagtccagggctagttggagccacaaaaccatttgagagtgggccaagaggggacttggcaggttgctcatccatgctgatccaaatactcactcgggagagaatgaaacgttttagagtgccttcttcaacatacgctacttagaccgggcgaattcctcccaaaaaaaccttgccctcaggtaggttacccatgaaagaagggggcctggccgcggctctttccgttccaggaggcagacagcggagtgctgaggccgtgtccccgtgtggtgaataaatgcccgggagggcgggctgccttcagggctcctctctccgctcatctccgcttgtgtgcgggctgcgcctccgtgggctctcgctgcgtggggggaaggcggtctcagcagccctcggctgaccagtcatccccaagaaccctgctggcatcccagggaacagacagtgtctttcctggaagttctggcaaaagccctgggaggactccggggcccccacggatcacaggccctgacctgattggctagaactgaggcatggccacccttgaacctgtcattatggccagagagagaggcctctgattggctgtgactaagtgacgtgtccatccgtgaccgtagcactgtggccaggagacagaggccttttgattggctgtgactgagtcacgtgcctgtctccgtagcatgggaggcgtcagctccccttttagattcagaggcttgggttgaattggtgcagactgggagaaaggaggttccctaaaggaaagggagatggaacagaccaaattatcacatccataacgatgagaaatggggtttattaatgtgccagcatctggtctgagtggtttctatgtattgtcttattcattcttcgggacggtcctaggagttaggtctgcttaccgtccgcagtttacagactagacaactgaggggcagtgtcaagcctgttgccccaggttacacaggcagtgagcgatgggctgggattcaaaccaaggcagtttagctccagagcccacactgacactcacagctaccacgagatcctccctcccggcaagccatagctttacatcctgtggataagcattttgagactaagaatcaaagtgtgccagcgcagtggttgtgttcatatccccttgttgcctggcgtatctcaagagaaatcctttctaggggggatggtgtcttagctcctctacaccaggtagactatagtcatcccttccctgcaagttgctgtccttcccaggctctatcgccctcttccctgtttcccacgaactcatccgactgtgtcccgtgcagctgcaacatcgatggcctagtgttccgtgctccagagagcctgagacagcatgtttcagtggttccttcgagtatcttcctggccagagagaacttcttggagaggctttagcatcactgcaggaagaaccaaaagggaaagggcccccatcccaactccagcatgcccttcttgttttcagaggagaacacagaggcccagagagggcaagtgaattgcttgaagtaacacagcaaattgttggctaacaccatggtctctgggcctcttggtgggagtcttgcagtatttcctcttcagaaccctcttggctattgagtgggtaagcgcgggtgacttcctgtctctgtgcctttagtgcctaactggaaaagtcagggttttcataatttgaagcatcctaagactgggcttttctccagttgggcaaaaatgatttttaaaaactgtatccattaggatgctttgaattagaagtaatttctaaaagtgttcaaactgccctaaacaaggagaatgtgttgtctcataaatcagcttttcagatatggtttgagctacaggcatggtttgatccagagattcatgacatcaccagggcaccaactctacttcttctaatttcccagctctcacctccttgatgtgtcaggctcatcctcatcgcggcttttcttgcagtgtcaagaacactgctgcagcacctggcttcacacccactcaccatgacctccagaggaagagagcacctctgctccagtgttcccagggagtctgcagtccactctgattcgactggcttacattacaggcctgccacccttatccagtcactgtaatcagagaatgtgatgtgcttaatggccaccaaggagatggaatcacagtccccagaactgctggcatgtccatacagaaatcagagcattggactgggggtgtggggtggggagtagaggctgggtcatcactggtgccttcttctacactgacgtctctctgagtctgtgaagaccatgaaatgaagaaggcgttctgagagtttgccagtcaccttcctccatccatctagggctctgagcccaggtgtgggaatgacaggaaggccctgcctggccttctcctgggtctcatcacattcttcttttcttgtctccagacagagattactgcagtttatgtgacaagcagccaatcgggaggctgcttttccggcagttttgtgaaaccaggcctgggctggagtgttacattcagttcctggactccgtggtaagttcctgctcctgagggatggtcctgtggtcctctgtgatcagtgattgttttggctcaaaggaaaaaatagatctcatgggttagaagactgaggaataaactcactgcttacaaaactcccactacagactttgattaggaatgcaaaattgtctgaggatctaaacacatgggtgaccttgggtgaccttgggtgggccccctcccctctggaccttagttgctattgctataaagtggagccctatcagctctttgattctggaagcctgggttattatgggaggcagtgcctggggaagttaggcctagctcttggatctcaaggccccttcctccagctgagaacccattttatagaattccaaagcttttgtctgtttgtacaattgtttattgtctgcttccccattagaatgcaagctccctgagggcaggaccctgggcttcctgttcatacctgcctcacacagtgcccagaatctatgggcactcaatacatgtcaaatgaagcacatggctgtcaagccggtctgacaccaatggctccactgggctctggcatggatgacatgcctgacaccatggagtcttccttcacatgtgcttgttattctttgtttaacaaatgctgattgattgcatgggcttttaagacaggttgtgggaatagtcaggagttcctctgcacctgcccggggagcctgggcacctcggttcagccaactgcccttgggtttctatccgaggaaggaggacaagagggaaggaagaggagtggagagcggtcatgaagggtgtgaagtcatccaggcccctcccctccccgccaggtgcaggggccgagaggctgctgtttcctgaagggccctcatgccaccattggctgcagccatcccgacctctatctcagtttgggggacaaccctttagggtttcaagtctctgtatctgcttcaagatctcgatgtgcatctctagacccacaaaccaaattgcccactggacatctccactgaagtcacaaaggcccccttaaagtcagtaagtcccaaatgcactcaggactttctcccaggaccccaaagctaccagccctgagacattacctgttccagtgaccagcaccctatagtcacccgagcctgaaatctttgcactctttgatgccttcccctcctcgtccttccccaacctgatcaggctcatgtgcttggctccttgaccctgcccaggccagctccctcccctctgcaggctctgccttgggcttaggggaggctctgccttgggcttaggggaggctctgccttgggcttcgggcaggctcttggcgcctcttgtgtgagtgattacagtagttttcaatcttagctgggcgttagaaacacctggggagccttaaaaacacaccagagcctgagctgaagcccagaccaattaatttgaatctctggaggtggggcctagtattttaataactttttattatggaaaatttcaagctataaaaagtaaaagtcgacagaatagtgtaatgaacccccaggcacccttcaccccacctttatgaacccacaattatgaactcatggccaatcttctttcatccattcctccatcctttactctgtaacactttgtagcaattttcacatattatctcatctgtgaacttttcattatgtatctctgaataagagctctttaaaaaatagtactatcacagcttaaaaaattctttcctatcatcaaatgttagtattcagatttccagtgttctcatacattttatgtgtatttgtttgaactggtctggctaaggtccacacgttgtgatctgttgatgttttcttgactctaggctcccccataaccatccatccccctttgtaatacatttgttgttcctacagaagagcttcccacagtctgaattttgtattcttatccctaaatgtcatttaacaggctcctctatatttctttcttttttttttgtttttgagatggagtctcgctctgttgcccaggctggagtacagtggtgcgatctcagcagactgcaagctccgcctcccaggttcacaccattctcctgcctcagcctcccgagtagctgggcctacaggcgcccgccactacacccggctaattttttgtatttttagtagagatggggtctcaccgtgttagccaggatggtctcgatctcctgacctcgtgatccacccacctcggcctcccaaagtgctggaaccacaggcgtgagccaccgcgcctggcctggctcctttatatttcttatacgttgctagttggatctagaaacttgaccaaattcggtttccgtttttgcagggtggagtgggattcgacttcctcagtggtttcatgttcttccatcaggggacatacaccatctggttgtctttctttttgaaatggtagcagctattgctagtctgtacctgaatctgttaattaacaagggcttgcaacatggcaacattctaattctgccattccttcttcatttgccaacagaggcacttccttttgatgaccatgtggtgacccagtggtaaagttcatagaggaaatggttgattcttttctcgcattaatgtttctaaaataccaaactggttcactaccatcctccagtagcagtaactatttttaacttgtggttttaaacatgttgcgtgtgtattgttgcactgtagtcattatcctgactgatgctcatcgtctcatcagtggctagtgggggcctctccaggttggcttctgagtccctggctgggctccagcagttatcagtagtctccttgctgtctgatatgacgcagggttctgggctcatcttgtactagatccattgtttctcagaggagctgtgattccttttactgggacatagcagttgcaggccacagtttggcacaagggttattaccactaggccatcgattctagcacctattggcatttttcaaagctcccaggggtttaatgtgtatccagggttgggaagtaatgacatctaggataaagtccaggttccgaggctgacttaccagatcttccagcatcagctcctgcccaccttttcaccgttggccttcccggagtctttcttcagctctgtgttctggcccgaccacccacttctggcgtttctgacttgccaggacagttcaagcctcttggccctagctccctcaggcctccctgcctgaaatcctccccacagtcccatttgcctggcaaatgcctacttgtccttctgtcccctgttctcagaggccctcccgatctccctcttcctctctctcctgctgtgcccctctgctgtgggtgcttgcttctcacatgcacctgagccacactgctgccccgtgctggcagaggtgcatgatgcagagtgcagcctccagagataggatgccaagacaaaatggctctgccaccatctgttggtgagaccatgggcaggtgtttaacccctcgtgtacttcgtgtcttcatctgtaagtggggatatagctgtatctgatgatgggcgaggtgttaggtagagactacatgagttcttaccgctcacaaccatgtctggaatagcactgaggctcagtgaacctagccattgaggggtctgtgtgcctgttcctccactagccagagcctctttgtggcacagacgtggcccatggtctgtgaatcctcagcccacagtgccacacgtaacagttgagtgatgctcagattgggcccagtggaggttggtggcttgcctagagtcaaagagcatgtgaggggcagaggtaggcccagaacccaggtctcctggctcccagtccaggctccttcctctgcatcatgctgcctctgagaccatgagcatcataagccaatgacatggaatgttcgaaggtgagaactgggatggaaaaacaactggagcaggttaaaggaggttgggagtttggatatggggaggctggttgtatcatgaagtaggatggtcagcattggagtctttgaaaaggcgacatttgactgaggaccaggaagtcgttggaggagttagccaagtgaatatgtggtgaaagggtgttacaggcagggaacagccagcacaaaggcctgaaggcacgagtgtccgcagttggaggggagggaggaggggcagagggggtaggagaggaggtgatcatgtaaaactttgtgccatcagagaactttgactttgggtgaaatgggggagccactggagggtttttagcagagcagtggcatggtctgacttggggttttattttattttattttattttatttatgagacagggtctcactctgtcatccaggctggagtgcaggggtgggttcgtagctcattgcagtctcaacctcctggactcaagtgatcttcctaccttggcctcctaagtagctgcaaatacgggtgtgcaccaccatgcccatctgtgacttaggtttttcaagaatccctctggcttccatgttgggagcaggctttgaggggctgaggtgggagcagggagatctgctaggaggctgttgcagcagtccaggtgagagcagctggtggctcaagccatcttagtagcccctggcggtggtgagaagtggttggatttgagacttgtgtggaaggtgtattctctgatggattggggatgagagaagagttaaggaagacttcaaagttttgacctgaacaaatggaaagatggagtaaggatgaggctgcaggagggtcaccttgtggggaaaatcaagagctccgttttaggcacacgcgccttgggatgtccaccagatccttgagtggcgaagctccaggggagatgggtgttcaagccaggcttcatgagaaagatctgggctggaaatggaaaattgggagttgtcaactttttttttttttaatttttatttttgagagtcttactcggtcacccaggctagagtgcagtggtgtgatctcaggtcactgcaacctctgcctcccgagctcaggtgatcctcctgcctcagcctcccaagtagctgggactacaggtacacaccaccacgcccagctaatttttgtattctttgtagagacagagttttgccatgttgccatggctggtctcaaattcctgggctcaagtgatctgcctgctttggcctcccaaagtggtgggattacaggcatgagcctccatgcccagccttggagttgtcaacacatatatagctggtgtttagagagccctgggctggaggagctcaccaaggaaacaaatccacgtggatggagaagcgtgaggacaaaagatgccccggaccaagggctgctccccatttggaaaagaggaggcagcagcagctttgggagccatctagagagttgatgaggcagagcagagtgaggctaagcctaggagtcggtggaattttccagccacgtgttttgttagacacttacagtcagtttgaaaaggggggaaaaaaatccaatggatgcccattttcattctggtcgtgccatcgttccctctctctgggcctgtaccaagagctgttttttggaaaggaaatgtgagtctggctcctgtgtcagcacgtcaaatgctcttcacatctaccctaatgaagctgccactcacgaggggccgacccgctcccttctgcgttttcatctgcatccctgggaattagcgagactttttcatcgcccatcttgacgtcaaatgaccagcctctggaacacctcttttacgcacggagactttattgagttttccagggctggcgtaacttctcgtctaaaatccgttttttcttccatcctgactggaacccagaggagggaggaggtggcggggtccttggtgttgcagtagcgccccgggtgctgcctgactcggccagcgccatccacgccattcccatctctctgttgaatttctaccaagtggagcttttaaaaataacctgtcctcgttggactctgatgtagtccctgggaaaggctcctctcctgcacagtatttttttttttttaatttgagacagagtctcactgtgttgcccaggctggagtgcagtggtgcgatctcagctcactacagcctccgcctcttgggttcaagtgatcctcctgcctcagccttctgagtagcagggattacaggtgcgcaccaccacacccagctaattttgtatttttaatagagatggggtttcgccatgttggctggtctggtcctgaattcctgacctcaagtgatccgcctgcctcagcctctcaaagtgctgggattacagacgtgagccaccgtgcccggccttctgtgcagtcttaatgtccacatttctcaagtcaagtggaaggctgcagctgttttttaatgacggcccaggtgattttctgggcagcagaactgtttgcgcgtcatttactagactgcagggggagtttggcctttggtgttggttatcaagggtcttccaggaacctgagaaagacttttctcctgccactgccacctgtcctctcagcaagaaatggagtcagtgacctaagccatgactaggtctggtctctaaagggcaaagagtttgcccagctggtcaggggattgaagagggtctaggctagtgtcagcccccacagggcaaagagtctgtggcatcttggagactgatggacttctctctaacctgttccctgggagccttgaccacatgctggctcatttgaaaccatcttatctccacacttgggtgagacttaatgggttcaggtctcttctctttgggattgagggatgtttggcagatatggaaccagattcacccagggcacatttatggggtggctcctgtgtgccaggctctgttctagcagttgggagaacacaatgaacaggagaactaagttcctgcccttgtgcagcttgctttctggttaaatgaaagattaaaaaaataaagaagattttttttttctaggaggtggaatctcactctattgcccaggctggagtgcggtggtatgattatagcttaccgtagcctcaaactcttaggcccaaagcgaatcctcccacctcagcctcctgaatagctgggactacaggcgcaggccaccatgcctggctaattaaatttttttttttttagagatggggtctctctgtattgcctaggctggtcttgaacttctggcctcaagtgatgcttccaccttggcttcccaaagtggaatcatgctggattacaggcatgaggcactgtacctggccaaggaaaattttgcagtgaattaagcaacaccagctacaagttaaaatatttgttcagtattagctttgggttttttgttgttgttcttttttgagacagagtctcactcttttgcccaggctgcagtacagtggtgtgacctcagctcactgtaacctccacctcctgggttcaagtgattctcgtgcctcagccatcctagtagctgggattacaggtgtgcgccactatgcccagctaatttttgtatttttggtagagatagtgtttcaccaggttggccaggctggtcttgagctcctgacctcaagtgatctgcctgtcttggcttcccaaagtgctgggattacaggcatgagccactgaggcccacacagtattagttcacctcaaaatatagtggcttgaaacaacagtcaacctttattaggtgatggttttgtgggtcaggaatttgggcatggctttgcgatgtgctgttggctcaaggtctctcatgaggtgagatattaagaagttggctgggctgcagtcatctgaaggcttgaccgtagctggaggatctgcatccacagttattcacatgcctggcaggttggtgctggctgttggcaggagggagcctctccatgggattgcttgagtgtcctcacaacatggctggctttctccagagcaagcaatccaagagaacatggtaggagctgcagtgccctctatgacctagccttagagcatctacaccatttccctaatatcatactggtggcactggttagccctgtttcatatggaaagagactttcctagagcatgagtaatgaggcaaggattattgaaggccaccttggaggcaggcgactacaaatatgaggttacaacaaatgaaatctcatataggaaatgctaagaggcattcctatctgctaagtagcctagactctaggtgatgaaataaaattagtgggctatcacctggctttagatgtgcctgaccatttgaaattttattgtgaaatgatccactctgcctcactgggggctaagtattctgcttctcttgtttatgagaatccagtatttgtctttgtctttctctcactggtgtgatcccccaaaatgggaagagtggagggtgcttatagtttttcaggtgcacatagagacagtcagaacatctaggaagccagaccccgggagcagggctgtcttgaaaaagtgccacttctaaaatgggtttatatagtgcacatctgtgggatcatccagtctcctgggtgccccacccgcattcccaaataacatggctgtcctagaagctgccatgttcttaatgatgtcacccccaagctgcagttgactggagcaggagggggtctgtgagccaaggcaggccaacgagtcctttccctggaattgatggcctcaaggggaagttcttccctgctagagaaagcttaacataaaaaccctgggaactgtggactgccatgtttcctacactggaacaagccagtcagcacccagagatcatgagcaacacacacacacacacacacacacacacacacacacccaacacacagatcatgggggctacagaagtgcttgtgtccctggtctctgggctcttggcccagctgcttttctgatttccccacaatttgtttgttcagctcatcctcagattccaggagccaggagcttacagttttgttgaactaggttaggctgggattgttttcacttagaacaaaaagagtaatggggaaagttaaagacctttcctggtagcctttagatccttggttggatgcagagacagagaaacaattctgagagggaaggaggaaaagcagctggtgggggtgaggatgggtggagctcttaggagaaaagtgatggggcagacaggaagcaggatggcacagcccgtctgtattagtccgttttcaggccgcttttaaagacatacccaagactgggcagtttacaaaagaaagaggtttaacggactcacagttccatgtggctagggatgcctcacagtcatgatggaaggtgaaaggcacgtctcacatggcgggagacaagagaagagagcgtgtgcagcagaactgccctttataaaaccatcagatcgggccaggtgcagtggctcagcctgtaatcctgtaatcccagcactttgggaggccaagatgggcagatcatttgaggttaggagttcgggaccagcctggccaatatggtgaaaccccatctctactaaaaatacaaaaattagctgggcatggtggcgtgcgcctgtagtcccagctacttgggaggctgagacaggagaatcacttgaacccaggaggcagaggttgcagtgagccgagattgcaccactgcattccagcctgggcaacagagtgagactccatctcaaaatctcaaaaaacaaacaaaatatcagatctcgtgagacttattcactatcccgagaacagtaccagaaagacccaccctcatgattcaattacctcccaccaccgggtccttcccacaacacaagaaaattgtgagagatacaattcatgatgagatttgggtggggacacagctaaaccatgtcaccctctgccactggggtgcttatcacttcccctgagatgggcgagcctgtcccctccctctgagagaggcgagcctgtcccctccaccacgtggagagatgcagccccccttccctcctgccttctcttcagtgtttgactctggccaggccacaattcacaagctggtggctgtggtacctcaggaaatctggagttgctcctaccactttcattctccacccaatgtggacaggagtccattcttccctcccttctcaggttccatcccatctattgccctaagttgggccagtgaatccctcttgactgaggcctgagagggccgctcagatgggagccggagccagagactagagaacactttgcccaggcgggcacaagctctggggttgaccaggtacgtctgaccctggggcccctgggggacacccccatcatgcactgctcgccattctcactggggagcagaaaggaagcaaggccagtgcccacccatctgaagcaccgtgcagggcatcagccaggtcctggcagaaaacagatggccggccccatgtgtgaatggaggagtttaatgagggcctatttacaaagcgtgggagggaaatcagtagctgctgatgcaacacccctgagcctccaccaccccgcaacctgcagggccaagggaagggactgacgcgggatcgtgggagaagactgcccacaggagtcgggtctggagaagagggtccgggagcctgcggtgcccaggcggggacggagccagcagaaaaccaccccaccactccacccccacagcagggtgggagagggctagaggggctctggaggggcggcccacgtggtcagcacacacgagaagctggggccgtgggggtggatgcaggtgtttctccagcggggtgcatggtgagcattgtgctgaccaggcgtgtcacttgtccctgcctcaaggactctggaaaagctgaccacatcaataattacagaagctggaggtggcaagacctcatggcatctctgacttcatcttcctgttagggcagaagaaggtctcctgggagaaggaggtgacatctaaagttagtctaaggccaggaggaattcagcccagactgccctttctaaacctagggccggcttctttgaaaacgtggcaggttcttaaaagcatctgaaggaaatgtgtcttcatagccaggacatatttttcctggcagattctgagattgatgatgcaattagggcaggccaagagaatgaagtattagggctataaactaagatgcacatagatgtttccactctttggaaggcacagatgtagaaataattctttgttccttaagctcaatgtaatagtctgcattttgtgttagagcagcatctccccgcaaaggccacccctgtgtttggcataaatcacaatgcagggagaaggctcattcagtggtgtcttccctgttggcacctggcacgtatctggattatggattgtcatgggtgctccctggcaccgtggctgttagacctgagttctgggcagggagagctccaggctggagtgcaatggcacaatctcagcttactgcaacctctgcctcccgagttcaatcgattctcctgcctcagcctcccaagtagctgggattacaggcacctgccaccatgcttggctaattttttgtatttttagtggagacggggtttcactatgttgggcaggctggtctcgaactcctgacgtcaggtgatccgcccgcctcggcctcccaaagtgctgggattacaggtgtgaaccaccgcccctggctaagagagctttaaatgaacagaacagcagaggtgcctgtgtttcggggaggggacaaggcccatctctctctctctggttggaagggactctcttgcagatggaggtcacgagggcactctttgcatacagtttacctttcttttcattgaaatcattggctgctatttcccaagctacatctaattgtaaaattctgggttgttggcacactcttacttgctgcttacgtttgctggttaagctggtttaagctttctcccaccagctgggcaagggtgttctcagggcagtggtttccagggtggccccagccgtgtggagtgtgatctgccttgagctcggcccatccaggggagccaccatggtacctttcctctgtaggtggcctctcaggactcccctcagggggccactgtggagacatggcctgtcactaggtgtcttaatcagtgcgaaaagcccagctggaggccttccatccgttttccacctcccaacacaaatgctcttcaagtggtggcctggcacggactctttgagaaaggccttttgatcccggcaggggaggcctgtccccgcgtgctccctctgccgccctgtggacctgcgtgcccatccaccggcggggcctctgccgggaggcaggtgacctgaaagggatgttatttttttaacgtgggttttagtacccacagcaagagtatttttagctggttattgaggctgattagtgagccccaggcctccatttggttaaatagagccaccttcacagatgtattttcgtacagtgcaaatctagtgttctggatggtatagagttaccccaaatgatggccggccatttgcccagggcctgcgtcctgcagagcagtctagctacattcccacggtgccggaccaacggcgggctgtccaggggcagcaggaccctgggtgcttctcattctggaaaacagcaggcagctggctctagagtgctcagcccctttggagacgccactgctgccccgtcgcttgctagctgtgctgtattggaacctcttagacccttagtttcttcatctgcaaatcgggactaataatacctaccatgtagatataataataataccctgccatgtagggtgagcctggaatcagcactccatatggggtgtgtgtctgtgtgtgggtgtctgtatgtgtgtgtgtaggggtgcgggtgtgtttgtgtggatgggtatctgtgggtgtgtggtgtttgtgtgtgggtgtctgtgtgtaggtgtgtgtgggtatgtgtgtgtgtgtctgggtctgggggggtgcgggtgtgtttgtgtggatgggtatctgtgggtgtgtggttgtgtgtgtgtgtctgtgggtgtgtgtgggtatctgtgtgtgtctgcgtctgtgtggggggtgtgtgtgtgtgtgtgggtatctgtgggtatgtgtgtctgtgtgtgggtttgagtgtgtgtgtgggtgtctgtgtatgggggtgtgtatctgtgtgtgggtacgtgtgggtgtgggtgtgtgggtgtctgtgtgtggatgtatctgtgtgtgtgtgggcgtgtgtgtgggtgtgtatctgtgtgtctgtgtgggcacgtgggtgtgtgtatctgtgtgtctgtgtgtgggcatgtgggtgtgtgggtgtgtgtgggtgtcggtgtgtgtatctgtgtctgtgtgtgggcatgtgtgtgggggtgtgtgggtacgtgtatgggtgtgtgtatctgcttagtgggcacgtgtgtggatgtgtgtgggtgtgtgtatctgcgtgtctgtgggcacgtgtgtgtgggtgtgtgtgggtgtgtatctgtgtgtgggggcacgtgtatgtttgggtgtgtgtgtgtctgtgtgtgggtgtgtgtctgtgtgtgggcacgtgtatgtttgggtgtgtgggtgtgtgtgtgggtgtgtgtgtgggtgtgtgtatctgtgtctgtgggcacgtgtgtgtgggtgtgtgtgggtgtgtatctgtgtgtgtgggggcacgtgtatgtttgggtgtgtgtgtgtctgtgtgtgggtgtgtatctgtgtgtgtgtgggcacgtgtatgtttgggtgtgtgggtgtgtgtgtgggtgtgtgtatctgtgtctgtgggcacgtgtgtgtgcacacatgtgcactcaggtttaggagagcgacagggggcacagaggaagaaaataacaggaaaaagtcaagaagaaagagccaccttaaagcatctcaggaattcatctctcgagtcaaatcatcaagaagtgcccagtccctcaaggctcatcttgatgtggaagaggagttgacctctggggagaggctctgcccacgcggcgcagtgggaatccagaggccagcgcgccagtccagcagctgtgaccttggaccttgggcaagtccctgacttctctgagcctctgtgtccagccctataaaatgaggggtgggattccttacagaaccactgccctatctccctgtgatctaaatgattgtagtgttcatgtttcttcatgggagaaaatcattggatcttggctctccattagaagagagagggcaagacaaggacactcgctcactgtggttggaaacgagcctggctgcctctgtggtcactgcgagtgccgcctgcgtgctccctttggctggcctgggaggaatcggaccctagacactgaggtgtgaagtttccctgagggccggctgggcatctgactgcatggtgggacgcctggggaggagttcgggtccgtctatgctggtgtcatttccttcctcttttgaaatagctgtacttttggacagaggctgacaaatccttgggtggtggattttgaaatggttataaacaatttgcaattagctcttttgtctaaatgagaaagggccgcttactcaggctttttattgactcgaggccctttatccatgtggcgagtgcgtcagatgtgagcgaaggagcccctctgggattcagggaaattaaaaagtctgttttttggagacctcccatctttagagcttgggccccctggcttggctagttatcagagtcctaaattctgtggtgtggttgaggagaagccctgcgcttggaggttcgagtcccagccctgccacctcccgctgcatgaccctatgcaagtcccttcccaccgccggccctcgggatctccacctacagacgaggggttgggatggcagcccctgttctcctgcgtcactgccctggctctttcgaggttcagataagaacatcttaaaaaacctgtgtatgttcactttgtaaactgaaaagctggaaaagaccaggcatccacattattgtttatccttgcaaggtgtaataatcacaatggcggtaactatagcaactgtttattattatttatgatgggccaggccccaggccaagagcttgatcacttccgtctgtataatcagtgtatacctaggtgctggtaccatctgcgttttatagaagggttaagcaaattgtctacgatcacacagcttacaaggtctgagtgacctaaggcagcttctcggcagccttccagtctggtgggctgttatttttctggtagtttcctttgattcatctaagtcagtggtcttcaaccccggctgcccaggtgccagccctcatggcccactggaaagcctggtttcatgggtctagggtggggcctagcatcagtgtttgctcagggctccctgctgattctgatgtgcagtctgcatggagcaccgccatcctgagacccagcatctgtgagagagggcaaagtagtttggactaaacatcggggctccgtggccaggtcttcccccccggtttcctgacctgcaggagaagggggttggtcaggtggcctctaggggatttcctccaggggctgtgaggttctgtaactataagaagctcatgagcaaacctgttattgttcttttttctccttctgttttaggcagaatatgaagttactccagatgaaaaactgggagagaaagggaaggaaattatgaccaagtacctcaccccaaaggtaaggagtcttccaaaccccacagcaggtggcacaggaggccttatgcaaaaataggagcccctaagtctgtgccaggccacatggggagctgttaagtgctgggctggtggctgttgttgacctcctgagatcacagttcccatcctcccccagagagtgcccaagcctggcagggccaagatggggatggtctaggccaggactggagtaggggcgggatgcctgcttcttggggcccagccccttcaagggtcaccatgctgctgtgtgcccacacccaaccatttgtggtagggcagatggaggcctggccaagttcaggagaagtgcccagaaggaagggcttagcagggcagttctgagaggtcagcgtggaggggaagtgttgggggttgactgggagggaaagggggtgcccaacgacatcaaagaatgaagagaattctgaaacatattctggagtattctgaagggtcaggggccaccccgaccccacctcggggccacccactggatagttgaagcatcggggtaccattgtcctcagggtccagcagcctcggttctccaagatctgcttcctcttgactcaccttcacagaagtgtgttctcaacccatttagtgttctagtgtcagtggttctgcccacttggtcaagccacattccctccctgggcctctgtttccctttcttaaaagtggccttcctgtcagactcacctcccggaggtgttgagagcctgagatgggacctgtgtgggaatagctttgcgtgtgtcccatcccccggggccagtggtggcttcaccctgctcaggaccctgtgggccaaccagctccccggaagagtatacctcctggtgcccatcccaggctgccagtggactgaggtcaccacagcctgtggaaggtcttggccatcagtcccctcaacctcctgcacctcttgcaccaaatgtagccctcgttcttctccagcatcagcagttggtagtggccattgcccttgcagggtgagaccagcctcacgcccagaagtgttgccctttgtcacgccccactctggacagcctgctagacggcattcctaatgcgcacacagtcgccatcaccttgttgcctccccttgctgtttctctgctgcatccatcataatccatgcacttctctttctgtgaactgcaaacacccccagcccttttgcacttttcagaaatgacagaatttatgtttataaaacacttctaggcatagaatagggctagtttgctctggacaaggtgtggccctgggtaggcacagctgcccccaccttgggggccttgctatgctccagatatgggcctgttgctgtctgtgaggttctcaggtggacacagacgaggagacgttctcagcagggtccctgttcacccagtcgcagccgatgtcatattggtggggctctggctagatacatttttgatctcctggccaccactcaagatagtgtggacactctgggcataaacacatgccctgagcttaaaggggtgcatgcaccctagagggcataatgatgacagctccctggctgggctcctatggtgtgccacatgcctccgagatgtctctgatgattcgcgtatccacgagattgccctatttacagacaggccactgaggccacagagctgaatagcgtgagaggccactctgctgaaggggtcttcagctaccctctgcagaggcatcttcccacggtggctcagcttggcccagtccagcgcttcatctgtgcccccatagggctacccagtcacatgtgtcccccccaaacaatggcaactagaatgtattgaggactccttgtgtcaggcaccactgtctatagtccttgctgtcactgtgggatgcagattatatttgttccatcttaccgataaggaaggagaggctcaggggagctgtcacatcccaagtcacacaactagtgagtggcggagctagaatttgaacccaagtctgggtgattctagagccctgagtgtttcccctgggtgtagtctcctcacccggcttcactgtcctgccactgtctgtggcctggctctgatctgcagtgagggcggagtgctccctttgcctgaccttgctgtctggataggctcttgtggcttagccaagaacagggtacaggcaggcactggggcagccactgagggctgccaccgggttgccccgtggccaaccttgtccagaagcccctgctggcagcccctgacctgagctctccagacctccctagctctgctcagccttgcctccatctcctggagggatggggcccagacacccccatcagctcagacggttttacaagtgcctcagagcctgccagcattttttcccttaagttctcctcaatttaaaaaatttaagccacaccatatgttacggccagggaggcctccaggggaggtggttgatccatgccttgggtcagctgtttccctacaataaactttgcactgctttcccagttcttcccataacagcttgctctggagcctcatttacctctcacgtgccccagtgccccagatgcagcgaagcaaggtgctggctgaggagctgagcgagtgactgaggccccagcactggctcagaagactttgaccaactgcaaagccactgtccccaagcccagattgtccttgccttgggacccctcctcagtatgtagcttgtgtgtctcagctctgagcagtgcttcccaaaaggtagaccataggagagtggccagtggagaagctctgtgaaaaagaaccctcagtggtcaattacacgtgggcagcactgtaataccatgtctcccccggtagattcactcagcatgtgagcatattcaaggctctgagaagtcctgcaagaaagaaacctctttaactgttaccaaagcatttctcaaagttattgaccataattttttttcaattttccattctgctgagcacactttgggctacagaacacatccaagagcctcacgcccacacctccttctgctccagcatcctttcctgggacctctcctgtggcttcacactggactgtggccacaccatttcctaggctcacctggatgtccataccttgtggcctttgttcaggctgtgccccagaaggccctttatgaaggcgctgtcccctactctgtctttctcgcttctgtatccctgcatgtattgaggacacttgtgtcaggcaccactgtctgcagtcatctccaacatccccagctgcacagagcctcttctgcctcttgtcagagtccgttggcctcacctgggtggtctctgagcacactgttccattgttgtgattctgtgccccatgatggggattctgaggagcccaccttcagagtagggccaacacataagcagattaaccaaatgccccacgatgggagcagtggtggagctgtgctcagggaagtgtggggtcaggtgagctagaggacgcttccaggaggtgatgctgctgaatcagatcttaaaggatgtggaggaggaagctggacacaaaagaaggggaaggaggagcggccttcatgggtgcagtgcagtgggcatttggggctatctggagatacttgtaattggcagaattgtgggggagggaagtgctcctagcatctgatgcgtagaggccatggatgccgttgaacattctagagtgcacatggcagcttcctacccagagttacctgggggcaaaatgtcaatagggctgaggttgagaaaccttggcacagaggtaggaaagcgcacaggatgggcagtgctgtgggggtgggaatggggagggggcccctctgagctgtaggccctgggaagccatgttgaggtggcagcagtgtggagttgccagtgcttcgagtgccacttgtattttaggacgatctccctgaccacatggaggaggaataagggggatgaggaaggactggaggcaagaggccatctggggaacagccccaggtccccaagctgggccagcagccttggggatggggaggaacaaagggccttgcgaaacggcagaaggaggatgcccttgggcttttgtcttgagtctctgggtgtatgggggtgtccccaggaaagacagagcacaggatgagggccgtgggaaggtccacctgctctcggcagaggcaggggaattcattttggatggagacagtggcatctgctctctgtgtccccgccccagcatgacgctggacacatggttctcgatcaatgtgagttggttggaatgaaacactgaggggagctctggaagctgccctccatgggcccgtcagctctcctgtctcatgtctctggggagccacgcttggcgagctcacatcctgaggtgtctgccatcttaaaattgctggaagccaggatagaaagcccctgcctaagcaatgcctatgccttgagctccgttctccctcaccacggaggacgccctacaaacccgtgcctgaagtttttatctcaagaggcaaaccccactccgtagaccctgcctcgaatcctgcatcagtcgcccatacaaggccagctttgctttgggggtgttacagggcaacagccaagggtgggcttggaaggggttgaaagctgttggagagctcacagaagggcagcagagtgctgagaaggacgtgagctttagagtcaggtagacctgggttcaaagccagatgtcacctctttgggctgcatgggtttgggaaagttgcttaacctctcagtgcctcagtttcctcatctgtcaagggtgtgggccatgatgaggatcataaataaaagcagcaagtactgagcatggtagctggggcatcttaagtgcccagcagcagtgcttgtcatctgcctttccccaccttctccgtgccttcaaagtcaggctgttgaatgaggaaatcgttcagatgtcgaactgccagctgtggagtgcgagaggccaaggaagggtcgggagggcctccagctgcagagggctggacagaggcagtgagccagtcaggatgatttatactagctgccacaacaaacaaacccccaaatctcaggggctcctcccagcaaaggttcatttctttctcacgcatcatctggttaggtcatcagctcttctgggtcctccctgggtgactcagggatcctggctgctcctgtggccccaccatctggagtgtgttgtcccatggtcagtgccacagaggaagagagggatgaaggaggcacagaagcttttaagtgcttgacccagaagcaacactcatcacttcctctcgcagtccatggccagtggggaggctgggaaaggcagaggagcatctggaatattaggtgagcacaccagtaaggctccctgcgtacattcccatccctcgagccccaggttaaaaacatcacgtggcaggctcatctctggtgctgattagacagccgtgagcgtggcttgtcttagggattgtctcgggtttgtcagctcacagaagctggccagcgggccacagttggatctgagtgtgtgctgggctctgaagagagctgagcagctcaccttctaccctccagttctacagcccagaagtgatacaggtgacaggtattcaggagaggggagggtcactccgagctgaggtggcccaggaaatgttcccattgtaataataataataagtgaaaacagaattatatttcatccagcattacagatgactttttgaaataccaattttatggccgggtgcagtgtctcacacctgtaatcccagcactttgggaggctgaggcaggcggatcacctgaggtcaggggttcgagaccagcctggccaacatggcgaaaccctgtctccactaaaaatacaaaaaatcagctgggcatggtggcccacacctgtaatcccagctactccagaggctgaggtacaagaatcgcttgaaccagggacggggaggttgcagtgagccaaggtcgtgccactgcactccagcctgggtgacagagcaagactccatttcaaaacaaaaaacaaaacaaaacaaaaataccaatttttttgagatctattggtataattctcataccatagaactaattcttttaaagtacaattctatggttttaaaaagattcaaaatcttataaccatcactgctttctgattccagggcattttatcaccccaagaagaaactgttgtacctgttagcagtcactccctgttcccctttcctcccaggccctgacagccactaatctactttctgtctccaggcctatttcagacatttcatataaatggaatatcatataatatgtggccatctgtgactggcttcttttttttttgagacggagtctcgctctgtcccccaggctggagtgcagtggtgtgatctcggctcactgcaagctccgcctcccgggttcacgccattctcctgcctcagcctcccgagtagctgggactacaggtgcctgccaccacgccctgctaatttttgtatttttagtagagacggggtttcaccgtgttagccaggatggtctcgatctcctgacctcgtgatccacccgcctcagcctcccaaagtgctaggattacagacgtgagccaccgcaccagccgactggtttcttttgtagcataatgtttttaagattcatccacattgtaacatgtatcagcacttcactcctttttatggctgaatgatattccattgtaaagatacaacacatttatttagttatctgctcatcatttgatggacacttgtgttatttctacctttttgttgttgttgttgttgttgagatggagtttcgctcttgttgcccaggctggagtacaatggcgggatctcggctcactgtaacctccaccccccgggttcaagtgatcctcctgccaccgcctcccaagtagctgggattacagatgcccatcaccatgcctggctaatttttgtattgttattagagatggggttttcgccactttggccaggctggtctcgaactcctggcctcaagtgatccaccctccttagttttccaaagtgctgggattacaggcacgagccaccgtgtccaacctgcttctattttttgtttctacatttttgctcttgtggaataataatgctgtgaaaatgcaggtacaagtttttgtgtagacatgtttcattggggtatatacataggagtagaattgctgggtcatgtggtaactctatgtttaaacttttgaggaactgctgggctgttcttcaaagcactgtaccattttaaattcccaccagcagggttccagttttgccaaaacctcatcaacacttgctattttctgtgttttttattttatccatcttagtgggtgtgaagtggtgtcttgatgtgattctgattcatacttccctaataattaataatgttgaacaccctttcttgtgctttttggccacttgtgtaacttctgtgggaaatgtctattcagattctttgttcatttttgaattgggttgtttgtctttaatgtcaagtcataagagttcttcatatgttcaggatacaaggtccttatcagtatatgacttacacatattttctcccattctgtgggttgtcttttcactttcttgatagcgtcctttgaatcacaaaggtttttcgttttgatgacattcagccttcatttttgttacttgtttttaaataacttgttttcattttgtcttacctgtccttgtaagaaggcctcagtttttgaagggaaagggtgtgtatggaaacaaagtaaagaaatcctaatgtacatttagccccatgacccggtcttcctttgaagaacgagagccccactgcctgttggaaagatcagggccagggggccaggcctggtccttcatggacattcagccccttatcccctggttgacatgacaacatcccaggggctttgagcccttccattcctaggactgcacgggcctcttacagacttgctcctggaacttcctggcagctccccaagatgggtattagtgtacccattttacagatcaggtaactgagatttgggaagagaagaggctggtccagaatggggaagcgcctgcgtgacctgctttggcagtgttacttgtaggacattttgctgcggctcattttaattgggccggtgagcaacagtgctgatctccatggttgcagtgccccaccgcaattactaaggtctggcaaggggggtgccagttttgatgtggctttgttagggactatcagtggattctaggggaagctcaaacccagtcctggtcctgctgaaagggcctgcgtgggttcttcccggacaagggggtggacaggtgggttggggcaggcttctggggaactggtatggcgtccttctgtggggtactgggaaggccgttgtgcaggcagctcttagagcgcatttcttgccaaaggtctgcaggcaggatattgttctctgggccctccatagatgcagggctgcctctttgtttcaataaacaatgatagggtaagacagggaagttggttcttgtgaagggggaagttacccatcagcctgtttccacacaaacgaaatctattcgtagtgcttgttgggctctctggaaaacatccacattttataaagtcaagagcttgaatgaaaggaaataataacgactccaaattccctcctctggctccccacccccacccaggcaccagcgtcaggaagccgaacaaacccacgcaggctgggccacggctcctcggcctctggcacaggcagtcagcttcatccttgtccccaggacctcatgcaaccccagtcctgccactttccagctctgcatccttggagcctcagtttccccaactgagtatggggctgataaaaatggcgcctacctgtgcttgtggccatcagtcattctctagcacttgcgtggttttggccatgtttgcagactacccttaacagttacctatacaacgattttctttaaatcaacttatcttttaacttaaaatagatgcgttttaaaaggaaaccttgtaccaggaacatgcctggagaaccagtattgatttgtcatacataaaggtaactggaaaaattaagattaaatccaagctagatactctattgtctgcctgaggttctgagcctgaaggctttgtccttgtcattttaaaggagattagtgaatgtgagagccctgatgacaggacggtagcactgcctgcgactttctacttcatgatggaaggcttgcaggagatccaaagagaatcactttttcaccgagtgattcaatattatctaattgtgtccctgtacttcctaagacctctcatcatctttagaagatgctgggctaactctctgcttcctagctatgatgcgttatggaaatggaaatgctggcttgtttttgttagagacagcatgacctagggcaaagagcactggactgggagtcaggctcattcctgatctcccttcctggggtccatggccctggtcctgcttagagtctgcctgatcatccaaccaattcatgatctccagggcaaccaagggtgtgaaatatgggaagcttgggcaaatggctcccttccaagtacctgtcccattctccctggggcttggggtcccagacactggccctggacccggctcttcatctctactgagattgcccggccctcatttcccagtccccggaacaggtcatcctgttgtcaattaatctagtgagctcagactccaccttcacttgagcagagggtctggctgggcagctgcccctgctgggccatctaccagcatttccagcttcctgtcacagccttgcgtacaggctggagggcggaagaggattgaaaagaaaacttgagaaagggacttccaggagttttctcaagcaacagtagtgagggacaggggttgggcctcttccacttccacttctgggagcagcagagagaggaattcacaaatcaagccacatgtgtgctcatgagctgtcttgggacagctagcatttattgagctactactgtagcctagaacttcatattccatgttttgctaagtcctcatcacagccatataaaataacaagaagtggaggctcactcaggatgggcgcccagggaaatctcaggggctgcccagttctgggccccgcacgcagttttatctgcagattcccagcgtgcaaacagataaaaagatctgtggttgacaaagctgggggctggacttctctttttcctcccttccgcttccccttccccttccccaggctctgactttgaggagaacatttagggttctgtggatcccagtttaagcaccatggagctgagctaaactcctcatttcctagataaagaaactgaggccccgagaggcccagcttggaagaggagactggaatcttccttgtggggctttctataactctgtgctagaaacaaggagaggaggcctcaaaagggatgcttactgacttggttttccttctcccactggggatggccggcagctgggtttcaattcctctgaggtgctttttctttaagccagtaagtgtctaaatgctgagacattcgtaatgtctgtgcaaagcagagaagttggctgttgccggaagttctactagttaagcactaagtcattaactctctgggttttagtggaagaggtgagagaaaatagcattaatttagcacctactgtatgcgacatgctttatagctttagtgcattctatcttcatgactatcctatgtagtagacactattgtccttgttttacccaggcagtcagagttctttagctcataatggtaaaacaggggaattgaaaacagggaggctgggcatggtggctcatgcctgtaatctcaacactttgggaggccaaggcaggaggattacttgaggccaggagtttgagacctacctgggcaacacagcgagacccccatctctacaaagaaaagaaaacttggggggctgggtgtggtggctcacgcctgtaattccagcactttgggaggccaaggcgggcaaatcagctgaggtcgggagttcaagaccagcctgaccaacatggagaaaccccatctctattaaaaatacgaaattaaccgggcgtggtggtggatgcctgtattcccagctactcgggagggtgaagcaggagaatcgctcgaacccaggaggcagaggttgtggtgagcccagattgcatcattgcactccagcctaggcaacaagagtgaaactccatctcaaaaaaaaaaaaaaaaaaaaaaattaattaggtgggtatggtggcgcatgcctgtagtccttgctacacaggaagctgaggtgggagaatcacctgagctctggagttcaaggctgcagtgtgagctatgattgcaccactgctctctatcctgggtgacagagcaaaaccctgtctcaaaaaaaaaaaaaaaaaaaaaaggcagaaaacacagatgcaaacagatactagtgtgcaaatatttatagcagcattatcacaatggccaaaaaatggcaacaaccaaagtatccatcaacggatgaatggataagcaaaagtggtctatcactacactgcagtgttcaaccatataaaggaatgaagcgctaatacatgccccaatgtggatgaaccttgaaaacattatgtgaactgaaagaagccagacataaaaggccacatattgtgtgattccatttctatgaggtatctagaatagacaaatccatagaggcagaaagtaagttagcatctaccagggggcacgtgggagggagggagtagggagttgctgcttaacaggtacagagtgtctgttgggatgataaatatttttggaacaagatagaggtgatggttgccatgatgaacgtaatgaatgccactgaattgtacactttaaaatggttgaaatggtgaagtttatgctatgtctattttaccacaatgaaagaaaaagagcaagaaaagagtggaatgtaagctggcctgtccgatgctggagcctgtgatctttctcttcctctgcgttgtcttcttgaaagttaaccaaagacaaaagttcccactgaatcagcttcccaggtgtagcagggggcaagcagcaaggccggggaatgagcaagccccggaggcggtgtcgggctgacgtccagaggctgtgcatgccagcgccctccggggcccagcccagctcctgacccccaacctgggcctcggcttccactctgcgctgtgtccttagcatcttctcacgtcacagtctcctgcgcggcatatttcatgactgtgtaattgtccttcaaatagacacaccccacccctcaccaacctttcctggaaaacaaattgtctttgcccacagcctgatttcatcttggcgcctcctgacgcccttgaggctgatgtgccttgctggagctcctcacagtgggccagggcaggcccatctaggtcctttttcctttctcatgaccatccaggtcagaaaattggaggttcctttgatgctggcagagctggctctgcctctgaccctgtccttaatgtgtgtgcatagtgtttcctgtccagaatgcctctcttttggagtggcggcagacagaagactcagccacaggcttcctgagggcacccccaactctgtcctgggtggcagtgatcctggtccctgtggcttggcaggccctccccatccgtggaccttgggcagagaagtggcatcacgtggctgaggtgaggggcaggttctcttgaatttcctggctcgtaggagattcctgccccctgccccccaacccctttattttgcagcccgaagggatgaagtcttcactggagaaaaatccaacatgatttcggattgaggagggtggtgggtgttctggaagaaggaaagttggcgggccctgccctcgcctatcacgcacaaagaatgagggacactccccaccgtttccccaccgtgaacatccccagcacctcagggcctgggctccatgtgtcagtgacctgcatgtggttgcattggcctgagcggagctggctgcatgcaaaccactggccaggaagaatcccactcctgctgctgctcctgcagctgcgccgggtcccgcgagcccccgcgtgcgcggcctgtgtaaacagtgcgtcatctcctgttgcacactttgggcctgcgggtcacgaccagggattatcaaattgacagagctcagctggcctctcactccacgtccgggcacattgcattttgttaattatcgtcttttgcttttgacgtaaagggtcggggtctgggtcagggtcactgtgtattttcctttccttctcattaaagttgcccagctctcagggcccccagttaaattctgccagcgtttaaagatatcttccctcgcttcccgacccctaagcgcacttcttccttatttctgtgaagccactggaatagcaaaggaaatgtgggtcagggtctttcaaacccagtccattttatttttcttgaagggctgcagctatttctgaagggctgggtttttctactttgttggcccagagaacatgacacgctgggtctcaggctgaccaggtcagcagggcactgtgaaggggctggaaccacccccgacgctttgcagccccaaggcaaggcttgctcccagcacttcccagccacacggccctcacttggttgctcatagccctgagcctgctgtctgcctgtgatcctcagtgcaaccctaccatctgaaaggggtctagaaaagtgtcagttctgccattaggaaaagtgaattcatccagagctctagtcttggaagagttcctagcgcacaaatggcatgagctggaggatagaagggtcctccctattgcctggctaaaccccctttaccctttgggccatgatcaaacctctccacagccgtggagccacctgtgtctaaagaggccacctctgtgagcgctctctcctaggtgctgaggggctgtgacctgcactctacagcctgcagtccttgctgaccttgaactcctgccattggccaacagagttggtctctggggtccttagggtggacctcatggcctgggcacagaatgggcactcagggaacccgtatggctgatggaccccagctgaagaagctttccgactggtcactggagcagtggccccacctccacctctgctcacaaagacagctcccatgccttgaagtctcttcctggcctggtggaaaacccagctaccctcatggtcaccaccaaagaggtacaagagatcctcagccaaagaattaaggaggttgcaagagtggtggtgtgtgtctgcaccatgatggagtcacaggcctttcgtggatgctggttacttctgaacactgtgtcatggtgtcactcccactttctcctccgccagacacacaagactccagagagcccagagaccccttagactctaggtctttggactgttcaccaaggaaagataaaaatggcagactggatgccatcttcctaaaggcatcatggcctctggaagggccctggagaggcccctttgagagttggagacaagggaagatccagagtttctttgaggggggactgaagcttaaataacttgctgagcatgctttttaagaaaaagaataggaggttaggtacaaaagtgaatattgagaaggagaaaagaaatcacaacaaattactgagggcttggagattcatatccttttcatctgtgacctcaatttcccggaagtgcttctgtagaaatgctctgtctcccaagatagagcattctgtagctcccaggactacaaataaaggactactccgtctcaattaacaaacaaacaaacaaaaccctaaagcttcggcctcctcagcttcattgcagatctgcttcttttttttttttttttttttttttttgagatagagtcttgctctgtcgcccagtctggggtccagtggtgcgatctcggctcacagcaacctccacctcctggagtcaagcaatcctctcgcctcagcctcctgcatagctgggactataggcatacaccaccacgcctggctaatttttgtatttttagtagagacggggtttcatcatgttggccaggctggtctcgaactcctgacctcaggtgatccacctccctcggcctcccaaagtgctgggattccaggcgtgagccactgcgcccggcctcagatccgcttctgattggaggctgtgcccaccttcatgggaaacggtgagcatcaccttcctttgaactcaaaagaggcacagtgagagccttccagcctcgatcacaaggacctctacccacaggctgccggtccggtgtgtctctgcctggcagggctgtgcctggcacggtgcccgggccgtgcagtccatcgcctgggctgaccacgaggacaccccggtgaagagctgggcgtgcttgggccgagggctgctggatgttggcatcaggcccagggtggagggagggacaggccacgagcccgcacagctcgtgagcgtgtggccggactgatttatttttctccccagtgaccccgaaaaccaaaccctgccttctttcctttggtctgttcttgtctggggcttgtggatcacgtctcctgcctggccatggacagagaaaggaaccactccagacggacgtgagggtgtgtggcagtggcttttccacatggccctgaaggttttgattaaaaaggtggaagaatggtgctttttcttcctgtcagccaggccttaaatcaaccctcaagtgaggaaatgctctctgcgcctgctgctcagcaaacctttttctctggttgtgaccgtatgagcatgtttaattgcaagccagggtttagggttggaacagcccccattcgccccaccaccctctgctttccccaccccagaccccgtcgctgcagctgggtgagcagggctgagtgagctcagggaatcggagctcggcgagacgaggggagctcttggccgtgtgaagagcacttggaggcctcctgctcacctggcctaagcccctgattttacagatggtgaattcgtctggattcttggcagcaagtggcagatactttcctcccagttgctcaaacaaagagggaatttactgcagagatgaggaggagggcgttctctcctatggtcaaatgaaaccatgagaccgacacggcggtacctaggctgggaacccccgaaccagggcacttctcccccacccagcaaccctatcctacagtttcttcctgagatggccacggcccctccatctggttttaattaagaaaattccttagcactgtgattggcccagcatgttacaaaggcaggaggcagagcagatgaccccataaaggaccttctggtggacagacctgctattctctatctccttctttcctgctgtgaacgttcacactcatgcacacaggcgcgtgcacacacacacacacttatccaacaagcatattgagcacctactatgtgccaggaacatcatcagttcattcagcaaagcagagtggagagattgcagggtttggaactgggcaggcctggatttgcgtctcaggtctgctacttgctaagcgttccgtctgcgggcatttgcggaaccctcacagcacacctggtgccgtgctgcattccatcctgataagcaggaatgagaccacattcctcctttcacagagctctctagggctctgtttccacatctgtgaccccggaacagtaagcccccacctcacagtgttgttctggagagcaacaggagtaaaaatttatgagaaaacccacatcaaggcccagcacaacgcctgcctctctcaggggccgtgactgttaggccggcccgtccctcaggcgcccacagcagcctccagccctggctcctgctaaagacccgactcccacccctgcccccgcccaggccaggcttcccgtagctgacgcagatcccctcgaggagggtcaaggggcggccagggtatggttgtgggagtgcccctcctctgttcccgccccggaggagaaatgagggtggcctcccaagaaatgacctccaccccatgacagcagaacagggcagcccccttgtgtggaaggaaggggacccctgggagcccctttcttccagagagtctctctctcctgctcagccttcctgaaagctgagcctgtccacgttgggaaattgcaaatagtttacatggggaatgtcagctgcccacatatgaaaatatacacatcattaagccctaagtgcttgcgtctggagatagagtggacagtctcccgggccgaccttttgtccactgacggaaccatggctaatgagcgcggagctcctcagtgggatgttttcctctactgaagtgaagcatatgttggacgttagcgtgtgtgtgtgtgtgagagagagagacacatgacagcactatacaaacaccattggtcaaaacacacagagtccaccgcacctccttatccagcccccatgggcctccagggagggcttgttcctcaacaccacatcctcctgcacactgtctaggaaggaatgtggcatccttggagtacatgctggtgctcagggataaggttctctggccagattccctaggtttgaatcctgtctttgctcccaggccaactatgtgcccttgagcaagttacttaacttctgagcctatttctgcgcctgtgaagtgaggacagtaagaataataaaacctatcttaagaagatcaaacaaggttactccacataaagctcctaggacctggcatatcataagtgggtgctcaagaaaaggcaatgatggccgggtgtggtgacgcatacctgtaatcccagcactttgggaggctgaggcaggtggatcacttgaggccaggagtttgagaccagcctggccaacatggtgaaacaccgtctctactaaaaatacaaaaattagtcaggtgttgtggggcgtgcctgtaatcccagctactcagaaggctgaggcatgagaataacttgaacctgggaggtggagcttgcagtgagccaagattgtgccactgcactccagcctgggtgacagagtgagactctgtctcaaaaaaaaaaaaaaaaaaaaaagaaaaagaaaaaagaaatggcagtgatggcagtgatgatgagaatgatcgtagcagccttctccaggaggtgaggctggaagaacggtcctgcctgctgggaggatcatcttagatgtggttatgtcagaagcaggtcctaaagaactgggtggggtttggacatgccatgaaggggtgggaaggaacgaagggaccaagcaaaggtccagtagccagaaagctggagctcgcccaggaaacagccagtgtggggccagagcactggagagcaggggaagaaaaggggaagcaggtcgggcagggtgttgggggccaggtctaagaagccactagacttggtcctataggcattgggggccgctgatgctgtgtggtgcagaaaaactcctttggggaccattgtgtcaaatgaaagagcaaagagtagcagagacctgtgaggagcctcctcaatagtccaaacaagagaagagaattctccaaaccagggtagtcagctggggatggagaggaggcagtgggtggcagagacgccacggctgagattgctagatgtgagtgttcccagctgtgaaatgggggccagctggttttgactggggccaaggaggccaaagccatgtccttcctagagggctggctcaggatacctggttaagggcttataccactcagatccatgcctcccagtcagaggtgccaatcctggccccgccatgggccagcaagtgacttgcaggggaccccttctctcagtttccccatctgtgccatgagtgggttgaagggctgagccctgaggggtctttcctggagggtcctctgatctccacctcctccgccgtctcactcctgaatctctgaacgagtatcaggcctgtgtttctggacagttcccagggtgacgcggggcaaaggattatcggtggctctggggaggcctctgggtgtagctctgagttgatttcatggtctttcagtcccgcttcatccctgggtgcctccaagggcaccagccaagtacaactgattccatctccaccctgacacttgaaacaagggatgttaatacagggagatgctttgggaaccagagcctcaaacatctggagtttcgcactgatgcaggaaatgatgtcccttcctcacgtcagtcattcatggtgcagaggcagggagcagtgccgggagagcaggtgcagccgccttggcgacgccatcctcggggctgataactcagccactgatagctgccccaggagggggtcagcctcaagctacggcagcattcctgccagccgttcctgcttatttcccatgatcttcactagtccctctgactccgaacagcatctccctttctgttcagtgctgactctgtcctccaggcgctggccctgcagtccagcttctctctccttcaaggtccaggcctgtatgacctctctagggctccctctcgaattgatcgctctctctctctcttttttttttttttaatttgagactgcttctcactctgttgcccaggttggagtgcagtggctcagtgatctcggctcactgcaacctccgcctcctgggttcaagcgattctcgtgcctcagcctcctgagtagctgggactacaggcgcatgccaccatgcccagctaacttttgtatttttagtagagatggggtttcaccatgttggccaggctggactcgaactcctgacctcaagtgatccacacacctcggcctgccgaagtgctaggattacaggcgtgagccaccgcacctggctgaattgatcccctttttcccctcagttgttgttgcagaggccgtactcctctggtctgagattatagtcagttggtaattattccaggtgtgcccacctggcctcccaagtctttggggaccagaaggctggcaggccgttggggtgaaggagcatagggaagcaatggcaccaccttgtggacggcctgcttcatgggccttggctgaatgcgtggaggcagaactggggttgggctgtcgcctgcccttgtgcttgggtccctacctctgtaatgccactgagggtgggtgtctgagcatcagcctcgggtgtggtgggtgatccacacgtgcttcccggattcagtgctgagtgtggtgcccactggggtggcttcatgcccaggcctggcccctgccttcctcctcagcacccctcctccccagcctgcctcagtgtctgaaatactccagatcattcctgcttcaggttaagcacagatggcgcctgtgaagcggcagttgacctgggaggggtgcggcaatgagcatttgctgtaccaaggggtgctgggggcaagggattagccagcaagtcaccccattcactctaaacccattgctgtacaaatgcagcttcaggacaggcccctagttcttctctccaaccacactgccaccccaacagtctcatcattgaaaattccaaggcctcccgtgcattgaatcgttagtggtcagcaatacatcatccacaccatgcctgaatatcccagaggtttctgctctgatggaacagaagatgagagaggcgacctacgcggcatgatacggtttagggtcacagcagcagaggatgcatgagatgaggacaaaaaggaggggagaggcttagagaggagtgaaggtgcgaagtcaccctaggcgtacttcatccgtttcggtggggggtctgccctacttatgttccaagtgatgggaagagcttttctccgtgccctgtggtgcccagaaaaacatcccaggcaagtttcatctcttgctacctgaagaggtacattctggtcatcacagatatcaggaactgcccggatccccagaaccagtggcatagagcagagagcgagtctgggccatagggaagaggtggtaagaaggagtgagtcatcgggggtcccgaggggagttccaaaccagcacgagctctgtccgatctgcccgctggaatagcaggcagccttggctcccctggcccagtgcggccccaggttcctccagtgcaggattcaaggtcaatttcccatcccaagagagaggcagggcaggttcttttacctccaggtgaagggggcttttatacagaagaaccagctcacagagcaggcagagtgcccccagcttcaaggttacctctgtccctccccagcttcaggggggaccagaaggggagagtccttcaccaaagaagtgggtggggagctcagcgctggggagtgattgccagaggggttctcacagcccgcagttcctcatggcaggcaaggcctttctcatccagccagaggggagagatgtctcctgccagcaccccaggctacacagctgtgtccccagggcgtatcttggtgtcttcagctgtcccagagagatgattacagagccctgctcagggatagctgggtgtcaccctgactgtcatcagagtggactctggcagggccaggctgaggctgaccactgtgtagcttcagctgtgcaaggccacaaggggcaggcattcatggcggggacttcaagcagagaaactcccctgctccttccagttaacttgatcctttcaaaggaaccttggtgcccaaattcactgttgtgttaaagtcgaggtctgcagctagagctgtttaaggagaccacctggtgacctgagggggtcccggacccctggggcaattttaccaacgagcaccaccaagaccccttccaacctggctgccttcacctctgcaggtatctacaggccttgaggccctcacgcttggatttctgtatggttagacattcaaggggcatctttgatgggggaagcgtggcacccctgaccatcagctccatcccagagggacatccctgcaggaagagctagagtgctgcccagccatagctctcctgacactcctgagtcctcagtggagtgagggtaacatttctctccagaacccacccggcctgtagggttcccccctctcccttctccagcccaccgcccaccagccaggcatctgaaactgcatggaattctcctgccttgaaagacccagtggatggatcccggtgctgagctgaggttactcagaaccccagagccctctgagcttctgggtgccttgtttcttacacggtgtatccgatctgacacgcagccagcggagggccttcttaaagagtctctctttgtaagtgacttccagggaaggaccagacatcctctggttccattgatgcaaataataaatgtccgactacaactactcgcttcttacccttctggcaggtttgggctttagtttcagacgcaatggccagcagcttcttattcccatcttactggcaaaggtgtcactccctggaggcacttgaaagggggttgggttggaattgtttaatctcttcaagtcgagccagtggttataaagccagacattattacccactcattaactcccttgttagggctttgcccttgggcagagctcccctgccagccaatccaaagtatgagagtggtgtgacttcatgtacacagttgggtcacctctagaccctggacaatccccttctcccatctgctgagaagggagttcagttggctgtccctgcctgcaggtaggagggtcaaattctgctttgccccttattccgtcttctataaagcctttcccagatgaccccagctcacaatgacccctcccttctctgagccgtggggctcattgtctcgagctgcatcacttgcctctgctatgggaccaaacagcaccctggtcctcatgctgagctctgcagagtaccgggggctagggtcagaccttatgggtcctgaggggataaggtgagagtggggcacaggtggcccagacagcccactccctccagccagatctcactcattagacacccaacctaggttcaaatcccctctcaggcacttactggctgagtgaccctgagaaaattgcttaacctttctggacctcggtttcctcatctgcaaaatggacactataataatagccacctcaggatatgattcagtgaattaatgaagcaatgtgtttagcccaggacctaactagagttagccttcagtatatgtaagctattgttaccaattaagttatttttataggttttaaatattgggtctgtggataaatttcatttggaggagaaaagtttgctactaaaacaaacaaacaaacaaaaaaaaaaaacaagaagaaagaaggtttgaaagccattgaatttcaaccaacccattttgtacatcaccatgtacagtacaaccgagaggcataagaacttttctgttgggatattataccttataatatatcatttctgtcttactggagaaaaagtattttgaggtcaaaaccacactagctccatctcttttttcttttttttctttttctttcttttttttttttcttttttcttttgagacagggtctcaccgtgttgcctaggctgtagtgcagtggtgtgatcatgactcactgcagcctcgacctcttgggttcaaggaatcctcccgcctcagcctcccaagtagccgagactacaggcaagccaccatgtttggctaatttctttttttatttttagtagagataggctgtcactatgtttcccaggctggtctcaaactcttggcctcaagcaatcctcctgccttggcctcccaaagtgctggcattacaggcatgagccactgagtcctgcctggcttcatcttcatcttttaattctacccctgcccagcaccaggctgtgcctgtggtgggtaagggtgggtccttcctaggtggaaacaaaggcagaaccctgcagagtgcacacaggtgggcaactcaggtcccccttctgaccattctgtttctccccatggcccaccctgctggcatctctatctggtccttgctgactcgcaccaggctcaaggtcatatcctggcacaacacattgtatcgtcttgctcacgaacagacaaccagcaccagctccgtgccaggccttgggccctcctggactaagggtgccaagccatcggctctctccttcctgaagcagatttgcccagggcctcgggatttgtgctaatattcagttgctctgaagtagcctggaggtactggttcccaagagactcagctgccagaatttccaagaaagttctccaagtcttagaggcacaagcccccagttgtcgactcccaaatctcaaaggacccttcaggcatctctggagcagctccttcctgtttcagagggtgagacggaggcacaaaatggccaaggtcagaggccgggccagagctcaggctcctggctcttggcctggggctcctcccatgacatcgaggatcttttctgcaaaagttgtgacccgtgctctgtgggttgctcttctgtgtctcctggggcagagtgggaaggcaggtgggagacagcagccactacccaggctgctgttggtaactgggaaatgtgctctgagactgctgtttggtgggaatggcttggcctgcacttgggtaagtggtgtttactgtcacagcagctcgcatccacactgcaggctgccccccaagaagctgaagcctctcaggcctggctcagctgggagaccctgagggcaggggtgagcctgcagagagggctggacctagaaaagaaataaagaaggaaggaagggatttggacattcagaaccgtggggaacagaaaacaagccactgattccattcaccaaggacaggccagctgctgcctcgggcgtcccctccacccccagggattgacacccccgcccagaaaccatccagtggactcttagcaaatcagccccatagggaagaggaggcaaggctttcagatttcagcatccttttgggagagagctgtgtccacaccccatctttctgagtccactcccagcaattttctcaattatctctttaatttattaaaaacccatctcaaagcccagctggtgagtcagcccctgggaacagctggcagagggtgaatggtgggaggaggggagggggtgggtaaggcctgccctgggtggagctgccttccagatgcggccgccactcctgggtaggacacagcaactctctgaaatgtcctttcaaatttaaaatactcaggccagcagcttaacctagaaagataaagaaacaacggtggtgacatttattacgtgcttgctactactgccagatctgggccaaatgccttacctgaagcttttattgatttgctccaagagaaactcctattcctgattgtcttcctgacaagagtgaggctgagcagttaagaccaaggccacagctgcgagtcacagatctgggattcaaacccaagcctgcagctccggggctatagctcccctcccctcctcaccaccctcctccctcctgagccttcctgtccaccttggcctgatccaaaccctttcacacatgaacctcgaggctgggcaggtgttcatcttctcttttgccctcggaggaaagaagcccagcatggccaaggggcgtcaccaagcctgctgggggctcagtgatgagctgggtcacgctgcacagccccttatggttgggagcatttgcacaccttgtcagctctgactacatgcccaggccatggggactgtcattatcaatgttttgcagatgaggaatgaggctcagagaagccaagtgacctccatgaggtcacacagcctgtaagtgacacagtcagaagtctcatcctgaacctaggctcattcaccaccttccagctcagccacctccccaaaccaccagtgtccaggtagccctgagccaggtgcagcctggagggggcagcaggtcacacactggggcacagacgggctgccagatgtaccagcacctggagcgtggctggttcttggcccaacacctgtgggcaaacccggccgcactgctgctggctcctcactgaccacctcccttcccttccttcttccagtcccctgttttcatagcccaagttggccaagacctggtctcccagacggaggagaagctcctacagaagccgtgcaaagaactcttttctgcctgtgcacagtaagtgccgtagtcacctggcctgtcctccccgggctgcccagagatgggatgccgcagctctccacctgaccatacagggcactgaggcaggtcttccatgcctgacagcttcagccaagttataccaactgtttgtatacttcccacgaagagaaaaagatatcaaggtgccaagtccaaagaaaacatctgctgcaaagggtattgaaagcaagtggctctccaggctgttgagacagaggaatgtgcaaacatttgaccctgtctgggtggtttggaagtctttcccagggtcctcaacccccaccactgccaccaacccgagccagtgctactgatgcagggggagcttctcagccaaaccccatcaccttgtctgcaggtggcacgtctgccgtgcaggaggtgacacaagtcgatggccatgctgccagcagagcaccaactaaacccccaccccatcctgcacacacacactctgaaggcatgagcactgaggagcacacacaagtcacttgctgacacacgcaagcacacacacacacacatacacacacacaggctcatgaaagttctccaaagccaggttaccccacatagttggatgatcttaggggctttttgtgtgcccttattcagcaccacagacatcaattgagtacctactgtgtacctggcactgtgctgggtgctgggggataccaaggtgaacaagaacccaatcctggctttcatggagtttttacaagaaaaacagcaacctgcatgcactttgaggggagctgggagggccgtcctgggaccaagcagtgggttaggtgctggagagaggccctggtgggcagagcaagcttggttgctgctctcttggagctgcccaggaatcagatccaacagtgggtggggtcttggttggtgactctgaccctgagggaatggccatcttggctcccaacgatggctttcaggtttggcaggacacagactctgacgtgccccacctgccatagtcccctcccttccccaggctccaagtgcctgtgctagattactcagtgtggccactttctaaaggaaagaagctgcctgcagacagtttcagaacctgccctgatggcctaagacccatagagatccacagcatcccagggctcggcctggcacctggcccacagcaggtgaccagtgaattccaatgcatgcataaaaaaactcccagtggctttgctagtccaagaccagatccagagctgcggttctgaggggctgtggccccacccttcccccaaccacccaccacccctgattcccagcccctcattaagtcttcgtctgttctcagcttaaggtcactttttagagagacccctctacccttccagtccccccaaactcattcatgatgacatacctctgggatcatttatttcatgtttgctattcactgtttgtgtcccacatacaatgccaaccccttgctcccagctatatcccagggcctagaacagtgcccaacacttggcaggtacccaacaagtgttggcaggaccaaccaatttcatacaaccctcagtagaatggcaggacctctggccagacgtgctgcatctgcatgggttgagaggccctgtttacttgcatttccaaagctggacacagctttgcccccctgcttgaagatcgggattataaaatgttcatcctcttgttccatctgcactaggtctgtccacgagtacctgaggggagaaccattccacgaatatctggacagcatgttttttgaccgctttctccagtggaagtggttggaaaggtgagtccaccacaccccatacagatcagggaggcagagggtacacatttttcatctgagaattcatataaaaatcagttacctcccgtgggctcatggttaaaacaaaattaacccgactccccctgttaattaagttgtgtattctagaaatgctgtatgcttattcaagcacacacacatacacacacacacacacacacacacacacaaacacacattcacgcaaatgtaaacagcatctcgttcttactttttttacttcactgtctttgtcagcaaataaagagctgccatattccttggaatagttgcacatccttgatttaatccagtgccctgttgatggatattgagttggttctccatttttctgtgtggagccctccctaaataataaatagctttgtacataaatctttaagtacttctgcaagtacatccagagaaattcctagcagaggaatttctgggtcagaaggcacctgattttaaaccgtgagtgctgttaagctgctgtccaaaacagctgcccctgacctccagtgccacagtgcccgagtgcctgctcctcagcttcatcaatgctgttctcgtcttttcctatcccgtgagtgagcagggcgcttccttgttgcttattttcttgtctctctaataatgggggagaccaagtgtcttttcttgtgtgcttgctgtctaattctcttcaaagtactcgcccatgcgtggctgtgacttgggcagatgtgtccctctgtgacagatgaggaagcagaacataggacctgacttagcttcccagcaagccagcagtgctgccgacgaggccccggccctgagcccccagcgcagtgctctgctaccttcactggcccaggatttgcagagcggggcgatgcctgtgtaaaatccatgccgggccgagctggtagatgagggtgggagcctcccctcccacagcccagagtccctgtccccagaggcctggcatgcacagccatctgggggcatccagtgagaaaggagccatccactgctgcctgccagccccacagctggctgtgtcccccgtagacactcaggaagctgcaggccaggagcccttctgaaccccactcacagcccttccctgcctgcttccagaaatccagcagaaaacccttggctctgcggccatggatgggtggtttctctccacctgactggtggggatgacagcgtgaccagagatagtctccttagtggccgctgtccaccctgcacaggcacatcatgactccaggaaagcttgagaggcaaaggattggcctagacatctactgagggcaccagagcccccagcctgggtccgagtcccgcctctgcctcttcccaaggagggtcctcagaaagggtcactcacgactctacacctcagtgtcctcatttgtaaaatgtggatgattgtgcctgcattgtgggcttgggctgaggaggagataagataagcacaacacctgctggaacaaggcaggtgttccgcaaagctcagccatttggccacaggaagtaaactgctgaatgcagttgttgcatccatcaccaccatcatcaccatcaccaccatcatcagcatcactgcatcaatatcccaccgccatcatcagcatcaccgccatcatcagtatcaccatcatcatcagtataccgccatcaacagcatcaccaccttcatcaacatcaccaccatcatcagcatcatcaccatcatcagcatcaccaccatcatcagtatcattgccatcaacagcatcactgccatcaacagcatcaccaccatcatcagcatcactgctgttatcaatatcccaccaccatcaacagcatcactgccataaacagcatcaccgccatcaacatcaccaccatcaacagcatcacagccatcagcagcatcacagccatcagcagcatcaccaccatcatcaatatcactgccatcatcaccatcatcagcatcaccgccatcatcagcatcactgctatcatcagtatcactgccatcatcagcatcactgctgttatcaatatcccaccgccatcatcagcatcaccgccatcatcagtatcaccgccatcaacagcatcactgccttcatcaacatcaccaccatcatcagcatcatcaccatcatcagcatcaaccaccatcttcagcatcatcgccatcaacagcatcactgccatcaacagcatcactgccttcatcaacatcaccaccatcatcagcatcatcaccatcatcagcatcaccaccatcatcagcatcactgccatcaacagcgtcaccaccatcagcagcatcactgccatcatcagcatcaccgccatcatcagcatcaccaccatcatcagcatcaccgccatcatcagcatcacagccatcagcagcatcaccgccatcatcagtatcaccaccatcctcagtatcaccgccatcatcagcatcaccaccatcatcagcatcatcaccatcatcagcatcactgccatcatcagcatcactgctatcatcagtatcacctccatcatcagcatcactgctgttatcaatatcccagtgccatcaacagcatcaccaccatcattagtatcaccaccatcgtcaacatcactgccatcatcagtattaccaccatcagcggcatcaccaccatcatcagcatcaccaccatcaacagcatcaccaccatcatcagcatcactgccatcatcagcatcactgctgttatcaatatcccactgccatcaacagcattactgctatcatcagtatcatcgccaccgtcagcatcactgccatcatcagcctcactgccatcatcagcctcactgccatcatcagcatcaccgccatcaacagcatcactgccattagtcccacttcaccaggtctgatactgggaggcacagccaactcttgctggaggatcagtcctgattctgccaattacagggcagtctagtggagctgtgttcgccatgcccacgcccggttctggagccctgggctgtgcaacacacaaccccaatctgtgtccaccttcccagagtggcagtgtggggtcaggatacagagcatgggctgcctagaccccaactccagcccaccgctaccagctagggcctcgggcaactcatttcacctcttgaagcctcagcgttctcatctgcagaatggggacaataatgatccctgctccctgagcttgtgtgaggattatagaagcccccatgtgtgcttggagcagtaggtattgttactatagagacccccagaggggggcatgccctttattcctaggagttcaaataatgacatctgacacatcaccagtttacaaagagccctccactggatgtaaggccttctcatgatcattttcctcagaggagttggagcagccttgggccactcagcaagggcctggcaaggctggaacctgaacccagaggccccctcccaagtccttgggccttggtccacccagcactccagttcccatagcagcctttgtcggtggtcactggctttcctttttcttatctgcaccaaacacatgaaatggagaaattatcctttttactctgtggcctgattgcaaagaaggcattaagtttttggagcctgtagggcaggaccctggcctaggaatgccctacatatcagatagcaccctgcacaagatcctgcctggttggtgctgtactgctgaaatagtcaagggtttttttcctcccaaggttaaccaagaaattcctgggagcttgcattccactcatttcccccagcagaggagttctgcggagatgtcaaccaaccgtttctcctccatgcatcgtaaactgttaggcgggccgccttcatgtggtttccgggggcggctgtagggaaggcttcccagggccacgtggtcgaggcaggcgtgtggcagctcttccctttggctgtccagccgctcctgtgcagaagagcgggatacccgcagaggggcagctctgcttcggtggggtttgggccctgtgtcctgaggaagcactggtgaagggagaagtgagccatggcacgcaaattcaagatggggtgccagagagtaccctggcttttcagggccttcctcagagtgcggctgtggtgccacagatgtgatttccagggaagactcattcgttcaagagctgctgggtgactgaaggctccctggtcatcctcagctgacccagttctttggcccagttctgctcgatccaacccctgccctggtcgggacttttgaggaatttaggagcaggagtttagtcttggagagccaagagccaattttcacgttttaagctgattatttgtagccaaacagaccagcaatgcaaaccacaagccctctgcaccgtgatgtcctttatggcaactagataggaccatgtctttgcttagtccaaaaagtgccatcatgcctcatgatcagaagttctgtctgattcaatgtcataaatggctttggctcattaaaacgaggagttggaagacgcgaggtgatcattacttccaatccgatcttggcaggcaggatcttctcatgttcctcatctatgtgggaaatacaataaagggtcctcagtggtggaaaggttgggaaccaatggtaaagatccccaggacacgatttgaagaccagcagcctctgccccctcctgaggccgggtcttctgggccagcagcaggagtgccctcaggaaggaataagccatgcccaggacaggaagcactgtcatcctgctgggcagactgagatgcacaggtgtagggagggctgtgacctccttcgcgtcctttgtgggacgctggtcctctgtggctcctggcccccaccccttcctgcacagaaggcacagcttccttctgagtttcgccgcatgatttgcagagagaggagaaccacatggagagtgtggtcaagcacctctgcactcaggtttttcaagctttctgagcaagcgaggcttgtgcatcccccagcttgcagggggctgggggctgggggccagggggcttgggatttgaacactcagcttcagactaagtcctcgaaggtccagtctccagcgatgattcctggggggtccctggggctgctgtggggctcctggaattataccccaccccagctgctctcaatgtgccactgtttcctgtggattctgagtcttggcaccatgagaccagtgtgggattcttctttcttccaggcaaccggtgaccaaaaacactttcaggcagtatcgagtgctaggaaaagggggcttcggggaggtgagtgaacattcacgtttttaattgaaagttcttacattcaagtcacctttcctgtcccttctaaatcaacctaaagggttggcccacgggtcccccgggggcaccagtggctcaatgtgggccccgggggcagtgagggtgggagagagtcagtggccttggggctatcaggtgtgtctatggtggaaagaggttgtggagctgggcaggtgagacagacgtgctctcctgccagcctcaggcaggatccagcctgcagaggacaaatgggcagccctggtcgtgtgtggggaggagatgtgagggcgtgaggaggctgggcaaccttggccactcagtgcctggatgacgctgtcatgcaagattcgagatttcgttgtacattacccgatcttcccagcatgtgaggcaagccttgttattcccattttagagatgaggaaagctgaggtccagaatggttaggtgacccagccaagggcgcgcagacaatgtgaggcagagctaagacttaagcccaaatgctttggttcccgcttatctggattatgaagtcagtgttcttgaggatctcctatcactgcctcccaaaacaaacttctctaccggcagccggtaggagaaaatcctgttgccctgggaatggaacggtacttggggccccagtcagttatctaagccttggtgtgagtggctcattctgccccttccagggctgggaatccttgaaggagaggaggagggagggcaagggcccaggacagctgtgggccccaggccaggcatcactgggtcctgggagcctggagcactcatgaagccaggcagggccggctctgaccccatccattctctacctgggaggcctgtggtccccgccctggaggagctcggggcaggcctccacggtgctcctgccaccctggtttctttcttgcactgcaggtctgtgcctgccaggttcgggccacgggtaaaatgtatgcctgcaagcgcttggagaagaagaggatcaaaaagaggaaaggggagtccatggccctcaatgagaagcagatcctcgagaaggtcaacagtcagtttgtggtgagtgagcatctgggcccagtgaccggctcgcccttctgtggactggggcttccctccctccggaagggcgtggtcctctaatgcggccggtccccacccctgggaaggggaatgccagtggcagcgctgagctacagaaaggccgcaagacattcctccatcacacggcccattgtggtcgactgtggctggctttgtcccatccccagagccggccagtgcctggctccctgctgtgcatgagaccgacgcctctgttctcctggaccactttgtaaactcctcagtggacaaagaaagttcacctgggcccaggctgggagctgtgggttccacagaccctctaggctggtgccatcgtggtggggaccttagtgccagcatcctggaatggcactatcaagtctgtgtgcattgtgttagtcagtctaggctgggccctgctgcagtaacacatttgccccaaaccctaagtagctaaatacagcagaggttcatctgtcactcacctgaagtccaatcagattgggccaccctcctccatctaacagctgccccatctggagccttgaaagtgagtgctaggggttccacacagagactttccactgcctctactggacagatgttcctcagtttcacccacagtctgccagccagaaccagtcaacacagagacaagttagtttcaggggaggctgggaaatgtgaagtgcatggatatttggtcagctctaatatcttctgctacacactgttataaaaaataaagctgggtgcagtggtacatgcttgtagtcccagctactcagaaggctgaggcaggaggattgcttgaacccaggatttcgaggctgcagtgaactatgatcgtgccactgcaccccagcctgggtgacacagcaagacctcatctctaaaactaaatacatgcatacattaaaaataatatatacacaaggtaaaaatttaaacagcacagaaggatacacaataaaacgaaaagcttccctctttgagtaatcactccaggcatgttttattcatgcacaggctttattattcttagccaatgggatcttcctgtacctcttatggaggaatgtttttcccttacattgtagatctttttctccatccagacctctagtcacacccctttttaaagttgggcatcattctcctgaagagataaagcataatccatatagtcagtccccatggatggaaattgttttccatctttaaaccactacagggccgggcacggtggctcacgcctgtaatctcagcactttgggaggtcgaggcagacagatcacttgagatcaggagttcaagatcaacctggccaacatggcaaaaccccatttctactaaaaatacaaaaattacctgggcatggtggtgggcgcctgtaattccagctacttgggaggctgaggcatgagaatcacttgaacctgggaggcagagattgcagtgagctgagatcatgccactgcactccagcctgggtgacagagtgagactttgttaaaaacaaaacaaaacaaacaaacaaaaccactacagaccagtggcactcccagaggatggaagtttgcatcttgggatctcatcccaggccacccccagctgccagccttgtcgggggtgcaggtgtgggcagtgccatggtatgtggagatgaggcagatgaggctaacttcagccatcatttcagctgcgggccttcttgagtccgaaaccttcctccccactgccagccgcttcagcagggacccctggatgctgcctatggagccttgtctctgaagggacagtgctggcgggttctgctcagggaagaggatcatgtgattcacaaagctgggtggcacgtctttaagggccttcagttacgatggctgcaccttctttaactgtgccccatccacggccccggcagggagttcccacgatgtcacctcctggatccctttctcggtgatcacctgggcagatgtgggagaaaggggacagctgcagccattgcagcagaagcacagtccccatgagcttgctcatccttggctgccattttatctcctttcctcaaaaatagctgatgttgatgcaccagttttacggcacagccagttcccagcctggcccacgatggccgggtttcatgtgtgccacctccctatgtggagaaggattaccttctggtgtaatttgcccctcctgccccaccatggccttgcttcacagagccttgggtgtctggactccaccagcagaggactagaccccctctcttggtggccctttgccaagtggaccagtgtattagtccattttcacactgctgattaagatataactgagactgagcaatttacaaaagaaagaggtttgatggacttatggttccatgtggctggggaggcctcacaatcatggtggaatgtgaaaggcacttcttacatggcggtggcaagagaagaatgagaaccaagtgaaaggggtttccccttataaaaccatcagatctcatgagacttattcactactatgagaacagtataggagaaactgcccacaattcaattatctcccaccgggtccctcccacaacacataggaattatgggagtacaattcaagatgagatttgggtggggacacagcccaaccatatcattctgcccctggcccctcccaaatctcatgacctcacatttcaaaaccaatcatgccttcccaacagtcccccaaaatcttaactcatttcagcattaactcaaaagtccatacatagtccaaagtcccatctgagacaaagcaagtcctttccgcctacgagcccgtaaaatcaaaagcaagttagttacttcctagatacaatgtgggtacaggcattgggtaaatacagctgttccaaatgggtgaaattggccaaaacaaaggggctacaggccccatgcaagtcagaaatccagcagggcagtcaaatcttaaagctctaaaatgatctctttgacctcatgtctcacatccagatcatgccgatgccaagacgtgggttcccacggtcttgggcagctccatccctgtggctttgcagggtaccgtctccctcctggctgctttcatgggctggcattgagtgtctgcaggttttccaggcaaacagtgcaagctgtcagtggatctaccattctggggtctggaggacagtggccctcttctgacagctccaataggcaatgccccagtagggactctgtgtggggtctctgaccccacatttcccttctgcactgccctagcagagggtctccatgagggccccgcccctgcagcaaacttctacctgagcattcaggtgttttcacacatcttctgaaatctaggcggaggttcccaaacctcaattcttgacttctgtgcactcgcaggctcaacaccacatggaagctgccaaggcttggggcttccaccatggctcgagcactgcattggcccctttcagccacggatggagcagctgggactcagggcactgggcaccaagtcccttggctgcacacagcacggggaccctggactcagcccgtgaaaccactttttcctcctaggcccctgggcctgtgatgggaggggctgctgtgaagacctctgacatgccctgtagacattttccccatggtcttggggattaacattcagctccttgttacttatgcaaatttaggcagccagcctgaatttctcctcagaaaatgggattttcttttctattgcattgtcaggctgcaaactttccaaacctttatgctctccttcccttacaaaactgaatgcctttaacagcacctatgtcaccccttgagtgctttgttgcttagaaatttcttctgtgagataccctaaatcatctctctcaagttcaaagtttcaaaaatctctagggcaggggcaaaatgccagcagtttctttgctaaaagataacaagagtcacctttgctccagttcccaacaagttcctcgtttccatctgagaccacctcagcctggactttattatccatatcactttcagcattttgggcaaagccattcaacaagtctctaggaagttccaaactttctcacattttcctatcttctgagcccttcaaactcttccaacctctacctgttaccggttccaaagtcatgtctacctttttgggtatttttttcagcagtgcctcactcttctggtaccaatttactctattagtccgttttcacactgctgataaagacatacctgagactgggcaatttacaaaagaaagaggtttaatggacttacagttccacgtggctggggaggccccacaatcatggcagaaggtgaaaggcacttcttacatggcggtagcaagagaagaatgagaaccaagtgaaatgggcttccccttataaaaccatcaggtctgtgagacatattcactaccacaagagcagtatgggagaaactgcccccatgagtcaattgtctcccactggtccctcccacaacacatgggaattatgggagtacaattcaagatgagatttgggtggggacacagagccaaaccatatcaactaggcacatcctgcatgcaagagaaagcctttaccaggccatgttccacttcccaaagccccactgcccctccagctcacccttacttggccctgtgagaatggctcccatacccaaaagggcaagtgagccctgcttttctgactggccaagaaggcaccctccagtcttccccagctgatgcacacatgtgcttctgtggaggaagcacagacgccattctgttggattcactgggaggtcggggtgctagcctgccctaacccgccttggccttctcaccttgatccactgaaagggaggagcaggtgtgagccccttatcagccaaggaggccgcaggcagggtcaccgcagaggccatctgggtgcaggggagcagggtgaggctcctctgttccctcacaccccagctcccaggatcctgaggagggaagtggaagtgagtggccattgtcacaacctccccatggcactgttcttgtgctcccaggtcaacctggcctatgcctacgagaccaaggatgcactgtgcttggtcctgaccatcatgaatgggggtgacctgaagttccacatctacaacatgggcaaccctggcttcgaggaggagcgggccttgttttatgcggcagagatcctctgcggcttagaagacctccaccgtgagaacaccgtctaccggtgagtggaaggcaccaaggacttccaagtctaagtccgagggggtggggccagcccctccacaccctcgggcaggtggttgccatcgctctgggaatcagccctggtcagcaccaggggaggatgcagagtcagacagactttccactccaggaagctggggcctccggcactgaggaagcgaggtgggccaccctctggccagtgttctccagcctccaaagtttagggaagccaagcaagtgaaatgatgttcctgaaactgactgctccttcaagtcaaggaggacgggccgtgaccactgctccctccagttgcctccatcccagcagccagggaagctgggagggggcctggtggccgctatctgggatcagtcctgggaagacttgggtcgggtcactgcccacaagcagaatcggagtggcccatggtcccactccatgctgtcctcagcttgctctggtcttcaccccctctccccacccacctcaatcccacagggacctggacattgtagggccaggggtccagattccactcacaatgagcagtgcccttcagatttttctcccagtccttctgaaagaattttgaaaaatctctgtgatgctgcattttaagtagacatttgaaatattccatcatattgaaatagtggcaatttttgatatattgaaattgaacagttacattacactcctcaggggatccagtggaatctctagttgctgtagccaattgatttccacctgcatttatccaaaaaatgcacagaaagctctttagtgatgaggaattttctatcatttccttcactctctccatccccccagaatgttaataatatatttttttgcctgaaagtctttcactgattagcgtacatctctgaaacaaatatatagatacatacaagagtttttgaagttctccttgaccgtaagtctctaagtgttaaaataacttctctggccggttgtggtggttcacacctgtaatcccagcactttgggaggctggggcaggcggatcacctgaggtcagtggtttgagatcagcctggccaacgtggtgaaaccctgtctctactaaaaatacaaaaagtagccggatgcggtggcacgcgcctgtagtcccagatacttgggaggctgaggctaaagaatcgctttaacctggaggttgcagtgagtcaagatcaccactgcactccagcctgggcaacagagtgagactccgtctcaaaataaaataaaataacttcttctgtcgagttgccattgtaattagtagtagatctcatttctaatcagtcctttggaagcaggggttttgacatctggagtgggtcgctacagtcatactcgggaggggaggaggctgcttttcttctgtaacttgggagaagagttattgagaaagggcagatgggagggagatcccaaaagatgccaggacagagcatcctgatgtgaagaaatccaaacccttcaaactgcggacaggagggaaccccctgctcggtcctggcagaccccgacacgcagcccagtttgaagacctttgcagtggagctcatcttgggaccaagaaggttttgaaaacaagaaagaatggtcttgatgacatgcccttccccccataccatccccccatttatgtttctgttttgttttcattcaaatgaaaagagtcaaaattttccctaagggttgaacaaagaattctctacgtgattgccttttatttaaaaagaaaaaagaaagccctccaagttccagctcgtcttcttccgggggaaagagaaccacagtgcctcctccctggctgtgaccactcaccacggcctctctttgggctccgttctggccagtgcccactagtgagctgccatgctagcctggtggcagccggcttgttgagatgatggctgctgcccttatttggaattgttaacacatcaaaagaatgccatttaaataacagcaacaaaagtattttatgataaataaggatacacaaacaccaattatcatttgatgaggctcactggctggatttgggtacattaaccactccgcatgaggacagctgccatcagttaaataaacaaagctgggtggttgagaactggagcctccatccagatcctgtgtactgtttgccccatggcttaactgagttgcacacactctcctcttggctgttcttttacccatagagaagaccttttcctataaaagcagctcctctgctggctctcccctcatcctgggaatgcagaggctcccttacttgtgagcaagatcctgtcatcaagagaggagacattagggacaggataaggcagccacacctatgccatgccccgtagctgttctttctcccaggctgtagcgtagctggtgttgggggatatgccagtctcctgcaggccccatcccaaagggggtctttttcctgtgtccccaccttctcccctttgatcctctcttcccaattgcacagctcccttcattccaggccctgttctgccttcagggcttcctgagacctgcagggtcttctcagccttggagtatcctcagacctgcagtcattgatgtgtgaacaggggccatgactggccttttcctaactttcccagtcaccctccaggattgggaaatgcctgtggcaaacggcagtgttgctttaaattactggaaggagaaaaattagctgaagatcattttgactcaaaccagacagcctgagccaggaggtgggaaggaaacacactgtggccactcaggcctgattagcccgaggggtcgacccagatgccagtgtatcctacctgcccagaatgcccacactctgatgcttgttgtttttcctttcagagatctgaaacctgaaaacatcctgttagatgattatggtaagtcttttcctactcggtagctgaggtgagcattgcaaccccaagaaagcaaagggcctcccagggattctcagagagggctggggaagctgaccacgggccccactcccactgctcagtgctgggtacctggggaagggggaaagctgtgagtgtgaacagagctccgcttggtgaacaggcagtgttcagagagactttgaaattcagagtttttgaaattccctttgaccataaggctctaagtgttaaaataacttctggccgggcgtggtctctacagtgcactgaacaaggagtccagaatttcagagatgctgggcaaatacttaacttccatcaagttctccacctctcatcttgtttgtaaaatggaaacaaagcgtcctgccctgccctgcccacccagaaggaagagggtggtggagaggcttctacatgacagcttgagagggaattgcttgtcagtctagccagctgtaaatgtctcaggcattacgtttgtgcattaccatcattattttctcttggctgtggacactgaataataagaacaaccacagtacccctcacagctgtttagcctcacacctggaaaatagttcctataccttctttttttttttttgagacagagtctcacttgctcaggctagagtgcaatggcgtgatctcggcctactgcaacctctgcctcccaggttcaagtgattctcctgcctcagcctcccaagtagctgggattacaggtgcacgccaccacacctggctagtttttgtatttttttttttttttgagatgtagttttactcttgttgcccaggctggagtgcagtggtgcaatctcaactcagtgcaacctctacctcccaagttcaagtgattctgctgcctcagcctcccaagtagctgagattacaggcacgtgccaccacgcccggctaatttttgtatctttggtagaaatggggttttgccatgttgaccaggctggtctcagactcctgacctcaagtgatctgccctccttggcctccctatgtgctgggattacaggcatgagccaccggtttccacacctttgatctgactagatcttcccacctgcacagagaagggcaaggcagcatctctgtgcccatttaacagatgacaaaactgagcctcaggggagccatcctgccaaagtcacccagcagcatcagtggggagctgagggcagaaactgggtctcctcccaccaggccccagaacctggcagcccccagtagagggaggggagaaaccgggtcgctgatgacctgaagagaggtctgcatgggatactgccctgtggaggggcggtcggagggcccaggcctgccgcccctctctggatgtgcccggtgcctcccttggtctaagaaccaagcccacgctgctcctctgctatcctgactgtcagcccccaccgagccagggagtccacacggctccagcctggcggggtctcgacactggcccttgctgacatctaggctggagggatgggggtggggccctggtgtccataggcagggaagggaaggggacgtgttccttcctgtggggtaagttgtggccgcgaccctgcccaggtgggctgtgggagggacaaagaccaaagtggagcctcagctcagcgtctcccgctctgggggctcagtcctgggctgtgagctgggattcatctccaggctctgccaggtcagaccagatgttttcccttctcgtttctctaaagtgaaaaacaaccaatctccagagaccaacaaggcaggccggggagctgcttcccaaatcgttttataattttttccccttaagcaaattgttgcataatgccagaagaacctcacatttttcccatgaagtaatcccagaaccaagccaagattctctgacctcagcgttccaggaagcccattcagcctttgactaggcaggtcggtcaacgtccagccgggtccaggcatcctattgcatctttatgttccactcctgaagagtgggcattttcctgtgtcctcccacacctgcactctcccaaggctcttgtggtcactctgagatggcagattggggtccctgttgtccttggacagatgagaatgccgagagctcgtatgccttgcccaagggcacacagcaaggccgggtgcccatgcggctgtcccagggacccactgaccctgctgtccccctcaggccacattaggatctcagacctgggcttggctgtgaagatccccgagggagacctgatccgcggccgggtgggcactgttggctacatgggtgagtgctgggctgcctgtgtcaatgcaccttgagacccaccacctgctcaccgccggccgagcccccagagcctgcccgcagagcctctcgcctcttcatgcactgctgatcacacacagagtcacagtctctgcagggctgctggggggcggccttagccagggggagggggagcacaggggccccagatgtgatgactgctctgagctctctgcactcccaggcccccagccccacctgtgtccaaagccaagccactcttaggggtcggggcctggcatacagcgctgctaggggaggccacattgaagcaggggtctgggaggagaggcctttgagaggaaggaggtaattcacaagagcccgcaaatgagaggcgcgcacagctgctgtgtcaccaagcatgattccagtagagagcagccttgggctcctgccacctttcctcagtctgctctgagaccagcgtcctgggggttgcagggaagagacccagagttaagtcctgtgccctagaatcccccgtccaattgggggcacgccctgggcttcctcctgtgcatttcacacacctaccctccttcccctgagaggcgcgtgcccggggagcaggcacgctgccgccctctagtcaggctggtactgacagcagctgcacaggaggtgtgccttgtctctggtgctagagggtccttttcagattgcatgacatttggcaacctgtggagtgtgtgtctgtgtgtatgtgagtgtgtgtgtgcccacatgaatgctgatcgatgattgataggtaggcgggtgggcgggtggatggatggttggatggatgatggatgatggatgggtggatgatagatctgcctacctgtgtgtgcatttgcctgggtctccttttgcagagtgttccatgcatctgtctgccccggctcttgtgtgcaaaccagcacatgtgtggatgcatttccctccagacatacgtgctgatgctgcagaactatcttttctgtatttctatggtaaatctgtaattcggtttatcaaagtggtacagaagacatagcaagagattgtttgaattacagataaatttaagatcatctttaatttgggtagatacacctttattcattgaaacaaatatactgatagcacctgttctgtgccaggtgtcatattgttacggtagtgaataaagtagctcatgttctaggcgaggggacatcaagagtgcaggacacctccatccacggtggtcagagttctaaagctacagtcaaagtccttcgggggcacagaggagagtcatcagggcaagctccctggagggggtggtattcacagcagttggtggggtaagagttggtggcggccatgaaactccaggccttctgtgagcagcgccaccagctgtctccctcctcctcactcctctctcctctcctctgcccccagctccagaggtcctgaacaaccagaggtacggcctgagccccgactactggggccttggctgcctcatctatgagatgatcgagggccagtcgccgttccgcggccgcaaggagaaggtgaagcgggaggaggtggaccgccgggtcctggagacggaggaggtgtactcccacaagttctccgaggaggccaagtccatctgcaagatggtgagctcctggtggccagatgccaccctcaagctggtggctcccctccctgggcctggccccagtctgtccccagaacagcaaacaggctgaagggacaggggtctgagcatgggggtgggggttgcagcccaccaagctagagttgagggcactccttgctgtggactggggtggtcagcggagacttccaggagaaagcctgggtggggcagggacacccaggaaccaagggaagaggggtgaggggaacagtgtggaacaccctcacatccagcctgtgggggggtccacacagggcggagaagagatggtctgagctggtgccccagacacaaagcaaccttgggccaagccccggcccctgcccgtgggcctcctgctccctccacctctggatcctaaggtgttggtttaagacgaagggctacagggggtgggggcgacgatttcagtctttgaacatcttataacaaagttttccaccactagatggactgctggtcacgccagcctggctcctgcatgacagggtctagggatagtgaggtcagacccacccaaaagctgggtgggtggggccagatggggggactggaagccagataaggagtgacaggagccattggaagtgggggatatgggagtggagtccgcccgtgcacccctgccactgggccgccccatgccggccctcaggcccttccctgggaaccaggactagtggctggctttgtggggagatggccacttcctgctgctgcctggctctcagcccccaagtccagcccatgcccccttggggccctcctccttatggtccccagcacagctgtgctggcacccccactgcaagcagctgccctctaatgccagcctcatagggacaggaggggccggagcacccagctccacaattgccagcccacagacttcctctcctctccctggagccacagatgtaccccgtatcccatgtacccggagccacagatgggcaaaccgagcctgggaggggggagccacacttcccacccctctacatctgcaggcacttttggggcagattcagcgtgtgcattgacaacccaggcaactcccggagtttaggaagcagcagtcctgggagttgattaaaagtcgcaatgcttctgctcaggaagacctgagatctgcgccgcaagcggccccaggagggtctggctcggctcctcaccccagaggcccctctcctgcagccagacacctctgcttggccccttcctgtcaccaacctcatcctcacatcacagagctgtgggaagaagtcctgtgtgtacagcagacccacactctaaccccacagctgttggcccgccatgcagctggggcctcagagaaagccacatggtcatcgcagccagggctagggtggggggaccggaggagcagtgcagcactggtcgggtaaatggaaatgtgggtgtgagccatacttggctgtctcattgggagatatctgtcaggtgcgacaaaacgagacaagggaaagaagaaggggtcagacagccgtgggcagagcatcaccaaatgtcccaggtcagggccaggcaatcagagaagcaggtcttgagagatctcagcagggatatgggacgtactaagaggatgacgaggcggagagggccccagtcccacccccagaccccagacacccaccttggcccctggctttggagctgggatctcctgctgcagcctggaccagggtgctgctgtccctctgctgccccctggtggacactgagagaaagcctgctgctcccggaggacctgtcccgtgggtacaaaaccactgtcctctggaagcctctggccttgctgcggcttcccttacaaatgatctttggtcttgggagtctagtcttaggcctccttcacgcccttgactgcagcatctccggcatctaggcctaccttgtcccctccagctggtggcagctcaggacactgcagagcctgacttgccaggagacctcgcaggtcctgggttcacagggctatttctaggctctggtggctccagccctgcctgcctaagagggtccctccacaatcagtgaggaagccagtctctggcccccaggtctgtcccccattctaccttagcagccgcagaacccactccccctcctctggagcccagaaattcacacatctcaccactttgtctcctgagcccagtccatgggcccagacctcagcctccatcttccccaaacccctgctcagtcccagcactgggccttagcccccctccagctccctcttgcctttcagccgtcttggtctcacttgtccttccagcccatctgtacccctcctccaggaagcccgctctgcctgccccacccatcccagctcacaccttctcttcctctcacttctcctggtgtccacctgatagcatgattgcaaactctttacctgacgatgtggctgcaaactgttgactggatgccagggtttcaaatggcagcatataggcgggtgttcaacctgcacacggtttttcaaaagaagtaaatggtaggttcattgccaagatttagaaatgaggagatttcatgtaataacctggattttctggcttctcttgaaaagcagaagccccaggccctggctgccgtcccacctggcaggagctgacacatagcccggcccggcccacccagcccacccctcgcctttctcatcctcgtttgtgccaccttcctggccagctgctgcagcccctgcagaaggagacttgcctctgagggactgcttagaacagtgcagcacctgggcccagcccaacccagtgccttgagcctttgttgaacagtgaagcccccagagagagaagcagaggcatgagtgccagaccctgagccgccagcctggtggtccgtgggggcgttaaggggcaacactgagcgactgagtgctctgctttgtcctttcaagggtggaacctggtgctggccctgatgccaccttcgattcctttgtttggggggcagccccctccagaccctgagccccaagaggccagtctggctgctcactctccccggcgtccccagccggtgcagtgcctgccccacaaggaccagcaggaagtgtacatgggatgaatatgagcaaagcgcacagggcattgggaaaagacaaggctgggcccctaccccaagcagtctgctcctctggattttagcctcaaagcagacacttagtagacaccaactgcgtacagctgcagcgctcagtaaggcagaggagaagagagaatcacgaggctggggcactgggagtgcaggtcaggggccggggccctgtggtcgtgtggctggccatggctagtcaaggccccctgcgcaggtctagccctctggcctcattcatagcctcatcccgtctcacctgggtgtctgctcccaaagactcttcctctcctagtaaccttcctgcctcgtggttctgatgaagacactctcctacctcaaccatccctggctccttctacctccagatgaaaatcccgccacctgacctggccttcaggatcctctatcatctctccctgaccagccccctccccttgacccatctctgcaccctcctcccgctttctaagtcaaacgtgttttgggtgttccccagactcaccctgcacgtcctgccactctgctttgctggtgcagttccctctacctgtatacccctccccctacccacaccttgaaagcctatttgtcctgcaagactcaacttaaatacctcttccccgtgcagctccctgacctccagctggcagccagtcatgccccctgcccccggggtgcccgatctgtatcaccttgatgcgtcctctgagcatgattagccccccatgagtctgagcactcctagaggccaagtgcctcggtggtgccttctctgtcaggaaggggcttgcacccaggaggtacaactctgcaaattagctgagtatgtgcacgagacagagctattgatgcagtccttgccttttgttgcttaccctacacagaagaggtgacagtgactcgacacccattaatgagtgcccaccataacccaggaacgaggtctgtaatcctgagagaaacaagattcctgctctcctgtcccatcaggcatctagccaggctgtgagtgtgtgagcacagatgcacgccaagactcagaggcagccctgaagcaagacctttgcagggtggggcagcgtgtcttgggttcctaggcatggtgcagacactgtggaggcaggaggtccggacaggaggagaggcccaggggacgtggcttcatggggctctctgtttcagctgctcacgaaagatgcgaagcagaggctgggctgccaggaggagggggctgcagaggtcaagagacaccccttcttcaggaacatgaacttcaagcgcttagaagccgggatgttggaccctcccttcgttccagacgtgagtagcctcccccagcccccagcagctcccttcacagggtacccagggctgcccccgagtgctgcctcacagtgagctggtgcagagtgtggggcacatcgtgtctttgtggggaccagggtcccctcccggccactcctcacctaagctgcagatgaacttcacgccaggcagtgcagaagaggcgtgggccagggagcccacattggctgtccagagacttgggcactttcccaggtctgggggtcctggacagattccttctaagcgtcagtttcctccctgtccagtgaaaccagtaacactcatgcctcccacctgcctgggagatttgagggtgaaatgagaactgaatggggaatgctttcaagagcattgacggccactacattcagttcatcttgaccagcatgcatgcatcgagcactactgttgacgccaggttctgggccaggcagaaacataagaggcccctcccccagcagctcacattgcagggagttgcatcttcccaggaggtccccaggtcccccagtcggtgtgtgaggcaagattccagctgaggtagaattgtccttgaaagtcccctacatggtctataaatcatgagctctcagctggatcagaggcccaagagatgcagaccaggcagaggctgggtgatctgtgcgggatacgtgctgtgattccggggcctgctctgtttaaagtcagggagtcagaagccaggaaggcctgctgtgcttcggctcctgccacgctcccgcggatgaccccttgctggcagggggactgggccggggactatggaggccgtgggagcagcagtgtgctgcaggcgaatgactgcatctccagagagctcatgtgcacctctcttcccaattccgtgtccaatggctttgcgtcggtagcttacagtagatctggtggtagcatctgcacagcagcaatttgcaaatgctacaaatcagggcctctgcgtccccctctcccagaaccagtggttatcacttaccagtaccgccctgagtggaggcaggtggggaccgtccttggaactctggcaccccctatacatggggattccctggtcctctgggacagaaggtggcttgggaagctgctaggtgcggatcagtgtccatggcaaccacaccacagaccccgtctggccagggatggcatcagtgtgatgggtaatcagggaatgctttttggagaaacacgggggccactgagaatataaagagtaggccgggcacggtggctcatgcctataatcccagcacttgggaaggctgaggcagtcgggttaggagttcgagaccagcctgaccaacgtggtgaaaccccatctctactaaaatacaaaattaaccaggcttgggggcacacacctataatcccagctacctgggaggctgaggcaggagaatcacttgaacccaggaggcagaggttgcagtgagctgagattgtaccactgcactccagcctgggcgacggagcgagactgcatctcaaaaaataaaaagtgaaagtcactgaatgctgcaaactcaatctgcagatgagcttgagcaggcagggggaggatggtaatcacagcattgctctcgaccctggctgcctggcgaaccgcctggggagcatgaacaacactcgccttggatgcagtccccagggagtctggggtaagactcgggcttcaggagttttgaaacctccccagctgattctagcgtagagccagggttgagagtcactattatgggaagtgccacatgcaaggagtgtgttgtttgttgtttgtttttagtgccaagggctttgggagtggccactccttggtgttccaggaaaccacatagtgttgagtgcatgaacatcacggttgtgccattgggctgatgtccgaaattggagaggatgtgggcatccagactgggggtgtggcaaaggtttggaacccgggtggccatccttgtggcctctgggctacctattgctatggtgacgggctgagattagtcatcgcattggagctattcctctaccttccagcacactccaggtcccgtgccaggccccaagggagatcccatggcacacaaaacagttggttgtttccagtctgaagaggagcaggggtgtcagcaaaaccccttaaatagaagtagaaatacgagtcacaagagaagagaacaggcagcctccgggaagatgggagagtagcggggcctccgtgcgtgcacccaggcatggctggagaaaagcgctccaggccctggaagcagcatgtggaaggaggcggctctgagggtcagagcgaccaactgtcctgctttgcctgggactgtcctgcttttagcactgaaagtcctgtgtcctggggagacagggacagttggtcaccctgggagtgaccctggccacttcgaatcagggcattaggaggatgaggtagcagagccccgcaaagcgcacagcctgacaaggtgcacagagcagcccaccggtgccctcctgcctcagccgtgtaccctgtggcccagggcctctgttcctggcatccgaggcctcaggtcagcaaaggttgcaggccctggagtgcgaagccgctgtgagctggggactttgccttttccccactggccctccccaggctgcacgccaacccccagtcatccctgccagccccccacagtcatcccgccccccacagtcttccctgccagccccccacagtcttccctgccagcccccccagtcgtccctgccagccccccacagtcatccctgccagccccccaccatcgtccctgccagccccccaccgtcgtccctgccagccccccacagtcatccatgccagccccccacagtcatcccatccccacaccactgtcggggctgctgccacattcctaaaccacgagcactgtgagtgacatcatctttttcacttccattgactctttttttaaaataaaaatcaatgtattttaaaaggaaacctttccaaggaaataatagccatgaaagaggggtttgggtgtgccaggtaactttctgttccattacagatttttaaaatacgctcatttcttaacattcctctgcaagccacccagggccagcttcgtgagcttgacctggcaccccctagggcaccctgggtccccacacctggctcagtgccctctgttgccatcttaaaattctaaatgtggaacatggaccctgcgttttcattctgcgctgagcatgtgaatgatgtggtcttgcttccagctaaaagtccgctgagttccacggtggcgtgcaccccgggctttgggaactagagaagggtcgcagctctgcaactggacacccctgcccgcacccctgcttccgtccacgtgcacttgggcccatggtttgctttgctggggacagcatggccttgagccttgagctggagaccagagcagactggaggggagagtcccagaaagtgccgagccctgagaccattgctagaaccttcctggcatggcggagcccatgctgagccggtgcactgattcacaaccttcgtattagccaaatgtcaggagactataagcaggaggtagcctctaccctccagtgacagatgtgtcaccaggtctggggatcccttcacaccccacctggggctgtctctataaaggcctcatctccagaggctctgggaagcctccccacaccaaccttgaactcttagagggcagggtccacccaggttcatctctgccctggcatagagcaggcccccagtgcacagctgagggacgagtaaggcaaaagatatgcctaccataataataccagctcccagttacgggcgccaggctcggtggccagcactgacagcagccccatcgcccaggtgcctcgttgtccccattttgccggtaaggaaacaggacataggcctcaggggatatgagacttccccaaagttcctaagccccacagctgggactctagcccacgtctgtccagtatgggtaagggagtgatggcaggaatgagccctgggctgggcacccaggtgccccgagctcctgtgtcaccccagccagggtccccgtcatggatctgagagagggctgcactgtcatctggaggggtcgcacaaaaaaaccacaggccatcatctgaggtggacaggaagcccagccaagccactggggccgacccctcccctggactcacctgcatctgagccacacaccctccagccactacccatagcagttctgggggtgtgtcctgggaagactcccttctgctccccaaaaccccaaggcctggctcggggccactggagccgcaggcgggacatatgtgtgaccggccctctgcccctggcagccccgcgctgtgtactgtaaggacgtgctggacatcgagcagttctccactgtgaagggcgtcaatctggaccacacagacgacgacttctactccaagttctccacgggctctgtgtccatcccatggcaaaacgaggtgagcagggcagaccacttgctttggtctgggtgggagggagggactgacgggtggaaggaggcgtcgggaatatgagtttggcggcaggaggctgagcgcatggtttctgttttctccatgaaggcagcacacaaaagctgtcagtggccaagtagggagctgtagccaccacgggccagtcattgacggggagcctcgcccagcccctgagacctggagggcgtgtggctcaggggcaggtgaggccaggggagggagccccagtggctttgctgctgggcttcctgactgccccagttgacggcctgtgttttgttttcacggcccctccagatgatagaaacagaatgctttaaggagctgaacgtgtttggacctaatggtaccctcccgccagatctgaacagaaaccaccctccggaaccgcccaagaaagggctgctccagagactcttcaagcggcaggtgagacacccatgcctggccagtcctggcatcagctccgagacccctggctcacttccatgggaaacgagaagacccacagtagagacccttggaaggcttggaagtctggggcagtagcagcttggaagggcaactgattatgtccaaggcccctgatacccacggcagctgatgggatccccggggagaagggcagggccagcccaaattcaccctccctctgggtttctccgccttgacactgttggcgcctggggccggttaattccttgtcacagtgccgtcctgtgcatcgcaagatgtggggcagcaagtttggcctccacccaccagatgcagcaacacgccatcccccagtcgtgagagcccataaaggagccagacattgctgaatgtcctcaggggcacagtcacccctgattgagagccactgccctctctggcccttacgaagcctcagtcatataaagactgaacatcataagcccagggagaactgggggtagaagctgaccccacagaaccttccggctcctgggatggcccccatccaatgctgtgccctctagctggcagccagaggagacagggcccttgggaaatgacacttagagcctggccctgggtaagggttggtgtgggccaatggaggaaatgcgggggaagggcccccacctcaccccacaccatgaaggtggccaccatacaccccgtcttggcctggcccctgaggaagctgtggcccagtgtgcccgccctggagcctgggaggctccctcacctagttctgctccttcctcctctccacaaagagccagctccaggatggacacactcagccagtgataatataaaaatacaacgcttcaatgcttccatcaagtaaaacggaagttccagaaagaatgacctctccctcccctgatggccaggcatgctaagaacaccctgggtcctagaaaaagaaattaccatggagtctcacagacccgggttcaaacccagccctgagacttcttggttatgtggcaacttacggaacctctcccacctcagtttgcctgcctgaaacatcaggatagaaatgcccattgcctagagccacgggtggcggcccacatatgggcaccagcacctgtgaagcaaacgcttcttgcctccctcctcctcccctctgcaacatgaagggcccagcactcacgggatgcagagggaaggcctgagcaatgggaacgaccgcccatctctcccaggccggccctcgctagagccctttgcatatgaggccccattgtatcctcccagccaccctgtgcggaagctgctcttctcccgtgttacaggagaggaaactgggagatggaattgcatgcccaaggccactctgcgagggaggggaagactgagaattccagcccaggcagcgtaaccccatgcctgcaggcttaaccaaggtggatattataggaggggccgcctccaccctgattggaggttctgttaattccatagctcttcccaggtacctgtgcctccaggggtggcccttgtacctggctctgaggggagactgcaaaaggcaataaaaagcaagggttggagcaggcagaggcagccccgacccatccccagggctcccaggactgacttctgttctctccaccccgtctcccccaaccccaaccccagcatcagaacaattccaagagttcgcccagctccaagaccagttttaaccaccacataaactcaaaccatgtcagctcgaactccaccggaagcagctagtttcggctctggcctccaagtccacagtggaaccagcccagacccttctccttagaagtggaagtagtggagcccctgctctggtggggctgccaggggagaccccgggagccggggaaggaggccgtccatcccgtcgacgtagaacctcgaggtttctcaaagaaatttccactcaggtctgttttccgaggcggccccggccggggtggattggatttgtctttggtgaacattgcaatagaaatccaattggatacgacaacttgcacgtattttaatagcgtcataactagaactgaattttgtctttatgatttttaaagaaaagttttgtaaatttctctactgtctcagtttacattttgtatatttgtatttaaatgaaagtgagactttgagggtgtatattttctgtgcagccactgttaagccatgtgttccaaggcattttagcggggagggggttatcaaaaaaaaaaaaatgtgactcaagacttccagagcctcaaatgagaaaatgtctttattaaatgtagaaagtgatccatacttc

SEQ ID NO: 36595 - DNA, 247939 bp, Homo sapiens; identical to SEQ ID NO: 36594

SEQ ID NO: 36596 - DNA, 9231 bp, Homo sapiens
ctccaggcaacttggggcaagcgtctcagttctcgctctcccttcctcccagcggggtcgccgcagaccccagccctgggagcaccgctctgcagcgcggccggcgggtggagacggttggcccctaaactcgctcgtccagcccaaccgccccggcggcttctcccagccctcgaggctctcctgagcggcctggagaggcgtcgagcgcagcccagcgcccgcctgctcacccgccccggcccgggaagggaattttcggatcctgcgagcccggggcgcccccgcggcctagggcgggcagctcccggggcctggccgagccggtggcgcccgggaggccgcggggacagcacgcagcgcgcgcccttggatgccgtcccgcagcgacgccccggcccgccccgctcctcctcctgcctggctagcctgcctctcatttgggaagttttgtgggttttctttctcctcctccaaccttggcggaggccacgactcaggcgccacagctgggggctagaggccgcggaccatggtgcggggcagccaccgctgaagtcagcaaaaccgagcctggcctgaggcaggctgcgcgggaggccaaagccatggccattgccacgtcggtgagtccaccagggagtggaggctgccggggagagacctccacggcctgccctgcgctcctgtcactttatttctgccctctctttgtctctctccttggtccctttcttctccaggaggctgtgtccccctcctctcacttttgtttcccttctccctctcactcctcatcccctgctcctcctggctccgggctcgcccctcttccccgccccctccccattctcctttttcttcctagaggctgcgcctgaatggaggggaaggggcaagcgtagcccgagtcctatctgctccttttgggcgggaacagatggccactggtggttggcagaggcttgtggttgggaggcaagtaaaaggtttggagggggctgaaaggacctagtggctcacggaaaacggaaaacgagaggctgaacgaccccaggaggcccatctcgagacgagggataaggaaaaaagggagatagagcaaaggagggagatcaagaaagagaagacagagggaggaggggaggtgatgtcagccagagcctcaggccactttccagggatcgggacaaagggaggagacagctggcatgatgggacagtgggaggaggcctcccagagagcacagaggctctctgccacctacattaggctggccattccctcaccagtcagctgggctgctgggggatagagcaggagtggtcacacccatcatcaatcagtccatcaacaactctgtcctgcaatggcagggcccagaggcttggctccattggacagaactcagtcctaacaccgggaggagcgctctacagccccacctctgctttctgttctacagtctatgcagtctgaatccaggcagctttgttccctttccaccctcttctaggtcctgcctaagattcccagggaagcgaggccgtcacctgctttctgttcccttctcagtggggactctcggagagagactggaaagagaagcacagagccacccaatgtcctcccataccctttgaggacaggttcaagtttggttctttctcagaccaaactccattttttttttttttttgagacaaggtctcaccctgtcacccaggctggagtgcagtggcacaatcacggctcaatgcagcctcgacctcctgggctcaggtgatccacctacctcagcctcttgagtagctgggactacaagcacgcaccaccacatcagctttttgtattttttgtagaggcagggtttcgccatgttgcccaggctggtctcaaactcctgggctcaaacaatccatccgcctcagcctcccaaagtgctgagattacaggcatgagccaccgcacctggccccaaattccttttagttcctcaatctgtaacgatggccaggaaaccctagctcagagtggggaaggaggccctctggagatagagtacctctgggagtactctggcatagagatactggttcagaagccagctggtcagctttgtagtcccaagaatgtagatttttctttttggggtcaggggcatttatgctaatcaaactcacaggattctaataacagctattatttattgagcatttactgcacctggccctgtgctgcgctttgtcatagtttctttatgcgttatctcatgcaactctcacaactaccctgtgaaggtagtattgttattatctgaaaatggatatgcgcatatggaattctacagagaaggaaattgagactcagaaaggttaaacaatctgcccaaaggaacctggctagaaagggacagacctggctgggcgcagtggctcacacctgtaatcccagcactttgggaggcagaggcgggcggatcatgaggtcaggagatcaaaaccatcctggctaacacagtgaaaccccgcctctactaaaaatacaaaaaattagccgggcgtggtggtgggcgcctgtagtcccagctactcgggaggctgaggcaggagaatggcgtgaacccgggaggcggagcttgcagtgagccgagatcgcaccactgcactccagcctgggcgacagagcaaaactccgtctcaaaaaaaaaaaaaagaaagaaagaaaaagaaagggacagacctccaagcagtgggtcgcaacggtaatcccaggtatttaggaggctgaacccaggcattcgaggttacagtgagttatgattgtgccactgcactccagtctggaccacagatcaagagctgatctctaaagaaatattttaaataaaattttaaaagaaagagacacagccaagactcaagcccaggtctgcctctagaactgtgcttttaatcccctggctagatccaaaagactgatttataatttacaactaaaaagaaaagtgcagcactaaccgggaatttgtgtcatctggttagcacgtttctttgtgtgggacaatatcctttagaaaccaaaatataatcagaaaatggtttgatgagttgggaatcaggcaagaagaggggtcaatttgttgttaaaatcacccagccatgagaggccggataacctcaccaccagagggaaacatcagctaagaggaatatgcactcctgctgactctagcagggcatccttctccccagggtctggtggcagcctgcctgagatctttaactttgagatttttttgctgaattagtcagtccgtttggctacctggctagtaatgcctaactagctgctctccaacactacatgtaagtcaccactgcctgggatcctaccagcaagcatcatcatttagcaatcaaaactgaagctgaatgtaattgtatgttttgagtggttttagcttgattctaccaaatgacatcatggagcaagagcactgcgaagggttatagcaaagggaaatagggtataagaaggctttcctatgcgcttgacttgcttttgagttagggaccctctcagccactgttactactctttcttttaagtagattcctacatttgtaattgtggagaagcagtagcacaagtgattgagagcgcaggctctgggatcaagcagcttagggttcagattatgctccacaagctgtgccagcgatatggcatcagacaaagtactaacctccctcttccagttttctttccaaaatggggtaatgacagtccctccctcgtaaggttgttgtgagaattaaatgagatgagttgattaatgcaaagatttgcacagtgtctggaaacgttgtttgcacttggtacctgtgagttattacctgagcctgtggcccttgatggaaaaagcttataagcccccaccagacaggactggaaacagaatgatacatgtttccttttggttggcctgccaacccccttcacacacacacacaaagacacactctgtcctgcaatggaagggcccattgctaaatgatgatgcctgctggaaggatcccaggcagtggtgacacacacacaagaatacacacttttctccatggtaacctcagcctcttctggtagaaacttatttgctcagactgagagcaaaacaattgctttgtttctgttttctttcttattatgcctaggcacactgtctggactaggcctctcccagtctctcagaatgagaggtctctgtggctgcttaatctaaccttttgctagtgagggataatgacttgggaacagagagaaggtctatgagagactgtagcagggcttcacatgttttggaagacattcattcaacatgtgtaatgaccaattccaggtcaggccttattgcaaggactagaaatatagccgttcctatgttcatagggtttacagtataagggaagaaatcgatacaaaagaagcaaatagacaaatagtataaagtacgaggatggaaacaataggtggagacaaacagagaatggggcggggagaagagtaaagaatcggcctctctgaggagagctggtctagttgaaggaactgaaaggaagagggagaatgcaagcggtgaagctggagagaagctagggcccaggcagaaagctgcatccagagttcaggttttttagcttgagggaaatgcggagctccgaagggttctaagcaggggtgacgtgacctgaaaggggtctgaagacccttctccccactcccacctccccaaccagacccagctggcccgggcactgtatgacaacaccgctgagtccccccaggagctgtccttccgccgaggggatgtcctacgggtcctgcagagagagggcgctggtggactggacggctggtgcctctgctccctacacggccagcagggcattgtgcccgccaacagggtgaagctcttgcctgctggcccagcacccaagcccagcctctctcctgcgtccccagcccagcctggctcaccatatccagccccagatcacagcaatgaggaccaggaggtgagagtgggagcctccccaaccccaagccagaagagccccattcctccccaactagccccacccagggcctgcagcaggtgggcaggaagagccctgaggccacagctcttcactgctctgcgctggacgaaacctgtctaccaacctttctgagctgtggccctctcgatacagggagagttagaaggtctctaagctcctcgcactcagacattatctgatcaccggcccctccgttcctcctgaccccccatctatttgatccctcaggtgtatgtggtgccgcccccagctcggccctgtccaacctcaggacctccagctggaccttgcccaccctctcctgacctcatctacaaaatccccagagctagtgggacccagctggctgctcccagagatgccttggaggtgagggctagaggtccctgtgtatgttgggtgggagacaaatggccccaagggagggttcatcgctgagctgacagatgactgaccactcctttccgcaggtctacgatgtgccccccaccgccctccgggtgccctccagtggcccctatgactgccctgcctccttttcccaccctctgacccgggttgccccgcagccccctggagaggatgatgctccctatgatgtgcctctgaccccaaagccacctgcagagctggaaccagatctggagtgggaaggaggccgggagccggggccccccatctatgctgccccctccaacctgaaacgagcgtcagccttactcaatttgtatgaagcacccgaggaactgctggcagacggggagggcgggggcactgatgaggggatctacgatgtgcctctgctggggccagaggctcccccttctccagagccccctggagccttggcctcccatgaccaggacaccctggcccagcttctggccagaagccccccacccccacacaggccccggctcccctcagctgagagcctgtcccgccgccctctgcctgccctgcctgtccctgaggcccccagcccctccccagtgccctctcctgccccaggccggaagggcagcatccaggaccggcctctgcccccacccccaccccgcctgcctggttatggaggccccaaggtcgagggggatccagagggcagggagatggaggatgacccagcaggacaccacaatgagtacgagggcattccgatggccgaggagtatgactatgtccacctgaaggtgagcgccccttggcagccccaccaggagggaccccagagggaccaaggggaggggtgtggagacctagggcacagaggcagagcctccctgcctcccttctgtcccccttccctctaccctgcagcctgggaccccagtacttggccacaacacttgtaccagtgccacactgttcctcctagacccagcctggggccaccagagctctctggagtcaagggactacaacctctgataacaggagtgtccttcggaaggaagggggtccggggaaggggcagaaaggccacagaggccaccccgtcctgctcccccaccccgacactgagacctgatcccctcctgcagggcatggacaaagctcagggatctaggcccccggatcaggcctgcacaggggatcctgaactgcccgagagggggatgccggcgccgcaggtgaccctggcgggaatggtgctagagaaggggacaggggagggaggaatggggacttgggagaagaactgagccatcaaccgtggaaggaaataggttaggatggagtgagagttcacaggaaccagggacagagcggaggcaagttagaaatctacaggaaggaactggaccttggaagaggatgttaggaattcagaaagaggggaaagaatgtgttggagaggagtcagaaaatcaagcagccaggagagcagaaagtttctgagttgtggggtcagagctgggcctggggacttctgagcctccttccaactgtgaattcctgggctcctaagagacctggcttctaatcccagcttcactactgagaagccaggggctttgaagccgtcagttaatctctccaggcctcagaaagtgaggtggtttcctcaaccctgcgtagaatggtcgcaacacaatagctaccatttatcaggtatttaccaagtgccagaccctgtgctaggcacactgcacgtgttagtattaatcacagccacagttaacactcatctggtgctcacagtgtgaaatgcactttgctaagccctttctgtatattatctcaattgaccttcactgcagcctcatgaggtacatactagaactgcactatctagtacagtagccactagctacatatggctattgagcactcaagataggcctagttcaaattgaaatatgctgcaaatataaaatgcagcctggattttacagactcagtatgggaaaaatctcaataattttcatgttgattatatgttgaaattataacatttttatatttggagttagataaaatatattagggttttgttttttttttaaccacttttaatgtggctactaacacatctaaaatttcacatgtggttcacattatgtttatattggacagtgcagtcctagactccctgttttagagttaaggaaaccaagttcaaagccttgtccgaaatcaagtttgaggttgtttgaatccagatctatctgatatcaagtgtgggcacttcactgctgctctctctagaatctaaactttccgatgggcagaggtaagagctaaaaggatcgcccttgggaagaaagagaggaaggagaaaagaagtgagggaggaaatggcactcatgagaatgttctctctgaccactcctcttgcccttcaggaggccctgtccccaggggagccactggttgtgtccaccggagatctgcagctcctgtacttctatgctgggcaatgccagagccactactcagccctgcaggcagccgtggcagccctgatgtccagtacccaggctaatcagcccccgcgccttttcgtgccccacagcaagagggtggtggtggctgctcatcgcctggtgtttgttggggacaccctgggccggctggcagcctctgcccctctgagagcacaggtcagggctgcaggtacagcactgggccaggcattgcgggccactgtgctggctgtcaagggagctgccctgggctacccatccagccctgccatccaagagatggtgcagtgtgtaacagaactggcagggcaggccctgcaattcactaccctgctcactagcctggctccatgaaggtcctttggcacagctctgctcctcccctgcctgccaaagcccccctttaggccttgggtggctggaaggctttgttaagggactaggagaaatgggggtatctttcccctttcctgccctttctgctcatctcaacctctcacagaggtgtcttctccccctaacctacagctttttgtacaagccattttgtgtaaattatttatatttaatattattccctgctttgtcaggagcaggtactaggctctggggcagtgaggaactagatccttctctcctcagcctagggtggaggtcactgcactaccacccacctctggaagactggctgtgaaaagtcaggtggcagaaacctggggccacatagagcctctctcttttcctgtttcttggctctagaagatcagcactgcactgttagctgagagtgcgggcaagacataaactgtccagagtttgaaggttctcggaaagaccggagggcttctccccacagaaggcggagagagctggggctcagacatgggtgtgcaccttaataaaccctgctgtctgcctccctgactctgcttcttgggagcatggtgagcagccctggtgctcagcagccatacctatgggacacacactacgaaaaggatgcctttagggtttgggggagattttactcctttcttcaacaactattcactggacaagttctctgctcccatgacgcgccaggcacagttctgcaagtatattgtgaatgtattgttctagtgggatacacaaataagtcagttaaaatacataaataaaaacataaacctgccat

SEQ ID NO: 36597 - DNA, 11161 bp, Homo sapiens
gccccgtcccggcctcgcgcacctgctcaggccatgatgagcttcggcggcgcggacgcgctgctgggcgccccgttcgcgccgctgcatggcggcggcagcctccactacgcgctagcccgaaagggtggcgcaggcgggacgcgctccgccgctggctcctccagcggcttccactcgtggacacggacgtccgtgagctccgtgtccgcctcgcccagccgcttccgtggcgcaggcgccgcctcaagcaccgactcgctggacacgctgagcaacgggccggagggctgcatggtggcggtggccacctcacgcagtgagaaggagcagctgcaggcgctgaacgaccgcttcgccgggtacatcgacaaggtgcggcagctggaggcgcacaaccgcagcctggagggcgaggctgcggcgctgcggcagcagcaggcgggccgctccgctatgggcgagctgtacgagcgcgaggtccgcgagatgcgcggcgcggtgctgcgcctgggcgcggcgcgcggtcagctacgcctggagcaggagcacctgctcgaggacatcgcgcacgtgcgccagcgcctagacgacgaggcccggcagcgagaggaggccgaggcggcggcccgcgcgctggcgcgcttcgcgcaggaggccgaggcggcgcgcgtggacctgcagaagaaggcgcaggcgctgcaggaggagtgcggctacctgcggcgccaccaccaggaagaggtgggcgagctgctcggccagatccagggctccggcgccgcgcaggcgcagatgcaggccgagacgcgcgacgccctgaagtgcgacgtgacgtcggcgctgcgcgagattcgcgcgcagcttgaaggccacgcggtgcagagcacgctgcagtccgaggagtggttccgaggtacgcaggcgcgcgggtggggggaggggcgcccctgctgaccccgcagcgaacttttgggctgcgtgacccaagggggcgctgccggactgcgcgtggagtggcgcgctgctcaccttccctctgcaaagtgcatgcccctagttaaatcgcagttttactctgggtctcttgtgggacgccccaactctgggttgtccttcggttccccctttccaggttctttacggctgtacttcaactctgggccccctgctgctctctaccccaagcttaggcgaccccactctgagatccctcccccgtcaagaaaaaaacaagtttcctctacaggaaaaaagtggtgcaggattctggtctgcaagcgctggagactcttagcccttctaagtagcaaggcttccccgccaatgctgccatgccctctcctacaccccgcaagaaactctattcctctcacccctaccaggctccttcccactacctgctcagtgcttaacgttcctaccttaaatcttccacgtgggggtgggtcaggaccttttcgcatcctttcttcctagagggaaccattactacagtcagttgttgcctgtggcggaggtggctggtgggccctttcatgttttaatgtcccctttctcctttagggaagctgggagcctcccaagtctgcccctcccccaactccttgcagccctgagtcagctagattgcgctgccctgaggctgtgcccagcagctgcagggtgaccttgaccaacacttgccctctctggttttcatttctttttgagttgaaagaggagggtagatcaactgggctgcttaatccggggagttccatgatgtctcacgaaactgtctgtaaaactttgcgttgtttttgagagagagggcagaggcttcagtgattttccaaaagcatctgtgatcgacaatagttgagaatctccaaccacctggatggtttctaagtctttgccagcactagcagggaaagctgggattttgatgcatagctttttctgttccttttccactcctctgcagagcagaaccatcccctcctccatctccgcagcaaggcccctccctgcgcaaacctcttttgggtttgccagtcgtaggggcagacgtcccaggattgtactggcccactcagctggcttccttcctccccgccaagacttgtgccctgagtgccactatctggggattcaggatgttcacttttacgagctaaagaccagtctccagacctccactgcctctggaaggtttcctgggaaccacgagcgggttgctggcgggggccggggtgtggctaccaatgctcaggggcaatgctcagctaggtggagaaagggacaggggttggcacccaggccacgggctctgcactgaccttggactgtgcgcagaaacctgtaaggaagggaccatggctacaaggtgacctgattgctcacggtaccctcatgcctcctaaaggtcacaagctcattaacttgttcagccacaaacctgcagcctccagctcagtgttaagccccatgggccaggtatcacatctgaaccaccagcactgccaggcccttgctagggagctggaccaggcattaggaccagggtttcctctgccctgcagggtttttggatcccacactgggggagacagagcatgatctttggggatttgagtcccagctctgccactcactagctgggtggccttggggagtagtcacttgcctttatctcacaggacagagtgagtcaagcatacaggatggtgtctggcacacgcagtaggtcaatccacatgtgtcaccttcaaaatctgggcattaggccgggcgtggtggctcacacctgtaattccagctctttgggaggccgaggtgggcgaatcatgaggtcaggagttcaagaccgcctggcgaatgtggcaaaaccccatctctactaaaaatacaaaaaattagctgggcgtagtggcaggtgcctgtaatcccagctactcgggaggctgaggcaggagaatcgcttgaacccaggaggcggagcttgcagcgagctgagagtgcaccactgccctccagcctgggcgagagcgagaatccgtctcaaaaaaaaaaaaaaagaaaaagaacaaagaaaaaaatctgggcattagaacccagtccaggtgtgtctaaccctgtgccctgctaccttctcccccagtgaggctggaccgactgtcggaggcagccaaggtgaacacagacgctatgcgctcagcgcaggaggagataactgagtaccggcgtcagctgcaggccaggaccacagagctggaggcactgaaaagcaccaaggactcactggagaggcagcgctctgagctggaggaccgtcatcaggccgacattgcctcctaccaggtgggcaggggcaaggcagacagccagactgccttacctgattgggtagccctggacaagttactgtccctcactgagtggggttgtagtggttaagattgtggcccttggagtcagacataccagcactttccagctgtgtgaccctaggaaagttatctaattctctgaatctgagttcctttccagccatgaaaaaaaaaaaaaaaaaaaagcctgctttgcagagctggaaagattaaagagatagacttttatttatttatttatttatttatttatttatttattttgagatggagtctcactctgttgcccaggctggagtgcagtggcatgatctcagctcactgcaacctctgcctcctgggctcaagagattctcgtgcctcagcctcccgagtagcggggactacaggtgcatgccaccacacctggctaacttttgtatttttagtattgacagggtttcaccatgttggccaggctggtctcaaactcctgggctcaggcaatcctcccacttcagcctcccaaagtgctgggattacaggtgtgaggcaccgtgcctggcctaaagagatatactttaaatgagattagtgtgaacttgtgaatgagctcggcaaggtcttcaacattcgaatctttctagatttgaatcccagctctgccactcactaggttggtcttggtcgcagtggacattctgtaaacagcaaccagtgtcttgggtggccaggggaagaccttagcagattccttcttttaaagataactggcggctgggcctagtggctcatgcctgtaatcccagcactttaggaggccaaggcgggtggatcacttgaggtcaggagtttgagaccagcctggccaacatggtgaaaccctgtctctactaaaaagatacaaaaattaactgggcatggtggtgcgtgcctgtaatcccagctacttgggaggctgagacaggagaatcgcttcaactgaacctgggagatgggggttacagtgagccgagatcgtgccactgcacccagcctgggcgacagagcgacagagcgagactctgtctcaagaaaatttaaaaaaattaaaaaaattagctgggtatggttgtgtgtgcctacagtcctagctactcagaaggctgaggcagtcatcaatgcctaccaaaccctgactgtgtggtggacactgtggcacactggagaaagacaggagcaaaagcaggcaaggccctgctcccactgggtttttttttttttcttttttgagacacagtctcacgctgttgcccaagccagaatgtgacagcgagatcatagctcactaaagtcttgtacttccgggctcaagtaatcctcctccctcagcttcctgagtagctgggactataggtgcacatcaccatgcccagctaattatttaattgttttgtagaaatgaggtctcactgtgttgcccaggctggtctcaaactcctgggctgaagtgatcctccttcctcagccttccaaaatgctgggattacaggcatgaaccaccagagtctcgctatgtctcccaggctggagtacagtggtatgatcttggctcactgtaacctccgactcctgggttcaagcaattctcctgtctcagcctcccaagtagctgggattacaggtatgtgccaccacatcccgctaatttttgtatttttagtagagacagggttttaccatgttggccaggctagtctcaaactcctgacctcaagtgatccaccctcctcagcttcccaaagtgttgggaatacaggcttgagccaccactcccggcctcactgagcactttctaagctcaagatctctaaatgttatcccattatcctgccagccaaaccagcaggaacaactgttgacatctgatgaatttcatttcagaccttctccagtctgaggtcactatacagcaggatttttgctccagattgttccacgtccactaatgaggaccctacagctctggcagggttggggttggccccagtgagcctggctggatgggcctgctctggggtcgcacagcccgccgcagcttctctggtactgagggccagacactggctggcatgtgatgtgtgtcacctctccttcccaggaagccattcagcagctggacgctgagctgaggaacaccaagtgggagatggccgcccagctgcgagaataccaggacctgctcaatgtcaagatggctctggatatagagatagccgcttacaggtgagacgcacaggggctgtcacatggtgaagaaagcttgtgttcctgcgagacgctaagccttgggtttcaagaccccgtttaggcagcctacctgtcttagggacaaaattctttttaaattgcggcaaaatagacaaaacatacaatttaccattgaaccaatttcttttattttttatttattttttgagacagacttactgtgttgcccaggttgaagtatggtggtgcgatctctgcccactgcagcctctccctcctgggttcaagcgattcccatgcctcagcctcctgagtaactgggattacacgtgcccgccaccacgcctggctaatttttatttttttttttttagtagaaacagggtttcaccatgttggccaggctggtctcaaactcctgaactcaagccctctgcccacctcagcctcccaaagtcctgggattacaggcgagagccaccatgaccagccccattcaacaatgttaagtaggcagttcagtgatattaagtactttcacattactgtgcagccataaccactgtctgtctccagaactgttttcatcatcgcaaactgaaactccatacccaagaaaccgtcattatcattctctccttccttcagcccctggcagccactcttttactctgagagacatgagtctttttttttttttttttttttgagatggaatctcactctgttgcccaggctggagtgcagcagcattatctcggctcactgcaacctctgtgtcctgagttcaagtgattctcctgcctcagcctcccgagtagctgggattacaggcacatgccaccacacccagctattttttgtatttttagtagagactgggtctcgctatgttggccaggctggtctcgaactcctgacctcaggtgatccgcctacctcggcctcccaaagtgctgggattacaggcgtgagccactgtgcccagccaatgagtcttgagagtgacttactttcattctgaaatgatttagacggtggaagttccttatcccctccccagatccagccagccagaggcctgctttgaagggaaaagaggtgcttgagtcagggacctttcaaactctgtcctttagagtttcttagctctgcaagcattcatttcttggggatataaagtggagatgataataagggcaaccatgtcatagggttgtcaggaagatgagctaatcccattcccaagctaatccaggaagcacaggtaccactgggctgctacagagggaacccttagtcagtggcagccttgagaaatccagtctgaggaataagaccggggggagcagggctagggagcaggactgattccctgaggacttgtcccagttctgactggtgacctgtggcttcctacctcttggctctcgtctgtaatcttgctactcaaagcatggcacatgaaccagcagaattggcatcattcaagagcttatcagaaagatagtctcttggttgggtgtagtgactcatgcctgtaatcccagcactttgggagaccaaggcagacagattgtttcagttcagagaccaagctgggcagcatggcaaaaccccatctctacaaaaaatacaaaaaaaaaaaaaatagctgggcatggtggcacatgcctttagtctcagctactcaggaggctgacgtgggaggatcacctgagcctgggagttggaggcttcagtgagctatgatcgtgccactgcactccagcctgtcatcacagagtgagacactgtctcaaaaataacaacaacacaacaacaacaaaagacagacgctcagcccctccccagacctgctgaatcagaatctgcattttgataagatccccggtcatctgtgtgctgctaaatttgggaagtactagtctgaggggtaacccccacacttactctgagacaagcattctgccaagtcttttccattcattgtctcactgaaacaaccctctgacgtagggactctaatgaccctctttttccagtgaggaaattgaggctcaaagagttggtgtgtcttggccaaggtcacccatctagtgaggagcaaagccaagaggagaaactgcggcctctaccctattcctgaaactcaaaagatggtaatacagggtgatgagagacactcgcgattcaaatgggagcgttctaagacctcttaaacccaaatttataaaagtagaattgtggtcgggtgcggtggctcacacctgtaatcccagcactttgggaggcctaggcgggtggatcggctgaggtcaggagttcgagaccagcctgaccaatatggtgaaacccccgtctctactaaaaatacaaaaattaactggacgtggtggcgtgcgcctgtactcccagctactcagtaggctgagacaggagaattgcttgaagctgggggaattgcttgaatctgggaggcagaggttgcagtgaactgagattgtaccactggactccagcctaggtgacagagcaagactccgtctcaaaaaaaggaaaaaaaaaagtggaattgtttgctcaggctcccagggttctcttgaataatattttagtttgagggacaataaatttaacttttgttaaatttatttaggagctttctcttgagggccattttttatggggcaaaagttgttttatttcaaaagtttcaggcttagctgtgttgaagaagaccagctgttccagcctgggcaacacagtgagaccctctcaaaaacaacaacatcaacaaaaaaagaccagtcccaccggggtacacattctgggtggtcactggaatgatttgccaagtgactttctctagtctcataatgcccaccattcacattcctgttccaccaaaacccatatcattcgatgtcagtgaccttcaggatagtctaggaagaacccaaatagtgaatttgccctgagtttatactaatgtgttccgtgatccatcctgcagaaaactcctggaaggtgaagagtgtcggattggctttggcccaattcctttctcgcttccagaaggactccccaaaattccctctgtgtccactcacataaaggtgaaaagcgaagagaagatcaaagtggtggagaagtctgagaaagaaactgtgattgtggaggaacagacagaggagacccaagtgactgaagaagtgactgaagaagaggagaaagaggccaaagaggaggagggcaaggaggaagaagggggtgaagaagaggaggcagaagggggagaagaagaaacaaagtctcccccagcagaagaggctgcatccccagagaaggaagccaagtcaccagtaaaggaagaggcaaagtcaccggctgaggccaagtccccagagaaggaggaagcaaaatccccagccgaagtcaagtcccctgagaaggccaagtctccagcaaaggaagaggcaaagtcaccgcctgaggccaagtccccagagaaggaggaagcaaaatctccagctgaggtcaagtcccccgagaaggccaagtccccagcaaaggaagaggcaaagtcaccggctgaggccaagtctccagagaaggccaagtccccagtgaaggaagaagcaaagtcaccggctgaggccaagtccccagtgaaggaagaagcaaaatctccagctgaggtcaagtccccggaaaaggccaagtctccaacgaaggaggaagcaaagtcccctgagaaggccaagtccccagagaaggaagaggccaagtcccctgagaaggccaagtccccagtgaaggcagaagcaaagtcccctgagaaggccaagtccccagtgaaggcagaagcaaagtcccctgagaaggccaagtccccagtgaaggaagaagcaaagtcccctgagaaggccaagtccccagtgaaggaagaagcaaagtcccctgagaaggccaagtccccagtgaaggaagaagcaaagacccccgagaaggccaagtccccagtgaaggaagaagctaagtccccagagaaggccaagtccccagagaaggccaagactcttgatgtgaagtctccagaagccaagactccagcgaaggaggaagcaaggtcccctgcagacaaattccctgaaaaggccaaaagccctgtcaaggaggaggtcaagtccccagagaaggcgaaatctcccctgaaggaggatgccaaggcccctgagaaggagatcccaaaaaaggaagaggtgaagtccccagtgaaggaggaggagaagccccaggaggtgaaagtcaaagagcccccaaagaaggcagaggaagagaaagcccctgccacaccaaaaacagaggagaagaaggacagcaagaaagaggaggcacccaagaaggaggctccaaagcccaaggtggaggagaagaaggaacctgctgtcgaaaagcccaaagaatccaaagttgaagccaagaaggaagaggctgaagataagaaaaaagtccccaccccagagaaggaggctcctgccaaggtggaggtgaaggaagacgctaaacccaaagaaaagacagaggtagccaagaaggaaccagatgatgccaaggccaaggaacccagcaaaccagcagagaagaaggaggcagcaccggagaaaaaagacaccaaggaggagaaggccaagaagcctgaggagaaacccaagacagaggccaaagccaaggaagatgacaagaccctctcaaaagagcctagcaagcctaaggcagaaaaggctgaaaaatcctccagcacagaccaaaaagacagcaagcctccagagaaggccacagaagacaaggccgccaaggggaagtaaggcagggagaaaggaacatccggaacagccaaagaaactcagaagagtcccggagctcaaggatcagagtaacacaattttcactttttctgtctttatgtaagaagaaactgcttagatgacggggcctccttcttcaaacaggaatttctgttagcaatatgttagcaagagagggcactcccaggcccctgcccccaggccctccccaggcgatggacaattatgatagcttatgtagctgaatgtgatacatgccgaatgccacacgtaaacacttgactataaaaactgcccccctcctttccaaataagtgcatttattgcctctatgtgcaactgacagatgaccgcaataatgaatgagcagttagaaatacattatgcttgagatgtcttaacctattcccaaatgccttctgttttccaaaggagtggtcaagcccttgcccagagctctctattctggaagagcggtccaggtggggccggggactggccactgaattatgccagggcgcactttccactggagttcactttcaattgcttctgtgcaataaaaccaagtgcttataaaatgaaaatgttgctgctgttattctctttccctgggaaggctgggggcagggcaggggaggtctggatgtgacaccccagactgcatgggactgagcaagcatcagt

SEQ ID NO: 36598 - DNA, 6128 bp, Homo sapiens
gaaccgtttactcgctgctgtgcccatctatcagcaggctccgggctgaagattgcttctcttctctcctccaaggtaaactcaggagctatgaagtgtgggcatcaagctgccaccctctgccaggctgcctgtctgcctgtaaatctcatgttctgagagccaggaggccccttctcctgggaggcagcactcctgggtcccttttagtgctctgggctgggacttgtctaagaggatgggttggagatttttagggagatgggatgcaaaaccccaagtggcatgagacccagcttacaggtgcaatatcagcgatctgtggccttaacactgtcacctcttggagccttaattacttcctctgtaaaaggaaagttaagttgcctttgctgctcaaaggactggatgattttagaatcccctttattataggatccaatgtgacagtgagttcatctttaaggatagatgaagccatctggagtggttgttaaaaatgtgggcttggtggccgggcgtggtggttcacgcctgtaatcccagcactttgggaggccgagacccacggatcacgaggtcaggagatcgagaccatcctggctaacacagtgaaaccctgtctctactaaaaatacaaaaaaaattagccgggcttggtggtgggcgcctgtagtctcagctactcgggaggctgaggcaggcaggagaatggcatgaacctgggaggtggagcttgcagtgagatgagattgcgccactgcactccagcctgggcgacagagaaagactccatctcaaaaaaaaaaaaaaaaaaatgtgggcttgggtattagccaattgtgggtttaaaccctgactttgccatgacctggctaggcagccttgggaatattacttaacctctctgagcttcagtttccttatctataacatgtggttgataacaatggtacctacttcgtggtgttgttataggtacaagtggactgcgtgccataaagtgctaagtactcaatacatgagaggagtttcttgtttttctttttaacttaagaaaatagcattgatctgacaaagatcatattagaggtgagtctgagggcatatgcattttccagttttgtggtataaaggaaagagcataggttcatgaattctgactgtcttgaatgtgtacccatgttgcacaatttgctgtgtgacctttatcccttgtgatattgtaaaatatattttttcatcccccagttcctggcatacaactcctaaaatccttggaatcttcaaagtgataaatatcttttgagtgataactgtctaataagttgactgatggctggcatttcctctggggaggggagaggggctgaaggttaagctgattaccaatgggcagtgatttaatcagtcatgcctatgtaatgaagcctccataaaaacacaaaaggacagggtttgacaagcttccagatagccgaatacaaggaggtctccagtgggtggtgcttctggagaggaatggaaactccatgccctttctcccataccttgccctatgcatctcttcatccggagcatttgtaatatccataaggaaccagtaaatgtagctgggtatggtggctgatgcctgtaatctcagcactttgggaggctgaggcaggcagattgcgtgagttcaggagttcaagatcagcctgggcaacatggtgaaaccccatctcaaaaaaaaaaaaaaaaattagttgggcgtggtggtgcatacctgtagtcccagctatgctggaggctgaggtgggaggatcacttgagcctgggaggcgaaggtctcagtgagctgagatggggccactgcactccagcctgagcaatagagtgagaccctgtctcaaaacaacaacaagatcaattttttttttttaaagaaagaaaccagtatatgtaagtaaagtgtttccctgagttctgtgagctgctctagcaaattagtaaaactgcaggagggaattgtgggaaccccagtttatagtcagtcagaaacacaggtaaaacaacctagggctttcgattggcagtctgggggactgaaccctcaacatgtgggatcggccactatctacccatagtggtgtcagaattgaatttggggaccctcagctggtgttcaccagaggactgattgtttgcttgctggtggggagaaacccccacacttctgctgtcagaagcctctcgtacggtgagggaaactgagtttctttttccacacacccttctgtgctttctttctgaaaaaaaaattaagttgatgtgaggccaacgtttggtgccagtagatattcaatgcattgtaagaatgagtttgtcttaaaaatttttttaaagcaaattctatgcgtcaggcactgttcaaagtgccggggatacagcgtggaacagttattaaattaacaagtaccctctgaaatagactctattaataccccaattttagaaataaacaaactgaagcccagagaagcaaagtaccctagtatcctgcccaaggtcacttgggtacaaggccaggaacaaccacagtcatgatattgacatctgcggagcttaccacgtgccaaacaccgtgcgaatccgcacagaatccgcacacccaccggttggggcagggacatctctgccactgatgcggagaggaaacggattcccgaggctcctgagagggatcctgggttccattcaccacacctcgctgctttttactgattcagttggaactggaagggaaaacaacggagctgatgagctccaaaaatgctccggggaccatctccctctcgcccgttcgcaggtctagtgacggagcccgcgcgcggcgccaccatgcggcagaaggcggtatcgcttttcttgtgctacctgctgctcttcacttgcagtggggtggaggcaggtgagaatgcgggtaaggatgcaggtaaggggacaggtaagggtgcaggtaaggatgcaagtaagggtgcaggtaaggatgcgggtaaggatgcaggtaaagatgcgggtaaggatgcaggtaaggatgcgggtaaggatgcaggtaagggtgcaggtaaggatgcgggtaaggatgcaggtaaggatgcgggtaaggatgcaggtaaggatgcaggtaagggtgcgggtaaggatgcgggtaaggatgcaggtaaggatgtgggtaaggatgcaggtaagggtgcaggtaagggaacagataagggtgcaggtaaggggacaagtaaggaggcatataagggtgctgggggatgggaggagtgtgggataaaggagagagtttcagggtccggggtgtagagggtctggcgtgcttctgtagagaccctggcgtccattccaatggacagcgcagggttggtgtcgccagagtcccagattcaaatcccactactctgttcattcctccatcctaccgaaatttactcgatgctagttctgtgccaggctcggcgcctaggggaaagtcccttcccctctgtgaggctctctgagtaggagagtggtggcccccgcctccaggagtggtcctgagcatcagacacagagtaggggacccctgtgtcccaccccaacacccccactacgctttgtctgctctcctgcaggtaagaaaaagtgctcggagagctcggacagcggctccgggttctggaaggccctgaccttcatggccgtcggaggaggtgggtctggagggcgaggatctcgggcaggcggggcgggcctctgccgcggacgctccctcacctgctcctgttcctccaggactcgcagtcgccgggctgcccgcgctgggcttcaccggcgccggcatcgcggccaactcggtggctgcctcgctgatgagctggtctgcgatcctgaatgggggcggcgtgcccgccggggggctagtggccacgctgcagagcctcggtgagtgcggggcctgggcccctggtgggacgttctttactattattttcatcatacatctggggaaactgaggcactcaggaattaagtaatttactcaagtaattaagtagtttaccaggaattaagtgattctttatttatttattttgagacagagtctggctgtgtcacccaggcaggctgaagtgcagtggtgtgatcttggctcactgcaacctctgcctccctggctcaagcgattttcctgccacagcctcccaagtagctgggattacaggcacacgccaccacgcccggctaatttttgtatttttagtagagatggggtttcaccatgttggccaggctggcctcaaactcctgacctcagctgatccgcccgcctcggcgtcccatagtgctaggattacaggcgtgagtcaccgcgtccggccagaaattaagtaacttactcaagtctccctgctagtttagaccagagcctagattctgacccagtcagtacaatgcgagaagccccattctcagcctcaaaggctgggtgcctcactgatgctttggccaaatcacaagcctcagttccctcagcggtgcgtggggatgatcatcctcagtttaacattttttgaatctgctcaatctcagagaccacagtagcaaagaaacatagtagagtaactcaaatcaatctcacaccaaactggtcttgacttgcactttttgaacaccatggagggaacagataacagagctcacagtgactcttctatcgattgatcaatctattgatctatttattatagataaaggtcaaaacaaggtctcacactgccaggttggaatgcagtgcatgatcacagctcacagcagcctcgaactcccaggtttaagctatcttcctacctcagattcccaagtagctgggactataggcgcataccgccacacactggcttttttttttttttttttttttttttttgtagagacggggtctcattgtgttgcccaggatggtcttgaattcctgggctcaagcaatcctcccactttggcctcccaaagtgttgagactgcaagcatgagccactgtgctggcccagagtgactcataaaaaatggccttacttccctctctctcctctctccccacccacccccacctctctctcgcgctctgaggcctccaaaatcctggagaaaacctgcccctgacaaacttccctctctgcctttctgaacctcgcatcttctcttctctcaattctgaatggcaaaagcccaaagaaccagcccaaaagaagagagccctgctcagacggggccacacccctgcaatgggaggggaagagtgtgggcgagcccagggacacctctgggctatcagctagttgtcctctcacatggcacatagctgtgacaagatgaaatgatccctggcttgtgaaccccccacacccacacagggctccacgaaggtggctgttagcatgattaataacatggcgtttccatggcagacatcaggtgaaggagccattatttttgcctttttcatcactgaaacacatctctgatttgggatgtcaaggcaatgggactcactttgtagtagtgccatcccctctcagggcctctgtttctccatctagacataaggggttggactcaaccaatggtttccagacatttggattcccaggcctggcacttgggccccagtgactcatctgtgtttgctttacaggggctggtggcagcagcgtcgtcataggtaatattggtgccctgatgggctacgccacccacaagtatctcgatagtgaggaggatgaggagtagccagcagctcccagaacctcttcttccttcttggcctaactcttccagttaggatctagaactttgcctttttttttttttttttttttttgagatgggttctcactatattgtccaggctagagtgcagtggctattcacagatgcgaacatagtacactgcagcctccaactcctagcctcaagtgatcctcctgtctcaacctcccaagtaggattacaagcatgcgccgacgatgcccagaatccagaactttgtctatcactctccccaacaacctagatgtgaaaacagaataaacttcacccag

SEQ ID NO: 36599 - DNA, 7217 bp, Homo sapiens
ccccgccccgctgaggcctgtctgcagaatccacagcaaccagcaccatgcccatgacactggggtactggaacatccgcggggtgagccagggtccgctgggcggtgggacgggggtgcgtgggggcggggaagtgtggagcagctgcaggacgggctctagggacggttcctcttcagggctgtccctgacagcggggtctgtgcttgccgctgtctgtgcgtgtggctgggcgtgcggggtgggggcgggtgaggcaggaacgagaggaggagatggggctccccttgtgcagagtcgtcacaaagtcagggaccctccatctctgacccgagctgtgggccatctctcccagctggcccattccatccgcctgctcctggaatacacagactcaagctacgaggaaaagaagtacacgatgggggacggtaatggcaccctcgagtctgggccctgccccctcacactaagttggcaccaagcaaccgatagtggccacctgtggctgactctgcaggcctcccttgctggaactgcaggctgtcccttccctgagccctggtgagggagctccttgcaaggcagaatgctggggcgggatgctgggcccccgtctgggtaattatgatgggtgtccctcagggcttgcctaaaccctggaagccttagctgtgtggggtccagagccctcactggaattctttttctctgaatcctgggatgtgggactgagtggtcagattctagatccacctgtctcaggggtcttgccactggctccttgggagggtccccaggaaggagggctgggctttggggaggtttgttttcacttcatcttccccaccacagctcctgattatgacagaagccagtggctgaatgaaaaattcaagctgggcctggactttcccaatgtaggtgcaggggaaggggcggttttgggggaaagtgcgacgtgtctctgactgcatctcctctccccagcttagaggtgttaagatcaggagtcttctgcccaattcctctcactcttggctgtctacacagcccttgcatgatgttctgtgtcccagctcatttattagtgtgacagtatttctatctcaggcctgccatgagcaggccctggtctcctctttgcccttgcatatgggaaggggatgctggggagcctggtggcccaactgagcttccccggtttcccatctatccagctgccctacttgattgatgggactcacaagatcacccagagcaacgccatcctgcggtacattgcccgcaagcacaacctgtgtgagtagatttggttgcaagatgcggggagggaccgtggcctcctcctcggcttggctgggctgtgaggctgagagtgaatctgctttacgagggtaggcggggaatcagaaaaggagcagattcgcgaagacattttggagaaccagtttatggacagccgtatgcagctggccaaactctgctatgacccagattttgtaagtccccccaccccactcccagtctccccttccctactcccagtctcccctttccctgcagagtttgtgtccaaaattgattccttctggtgagttcttggtcttgctgactctaagaatgaagccgcggtcctacacggtgagtgttacagttcttaaagatggtgtgtccggagtttgttccttcagatgttcagatgtgtccgcagtttcttccttccggtgggtttgtggtcttgctgacttcaggggtgaagccgcagaccttcgcagtgagtgctacagctcttaaaggtggcgcgtctggagttgtttattcctcttggtgggttcatggtctggctggcttcaggagtgaagctgcagaccttcatagtgaatgttatagctcataaaggtagttcaaacccaaagagtgagcaacagcaggatttatggtgacgagtgaaagaaaatacacttccacagcctggaagacaacctgagcaggttgctactgctgcttgggaagggcggaggtggggggggaaatcccttatttggccccacccacatgcagattggtccattttacagagagctgattggtccattttacagagtgctgattggtccgttttacagagtgctgattggtctgtttttacagagtgctgattggtgcgtttacaaacctttagctagacacagagcgctgatttgtgcatttacaatcctttggctaggcagaaaagttctccaagtcctcacctgacccagaagcccagccagcttcacctctcattttgatcaggagccaagactgtggtcctgccaaatacacgggtcctgttttctgtttgaactctttagtgctactcatccttcaagctatttcctatactgccaccagagtgaccctcaaaccccaaagtcgtgtcaaataaaacctctaaatcaattccccaccaatctacttatagaatcctgactccccagggtatgaattcactctctagacagtaatggttacttccagaatcccttccatctctgacccatgacctgtgctttgggccatctctcccagtggtttatatcatctgcctgctttaggaatacacaaactatgaggaaaacaagtgcaaaacaaaggagtaatggcacctgaaattttggtgtcttccgagtgctctcttgacatacactgagatcagcgaattttcctaacagacagcttaggggcagccagaggctctttttccccctcctttcttccacttatcctctgaatatctcctcatctttccagaaaccactcaatgtccattgtattctactgctgcccaactaggaggaaatttctacttctttctctgagctcctttagttctttgcatccttgattctgctcatatctggtccagagcctaccaggtgctcaggtgctcctggggctgacccagaggttgttgggaggtcagtggggacagatttagggacagtgtcacattccgctctgccatcccatcacctcagaaagactccagctacccagttggagtctaataaatgctgatgtatccagctgaagcctggacagtgacccagttccagctgtggggaagatgactgcttgcccgcggccagctggggccatgcacaaaactgggaggccgcatctgtgcagggagcttgtgtctgagggtgttgacagctgttttctgcctcaggagaaactgaaaccagaatacctgcaggcactccctgaaatgctgaagctctactcacagtttctggggaagcagccatggtttcttggggacaaggtaatgggggcgtgtgatggggacaccacagatttgtcatacttcctatattatggaggtttcagcccacatatccttggccttatccagatcacctttgtggatttcatcgcttatgatgtccttgagagaaaccaagtatttgagcccagctgcctggatgccttcccaaacctgaaggacttcatctcccgatttgaggtgatgcccccagcctcctttctctttatgtctcttattcctttccctcctttgtgatgctttcccagtcctggagctacacaaagaataactcacatttttggccatgtgcggtggctcacgcctgtaatctcagcgctttggaggctgagggaggcagatcacctgtggttaggagtttgatacctgcctgcccaacatggcaaaaccccatctttactaaaaaaaaatacaaaaattagctgggcgtggtggcgagcacctgtaatcccagctacttgggaggctgaggcaggagaatcacttgaacctgggaggtggaagttgcagtgagccaagatcgtgccactgcattccagcctgtatgacagagtgtgactccatctcaagaaaaaaaaaaaaaaaaaaaaaaggagccgggcatggtggctcacacttgtaatcccagcattttgggaggccgagttgggtggatcacctgaggtcgggagttcgagaccagcctgaccaacatggtgagacccctgtctctactaaaaatacaaaattagctgggcgtggtggcacatgcctataatcccagctactagggaggctgaggcaggagaatctcttgaacctgggaggcggaggttgcggtgagccaagatcgtgccattgcaccccagcctgggcaacaagagtgaaactccatctcaaacaaaaaaaagaagaaaagaataacttgcatttattgagtgctggcttcatgccacgaactgtacccagcacattatacctattgtgttgaatttgaaatttacaacattcctacagggtggtagaattatctcccccattttagagacaaagaaactgagaatgagagggtcagtcctttgctcagggtcccagagccagtggaggctgtgctgggctccctgcgagcctctggatctatggttggcagtcagggctctccgttttgtgacaaaagaaaagcctcaggccttgtccagcctgggtttcatagcccaggacactttggaagaggcagagcacttcaggaccacggatgcagctggcaatagtaggactgacacacagtagcattgatgttcaatactgaacccacaggcagtattcacagctacacccagaaactttgtatgattgaacccccatgtggggaatcctgagagccagggctgtggctggagctggattaaggtacatatgtgggtgcccctgttgaaggagcttatgctgaaatgccctgtgctggagcactttccttctctacctctttttttttttttttttttgagacggagtcttgctctgtcacccaggccggagtgcagtggagcaatctcggctcactgcaacctctgtctcctgggttcaagtgattctcctgcctcagcctcttgagtagctgggattacaggtgtgtaccaccacgtccagctaatttttgtatttttagtagagatggggttttgctatgttggccaggctggtctcaaactcctgacctcaggtgatccacccacctcagcctccctaagtgctgggattacaagcgtgagccaccgcgcctggcctcttcctctctttttttccctccaatgttccaggtgttccccctgtgagatgagtagcacgctgattttactcctgttcactgaccttctcctctgcatgaggcagggtgtgaggcacagtgggagatgcatagatgacagccccatcctggaaatgagtgcagtgagaggcctgcaggcagagcagcctgtgaagtgtgtgctgaacttgtttgagagcagcaaatcctacattactacagatttggggatttgaggcatttgtccaacaggcttctgagccttgaatctgtttcccttttccactccccatcaagagatctgcttgctcagctagttcccatcagctctggttctgcggttctggtccaggctgagtggccttggagttaggtaagaggtggtgggaagggagggatggaggagagctgagagctatggcccgttatgtgccagggtcaagcctgtcacccaggctggagtgcattggtgcgatcttggctcactgcaacctccgcttcctgggttcaagcaattctctgcctcagcctaccaagtagctgggattacaggtgcccgccaccatgaccagctaatttttgtatttttagtagagatgggttttcaccatgttggccaggctggtctccaactcttgacctcaggtgatccactcgtctcggccttccaaagtgctgggattacaggtgtgagccggatgtttttgaataccttatctgggcattcaatcctggtaagattgtgcacagcacatctgagtgtcatgtagcctgatctgcagcagggctggagatgccatgggttagggcacagtgagattttgctaagataccagatggagaaccttggactttctgctttaaggggaatgattagagcctagtctcgcctttgattttcttgtgcactgccactccccattccactttcatccaggttttactgagacattgggtgagtgtgttcagagcccctttgttctgctggaggtcccttctgtgtctctatacccagacaagccaagagcctccctgtggaaaaggagactgtttgtgcagtcaaggagtgacagggcctggtgtgaggggtggtggggcagaagaagaagagaatttggcagaaagaggccagaactggagagagacagaaccaggctacattgaagttctattccccttactaggtatttaaatgtaaggaagttgctgaacttctgtttcccacatgacaaatggtgataatagattcagccttgcagagtagtcgagtgggttttctaagcttacgttgtaatttctcttgggtacagagcacccagcaccgtgtagaatcttcataagtgttagctgttactgtggtacaacattacttaaaggaagttggaagagttaactccgcagatctggggaccctaagaagctgtgtgatgcctcagcacttgagcccacatggaaaggctgtggccagggccctgacctgctgtgtctgcagtggggttgtgccagccctcatgggcagctgaccttgagttctggccttattttcccccctctcagggcttggagaagatctctgcctacatgaagtccagccgcttcctcccaagacctgtgttcacaaagatggctgtctggggcaacaagtagggccttgaaggccaggaggtgggagtgaggagcccatactcagcctgctgcccaggctgtgcagcgcagctggactctgcatcccagcacctgcctcctcgttcctttctcctgtttattcccatctttactcccaagacttcattgtccctcttcactccccctaaacccctgtcccatgcaggccctttgaagcctcagctacccactatccttcgtgaacatcccctcccatcattacccttccctgcactaaagccagcctgaccttccttcctgttagtggttgtgtctgctttaaagggcctgcctggcccctcgcctgtggagctcagccccgagctgtccccgtgttgcatgaaggagcagcattgactggtttacaggccctgctcctgcagcatggtccctgccttaggcctacctgatggaagtaaagcctcaaccac

SEQ ID NO: 36600 - DNA, 71528 bp, Homo sapiens
cggccccagaaaacccgagcgagtagggggcggcgcgcaggagggaggagaactgggggcgcgggaggctggtgggtgtggggggtggagatgtagaagatgtgacgccgcggcccggcgggtgccagattagcggacgcggtgcccgcggttgcaacgggatcccgggcgctgcagcttgggaggcggctctccccaggcggcgtccgcggagacacccatccgtgaaccccaggtcccgggccgccggctcgccgcgcaccaggggccggcggacagaagagcggccgagcggctcgaggctgggggaccgcgggcgcggccgcgcgctgccgggcgggaggctggggggccggggccggggccgtgccccggagcgggtcggaggccggggccggggccgggggacggcggctccccgcgcggctccagcggctcggggatcccggccgggccccgcagggaccatggcagccgggagcatcaccacgctgcccgccttgcccgaggatggcggcagcggcgccttcccgcccggccacttcaaggaccccaagcggctgtactgcaaaaacgggggcttcttcctgcgcatccaccccgacggccgagttgacggggtccgggagaagagcgaccctcacagtgagtgccgacccgctctctccgcctcatttccatttcgtgggttctcgcccgctctctcccctccagcctgcaccctcctcccggatcttcactgcgaccctagcgctccgtgtggtttctggccgcgcggccctcggcggtttcgggttcaccactcaccccctcctttccgggctgcggcgtaggcccgggtgtcccctgggctttggggtgtgccaatttgccctgtaaaccagtacccccggcccggagccgcggcgcgccggggcctcgcggactggctgtcttcccgcggacaacctgtcgcgtcggggatgcccgcggccccgccatgcagctctggccgcttctatctgctgcgtgctgtcccggggacaaagacaggaaggaccgcagcagaacgaaacggtctttactggaaaaacacctttctagagtcctgcccttaaattccgactcgggacgacccgaggcatatggcacactactctcacccactctgttttatatttttccgaattgacgaaagctgaaagagcaaaaacaaaaaccaaccagccaaccagcaaaaaatccagatgttgttaataaagtgccatagctttgtttcagtagtgaaaagaagtgcaaacactttaatcttccacctgcagtgactagctttgagaccttgagccgacgcttaaccccagagccggtttcctcatcgctcacgtggggctaatatattactaccttgcagcaggcttgaggatgaaatgagaattgcagttttgctttctgtaagaaacaatgtttgtggttctagaaagaacactggcctaaataaggagtgcttggactttaggggattccctaagtctggagtgggggctgaagatttgcatttctaacatgttccccggggatgctgatcacatcacactttgagagccactggtctagaggaaagagaaagaaaggggcataagatgagccgatttacaacactgatggaatttgaagtgagagaaagaggactagaatatattgtaacctgtcctcctgtaagtgtatgtaaacatgtgttttaaaagctgtgtgttatggcgttccttcctttatgggttccaggtggagaatctgattctctcattgcctgagaaaagacccacaggggtcccagcgccactcccctgtagttctgcctttgtcttgggatgctaatgggatgtcatgaggggaggtggaggggggctggaagagaagaaaattctacaaccaaacgtgaattggcagaagaatgggcaatacactttcatatgagctgagtctttattgcttccaaaatagcaacctgcaagagaggcaagtatttaatttttttcaggcttgccataatttaaaaattttatcaatcacttaatcccgtaaaactgaaaagatgcttgtaacctattagatgggttagtgctagttctctattctggtaacttgaactcatctatttcaaaaaattatctttgtgattgaagtttgttctgcagttgtctgctacgccatctcagctgacaagggcaaggtgctgtgtgtcccaattggttttgttctttctagtatcacaaattatttattaaaaagcatgtattatgaccagaagacagaagaatttccctttaaattaaattaatatttggggcttcccctaatactctttttttttcagactctattagttgctgaatcattttttctttgaagattttgatacccgattcgccttagaataaaactatgtagaggttagccagtggacataattttgaattgcataccacattaccaccgttgtaaaaacaaccgttaactttttcttcctaactgtgagttgggttttcatttttgtaatcttactttaactctgtggttctcaaatggggacgattttgcctcccaggggacatttgacaatgcctggagacatttttggttgctgtaacctggaagggtgctactggcatctggcaggtagaggccggggatgctgctgaacatcctacaatacacattataataccctcaacaaaaacatttttgaccccaaatgtcactagtactcaggttgagaactctgctaactttataactagctaaggacaagacattaaaagggaaatgtagaataactcatccagacttgtggagactaccaatttttttaaaattttttatttctatagggttttagggaccaggtggtagttggttacatgagtaagttctttagtggtgatttgtgaaattttgttgcacccatcacccaagcagtatacactgaatccagtttgtagtcctgtccctccccaacttcccaccctttcttcccaagtccccaaagagactactctttttttaaaggatacctgtaccaggcaatagactgacaagaatacaaatctaaaaatgacaaatttcatctatttctatgtagcccaacctggacataaatttaagtacagtatattattttctcacatattggatgtttactgatagttgaccaaaccatgaggagaccccccaaaacaaataaaactgaccagaaaacatggagaagagttaatagtagccacagtttcctactacattatggctcagatttctagacctgtttgaaaagttgaaaaatctatggtctcattcctcagactgttttgtccaactgacctgaacatctgtcactggaattttttttcctttggcatgacactttgtgcctacatgttttctaaactgcaggtaacttttgaaaggccaagttcaaccattatcagattttaacatttagtatggattaaattgtgagtgcaatttcttccccaaaagctggccagaaggactggagtttggggagggatgctttgaagactgtgatataaatgatggggtcctggagaggtgcaggggaagaggaggcagagtgggaagctgtgaggtaggaaagagaggaaaattttctaaaagaagaggtaggagaagatgacacaacacaaatgtttccaatttttcagtgttgctgaaggtcaactgtgcttcacacctgggcattctcctgaatttgcactcaaaagggcccattttctggcgtttttctcatagtcctggaataatcttcatttgacatgagagtcttgataaaaacaagatgttaaaagtggttagagagtttctccttctccagcatgtgcgctgcactcctgcctttcttttggcatccttaacttttggcaggcctctttcaatgcggtgggaatggataatattaagtatgtactctaaagtagcaagctgtgtaaaaacattcagaagagagaacactttatcccaagcagcacgtacaacatgtggtagagtatagtaagtgaaatgtatgctgcttatgtacacttagtattcaatttattccaggtgctcttatttacaaaaaaaaaaaaaaaaaaaaaaaatgagagtagttagaagtactgtatctacccttgggcttctcccaggaggtgactgcctgtgtgccacacttctttgcttgcaggctccagaggacgctgagacttggaaaggcagacctgcccaccccagtgtggagcaggggtggcttgtaggtgggcctgacccctgggctctttgctactgcatgtgttccatgcaaccccaagcataaaaacatggacttgtgaaatcaaagggaggcttcagaccttctggtttacccatctctttttacagaagaggatactgaagctcagaaaagtcaccaattactcaagttcacttgtgggtttcctctttttttatcctgaatgagcttcttaccacctggtcccttgccttctcttcctgccatccctcagcctcagtgcgctcttcattccaccatagagtgtgccctgctggaccccactttggttaggcttcctccatttcagggtagtgagctgctagcccctttgaagagttcttactagtttacgggtgcctcaggttgatttcctggggttttggataaagccacctttccatctcttcactactgcctttggggtaaatagaaccattgatttaataatacacgtactagattctctccccccacctctctttggtaatatctggcaagtggatagcaataattttacttaatgaacgtgatatttactgtaataaatattgggtgcagtaaacaaatgaagtcagaatctaatagctcatttaatcttggaaatcatgtaatcagtacagcaatgaaaggacaattcatgagtcatagatattaccacaccttaggagccttttaagatgagtttgatgccaagtgacttcagcctagaaaaggcaatatcccctcatgacatgccctgaggggtttcatttgtttataaaatgaccgttatgtaattagactttgacaatggtgtaacaattgggttttaagtattctcattttgatttatgatgccattttatgtggaaggacataattttaaagtttaattagaaaataaaatgttacagatgtaatgaacaaaacaagaacggttctttaaatatcataagcataaaattgactttcttcatctatacactgattctgagaactcatcatcagtgatgttgaaaagacaatttaaggtctcacattattggaactactattttaaaaccacgagatgcctgtacaagctggtaattacacatgtgctgtagtctttgcttgtttttccaattctagtgtttgttgattttccagataccctacttgggcccctatgtcccgtagcacacgtctgtaagaaggctggcatgggataaaagtctatgaccatgaaacggagcaaggcaaatctgtatctttggggcacatatctttttctttttttctttttgagacacagtcttaccctgtcacctaggctggagtgcagtggcacaatctcagctcactacaacctctccttcctgggttcaagcaattcttctgcttcagctgtgattacaagcacctgccaccgcacccagctaatttttgcatttttagtagagacgggatttcaccatgaattttcctggctggtctcgaactccagacctcaggttatctgtccacctcagcctcccaaagtgctgtgattacaggcgtgagccaccgtgcccagcctggggcacaaatcttaacctcatcaggatattctgtccaaacaaatgtattttgttctgttttatttttgagtttgtccttttctgtgctctgaaattaggatctggtctagtacttaatttgtatattgtcagtgctcaataaatagttaatgcttgattgtttgcataataatttggaataatgattatcagtgtagagttttagctggatcattagaaaatgcacttatggcactgtgattttaagtgtttccttgttgtatccactgttcagttagctcctgctttctcttttctccctttaataatgaccgccaacaaggccttttaagctaggttatgtatagccacaggaatttaggagaggaggaaaagaaaagtggcaacttccaggggaactcaccctttgagccatagactgtggttcttagaagccagaccagtctcattctaaacaccttcagaatatttttagtttgaagaaattggaagggcctggaggcaacagacagccaatattcagtgtttatgtctcatccagctgtcttctgtcactcttcctgcacaaggtgacttttgacttgaccggtgtatctttgatacttactcatttacagaaatgtataatggatgtgtgtgtgtgtgtgtgtgtgtatgtgtgtatttgtatttttatagagctattgacttctgcaatttaacctctaagatgaattatccaatagaattctgaaatgaaaagttcacagattttcaaggtattttggagatttaaaaattgaagagaagctatgtgaatattaagtgtatgttccagatataattgaacaattgaaaggaatgatcctggtttaatttataattaagctatacattaatttataatgaaaacttgtaattaaatgataactcaaattagccaagaaaaaagtattttttaaaagaaatttgtacagagtagtaatgatctggctgcattctgtgaacagattattctctgttcataatttaggcaccttaagatgctggcaccttaaggtaggaaccatgacttctttatataaataaacatcataaaaagctcagtactttttactcagagagtgctcactaaatgtcagctgatgaggaaaacattctctgtggaacttgctgtgaaataactactcatgaggcatatgctgtataaagcttggtcaaagtttacagttttcttggtgtcttgacatctgtgtttagatacttggtcaatctttaaatgaagataattatatatagcaaagttatatttgggaaacatttcggaattttggagactggctattagtttttcttagaataatctagagaaagatgaatcatttttcaggaaaaattgtttagaacttttattgggaattctgatttccttaaaagtatttaagatttttatcatgtactattgttgtaggaaaatcctggttcttgtcacacgcccaggaaagattaggctcacagacactttggagggtgaggggttatggaatttattggtcagaaagaaaaaaggaaaaacaacacagcaaagcaataggggttcatattaacaggcccccatctcacagattgattcccaagttaccaccccgaacaggagagaccagtctcctccctgcaaagggcgtgaacttctgtggctccaccccattctcccagtgtgcaggccatttggaggttctccagggacccctttatacttggctgtcctgtctcactatgcaatataaaactttctcaggtatgctgtgcattgtttttcattcttattttcttttgtgaataatatcctggaatcagtacgttcttctacatcatctccttttctttttttgaactcttttaaattctagattctgccctcagtattccacttaaatcattcttatgagagcaccagtagtcttctaatttaatcatgtggccttttccaatttttcatgctactctgacatgtggcagtattgtctgcctctgacttcttgataattccttggcttctattacatcacatcaacctggttctccttttgaaactgcctttgcaaaagttatatctgagaaaattatgacactgccagagatatgacctagcccactcccctcctcttgcctttagctttcaagctgccttaatcatttctgggcttaggcccagataactttgggagatagtttaaaggataataagccttccccaaaactcaactgcctttataaagctaatgaaaggccctcaggcttcaggggaggacaggaatctgagttgtgctaaggtgtagacgtattaatagattgccactagtgcaccaatagtggtgcagataacaccactattgtagattggccttttgagatatcttttcaggttttttgcatgtctgacacccatggctccagctggacctgctaaaccactcctgtggccccacccaggaatggttccactcaagaggacaactttgaccccctattatttcatcttcagcccaatgaattatcagtaagcacccattgcatagcaatcctcaccctttcccccaaactgctgttgaaaaactcctatcccatgagctgtggatgagattggtttgagtactaactctatctcccatgtggctttgccggccttgtgtttattaaactctttctttactgcaatgctgtggtctttccttgtgcagcaggctggaagaactcctcaggcggttatacttttgcccatccaactgtctttttttccactttcttctgttttttttttgcatttgtattcccccaaggttctgtttttagccttctactcttctttctgtgtacttgtattccttcagaagatcatgtattgtctctgtctctgtcttgattccccatctcaatttcccactgcttggagggcagacacactgccatagcttcaacttaacatacataaaacagaacttaacaccattttctcaaactagcaccctttcctcctgaatttctgcttgtagtgaattattattcttgtctccaaagctagacaccatggaattgtctttgatgcctttctctacttctttcgtatatatctctctaaaatgtttcccagccatagtgatttccttgccctgcctcttgatttaatgacctctactctcctgcaattttaagcactaaccagacctacctggctttccttcttaaacatgacctaccttatttcttactgtttaccatccataccttcctgaagctgtagcactctgtgctttaattatagtctctttaatgtgtcataacgattactgtcacaatgattggcctttcttcatgtgactcttgtttttgaaaaatccttctttttcttatcaatttctctctcacaactcctcccatcctcacctttctctggaaaaatcctttaagatccagcccaacagacttctttgtgaaactttcctctaccttcccagggagaattaatggtttttactgttttcccatatacttggtacatagtctgaacacagaacttcatgctttctgtaatagttagtggtttatgtgtctggcttctgcactgggactgtgaactctttgtaggcaagcactggatcccatttgctgcatctatcctcacacacagtggccactcaaagaatgtttgttaaattgaagatgtactcaataaattagccaagtctcttaacttcctttctgaccttcccttcacgtctcctgtcttccttgtcatcttagcctttaaccaggcagttttccttaagctgaaatgtcctgtctgtcctcgtaccttatcccatttccagtcatgctttgggccttatttctttcacatcatcctgtatccatctttccttttctgtgtgctatctaaaaattctctctaatagcttgttgtattttaattttatgtcccccagttttactggaaattcctagctggcaagaaatttttatttttaaaaaatccagaccacattacccagtagttctttactctttcctattctgagggtctgaggctgaatttactcatcccagggtccttttggcttcattgctgaatgagtgaccagtctgagtcccatgaaaaggttcactctatatttgttgaatgggcaacaacttcaaataagtataaatactatagtatgaggcatataaaatggtaaattgaatgcaacagcactgtagttcttttctgcaaacacctttaacattattcaagggaagcaataaaggcaaagcgtagtcatttgttggatcactttttattttggaaacttttcagctgttaagtaacatattaatatttctagccaacattaatgctcagttctagaactggttatagtactctaattaaggaacgcagacctgggaattcatacctgattcagacacttcaatccttacgtcagtgtgtctctctcttactcaggtctaaaaccagtgaatcattgtaaaagttagtattggggactgtctggtaccattgttaatattttgggctgtgatgaaatggcatggatagtttcatctgaaaatttattcagatttatgacccagtattcatcacaacaatctgaaaaactcttaagaggatagaaattgtatgacaaagtgagtcacagtctttgtgatgtgatgtctgcaagggtgggtgggagaaattactgaatgaccagtctcattctactcctttctaagctgaatcattttgtaaatagaaaacaattcataagtttttaggtggccttacatcaataggaaatggaagagattaaaacggtcaaataatgcttccatttaaaaaattacttttggaaacatatcacttgataaacactttgcttttgaattagaaatgcaaataatctttctactgcctgctatatatcttttaatccaatacttgctgcatgtcttcatgtattcttactttttctattaattatgttacttttcttgcctagattttttttttattctaccaagtgtcatttgacctttcgtcttatagctatttctagtgttggctcatttggagatggggtgtgtgtgtttgtgtgttggggagaggtgtcatttactcactggctggatgactacttgaattggatggggactcaagagaaaaaggtccctttgattttggaaattctgattctgggatggtatcatcttgcattttgcattgtgggtcctcttctgttaacttttcatctaagcttttctccgagtcatattttacctttaaatgtaagacttattaacattatttccttatcttctttggggtaaggcatttatttaaaaaaagctaagtgaaaagagaaatattctattttgaatgtgtttctaagtgttagttctccttacatatttatatatatctacattactctgaactcagtaatgggagtataattgaagtgagattgggaagataattttgttaactgttttaattgagtgtactaatgtataaagacatagacagaaggtgttggattgaaaaataacgaattacagagacaccctcagctgttaaaggatgagaaaagtgagacatagattattttttggagggtggtatgaaagccctgaagtattcatgggatctgtccagctctgtccagacaatgagggagactgccatggtgactaggcagagtccctttgctctgtggtagaggaagggtcaggtgtttggcctttaccactgcactatgttcctaggaccctgatatttaccaagtacttattgaatgaatgagtgagtgaaatttttgagaacatgctctatgccagctttataaataatatctgtttaatcttaaatacaaacttatgaagcaggtgttgttatcttcatttgacaagtaagaaaatagtttttttcctattggcttttcaaaacatgatctctttgtccataacaactggtgattgtgcattctagacttcttagtgtttagaatacaagttcatggccagaattccgcatggacaaactagcagaaatttgaacagaaataatgatttaagcaaataatttaaactctttcagaggctttgccatgtccagcaaagttgaagtgtgtgccatctattcctctgccccttcgtctattccactctcctttgtttaggaaagacttctgtcatgatttagtatgagacaattcttctttagtatttaagggcttcttaagatttttgagtggcatatacaaaaatagcgtagcatgtaattaagaatgaataccatacagccatgcactgcatcatgatgtttcggttaattgcagacctcatgtatgatggtggtcccataggattataatactgtattttaactgtatcttttctatgtttaggtaacacaaatacttagcaccatgttacagttacctacagtattcagtacagtaatgtgctgtacaggtttgcagcccgggagcaataagctataccatcatctaggattgtgtaagtacactctatgatgttcacacaatgatgaaattacctaaggatgcatttctcagaatgtatccccatagttaagtgacacatgatcatgtaacacagtggtatttgtgtatttaagcatatctaaacattgaaaaggtacagtaaaaatatgacattatagtcttatgggaccactgtcataaagataactaaaaggatgttttcaaagtatagttaggctcttccagaaaaaatcgagggtatcttttcagtatttaaggacatgtggtgtaagattttaaaacaacaacaacaacaacaaaagcagatgggcttgggtttaattttcttcattgagtgagattgtccattaatcaataattttctgagtgtctactatgtgagggaataaagaccaagatagataaagagataccaagaaagcatgtagcaagacacgtccggaaaagtgtctaaaaattaaactcctctttcctttattgactctcctgtattttcaaatggtatcaccatcttccttgccaaccaggcccaggtgttagagtgaatttctactatgtcgttttccccactcctcacttctcttctcaggccctgtccatttcatttctgcagcacattcacacttgtgccggtcactgcaatcttgctgcagcttgtctagttctaaccctgactactgcaactgctgtctaactgagctcatctgtattagtttgctaaggctgccataacaaacataccacagtctgggtggctcgaacaatagaaatttatcttcttatagttctggaggctggaagtccaagatcaggttttggcaggtttagtttcttccgaggcccctctccttggcttgtcgatggccactctctagctgcctcttcacaagatctttccactgtgcttgtgtctctgttgtctctttgtatgtccaggtttcctcttcttataaagacctcagtcagattggatgggggctcaccctgaaggcttcattttaacgtaatcacatctttagaggccccatctgcaaacaggagcacatgcagagatagtgggattagagcttcaacatgagttcggggaacacaattcagcccatagtatcccataataaaggatgttattctttgccagagtgagttaattactctgtctagttgttcagcagttggacattgttttttcctgaagaggaactctgatcatgttacttctcagaaactctcctgggcccttgcttccaaaacgcaaaagaaaagaaggaataatggtcatgccaaaaaaggccatagccacgtacagcctatttgtggcaggaactgtgcccgatgcatggccaagtacaaggctattaagaagtttgtcatttgaaacatagtagaggctgcagctatcaggtacgtttccaaagcgagtgtctttgacacctccgtgcttctcaagttgtatgtgaagctacattgctgtgtcagttgtgccattcatagcaaggtagtcaggaattgatcttgtgaagcccacacgaaccaaataccccgatcccgatttagacctgtgggtgctgccccacgacctccactaaagcccaggtaaggagctgagtccttaaggtctgaagaaaaactatcttctggaaaaaaataaaatgaaaattgtatttaaaaaaagagaaaaacatcgtggacttgaaagacttcaatctcctggtacgcacattgcccccagagctcacagatgtttcaagtctgtaaaaatcagaaaacataggaaagttaccagcagatgtgtggttgtcatagatataaaaaagtgggatacagggtgtttttggaaactctaggtaagtagtaagcttgatacagatctctgaaaaaaactccaagaggtttgagaatactgaaaaagaagataacagagtaagtagtaactagggtgctacaatgggagagtcataatatatacatagccttcgtgtgttaatttccatggaatatttgaccgaatttctcatagcaaccttctgtaaaagatgtgtattttcttcaagagagtctagagtttttcgtatttaggattcttaggccaggctccaacagctaaataagttttattggcacacagccaccctctttgtttaaacattgtctgtggccactttcacactacaatggcagatacccctcaaggtgtaaaatatttacttcctggccctttaccccagaaaatgtgctgacccctggcttaggccatatttttcatgaggagtggacactccttagtcatggcatttctgctattccgcactattacatttaatactaatttcctgacacttgatgtcagaaactgtataatattgtctatggcttttatggatattcctccaacctttggacaggaattgttatttccaggctgatctcttatttaaaaatgtatttattaatgatttaatatcacttttaataaactggaattatgcttttcctctaaaagaaaaaaaataaaggtgatatagatgcattatcataatctaaaactattttaatagacagctgatcctattttccaattactagtaaaacgtcatgcttcagatgattatgctaaaccaaagttatgttttttgctagaccgtccacccaacttttaacagcaaagtaactaattcctgtgtagcaggaaaattcacttagttatttccatatatattttgcaactcaactaatttttcttggaagatactgcaggaagttacattattcaaagttagatattctctgttttagtgaaattttaaaaaattaacagtttggatatttggttacacctactttgaatattttcctcacttaaattatttttggctatgcttaatgatgtagaactgtagagcttttatgttaaagaattctggagaatattggctctgcccatgggtatcactccagaagtggatgaatgttcctgttggattcctctctttttctagaagaagcctaatgcccaccatggctgacagttaaagcacacagttctgctctctaggttaggtaggacagacagcagaacctttctaaagacctgttgggggaaatactatttatggaagcctgcctcaacgatgtatggagtgcatctttcctccagacagagagttttaacctgggagttcatggatttgctttaggtttcccttaaaaatagatgcaaaatgctaggttgtttttctgaggagagggtgcatagcattttgtcagattctcaaaaggttatctgtggtccaaaatgttaaggacagtatcactagaaacactaaaatatgtcttttaattaatctgacatctgggagagaaccaatttgaaccacatgacagtgaaaatgagtttactgaattgtgtgttggggtgaaactttagtttatggtgagtgattttgtgagaaacatctctgtgaagctcgtctctgtgtataattaacagaaacattaaagaaatgttgaggactgttgttgatctcattacatagtgtccactctgaggttccttaggagaaacttctctgtggtaactatgttgggtctagttatgcttttccttagcagccagcttatttttatcttatggtctctgggaaatttcttattgctgctggctactagaaagccaaatatatggcctgcttctagcaagtataataatctcactcctggcttcatcagttttaaacccttcatttgtatttgccttattaaaaagccatttttaaagttttttgttttggtatattgtcaatatctttgtaactcaccttaaatattacttgggatcaaacacattatacctcaataaaaataatatattgattaatttgctatttttaaccacaaagtaccactatattatacagagcattgggtgctggagatgaaaaagtcaaggcccttgtcccttaaaatgtgttttgtttggcacgacaagaaagagatataaatcaataagggcaataaaatgttttgcctgctttgcttgtggtgttttccatgggacagtgagatcatagcaaggatagcagtaagttctaatggggaagtcataaaaggcttcaaacaggagtgacactgaacagaatgtttggaatcaagtagatgtttgccaggcagacagggcggggaagggcaggaaggccaaggaggcagggccaggtctggcatgttttgggaaccaaaagaagtttggaatggcaagaagtaagacctgctagctaggcagggactggattatgatgggccttgcaagccatactgaacaattcgtctttatcctagaagtggtggggagtcaatggagggttttaatcagagaataagaggattaaatttgggctttgatgagatcactctggcgggtgtgtgtaatagattggagggtgtgaagctggcggcagggagtacagttaggaaatgatttcagttatccaattgagaaatgtaaatctctctcagactattttcctgaacatagtaagtgatgtatggacatatcttcaaagaagatattgtgggtttggttccagaccaccgcaataaagtaaatatcacaataaagcgagccacataaactttttggtttcctaatgcatatgaaagctatgtttacattgtactgtaatcggttaagtgtacagtagcattatatatgttaaaaaaccaatgtataaacttcgtgaaaagatactgtatttttaaaaaatgctaatgatcatctgagcctttagtgagtcgtaattgttctgctagtataggatcttgcctcagtggatggctgctgactgatgaaagtggtggttgttgaaggttagggttgctgcggcaatttcttaaaataagacaacagtgaaatttgcggcatcagttgacttatcctatcacgaaagatttctctgtagcatgagatgccatttgatagcattttacctacagtagaacatttttcaaaattagaggcaaactcttcaaaccctcctgctgctttattaactaagtttatgtaatattctaaatcctttgtggccatttcaacaatacatatagcatcttcaccagctgtagattctatctcaagaaatcactttctttgttcttccctaagaagcagctcctcatctgtttaagttttatcatcagattgtagcaagtcagtcacatcttcacgcttcacttcaaattctagttctctttctatttttgtcccatctgcagttacttcttccactgaaggtttgaaccccctcaaagtcatcatgagggttggagtcaacttcttccaaactcttagtagtgttaatattttgacttcctcccatgaatcacaaatactcttgatggcatctagaattgtcagttatttccagaaggttttctttctttctttttctttttttctttctttctttctctttttctttctttctttttctttctttctttcttccttccttccttccttccttccttcctttctttcttcctttcttcctttctttctttctttttttttgactgggacctactctgtcacccaggctggagtacggtggtatagtcatggctccctgcagccttgatctcctggaatcaagtgttcctcccacctcagcctcctgaatagctgagactacaggtatgcaccaccacacccagctattttaaaaattttttgtagagacagggtctcactatgttacccagtctggccttgaactcctgggctcaagccatccttctgccttggcttcccaaaattttggaattacaggcataagttaccatgcccagcctccagaaggttttcaatttactttacccagatccattggaggaattactatctatggcagctatacccttacaaaatacatttcttaaatcttaagacttaaagtagaaattacttcttgaaccatcggctgcaaaatggatgttgtgttagcaggcatgaaaatgttaaccttgtacctctccatcaaagctcttgagtgactagctatgttgctagccaacagtattcttttgaaagggatgttttttttgagcagtagtctcaaaagtgggtttaaaatattcagtaaaccacgatgtaaacagatgtgctgtcatccaggctttgttattccattgatagggcacaggcagagtagatttagcataattcttaaggccctgggattttcagaatggtaaatgagcattggcttccacttaaagtcgccagctgcattagcctctaacaagagagtcagcctgtcctttgaagctttgaagacatgcgttgacttctcctctctagctgtgaaaatcctagatggcatcttcttccaagaaaaggctgttttgtccacattgaaaatctgttgttagtgtagctaccttcatcagtgatcttagctagatcttctagataacttgcgctagcttctacatcagcactgtctgtgttaccttgcatgtttatgttatggagatggcttgttttgttaaacctcatgaaccaagctctgctagcctccaacttttcttctgtagcttccttacctctctcagccttcatagaactgaagagttagggccttgtcttgtatttggctttggcatgagggaatgttgtggctgtttggatcttctatccagaccactcaaactttctccatatcagcaataaggctgttttgttttcttatcattcttgtgttcactggagtagaacttttcattttcttcaagaattcttcttttgcagtcacaacgtggctgtttgtggcaagaggcctagcttttgacctatctcggctttcaacatgccttctccactaggcttaatcatttctagattttgatttaaagtgaaagacaatgagactcttcctttcacttgaacactgagaggccattgtaggtttactaattggcctaactttaatattgttgtgtcttagggaacagggaggccctaagagtggtggagacaggggaacattcgtcagtggagcagtcagaacacacacgtttattaagtttgctgtcttatatgggtgtagtttgtggtccctcaaaacaattacagtggtaacatcaaagattactgatcacagatcaccataatacatgtaataataatgaaaaagtttgaaatattgcgacaattacccaaatgtgagacagacatgaaatgaacacatgctatttgaaaaaggtcactgatagacttgctcgatgcaggatttccacgaaactttaatttttaaaaatcatagtatctgtgaagagcaataatgcaaatcacagtaaaacaaggcatgcctgtatatgtgcaagaatggaagggtctccattttattaagtgaaataaggaaactattgaataatgctgaaaatattagtccatttatgaaaatgcacacacaccaacacaagatatatacttgtgtagtaaataggaagactgagatctgaaaaggatgtatacctaactgctaacaagtgcttacagctttagagaaaggaatgggattaaaagagacgagatcaaggggaatggtcacttctttacctatgtatttgtgaattttttaaaagaatgtatccatgtattatttatgcaaaattttctgagaagaatgaatgggaagtgaggaagtggatgcagatgttgaatacttttctctgaggtgcatgaatgtgaagggaaggagagagataggatagcagccagaagaagttcctgtttcgggaaacacttgtggactggggttttttgccgtcagtcacacgatggatgcacgggtgggctgtggagcactcctgggaagggggcatggtcaggcctgtgcccgcgcattacaaggggcgcattcctcactcattcatctgccccttggcttatttcttttcaagtcccacacagagaagcaaggccttgatcattatcagcacaactgctttactttccttcaggaaatgatacttaattagtatttgaaagcagtacattatcttgaattcactgtctattctaaggcaaagcacaccaaaaatctaaaatcaaatatattctccatgatgtatttacttttctaaggtgagagaattataaccgtattctttgggaatgtcctcttatactcacggaacaatgacttgggagagacaggaaaggcctggatcagaacacagaggactagattaagcttaatggaagctaggagtctgtggagtgggagtgctacaggtgtatcttggactgaccccatggactgggtttggtctatgagcagcagtattcactggaagtcaacctggctttggagtctcatcacagaggatgaccttgctatgtggaataggctgcctggggctgggactgatgacctgatgacctagcaactcgatttttaggaggcttgtttcagtctgggctttccagagaaactgaatgaataggagatcactctatctatctatctatctatctatctatctatctatctgtctatctaatctatctatctacctacctacctagagggatttattttaaggaattggctcatgtgattacagaggctggcaagtccaagtccaggccagcagtctggagacccagggcaaagctaatgttgtggttcaagaccaaaggccgtctgctggctgaattccttcttgctggaggaaagcagccttttgttctattcaggccttcaactgatttgatgtgggccccccacaatatggagggcaatctactctactcaaagtccactgattcaaatgtaaatttcattctaaaacacccttacagaatcatccagaataatgtttgacctaatagctgggcactatggcccagccaagctgacacataaaattaaccatcacaaggcatttgttgacataaaccctagactggcctgactgtccaaagagggtggtgaataagccctggcttgggtaagaccaacttattcactatgatgccccaaggacacgggtcagagacttcctaacagaggtactagactggcctcctgttgacactgagaggttcagttttgctttgagcctcagctcaacactgagaccctaaggagtctccttcttccatggctagtgccttccaggggcacatggagtccaggttctttcttctggtttctcttgtctttcccctgaggtgtgtgggttagtttttcttcttcaggatttctgaaaataggaataataatcttattccagaagaaaggacataattatgttaaacaaaaagggaacattcccaacttgatcacagtgatcgtgatgtggagatgttgtgggctgctgttgcctgtattctggagacttgtggtcacagcagtaaacaattgctgctgggcctgttgtctgtcagctgccatctgctccaaagcaccccctactcttcgcttgtccctttagttgacctgggcctcagagcctgtttctgaggatatgggccacagaggggaattgaggctgcaggctgattacatagcactggtggtagtttcttttaaagtcatgttctgatctgtggttgcaaatgtctgctgcttctgtcagagcattattcccctttcatgtggaagaaaactgccattgattagaagcaggagtatcatcgtcagtagaagcacttgtgctttaggttctttgagcctcatgagaggtccaagatgacactgaagtaaaggaaggtggataccagatgccttggctactttttagaatacatcactggcactgctaggagagagctgggattcatgagagtgggattaggtgctgggccaggagcagagagtgttctttgtactgtggatctcccttacttgcttcctggacaactggctcttccggactgggtctcttggtctatccttgtgtccttaggggcaaggtgcttctccactttgaagctaaaacaccatatcagaatcctaccaaatacatagacattttaacatgcagcaaaacaataaaatctctttggtggcttagttgctatagaaaaagacaaatgttcccaaccaaagtgcccatcaatgatagactagataaagaaaatgtggcacatacataccatggaatactatgcagccacaaaaaggatgagttcatgtcctttgcagggaaatggatgaagctggaaaccatcattctcagcaaactaacacaagaacagaaaaccaaacaccacatgttctcagtcatgagtgggagttgaacaatgagaacacatggacacagggaagggaacatcacacaccagggcctgtcagggggtggggggctaggggagggatagcattaggagaaatacctaatgtagatgacgggttgatgggtgcagcaaaccaccatggcacgtgtatacctgtgtaacaaacctgcacgttctgcacatgtatcccagaacttaaagtaaaataaaaaaaaaaagacaaatgttctactaaatggtgagcttagcttggctagcacagtgtgggtagatacattttaaggtataggaacattgagggacttcatgtctgtgatattcagtaatttctttgaagtaggagggaatgctgtctctgagagagttgtgactgctggctgggtagccttagagcatggtgtagagaataggaaaggaaattaaccagggatatgcccaagtggctaacacttgctgagggcccacttgaggctggagacctcatattgctaataacaccagtttggatgaatgtatcatttccagaacattgtgtatgttgaacattgtgtatgttcaacaatgtatgttcaagaatgcagaagctggctgggcgcggtggctcacgcctgtaatcccagcaatttgggaggccaaggtgggtggattgcttgagctcaggagtttgagaccagcctgggcaacatggcaaaacctcatctctactaaaaatacaaaaattagctggatgcagtggcacatgcctgtaatctcagctacttgggagactcaggcacaaaaattgcttgaacctgggaggcggaggttgcagtgagccaagattgcaccactgcactccatcctgggcaacaaagtgagactctgtctcaaaaaaaaaaagaaaaaaaaaagatacagtaaaagttgtgagttgagcaaaatgttatatatttgtttctggtcttggaacaatgtacttgggagggccagactcctttctctgcctgagataagagatttcgattcagagcatcttaaacagaattaatttctgtgccttaaacttttccttattcttccagaaataacattgagcgatggtggatgactttatagatgtctgatttttttcttctcttacatagcctcatatattttttggaggaagcagaaagaaaaaaattaagtcatgggagcagacaggataagggaagtagaaagtagaagagggaaaggaagaaagagaaaaaaacaaaaacaaaataaagtgagaacaagcaagagaagatttaggttgaaacagacattcatattcaaaactcccaagtagctagttgtatgggactcttagcgctctcttcagagagcggttccaaatctcacaagaagaagggagcaaaaaaaccaacatgaccagttttttgtggcacaggggaaggaaacacattcaatagttgtgattttaggcttcttttttgggatggaagtgtcagtactggagccagaaactatttcctttactacctgtgtacttgcttttatgacgcttagaaaatgtatacactatagctattaactatgtctttttagtgtaagaaataagaacacatagtataagaagactttctttggggagagaagacttcttggtattttcatccattcccctacttcccctgctcccccatccttgcatccaaccaattgcttggatcaaagcacaattttagtattatttcaacctgctatgtcttgttggatggcaaatgaagagataacagagtggcatgcttcaaaggggcagtgtggttcagcattcagcaaaagaagaggattaggactgctgatcttgaccctagattgctgggtaactttaaggcaaaacaatttaccaacctgtgacccagatttcttatctttagcagagaagtccagactagatgatttctcagggccaaattttaaggatttttgactcaaattctgctggaggttcagtttttggggaaggctgataatatcattagaagtaggtatggccaatagaaaagagtataatcccagaaaagagggtacttcacaccagctctgtcactggagatggtcagagactgtttaacaaccctttgatcctaaagcaaataggcatgtgaagctaaattctgttagccgaaatatggcttaaatgtggctctagtagatagtgttgtgagttttaaagtatatagatagaatgacaagcaggaactgactgtctaaataggggctagaattgatttcttagctagaatgtgttgaacagctattattaaaagtagagaaaatgcaaaagtgcaatcatgtggcttttcttcctggccctaaccctagcctcagccctttctttctttcttctcatttctctggtgagctcattctcacagtttcatctttcacatatgtgcaggtaacaggtagacttgggtttatgtctcagctgtgccttactaattctatgctcttgggtaagttaatttatttaaatattagtttcctcatctattatatagggatactagctgataatagctactatgttggtattgttgtgatgattaacatgataatataggcagtgtgtttaggatagtactgtcaaataataagtaaccattttactgttatttattattcctaaatctctcaaagcttatatcttatctgtcctccactgcttcagttgtctattgctgtgtaacaaacatctcaaagctgtgtggtctaaaatagtgattttatattttatgattctgtgggttggcctgggtgcaactgcatagttcccctggtataatttagaatgtgtcatgcagctgcagtcaagtggtcacggggacaagaatatctgaaatggctttacttacatgtccaataccttagcagggataactggaatcctaatgatatctttctccaggtgctgtctctctcaggttagcttgggctttttcagtggctggatctcaagaggaaagggttccaagagagcaagctccattgtgtaagccgctgtttgcatcctgtttgctaatatcaaaattgccaatgtcacatcagtcaacatgtctaggactagattcagtttgggaagagctacagaagatataaatatcaggtggtgtggtacattggagccaccaaaataagtctgccatcagataaacaattaattcctcgcttttatgagcatggaattggtgctagatcataaactgactatcctcattttaccaactttcccttaattgttttctgtgtcagtttttcatatttccaagttgaaaccccctaaacacaacatttttttccactgctcattttttaccaaaattcaaacttcatgaaaccctggcatttcatcctttgccttccatcctcatggccaccatcaaagtccacatctttattatcttacatgtgaacagctgtaataacctttccagttattaattctttaaacaccacttttagcctgatgcatttcttttcaagaacctacggtatgtttatagtccagattgcattaaacctaacctttctgttatagggcccttttctgaggccttatttatcttgctctgcaccatttatataactattttctggctgagcacagtggctcattcatgtaatcccagtactttaggaggcagaagcaggtggattgcttgagctcaggtgttggagaccagcctgggcaacatggcaaaatgccatctctaccaaaaatacaaaaattagccaggtgtggtggtgggtgcctgtggtcccagctacttgggaggctgaggcaggaggattgctggagccagggaagttgaggctgcagtgagccatgatcatgctactgcactccagcctgcatgacagagtgagatcctgtctcaaaaataaaataaagtgaaataaaaataaaaactattttttactattgtatgccctccaccctccagaatcagagtgtgatgaggcaagttatttaataagagagttttaagttcatgtatattataaatatcttaacacacagaggggaacagaggagacaatgctgaggtagagtaaaaaccctgaagacaagatgtaaggaggaagggattttgttgttgctatttgtacttttgagaattaggaaggagggaaaaggggaatcaggaaatatttcagggagttagaaattagatccccttcacggaattccccaatatttaaacatcttgaactgtcttttgttcaccacactactcctgctgcacttgggttacgcatccatacccacgtggtctgtttttgtagttgttactggaatggtgcgagggtgtatatactaatgctgtgcttgatactcaatgagtgcttcataaatgcttgctggatgaagaatataagcaaaacttacctaattccttatcttttataaactaaaatggacaatattgataggagttaaatgaaagaatgaacgttcttatatattaaatggagagagatgcagaatgcagttttgttaattatcttcactattaaaaatagacatttgtaaagcatcagtatatgtgctgtatttgctgcgtctagagaggagctgggatggatgaaggcttagctggttatactgcacaatgagagtacctgtttcttctgtagatagagcatagaagatatactaggaacatggggaaaagccattatatattttcttttttagatctgcaagccttttggatgtgagaagattttttaaaaggacattaaaaaatagcttctttttcacataaggatacaatattttaaagtagtaaacatagaaaggcattcgcctacagaattctaatgagcatattcgttattcactgatactcttttgatggctgtgcatttcctttccaaaaacacaatatttttgtgaaaccagtggtagtattcgaccctggcaatcaagattgtgtaaggaaatggtaaacattttttggagaagagtctcccgcacctcacaggcttttaacaacaatttcaaatagcatattttaaagaactcagctctggagtctgcctaattattaacttctacttagaggcagctgcattcttgagggtggagccatgatcttcttttactgtgatcctgttttattcctttaaatactcagcacagctgaagaagaggtcctgttttcttactgaagactttcaggcaaaggagccgtttccaacttcctactaagtccacccagcatatgtcatgcaggggatgcggggaagaattttccttgcaagggccttctcagaagttttggagatgggccttgagctcttggctggaagcgtggttttccaaagtggaggctgcagtaatgctcgtcattgattgagagacgtgctgccggggctattttcatgggagtcaaataaaactctcttgtcttaagcctgctttgaaaggtgttttcctaatgattttacagtcaaatagaatgactgtgtgggagagtgtattaaataactggaacactctgggcagcttcccttccccaccctgtgcccctacttgcctttcccccaaagctcctcctcctccgggcacacacatgccgctctgttttctgttctggagctgcctgaattgtgtgatttttgtggatgaatgtgaactctttaatccagaaagaggtgccaggaacacaaacagcccggctaattggcattcacccctagggaaagtaacatggccaacaagctggttgcattatctccatgaggcacttacttaattaactttgaggagaaacctcaagctctctcaaatcacccaagaagcatttcgaaaaggaagaatttgccaagaaaaggctatattcaggaggtgttccatctcttgagtatgttggattagttgcagaaatacttacttaaggcagcttatatttttgtttaatctctttctgagctgcttatgatttcagcgtactgagaggaattttcaagaattgatttatattgaagaactcacatttcaaaatatcagcagttttgttgaagtatttctcagttgtttttgtgaaagtattgccaaccctgactgaaggtctgacttccaacaacttgttccatatgaagatactgacttcctcaaaggcctgtctgctgctgcctcctcagacaacagagcaggttgtctaaaccatggcacttccacctccagctttggaaggcctctgctagaagacattttctcataagtagtgcagatggtgccctaggagctgatgagcttcctgtttattcagtaagcgttgcaggaaatacaaagaaatgtcaggtgaccaaatgttctggggtcaccagagaagttcttaacattcccttactaatggaaatgagaaaaatctgtagattttcagctatctgaggaacaatttttgtctttaaataatcctctcccctcttctaattactaaaagtgcaaccaacaggtagcaaaagtgatatttgagcttcatccttcttttcttctgtccccgtaccctcaccttctagtgaaattactcagagactatgaagaatagggattggaagaaattgagagctcatggtggcaggatagcccacagaccatatgtgtctctgaataagggagaatttgataagtagaataagccatcagaaaaaaaaattttcaaatagtgattcctcttcaaaacattttacatattttctctaatataattattagaataaaatcattgaaatttagtattaattgaaacctctcatcagatttttatattgtgttacattgtgttatattgtgttcaagacacaatattcatttggctttaagagactgcactagaatgtaaaatccacaagagcagagacagtgtctggttcctttcagtgctttatcccttgtacctgaatgggacctagttcaggtactcagtcaacaatgaattgtaaaatgaaaaaatctaaatacagtggaggctatttggtctgcgggctcttctgcccttgggttctcaatttcttccattttctgttctaacatggaaatggaagttacactaaaagtaatatttaaaggaatcttatttatattgcttagcttctttctctcaagtaatttctagatcttaaagcacagatttaaaatattaattattaagctagaagtagagactttgaactagttggctggtattttctaaattaaattttaaaattttgagataattatagattcattcacatgcagttgtaaaaagataatacaggcagattccttgtactctttacccaattttcccccattgtaacatcttgtgaaacagtagtacagtatcataacccagatattgacattgattcattcaagatacagagcatttccatcatcacggtgattcctcaggttgcccttttataggtgcactcactccctcagccccaccttgggaaactacccatctgttctccatttctataattttgtgggcaacttatttttagaaacatttctccaacagctggcccctgagaagaaaagaccatttaacacatatagggttgatgcgttttgtaggtggaagccaggtatttatagatgcatgtcgtcagtgttgcctggtgttgctgtgccaggagtcagtgtggggtcctgaaatccagattactgaggtgttagtactgtaattattcttaccagaaaatgccccagccaaaagtggatggaattttcccacctgaattacaatacctccacaaaccaggccaagaagtgtcctcagtggcagagcatttctagcctttccgtgatgctcagatagtcagataatgtctgtaatccctaatagctacagaacagatgagggaaggtgtcctctctacctgtcaacttgtgactatttactgatgagtactgggactttgaactccccttttctctctatctctgaagcttatctttgctgctgtgcagttctttgcccctgtattgcgcctggagcttctggaatgccacaagatgctaaatagttcctaccttttccttttcttaccatcaatctgacttaattatctgatggtgtcactatagaaataaaagccattggcattcttaaacaagcagctgtgctgttagaagaatcaggagtcacctgatatttacagctatttgggcattgtgttacagttgcttgtattggtagctcagccagcccaaacatatctcttttagaacatgaggtaataaagccagtacataagatattggaggaaattgtaagtttgtatggattgaaattgtttctaacagcctacctttggcataaatcagctgtacatctttaaattttttaaattacataagttaaatggtatggcttagaagtaaaattttggcaagagatttagtatttcagacattgtatgttgcacttatttttaattaaattgttttaattattttgtcatcatctacaatcttaagtttcataataaaaaccatttttactttatggctataagagttgatacacagaaagatttaatggactcgtaaagccatgtcctgattgggtagtaatgaaggaatgcacagatttctaagctagctcccttcctttctttctttaatttttctttctttcatattatgcccaattttaaccttgtttgctagctgaggagttgctaagaattttaatgaactatctgggtgtctaatgttcttatttataaactttaattagccagttgaattgtgaagagaatggaatgtgtggttttgggcttctgggatgatatgcaaaataaaatagtaaaaaaagaaagtttactgagaggggcaatatgaaatgtgttagtcatatttgtatctgatctttgtaatttatctgattattaccatgggtactccatatacatgtatgaagatgtaaagtttttcattttcagcaaatgagttcctttttttttttccttttactttgttttctttttggagacagagtctcgatctgtcacccaggctggagtgcagtggtctggtctcggctcactgcaacttccgcctcctgggttcaagtgattctcctgcctcagcctcctgagtagctgggactacaggtgcatgccatcatgcctggctagttttttgtattttaatagagatggggtttcatcgtgttgcccaggctggtcttgaactcctgagctcaggcaatctgcctgccttgtcctcccaaagtgctagggttacagacgtgagccaccgtgcctggccaaattagttccttttgttacctagcctcctttgtcagttatctatgcattaaacggttttcagtgcctggtcttcagcattggattggatgatggctgatggaagaaaaaaaaacagtggttataccttggaatttagttttcagttactggtgaattttagatccaaggagactactaaacctggctcagttatttttggacaccaaaacataattttattggaaagcgaacacactctatcaaccaattttaaataaaaaaggtcttttgaatcagccagaagttaaaatgtgagcattgtgttctgagctgaagatgtcaggttatgtgagtacttgttctctatagactaatatagtgagccttgaaatatagtattagacaactgctttctgattatcttagtaccctaaattgagagtttcagtttgcttgggtttcaaattacttaaatgagaaataatattaacactggcccaactaatgaaaaattatgcaattgccactaagccccatgagggtggagactttgtaggtctttgtcactgttgtatttctagatcctagaatagtttcctgacacataagagacaccaatatcaattactgaatgaatgaataggataatagattgagaaattatataaggtcttagtcttttttgcagtatttcccttgggaaataaaataaaactaaaaatttatttattctgtaggtaaagaactgggctcgctatggtaagacattatataagcataaataatatactttaaaaagatgcctcagccacattcatacttgccctcttctagatattctcatctttgataaaatacaaggattcctaaaaacataatttcctgaatctcaaaacaaagcaggtagggtgcaaagccaacatatttgagtgctatatactaaaagtttatatatgggtgtgtacatatgtatatacacacacacacacacacacacaaaagatctataacaactgtttcccatcgtacaggtgagaaggtaagctcagttacttggagatgaaggctgattttgaatccaggtctgactccaaaattcatgcatttgacaccatgttatttactctgagtactacagtttaacatctgcggtttacttcacaaacttcttgaaggagttgttcgcatttactgttcccaaattgttactgaggttaatctagtgaatacttttcagttttatattacctgtcatttttggtaccatttgatactgaaggtcttcttgaaggtcccacttgagatcctatctgcatttggtttctaactcctggtttcctacttctgaccactcttgtggggtttcattaaatttgtaaactatttggttggggtggaaatgacatcttacctatatcgagttttcccatctgtaaacatgcatagctccccttttaagtcttttaaaaatgattttcaataaagttttaaaattttctccataaaagtcctagatactatttgttatcatcataaatatttttttaataactaacagttctaataatgtgttgtaggtgtaaataaaccgaatttttatatattcttgtatcaagcaagttgctgaattattttcaatagttcatctgtatgttctcctaactttaaaagaaactttttattttggaataattttagatctacagaagatttacaaagactttacaaagttcctctatacccttcacctagatttccctaaggttaactttttttttttttttttttttttttgagacaagatcctgctctgttgcctaggctgaagagcagtggcccaatcatggttcactgcaacctccacccacccaggctccagtgattcttgtgcctcagcctcccaagtagctgggattacaggcatatgccaccacgcctggctatttttttgtattttttgtagagacaggttcttgccatgttgaccaggctggtctcgaattcctggcttcaagcaatccacccaccttggcctcccgaagtgctaggctacaggcgtgagccactgcacccagccttacttcttacatatctgtggcacctttgtcaaaactaagaaattgatactggttacaacgctggttctaaagtatagatttatttggattttgccgctttttccactaatgtcctttttctgttccgagatccaatccagaatatcatggtgcatttagtcccttgattttttaatggagaaaatggtactgtctgcaaataataactgttagataccttagtttccaagtattgtgtgtgtgtaggtattaggtgtgcatatacgtatcttcctgcactagctcgtactgaccactccatccaggctcttcttgctctacatcctatacttctcccataaatgttggtgcttccttggattatgtcctttgccctttaatctgcgctggctacacacttttgagaagatcgcagccactttacatctccctgtagggattaggcacagcctgcactcccaaggcagccactgttagctctgattattacctctttatttctaatagattccttttttgaactctggattcatatagctgactgctttctggacatctctgtctgaattttccacaggcattgcaatttcactgtgtctgaagggaacatatatcattgtcttctcttgccaactttcccctcctgctgctccaaccacctccaagttatccaagacagaaaaacctgggacctatttctgaactatttgctttattctttcctcccttcttctctccttcctttttgccctctttttacctccctcccttccttctcctcatagcccctgtgaatcctgcttccttcatgtctcccgtatttgttaccttctgtccactcccacagttggtgcttccttggattctgtcctttgtccccactgtttcattaaaagctctcattctttcatgctattacacactaccaaactccttaacatagtattcagagcctctggtatctccagcctcatttagtcccccatacccccttccacaacacacacatacatacccctacactccatgctacctaattgctggaagttccttagatgtgctaggctttctctccctttctcctttggaagttatataagatgctttctttttgttcccgttctttcttttccttactattgctaattctttcagtctccaatcatttgtcactgcttccaggaaacctctctgttcaggctgggttagatgtattctctgagtgctctcaaagtagcctgtgtatatttttctcatggcacttacagtattgagctttagttatccgtgtaccagtcctcatcgcctcaaccatgctgtatgttccttaaggctaaagaccaatgttatattttcctttgggcttcctattgcttagcacagtacctggcacatagctgttacccataaatgttaattgaattaatgagtaaatgtattcaccatttatggaaacactgacttgtctgtttccaaaaaccatattctttcaccagggacagatctctctaaatatcagcttccttatttctaaatagggaaggtgtactggatgatcccttacactgctgataaattggtattgtatgattctaagattcatcatcctggggcatatacaaaagaaaatgatgtggattgtggaagatattccaaaataggagttccaaaatattttaagcaatggtggtaatgttgaaataataatttggctttttggtcctactgtttaactaatgtgttgagtgccaatgatctgaacacttgaacatttaagtgatttacttatggtgatcagagtttctattcctttgctgacatatctaaatcattttagaaagattgtgtcaattctcctttgctgaagattttcaagtcaaagttggacagttgtttgtcatggatattgtagatgtgatttaagatataattgtgtaatgataaggctaagtgaccactaagattttgctttatgatgagatgcttcaattttgtagtttagagcttttgcttttatgttacaatattttaaaaaattgaatttaaagcttggataacatactatttatttgtctaagtttaggtcttagtggatttaatatcaacattagaaagttaccagaagtctatgtttatcaaaattgttgacttccatgcatccaaaaactgactctagggagtcatctccggcttgttaaaatgagctgggttaagtcagtgtctaaagtccaatttagaaaggtctcttagcacagccttttaaaaaatttataaaaatgtaaaatacaaacacagaaaatcacgtttaaaaatttgtactttagggaattattcctatgtgaacattcttataactgttgctcaggtcataaaacagaactttgccagccacctcagaagcgttctatgccctgtctctatcacagactgtcttccccaatgaaagtgtagacttatttcagtcacttctttatttttcttaatagtttttgtcatagaaataggtattctaaaatagtctactttagtttggcctttgaaaatatatgaatttttagctgttttcatgtcatgtcttccttccatccttttttctcccttgcaattacttgctaaagaaattggattgtttgatctatagagtttctcagcctgggttttcttgattgctctaggtgtgtaggacttaagtgtttagaacaggcatggctgtttcatgcctcagtcctggaatgacattctacccagaatatcattctcttttgtctctcccttgccaataccttgctcatgtggttatcttctatctatactccaaaacttagctcaaaactcacccctcctagaaatattcccagccttttcatttaataatggatatgtcctattctgtagtctcctagcacctgtaaaaaactccagtatgacaccaatcacatggctgcaattctttctttttctaaaaatatatatgtttagagatgtattggaaggagttggcttacaccatagtgggggctggtgaggcaagtctgagatccataggcaggctggcagaactggcaggctagaattctctggcataggctgaagtggctgtccacaggcagaatttctgctgggaagcttcagctctgctcataaggcctttcaactgattgaaacaggcctgcaacattttcaagaataatgttctttactcgaagtcaattgttgaaacaggcctgcaacattttcaagaataatcttctttactggaagtcaattgattatggactttaatcacatttacaaagtaccttcacagcaacacatagattagtgtttcattgaattactggggactgcagcctagccaagttgatacattaaaaaaaaatcacactgcatcttttgattttctttctgaatctctgcttttctttttcctaattttggcctctgtaaacctttcatttttttcatgctttagcattgtgagggacttaatactgggatattttttcacaatatcttgttcaccatcttacctgtcactcttttccctgaggtactttgatccaacagacattcactcgattctgttgtgtgtcgggcagtgtgccactgctagggatacagaaatggataaggtatagttccctaccctcaaaaagctcaccgtcagttggtgggggacagacaggtatggtataaaattactgtgagtggtataaaattacctgaaggcataaaatatccagctagtgttaaaattttcctgatggtctcatattttctttacagttggtttattctccatcagaagttgaacaaggttcacatatcccttttgggtgatacgtctccaaactccctttataattgagaaattctctctttttccttgaactcatgaatgtgcgtattttcagtcatgtttaatatgatgcacagttggtatttttattctagattgctttaaagttttaacaatgctaacattgttacatatggatgtaacaaagttaactccctttttaattgagaaattctctctccctccttgaactcactcatgaatgtgcttattttcagttgtgtttaatatgacacacagttggtattttattctagattgttttaaagttttaacaatgcaaacattgttacatgcttattataaaggtaacatgcacaactgagaaaaaaatttaaatatcacaatgcatgtggaagtaaaatatcatttttatctcattatccccaaataattggtaaccctttgggattgtttcctactaatctgtacatattcaaatgtacagtttttacatattaaatattccctgtgctattactttgggtttaatttgctcttatttttctagatcataatgtagaagcttagatttttatgttttgtttatctaatacaaatatttaaagctgtaactttcccattaaacatgctgagttttcattatcataaaactagaaatattttctaaatttctttgtgatttattttctctgtttttttttgtttgtttgtttgttttgttgttgttgttgagacagggtcttctctgtcatccaggctggagtgcattcgtgctatctcggctgactgcaacctccgcctcccaggcccaagcaattcttgtgcctcagccttctaggtagctgggattacaggcgcatgccaccatgcctggctaattttttttattttttgtagagtggggttttgccatgttggccaggctggcctcgaactcctgatctcaagcaatccacccatctcccaaagtactgagattataggcatgaaccaccacgcctggccttctctgtgttttatttggaaatgcattgcctaatttccaaatatttggggattttccagatatcatattgctaacatttctactttaatacatcatatgatttcagtcatttcaaatgtattgaggcttgttttatggtcaagcatataatttattcttgggaacgttctatgtgcccttgaaaagaatgtagattctgcagatgttgggtgtagtgatctttaagtgtcattttgggcatatctgcatgcaaaagaatgaagttgtgccacataccacatacaaaaattaactcaaaatgtattaaaacctaaatagaaggggtaaaactaaaacttggaggaatgcataggtgtaaaccttcatgaccctagattaggcagtgattttttagatatgacaccaaaagtacaagcaacaaaagaagaacattgataaattggacttcatgaaaatttaaagtgtttatgcttcaaaggacaacatcaagaaagtgaaaagaggccgggcgcggtggctcatgcctgtaatcccagcactttgggaggccgaggcgggcggatcacgaggtcaggagatcgagaccatcctggctaacacatgaaaccccgactctactaaaaatacaaaaaattagccgggcgtggtggcgggcgcctgtagtcccaactactcgggaggctgaggcaggagaatggcgtgaacccaggaggcggagcttgcagtgagccgagattgcgccactgcactcccgcctgggtgaaagagcgagactccgtctcaaaaaaaaaaaaaataaataaaagtaagtgaaaagataccccacaggatgggagaaaatattctcacatcatatgtctgaacgggatttgtgtctagaacatataatgaactctttcaactcaataataaaaagacaatctaaaaatgaatcaaagatctaagtagacagttcttcaaagaaggtaaccaaatagccaataagcacatgaaaagatgctcaacattattacccatcgaagaaatgcaaatcaaaaccacagtgagatattacttcacactcaactaggatgcctataattgagaaacaaaaacagaccataacaagtgttggcctggatgtggaataattggaactctcatatattgtgatgagaatgtaaagttgcattggaaaacagtctgacagttccacaaatgattaaacatagagttaccatatgacccagtaatttgactcctaggtatatactccccccaaaagaaaacatgtctacacaaaatcttgtctacgaatgttcatagcaacgttatttacgtagccaaaaagtaaaaacagtccaaatatccatcagctgctgaatgaatgaatcaaagtctagctatacaatggactattatttggtgataaaaagtaatgaagtactgatacatgctacaacatgcataaaccttgaaaacattattctgagtgaaagaggcagtcacattttgtttatatgaaatgtccagaatagacaaatctatacagacaggttgcccagggttgggatgagtggtattagggacgtgtaaaatgactgctaaagaatgtagggtgacgaaaatgttctataattgattgtgatggttgcccaatgctgtgattatagtaaagcacattgaactgtatgcatgttttaaatgagtgaattgcatggcatgtgaattatacctcaataaggctataacaggtaaaacaaacaaaggaaccatgggtaccaacagttcagaataagtgccttcgatattacttagtattatggtgtctttggaaaaggaatttctcagatggagttaattgatttgaacaattcaagaccagtaggcaaattgccatagatggcttcccaagctggcagttaatttttttctgttaaaaatatatatttttttaattttttagagacaggatttcactttgttgcccaggctggtctcaaaccctgggctcaagtgatctgcctgccaaggcctcccagagtgctggaattacaggtgtgagccactgtgctcagccacaattaatgttttggaacatagttttcaaatgactatattaggaggatgaagtcttaggtaaatgaaacttacctgatttaaacaacagtatcatttaaatcacgattggtaatgctgttcacaccttccatattcttaatgatttattctcttgtcagtttttgcttcagatattttagagttctattattagctgctaaacatttaagatgattatggtgaccctgtttatttctggttatactacttgccttcaaagctatattgtcagatattaatatagccagatcagctttcttatactgaaggtctgcattttacccattttttccacagttttactattaacttgcctagtaaattaaggtgcttttcttgtaaacaacatagttaggttttgttttttcatcttgttgacaattgtttccttttagtggtgtgttggacatttatattcagtgttattattgatatggttagtttaaatctgacattttgctatttttctttttttaaaatttcttctaaaaaaatgggatacatatgcagaacgtgcacataggtatacgtgtgccatgctggtttgctgcacccattgacccatcctctaagttccctcctttcactccccaccccacaacaggccctggtgtgtgttgttccccactctgtgtccatgtgttcttattgttcaactcccacttacgagagagaacatgcggtatttggttttcttttcctgtgttagtttgctgagggtgatggcttctagcttcatccatgtccctgcaaaagacatgatctcattcctttttatggctgcataatattccacggtgtgtgtgtaccacattttcttgatccagtctatcattgatgggcatttgggttggttccatgtctttgctattgtgaatagtgctgcaataaacacacatgtgcatgtgtctttatagtagaatgatgtatattcctttgggtatatacccagtaatgagattgctgggtcaaatggtatttctggttctagatccttgaattgccgcactgtcttcaacaatggttgaactaatttacattcccaccaacggtgttaaagtgtttctatttctccacagccttgccagtatctgttgtttcctgactttttaataaccaccattctgactggtgtgagatggtatctcattgtggttttgatttgcatttctctgatgatcagtgatgttgagcttttttccttatgtttgttggccatgtaaatgttgtcttttgagaagtgtctgttcatatcctttgcccactttttgatgaggttgtttttttcttgtaaatttgtttaagttccttataaattctggatattagacctttgttagatgggtagattgcagaaattttctcctattctgtagattgcctattcactctgctgatagtttattttgctgtgcagaaactctttagtttaattagatcccatttgtcagttttggcttttgttgcaattgcttttgttgaggtctctgctctgctccattggtctatatatctgttttggtaccagtaccatgttgttttggttactgcagccttgtagtatagtttgaagtcaggtagtgtgatgtctctagctttgttctttttgcttaggattgtcttggctatacggggtcttctttcattccatatgaaatttaaaatagttttttctaattctgtaaagaatgtcaatggtagtttgatgggaatagcattgaatctataaattactttgggcagtatgtccattttcacgatagtgattcttcctatccttgaggatggaatatttttccatttgtttgcattctctcttatttccttgagcagtggtttgtagttctccttgaagaggtccttcacatcccttgttagctgtattcctaggtattttattctctttgtaacgattgtgaacgggagttcattcatgatttggctctctgcttgtctattgttggtgtaaaggaatgcttgtgatttttccacattgattttgtatcccgagactttgctgaagttgcttgtcagtttaaggagtttttgggcagagatgatggggttttctaaatatacaatcatgtcatctgcaaacagagacaatttgacttcctctcttcctatttcaataccctttgtttctttctcttgcctgatttccctggccagaatttccaatactatgttgagtaggagtggtgagagaggcatccttgccttgtgccagttttcaaagggaatgcttccagcttttgcccattcaatatattggctgtgggtttgtcacaaatagctcttattattttgagatatgttccatcaacacctagtttattgagagtttttagcataaaagggtgttgaattttatcaaaggccttttctgcatctattgagataatcacgtggtttttgtctttggttctgtttatgtgatggattacatttattgatttgtgtatgttgaaacagccttgcatcccagggatgaagtcgacttgatcgcagcggataagttttttcatgtgttgctgaattctgtttgccggcattttattgaggattttcacatcagtgttcatcagggatgttggcctgaagttttctttgttctgtctcttcttggtttggtatcaggatgatgctggcctcataaaataaattagggaggagtccctccttttcaattgtttggaatagtttcagaaggaatgatatcagctcttctttgtatttctggtagaattcagctgtgaatctgtctggtcctgggctttttttggttggcaggctattaattactgcctcaatttcagagcttgttattggtctatttagggattcttcttcctggtttagccttgggacggtgtatgtgtccaggaatttatcagtttcttccagattttctagtttatttgagtagaagtgtttattgtattctctgatgatagtttctatttctgtggggtcagtggtgatctcccctttatcattttgtattgtgtctacttgattcttccctcttttcttctttattagtctacctagtggtctaatttgttaatcttttcaaaaaaacagctcctagattcattgatttttttgtagggtttttcgtgtctctatctccttcagttcttctatgatcttagttatttcttgttttctgctagcttttggattagtttgttcttccctctttagctcttttaattatgatgttagggtgttgatttgagatctttcaagctttctgatgtgggcatttagtgctaaaaatttccctcttaatactgctttagctgtgtctcaaagattctggtacattgtctctttgttctcgttgttttcaaataacttcttcatttctgccgtaatttcattatttacccaggagtcattcaggagcaggttgttcaatttccatgtaattgtgtggttttgagtgagtttcttaatcctgagttctaatttgattgcactgtgttttgagagactgttatgatttcagttcttttgcatttgctgaggagtgttttacttccaaatacgtggtcggttttagaataaatgccatgtggtactgagaagaatgtatattctattgatttggggtagagagttctatagatgtctactagatccacttgatccagagctgagttcaagtcctgaatatccttgttaattttctgtctcattgatctaatactgacagtggggtgttaaagtctcccactattatttcataggagtctaagtctctttgtaggtctctaagaggcacaccccctccaccaagagagaaagtgcttcatcaaactggtcctattacccgtgccacccaattgggtgagaccctctaacagggggttgtcagacaccctatgcaggagcgatcctactggcatcaggttggtgctcctcgaggtcagaggacacagaagaagcaggcacccatctttgctgttctctagcctccttgagtaacatctccaggtgcaggagcaaatcagatagaatagggcctaaagtgaacccccagcaaactgcagaagccctcagaagagggacctgaccattgaaagacaaaaaaaaaaaaaaaaactagcagaaagcaacaacaacagcatcaacaacaacaaaaaatcccccacaaaaaccccattcaagggtcagcagcctcaaagactgaaaatagacaaactcacaaagatgagaaagaaatcaacgaaaaaatgatgaaaacccaaaaggccaaagtgcctcttctcctccaaatgatcgcaatgtctctccatcaagggtgcagaactgtatggaggatcagatggacgaattgacggaagcaggcttcagaagatgggtaataaaaaactacgctgagctaaaaggagcatgttctaaaccaatgcaaagacgctaagaacctttatgaaaggttagaggaattgctaactagaataaccagtttagagaggaacataaatgacctgatggagctgaaaaacacagcatgagaacttcgtgaagcatacacaagtatcaacacccaaatcaaccaagtagaagaaaggatatcagaatttgaagaccaccttgctgaaataaggcatgcagacaagactagagaagaaagaatgtgaaggaatgaagaaagcctccaagaaatatgggacttcataaaaagaccgaacctactatcgattggagtaccagaagaagacagggagaacagaaacaagctggaaaacacacttcaggatattatccaggagaacttccccaacttagcaagacaggccaacatgcaaattcaggaaatacagagaacaccaccaagatactccacaagaagatcaaccccaagacacataatcgtcagattctccaaggttgaaatgaaggaaaaactgttaagggcagccagagagaaaggccaggtcacctacaaagggaagcccatcggactaacagcagacctctcagcagaaactctataagccagaagagattgggggccaatattcaacattgttacagaaaaaaattttcaacccagaatttcatatccagccacactaaccttcaaaagcgaaggagaaataaaatcctttccagacaagcagatgctgagggattttgtcaccaccaggcctgccttaccggagctcctgaaaggagcactcaatatggaaaggaaaaaccggtaccagtcactgcaaaaaacacaccaaaatataaagaccaatgacactatgaagaaactgcatcagctagtgtgcaaaataaccaaatagcagcatgacgacagaatcaaattcacacattttgctatttttctaattatcctatctgtcctttaccttctgtctttccctttctgccttcttgggttaattgagtagttttaaaatatttcattttgcccttataactcagctgccaaatgtttgggttggtggggagctaaccttgctcttgaactgtactcctggctttccacatcttggaagatctctctttatcctgctggtcattggctttgcatttggtgaaggctcagtgcttctcagaaggatcactttcagccctttgacctgctcccagccttcagtggactgctgccttgcattctgcaaaggcccagtgtacttgaagaggatctcttagcccttctgttctgttcctagcctttggtgtgtggtacttgtgcactgggtggaagctctatgggaaagaactggcaggtggatatggagttgctctttgatcagggctcttcagaattctaattcctcacatcagcagctaataaaagtttcttaaaaattcagctggtttcttcgtggtcccatttttggcaagtttattcctccttctatcagagatgaagcagctatgcatctcttttttgggaagaggtcatctgtatatcgaatttatttaggagatgaagcagctatgcatctctattttgggaagagatcatctgtatattgaatttagtttatttaggttttttatgcatctcagctcagatagtttttatagaaaatctatgattttgtgacttcctcaacttcttgttgtagactctggttatttttaaaacttgtaatttaaaaattatatgccaatggaaacactcttcaagaatcttacatgtaatgcttattgcttagtggtttaatgaatgacaacaatccctgagtgtgggaatagttgaggtctacaaaaggttaatgagtaaatgaattatgtttactttgggtattgagtcactggtactgatctggccatacacgaatatccctaatcaccctcatgactagtaatacacatttataagatggtggaccagagctgggctagcgttgattgataagggacagaaagaaagtatagcgattgattattcagccttgcctcatgggcatttgtacatccttatgagttaaagtgagatgcaaatgcattcttcattaaaatggcttatctgaatcattttagagctgtatgcaataatttgcttatactcattaagataagtttggttatgttgattaaaaacaaagcttattttctgcattttccaataatattgtaaaaaatacttcatacccttcattgtttgggtttcatgtcttcattacattccttttacttcgtattatcttttaagattttgtagaagaatttcacttgggtaactgtaggcttaaatgatgcaatgctttctggaatccaggggtgactgacacacagaggtgactcagacatgaaatgttcaacaaaattctaagattgtcttttttttaaattgtaaattcttaaacattcataaaagtagtgagattagaataatgaaatcctgtgcttctaatgactgttaacacaagtgaatcttatttatcctatccactttattaaaaatttagttatctattatttaaaataatatattagcttattttaaagctaatcccagatattatgtttcattttgcatgtctgttgctgtcttggtaggaaaaattttaaaacataaattactatgacataatgatatctaacaaagttaattatttaagaaactttcaaaagttgctttttcatgccgtttccctagctacctataaacacctggaaattatatttattttatatttctaatgttattcaaatgataatatgctgatttctaaaattgcatttttttctgttgctctcaagaatatcctaaacatatccataggatgtgggatgacctatgaaaatagtctggacaaacatttatcttgtttatcttatgataagcagagttctgagaagtttggtaataaagagttaacttggtttaactaagattttcctaaattatttgacaccagaacctattttttatttaacatctgttagcaaaaatatatttgggggaatattgttctaggcaggagaatgctgcctctgaatagcaaaataatctttacttcatttttatttcaattaattaggtaattatttgtccatattacattatcatcataattaagtaatttttttttgtttttctgtaatctgcttaatattgataatgtggtgtgacaagtcatctttctcaggatcttattttatgaaaatctttcatcacacttattttatgaaaatcatttgctgtgtaagcaaattaagtataagcattttgtgtttccactagatagatatttgcacacaaaaaaatagacatcaaaatcccatatagaaagctaaatgcatctatagttcattgaagaggaagctagaaataagatgtgtagaagtcaaagaaatagggccgggcgcggtggctcatgcctgtaatcccagcactttgggaggccaaggcaggtgggtcacgaggtcaggagatcgagaccatctggctaacatggtgaaaccgcgtctctactaaaaatacaaaaaattagctgggcgtggtggtgggcatctgtagtcccagctacttgggagactgaggcaggagaatggtgtgaacctgggaggcagaggttgcagtgagccgtgattgtgccactgcactccagcctgggtgacagagagagactccgtctcaaaaagtcaaggaaatacagctcaaattataacagtgaataactagattttgtttcatttgtgaagaattggcaaataacttttaaatagtttcaacataggcagtagcatgggaattctcctacacttttatgtacccttaaaatatgttcactttaaaaaatgtaaatagttaacaggggcgattgaaagctaactgcccaacaaaggaaacaattctccgtgtgtcccccttctctgctcaccctgtgacaccttctctgctcaccctgtgacacaggagcgacaaggaactcacaaggcactggtgccctagtagttctgcatctcatcctctctcatacagtttagttgacatctgctccctgtcactcacccatacccccaacctcaccaatcctccaaagtggattagttgttgcttaggtgtgttttgtctttatattgcgtaaatattgtgaagaaggctctttcctctgtggtgctacaaagataattttttttcccgttacagtcaagctacaacttcaagcagaagagagaggagttgtgtctatcaaaggagtgtgtgctaaccgttacctggctatgaaggaagatggaagattactggcttctgtaagcatactttctgttttcacacgttttttgttagcttttattgctgttaatttaccagcattgttgtttatcaaatctttataaaggattttacgtgtatcatcgtcatagtcaccctgtaaaatagggagtattttctttatttcacagatgcaaaaactgatgtgctgagggagtaagtaaagtaagaaaacacagctcatataaagtagagactggattgggctggaggcattcctgacctctaagtcactgcttttactctgcaaaactattaagctataatttaaaaaaaattttcttctattatgcagttgtttgaagatcattgggaataaatgtatacaattttgattattagtttttaagtttcttctttagaatgtgacgtacaaaacactagcaatgtagaacactagttgagaatgtaagctttctgcctggtacagatgccgactctgccacttatgagctctgtgttcttgggcaaatgattctgagttagttctcttacctgtaaaatagaaacaatgatactatctcattgggattttatcagaatttaattagatactacacatcaagtgcccaaatcagcatctgacacgtaatagatcctgaaaattgttacttcttcctcacattacttctcatttacatatatgtcaggagagggacttttttttttctttttttttttgagatggagtctcactccactgcgcagactggagtgcagtggcgtaatctcgggtcactgtaccctctgccttctgggttcaagcaattctcctgcctcagcctcccgagtagctgggattacaggaatgcaccaccatgcctggttaatttttttgtattttttagtagagacagggtttcgccatgttggctgggctggtcctgaacttctgacctcaggtgatccgcctgccttggcctcccaaagtgctgggattataggcgtgagccaccgtgcctggctgtagagaggaacttttcttttttacatgttatcacagcttatcaggggtcctagttcctggctagtattctttccactagtacaggctccctgtcaacttcaccattattattagaaacgggactgcatatctgttgaacatatgatgtataaagaatggtgcaggaaaataaatataaaagacagatctcattcctgtctccgtgagggagtagataggacatgtatgtaaatgtttgtgcgtgtgtgtgtttcacagctcttacaccaatgccactggccagttatgacatctctatataacctccccacagaaaggatctaacagtactaagaaattgtggtattttgagctatacaaatagtttttgaaatttcttctgaatgaagacctttggatttctaaaagcaccaaaacaaggcttacagagaaaaagggtatctaaactatcccaatttcagactgactgtatgacaaagatatacttacattgatattaccagtttatgtaatttttgcaggataaatcacaagtttgagtgtagtggctctcaattttggggggaggtagttgaataaattttagaattctctttaagaatagccaatacttattaagtgaaagtgtgccagatgctatggtaggcattgagcttataaaattgaatatcaaattgtctctgcccttaatgagtgacaatccaggggaggcagaagtgtaaataagtatttataataatgtataagggttttgatatgctacttctatattttgcatacatgcatagtaatataggaaaggataagaagtattatgatataggaagcaatatagaaaatgaggtaattacatttttctagaattgggggagatgacctataagtagaattttagacgttgtaaaggaaggagttcagcaggcagtcatggggcagaagaaattgagatgaaggtatagataactctaggacataggacatgaaaaggtgtggataaaaaatctacttgatgtatctctagaattacaagtaattaactaatgctggaatgtatagtgcaatggagtaactaggtggaagggaagggagagaaggctggggaggtagatagactgtctgctgaatctgttgaagggctttatacaccatgctgactataagcagtggagagccatgaagagttttaagaagagatctaattagatttaaatttgagaaagatcatcctggcagaagtgtagagaatggacttgagggggccaagactggtggagagagatcagttagaaggccactgtaatagtccaagcaagtcatgttctgatcctggcaataacagtaggtcagagaggagtgaggaaagtgctagcacttgtgattgattagatttaggactgaagatgaaagaaaagtcaaagatggcttttaggttgctggtttgggtgagaaggtagacgagaaaggggaaggaagaaaagagcaaggtttgggaaaaggtagtaagttcgaatttagacctatttagtttgagttgcctaagggaaattcaggtaaagatgttcagtgagtagttgaaattataaatctggagcttagaggaacagtctacattgattgttagatagatttgggtatgatcagcatataggtggtagttaaattgggggaatgtatgcagtttcctaggtaaagaatacagctcaaaacattaactacttgggactttcacttcttctactctgtacttgccttttattctgccaatctattgtcagctcaagaggtgatgtaatagtttgggaatctaccaaagtagcattttaaatatctcccatgaaagtgaaccaataagtaattttggatgactgacattttattagtgagaggaagatgagtttccaaccctcctgcccctttcactttaggatgtgacaaatcactatgcttctgcagtagaattggtttggctactgtcagacagtgagggtggtagaggaaaaaaaaggagttgcacacaacatttgctcctgttataactaactatggacagcactaataaaatggttttaaagctccagccttttatatgtctgccataatctgggtcagtgaatgccttgagattagttgttaccctgtggtgttgttgagattagaagatgcagtaacctagtgcattagtccattttcatgctgccgataaagacataccagagactgggcaatttacaaaagaaagaggtttaattggacttacagttccacatggctggggaagcctcacaatcatggcggaaggcaaggaagagcaagtcacatcttaaatggatggcagtaggcagagagagcttgtgcaggggaaggcctctttataaaaccatcagatcttgtgagacttactatcacaagaacagcatgggaaagacttgtccccatgattcaattacctcccactgggtccttcccataacacatggaaattcaagatgaaatttaggtggggacacagccaaaccatatcattccacccctggcccctccaaaatctcatgtcctcacatttcaaaaccaatcatgccttcccaacagtctcccaaagtcgtaactcatttcagcattaactcaaaagtccacagtccaacatctcatctgagacaaggcaagtcccttctgcctatgagcctgtaaaatcaaaagcaagttagttacttcccagatacaatgtgggtacaggcattgggctaatacagccatcgcagatgggagaaattggcccaaatgaaggggctacaggccctatgcaagtctgaaatccagtgaggcagtcaaatctttttttttttttttttttgagatggagtctcgctctgttgcccaggctggagtgcagtggcatgatctcggctcactgcaagctccacctcccgggttcacgccattctcctgcctcagcctcccgagcagctgagactataggcacccgccaccatgcccggctaattttttgcatttttttagtagaggcagggtttcaccatgttagccagggtggtcttgatctcccaacctcgtgatcttccccccttggcctcccaaagtgctgggattacaggcgtgagccactgcacctggcccagcagtcaaatcttaaagctccaaaatgatctcctctgactccatgtctctcatccaggtcatgctgatgcaagagctgggttcccatcatattgagcagctctgcccctgtggctttgcagggtacagcctccctctcagctgccttcacaggctggcattgagtgtctgtggcttttctaggtgcatggtgcaagctctcagtagatctaccattctggggtctggaggatggtggccctcttctcacagctccactaggtggtgctgcaatagggactctgtgtgggggctctgaccccacatttcccttctgcactgccctagcagaggttctccatgagggccccaaccctgcgcaaacttctgcctgggcatccaggcatttccatacatctgaaatctagcggaggttcctaaacctcaattcttgacttctgtgcaccctcaggctcaacaccatgtggaagctgccaaggcttgatgcttgcaccctctgaagcaacagcctgagctgtaccttggccccttttagtcacagctggagcagctgggaagcaaggcaccaagtccctagactgtacatagcagagggaccctgagcccagctcatgaaaccattttttccttgtaaacctctgggcctgtgatgggaaggactgctgcaaaggtctctgacattccccagagacattttcctcattgtcttggtgattaacatctggctccccattacttacacaaatttctgcagcccacttgaatttttcctcagaaaatgggattttcttttctattccatggtcaggctgcaaattttccaaacttttatgctctccttcccttataaaactgaatgcctttaacagcacccaaatcacattttgaatgctttgctgcttaaacatttcttccgccagataccctaaatcatatctctcaagttcaaagttccacaaatctctagggcaggggcaaaatgccaccagtctctttgctaaaacataacaagactcacctttgctcagttcccaacaagttcctcatctccatttgagacctcctcagcctggatttcattgtccatatcattatcagcattttggtcagaggcattcaacaaatctctaaggagttccaaactttcccacattttcctgtcatcttctgagctctccaacctattccaacctttgcctgttaaccagttccaaagtcacttccacgtttttgggtatctttcagcagcaccccattcctagtaccaatttactgtattagtccattttcatgctgctgataaaagacatacccaagactaggcaatttacaaaagaagaggtttaattggacttacagttccacatggctggggaagcctcacaatcacggcggaaggcaaggaagagcaagtcacatcttaaatagatggcagcaggcaaagagagagagagcttgtgcagggggactcttctttataaaaccataagatctcatgagacttattcactatcataagaacagcacaagaaagacttgtctccatgattcagttacctcccactgggtccctcccgcaacacatgggaattcaagatgagatttgggtgggggcacagccaaaccatataacctagtaatcatggtgactctgtaagataattgccggtggaatttttcatctcctcaggagcactggctgaatattgattcattgacaatgataaaaagacccattgttgttaaaagtgatgaaaacagaaattgctctatcttcaagtgtatctctgaaactactagggtacataaaaagatgagacaagttaaaagaatgtagacctgaaaagagaattctgactttttctcttggcaaataggtattaagcttcccaaactgttgattctgtaccatcagaaatgtaaaatactcaaaataaagttttctagtttcattcttagctaagcaggaacttgtgaaagttagtcttaaatgtgtttctatctctttggatgtattaactctttctgatggaacagatttccaccaagttggtgcagtaagaattaatttaccaatgcttagaaatgtatcacaaacactctgtagagacaaagccatggctattaagcataaattaaaaattcaggatttcttagtctcctttgaggaatggcatgaccaagatccagttgtacgtttcagctctcgtcatacgacctgttcacaagttaatctctagtcttaccatccaatttgtgtggcttgatgtcatgccttttcagcagcaatcctgtctctttcaaatgttcttggtgggctgtgtcaatcttcagatgaaaaagtaagcgtgccccacctcaacaccaaagatatggtgttggtgattcagtaagtggcacatttctctccgagtcagatccatagacattaaactgtcaacaacagcagcttttggtatgagttcagtgttctgaccagtagccatcatctggggatgcagatgtgcctcgtaacttgaagaaactggaatttatgaacttgcacttgccagaggcatagtccttcccactcttctacctggccctttttcagactactgtgttatgacacatccctgggttcttctccattttactctgtgattcctgcagtgatttctaaagcagtctagtttcctcccagaaagaagagtgctgtggatacaaaaaacattttggtttttaagagttatgttaggttgattaccaattagagtatgaaaaaagactaatttgtataccgttttttccccaacaccttcacatattaatggtatgcatgttttcaggttaccgattttgtgttgtttgaaaacatttcttaagggtctttcctttccttttgaagctaggaaataggaaaattcaaaaaataactatatttaattgccaaagcctgtatttggaagctgaagttaaatagttctttaatgcacaacagacttcttactccattccatagcaggataaattttgttgctatgagcaacagaagtccagaacaaatattagaattgatgatttaagtgttcacaaaattacagatttttaagaaaattgcataaagtgaagttaattgtagttttaagtttaaatcaccaaatgacctcaatgttagcattggtatgaaaaaactttactgatcttcatctgccagaaagttgcacattgttttctatataatgctatatagatcatgatataccctgaacaaaatattaatatctcagtattagaatgtaatttgcattgatccacaatagtgaaatatgaaaaaatgtatattctctgaggatatacatgtaatttctgtaaaagtaaaatacattttacctacagaataactttcttaattgaggggccttcacaatgacatgaaatctataataaagtaaagtagagaaaatagatatctgagagcccaattatccagactgacaatctatactgatgaaatttgtgagaaaaatacagtaattgaagaggaatatatatcctttttaagagataaaatactagaaaaaatacaaaggttattgcataatgagaattactgttcttttataactcaatcttaaaactgttatgcaacctataggtattacaggtttaagatcaaatttaggcctggcacaatggctcatgcctgtaatcccagcactttgggaggccaaggcaggtggatcacttgaggtcaggagtttgagacaagcctggccaacatggcgaaaccccatctctactaaaaatacaaaaattagccgggcatggtgatgcacacctgtaatcacagccaacttgggaggctgaggcaggagaattgcttggacccgggaggtggacattgcagtgaatcaagatcacgccactgcactccagcctaggcgacacagtgagattccatctcaaaaaaataaaaaataaaaagatcaaatttaattttaacttttcactatttggatgtttcttttttttctgaaatagtcaacattgatacttacatcatgtctgtttttaattctcagaagtggtataagcaaaagcacttttggattcctattgagcaagctccctcaaaagccaaaactgaaaaatcaatgtactgtaaaagaataaacaacccagtaaacagagcatggggaaatggtcataaggttcaaatctaaaattaggagtggactagtattgtgaggccgatgcataaggaagggagagttggggtgagaggaggtgctggggggatgtgaggagaacttggctcatgtgcttatttctttccttattgtgtactaaggctactagagattaggagggattctaaagaccatctaatccaatcttcttattttacagaggaggaaagtgatgcctagagaagttaaaggacttgattgaaaatacaagttagttagggatcaaggcgatattagaagctaggtttcttggcccttcagagatcctcacagatgtcaagtttggatagtcaactcttggaaaggtcatctggtctattttccttagggagtaaatagttcataaagttaaaccatattctgtatttcagttcctagtctggattttccccagtcctagttctctagttcttatttagattttgtaaatgtcattgaattatatttttattgtaagctatctgaaaaagttccatttgttcattaatttagcaaatacttattgatgacttactatgtgccaagcactgatacagcagtagacagaatagatgaatatcttcacaaacatgctgttgacagtctggtgaaataaagtgatatgtatatatgaatcatctgtatttgggcatagtagagcacaggaatgcatgaggtgcttttatttttcacattatagctagagttgctgtatctagtgacttgagaaatccttttttgtgatggtacttgtagccctagagtcagttttgtaaaaaatatattttagttttacaatggtattagacttacagaaaagttataaagatgacacagagagtatctatatactccacactgagtttcacttttattaacatcctacattagtttggtgcacctgtcgcaactaatgaacccatactgatatgttattattagctaaagtccatactttattcatgtttccttagtttttcctaatattctttttctgttccaggataccatatttagtcatcatgtctccttagtttcctccagactgtgacagtttcttagactttccttatttttgattactttgatagtttgaggagtactgttgaggtattttttagaatgtccttcaacttgcttgattttttttttcctttttttttttttttttttttttgagacaggttcttgctctgtctcccaggctggagggcagtggtgtgatcatagatcaccacaatcttgaattcttgggctcaagcgatcctcctaccttggcctcccaagtaggtgggactacagatgcatgccaccatactctactaatttgtttttatttttagtagagatgaggtctcactatattgcccaaattggtctcgaactcctgggctcaagaatcctcctgccttggcctcccaaagtgctgggatgacaagtgtgagccattgcacctgacctgatgtttttttcatggccagatagggatttgagtgtttgagaggaagactatagaagtaaagtaccatttttgtggcatataatggtatatgttatcttcatgactgataactcatgatataatccttgcttacctggctgaggtagtatttgtgtccactgtaaagttactctttcacttcctttccatactatactgtttggaaggaagtcaccatgcatagtccacacttaagagatggagatgatggttatgctccacctccttgaggggtagtatctacataaatcgtcattcttttgcctgggaaatgtgttcattttcctccatttatttatttattcaatcatttatatcaatatgtattcacagatatttattttatactttgagttacaatccaatactacattatttattttgttgctcaaatagttccagctttggccattgggagctctttcagttggctcctgtgccctcctctttgacatactctcaacaatgcatttattttaagtacttcattactttttggcctacaagatgctccaggctcattttgtatattccctactccaccctagaatgagccatttctccaaagagcattggtttcttttattagagaatggtattagaaaccacaaactggaatgctgggtgtgcttgttgctactgaagtatctttgcttctaagccctctaagcttaagctgacagagcaagaaatggtggtacatactagcctgggtatatacatgtatttataaatatttctatatttggccatctgtatcaatattaatatgaggcagagcatggtggctcacatctgtaatcccagcactttgggaggctgaggcgggtggaccacgacgtcaggagttcgagaccagcctgaccaacatggtgaaaccctgtctttactaaaaatacaaaaattagccaggtgtggtggtgcgcacctgtaatcccagctactcaggaggctgaggcaggagaatcacttcaacctgggaggcagaggttgcagtgagcctagatcgtgccactgcactccagcctgggtgacagagggagactctgtctcaaaacaaaacaaaacaaaacaaaaacatctaaatatgagttcattcatactgatatctccaaccttaatccatcaataacaaatgaatattttagcagtcccccccacttgcttgtgtgtaacctgccacccccaacagtgagaaacatggctcccgccatctcctgggatcagtttttcattatgtagaaatatctcacataaccttattttctttttgaaattccaaagtaaattaactatccagacaaaaaacaaacttttaaaagtgttgattatgctttttcatgctacattagagtctgctctattcaaatactccctacaaggggtcaaactgccagcactatctttaacattattagcatcattatcaatatcaataaatggttattgggcccctcttatagaaccataaactaagctggtttatgtggacagcctccaggggaaccttgaggtgttgccccatcactaacacatgacaaatttatatcactatcatatgtatacatctacatttcttttttaggtttataccttttagacctgagaatacttgtttactggcattattgtatataacacacttcctggtattccaaataaattagtactttttaatttctagttctgtggttattagcattagcaaaaaagaaggaaaaaagttaaatgatgtgtctgttgcatagtaggtgctcagtaaatactgtctccatttggatgtctgatattcctctcaaactcaacacatacaaaactgaattattaaccttttcctataaaatctgttcctactcatagccctccccaccgcatttgatggcaagtttatcattctagaacagaaacttcagtgccattcttaattcccctgtttttctcataccatgcaaccaatccatcaggaaaccctattaagtctaccttcaaaatatgtacaaaagcagacacctccttaccatttctactgctacctccatgatctgaaccttcattctctctgcctgtattactgaataaccctttaactggtctaagtctgcttttggccctctgtagtcttggcagcgagaataatcctacaaaaagatgtcagatcatgttatttttctgctgaaaagactccagtggctctccattttcttagaataagagccaaatatttacaatagcctacaaaactatgaggtctgccccctctcccatcccattacctctctgatctcatttcctgctactcttcccacattggcctacttgctacccctcaaatactctggatatgatcctgttgtaaggcttttgcactggcttttcctctgatgggaatgctcttctctgatagctggatggttaacgccttcatctccttcaagcatttgctcaaatgtcactttctcaatggagcctactgtgaccatgctatttaatattgcacctagcttctaccactcaccattcctagtccctcttaccctgttcaggtttacatttttctaagttttcttatattctaacatagaatataatttattcacttaagcttattgcttattgtgtgtctcccccagctagaatttgagtggcataaaggcagggatcttgttcagttttgttcattgatgtgtcttagatgcctagaagaaaaaaatatatagattgaatgagtaagtgtattatttaaactctatgcttcctgtacctctaaattattcttcaattttaaaaaagcaacacataaacaaaaacttaatttgatataaaggtatcaagtagatgtaagggcaaaaggtatccaaaatctgaaatgttaccaaaagcactgagttttaaattcctcatttgttaatgagtataataatgttaaaatattgttgtgacttttaaagtatatgcataaaagcagtcaataatcatgcattaagggatttctcagctcttaggcctatataaaataaggctttggaaacaaggtacaagttgttataagcccttagaagccactttctttgtggtggcattcctctgaagacccctttttatccgaagtttgaaatggtgagcaaacactgataataggaaaacagttctttaaatatgtttataaagattaataaaattataatgcaccagtttttaataggcacactgagatcacagtcactgaagatgacttggaaactcagaatggagacaattgaaaattgtacatatgttgctctgttagacatctacttttcttgaccactaaattttggccctactactcatttttttaaaaaaatgcagtttgttttcaagagcaaaacagttgtttagtaaatttgcattgctgaacattcagcacagatgtaagtttccttccctccactgttttttttcaaaagtagaaataacttttgtaataaataaataagtaaattaattaattaataagctgtgggttctatcatgtatccacttagtccctggtactgtttcttttctctgaaatattaggaactggctgaaaaggcaaatgttattggaatagttagtattctagtatgccaagcattgtagggagtgccagctagcaaggtggggcatccgggaagctgatagaacaccaacaaatgaacatatgactaaatgctgttgtttaaatttacctctggggaatcagtctatgaagttccatggtgacctttcatgttgtctttatggttactatgaattttcctttcactctttgtttcccttctgcttctattcttgatcataaacctggaatagagaaaagggaagatttttttttcttttatcagtggcaatgaagatgacagaataaagtaacaggttaacttcagttcacacgagaggggtactaaatttcactagaggtagagtaaaagtattggatttggaatatattggtctatattactctaagtttaggtgtttcactcttatcacatttgaatctttatgaacagcacaagacagtcctgtgtttcatatagctgggtcctgtcaatgtgtgcttctctgtaaggctgtgatttatttgcatcatgaagaattgagtttctttatgagtaacgtattacataataggcaaattagttaagtttgtatttcagtttttaaaaatccatttaacagtggtcaaaatattaaaaccaagtaaatatccagtaaaattcttatctctagaagattacaggatctaataccacacccttactttagatggctgagacacattagtcacttttagttctttcccaggctttactttacatttttgttattatgccagctcttttccttgttttgccaattaatttatgtttttgtcacagtttgtgccattgtttgccttatcttagaaccaaggaatctgggaaaaggttcaagtctttttaatgtgggcttttccaaacctgaagtttcctagatatgagtatatagaaataaactggaatgtggtattaatacaaaaccatatatttatgtctctgtatacatcttatatttatgtgtttagataaaatttacatgtgttttctatataagtttatcattcgattgatatatatacacataattataatgtaaaaatgatttttccttttgaagtgaataaattaatttttcccctttgaggtcagtaagtatcttcagtgctaccctgtgaagttgctttttgaacaatttatcttttttttttttttgttttgttttgttttgtttttttgagacggagtctcgctgtgtctcccaggttggagtgcagtggcgcgatctcggctcactgcaagctccgcctcccaggttcatgccattctcctgcctcagcctcccaagtagctgggactacaggcgcccgccaacacgcccggctaattttttgtatttttagtagaaacggggtttcaccgtgttagccaagatggtctcgatctcctgacctcgtgatccgcccgtctcggcctcccaaagtgctaggattacaggcgtgagccaccgcgcccggccgaacatttatcttaaataatgtggtagctattaaattccattacttggagtattatttccaggtctttttgaaagccagctatccttttttttttttttttgataaatagttgaattgaaattaaaaggcaaagtccctccctcctgaaagagactgccagaaatcagtatgatacttacttattcctcattgtctaacagtgtttggagattgttaatcatatgtaatataatgttccaatattatttttggcattatataccaatagctattttctgtacaataaactattcattattatgccttaaaaaacattagccacttaaaactttttgttaaaatttggggaattaactcttcttgtgagtaaagtattaacaaacctccttctgtatggaaagattacaatgggttagccttctactgctgcttctgataaaagtaaaaatgatccctgattggtaacctaccttgggactgggaagagtgtggatggatcataaatactgctgggagctatagctttgggcttcccatagcatatttcttcttactgggtatgtccctccttgtgtttaacacctgacctgtctgttttggagctggagaattgtctctgaactcctactgaagagacatacttgatgctgtcctgctgacatgctgtgttcctggcctgcatccttcttcagaactagtctgtgtcacattttggcccattgaatcttgttagtttgattgccctgctgaacccaacatcactgctgctggttgagcagaataggcattatactatcataaatatttaatatgaaaagtgtaataataataatgataataataacaggtaattcttcctttatttttcagaaatgtgttacggatgagtgtttcttttttgaacgattggaatctaataactacaatacttaccggtcaaggaaatacaccagttggtatgtggcactgaaacgaactgggcagtataaacttggatccaaaacaggacctgggcagaaagctatactttttcttccaatgtctgctaagagctgattttaatggccacatctaatctcatttcacatgaaagaagaagtatattttagaaatttgttaatgagagtaaaagaaaataaatgtgtatagctcagtttggataattggtcaaacaattttttatccagtagtaaaatatgtaaccattgtcccagtaaagaaaaataacaaaagttgtaaaatgtatattctcccttttatattgcatctgctgttacccagtgaagcttacctagagcaatgatctttttcacgcatttgctttattcgaaaagaggcttttaaaatgtgcatgtttagaaacaaaatttcttcatggaaatcatatacattagaaaatcacagtcagatgtttaatcaatccaaaatgtccactatttcttatgtcattcgttagtctacatgtttctaaacatataaatgtgaatttaatcaattcctttcatagttttataattctctggcagttccttatgatagagtttataaaacagtcctgtgtaaactgctggaagttcttccacagtcaggtcaattttgtcaaacccttctctgtacccatacagcagcagcctagcaactctgctggtgatgggagttgtattttcagtcttcgccaggtcattgagatccatccactcacatcttaagcattcttcctggcaaaaatttatggtgaatgaatatggctttaggcggcagatgatatacatatctgacttcccaaaagctccaggatttgtgtgctgttgccgaatactcaggacggacctgaattctgattttataccagtctcttcaaaaacttctcgaaccgctgtgtctcctacgtaaaaaaagagatgtacaaatcaataataattacacttttagaaactgtatcatcaaagattttcagttaaagtagcattatgtaaaggctcaaaacattaccctaacaaagtaaagttttcaatacaaattctttgccttgtggatatcaagaaatcccaaaatattttcttaccactgtaaattcaagaagcttttgaaatgctgaatatttctttggctgctacttggaggcttatctacctgtacatttttggggtcagctctttttaacttcttgctgctctttttcccaaaaggtaaaaatatagattgaaaagttaaaacattttgcatggctgcagttcctttgtttcttgagataagattccaaagaacttagattcatttcttcaacaccgaaatgctggaggtgtttgatcagttttcaagaaacttggaatataaataattttataattcaacaaaggttttcacattttataaggttgatttttcaattaaatgcaaatttgtgtggcaggatttttattgccattaacatatttttgtggctgctttttctacacatccagatggtccctctaactgggctttctctaattttgtgatgttctgtcattgtctcccaaagtatttaggagaagccctttaaaaagctgccttcctctaccactttgctggaaagcttcacaattgtcacagacaaagatttttgttccaatactcgttttgcctctatttttcttgtttgtcaaatagtaaatgatatttgcccttgcagtaattctactggtgaaaaacatgcaaagaagaggaagtcacagaaacatgtctcaattcccatgtgctgtgactgtagactgtcttaccatagactgtcttacccatcccctggatatgctcttgttttttccctctaatagctatggaaagatgcatagaaagagtataatgttttaaaacataaggcatttgtctgccatttttcaattacatgctgacttcccttacaattgagatttgcccataggttaaacatggttagaaacaactgaaagcataaaagaaaaatctaggccgggtgcagtggctcatgcctatattccctgcactttgggaggccaaagcaggaggatcgcttgagcccaggagttcaagaccaacctggtgaaaccccgtctctacaaaaaaacacaaaaaatagccaggcatggtggcgtgtacatgtggtctcagatacttgggaggctgaggtgggagggttgatcacttgaggctgagaggtcaaggttgcagtgagccataatcgtgccactgcagtccagcctaggcaacagagtgagactttgtctcaaaaaaagagaaattttccttaataagaaaagtaatttttactctgatgtgcaatacatttgttattaaatttattatttaagatggtagcactagtcttaaattgtataaaatatcccctaacatgtttaaatgtccatttttattcattatgctttgaaaaataattatggggaaatacatgtttgttattaaatttattattaaagatagtagcactagtcttaaatttgatataacatctcctaacttgtttaaatgtccatttttattctttatgtttgaaaataaattatggggatcctatttagctcttagtaccactaatcaaaagttcggcatgtagctcatgatctatgctgtttctatgtcgtggaagcactggatgggggtagtgagcaaatctgccctgctcagcagtcaccatagcagctgactgaaaatcagcactgcctgagtagttttgatcagtttaacttgaatcactaactgactgaaaattgaatgggcaaataagtgcttttgtctccagagtatgcgggagacccttccacctcaagatggatatttcttccccaaggatttcaagatgaattgaaatttttaatcaagatagtgtgctttattctgttgtattttttattattttaatatactgtaagccaaactgaaataacatttgctgttttataggtttgaagaacataggaaaaactaagaggttttgtttttatttttgctgatgaagagatatgtttaaatatgttgtattgttttgtttagttacaggacaataatgaaatggagtttatatttgttatttctattttgttatatttaataatagaattagattgaaataaaatataatgggaaataatctgcagaatgtgggttttcctggtgtttccctctgactctagtgcactgatgatctctgataaggctcagctgctttatagttctctggctaatgcagcagatactcttcctgccagtggtaatacgattttttaagaaggcagtttgtcaattttaatcttgtggatacctttatactcttagggtattattttatacaaaagccttgaggattgcattctattttctatatgaccctcttgatatttaaaaaacactatggataacaattcttcatttacctagtattatgaaagaatgaaggagttcaaacaaatgtgtttcccagttaactagggtttactgtttgagccaatataaatgtttaactgtttgtgatggcagtattcctaaagtacattgcatgttttcctaaatacagagtttaaataatttcagtaattcttagatgattcagcttcatcattaagaatatcttttgttttatgttgagttagaaatgccttcatatagacatagtctttcagacctctactgtcagttttcatttctagctgctttcagggttttatgaattttcaggcaaagctttaatttacactaagcttaggaagtatggctaatgccaacggcagtttttttcttcttaattccacatgactgaggcatatatgatctctgggtaggtgagttgttgtgacaaccacaagcactttttttttttttaaagaaaaaaaggtagtgaatttttaatcatctggactttaagaaggattctggagtatacttaggcctgaaattatatatatttggcttggaaatgtgtttttcttcaattacatctacaagtaagtacagctgaaattcagaggacccataagagttcacatgaaaaaaatcaatttatttgaaaaggcaagatgcaggagagaggaagccttgcaaacctgcagactgctttttgcccaatatagattgggtaaggctgcaaaacataagcttaattagctcacatgctctgctctcacgtggcaccagtggatagtgtgagagaattaggctgtagaacaaatggccttctctttcagcattcacaccactacaaaatcatcttttatatcaacagaagaataagcataaactaagcaaaaggtcaataagtacctgaaaccaagattggctagagatatatcttaatgcaatccattttctgatggattgttacgagttggctatataatgtatgtatggtattttgatttgtgtaaaagttttaaaaatcaagctttaagtacatggacatttttaaataaaatatttaaagacaatttagaaaattgccttaatatcattgttggctaaatagaataggggacatgcatattaaggaaaaggtcatggagaaataatattggtatcaaacaaatacattgatttgtcatgatacacattgaatttgatccaatagtttaaggaataggtaggaaaatttggtttctatttttcgatttcctgtaaatcagtgacataaataattcttagcttattttatatttccttgtcttaaatactgagctcagtaagttgtgttaggggattatttctcagttgagactttcttatatgacattttactatgttttgactacctgactattaaaaataaatagtagatacaattttcataaagtgaagaattatataatcactgctttataactgactttattatatttatttcaaagttcatttaaaggctactattcatcctctgtgatggaatggtcaggaatttgttttctcatagtttaattccaacaacaatattagtcgtatccaaaataacctttaatgctaaactttactgatgtatatccaaagcttctcattttcagacagattaatccagaagcagtcataaacagaagaataggtggtatgttcctaatgatattatttctactaatggaataaactgtaatattagaaattatgctgctaattatatcagctctgaggtaatttctgaaatgttcagactcagtcggaacaaattggaaaatttaaatttttattcttagctataaagcaagaaagtaaacacattaatttcctcaacatttttaagccaattaaaaatataaaagatacacaccaatatcttcttcaggctctgacaggcctcctggaaacttccacatatttttcaactgcagtataaagtcagaaaataaagttaacataactttcactaacacacacatatgtagatttcacaaaatccacctataattggtcaaagtggttgagaatatattttttagtaattgcatgcaaaatttttctagcttccatcctttctccctcgtttcttctttttttgggggagctggtaactgatgaaatcttttcccaccttttctcttcaggaaatataagtggttttgtttggttaacgtgatacattctgtatgaatgaaacattggagggaaacatctactgaatttctgtaatttaaaatattttgctgctagttaactatgaacagatagaagaatcttacagatgctgctataaataagtagaaaatataaatttcatcactaaaatatgctattttaaaatctatttcctatattgtatttctaatcagatgtattactcttattatttctattgtatgtgttaatgattttatgtaaaaatgtaattgcttttcatgagtagtatgaataaaattgattagtttgtgttttcttgtctccc

SEQ ID NO: 36601 - DNA, 71528 bp, Homo sapiens; identical to SEQ ID NO: 36600

SEQ ID NO: 36602 - DNA, 59718 bp, Homo sapiens
gtagaacagtggggagctgtgcggatgggtgaagtgcatgtatgcctgcctagacgggccagaaaagccaaacttaagaaatctgcctatgtacagaacaagtcaactaaggggttctcattaatctaccgtctgtgaatatcgttatttttcaggttagttctgagttttgttgccttttaaagggagaggaaagcaaaccacaggctattttattatgagccttcaaaagggagggggtaaaaactagttatcaatgttgtgcctttattctttatgaagaaaaacaaaatttagcttaaatactcatggggggggtgctttgattttttttttaaaactagagctagattaaaactgatggtgaagagaagaaaaaaagttttttgtagttcaacaattgaatatttcttggctcttaaacatttcagtgagtgtctttcaaatgtggaccatttttaagcttgacctctgacaaagctttgtaaaatctggtgagggtactttaagagcagcccaaacagagggtgactttgaagtttgaaaacttagaaaaataataaggtattttaaagctaccagtggcctttatagatgccaaggaaagttaagaggagaggaggttagagagaatgggacctattagaaaaaaaaaaaaaatctgtcaaggccttaaaacaagcctgtgaagacaaagcagtaatggtgcagaaactatggttctttgaccaagttagtcctgaaaacatgtttctcagtgctgttggctgtttttcattggagcgtgtgagttttaaatagtaaggaattcaagtaattgcaggaagtgtgtttcggggtggtggtggtgggggtcagcattagtgaatggagaacaagttcacagtttgggtcttgggccattagaggaagggaggaagggaggaaggagagtgtgtgtgtgatcccctgaaccaggcttgtgtggcggacttgcggagcagcgacttcagagagttcatgaatggaagtcacagacagaccagcgactgcagccacctccaggcatttcttaaaggggagggttgtgtgctttttccagggtattctggtagcagtttgattctcttgcttttattttaatttccataattggtagcttcagaaatggctttggaaggcaatttgctttaaatgtagccacctattccaaaatgccctggttattttaggaaccctacccttttcctccggagctctctcgcaggagttcttcttttggactggtccaggaggtagggtccttcctcagtcgactcctgcagaggtcacattttgtgtgcgggtttgtccccagcgtttgtgagtagcatatgcatgtggttgtgctgactgcactcgcaggcttgtaaattttcaccctgggaaattagcaacaaagcccgatctgtctcgtggctgctttgcactttccgagggcggctgtacttgactgagctgcagaacaggcacacgagagcgagcgagggagccagcgagagagggagggagagaaggaaagaagaggggaggggtgggggcgagaggtaaatagtcttaaatcggaagggagctgcttctctgtggtcttgacaagcgctgcctgggctccgccggctcactaataactgagtgaccttttctttggctgtattatgtctggctgggaagggattgcattttgcagctgagagccggagcttccttcagctcggctcctcgcacgctgctggggtaagttgtcttgaaccaggacggagagagacagcctcggactgcagttgcctaaaaggaggacacctgtggctcagatgcggtcaacaccattgcttggcgtatccttgaggacctcattattttaaacttaaaaaaaaatagacattccctcccccgtcttttttttttttttcaaacaatgcttctttttgacctttcccaaggagaagcgctacaaagcagccactgtgcttactgaacggcctccccctgtatcgcttaattgagaaggtaagtgcagcaactgtgtacacacgcgtcggcttatttgtggtgtgtgtgtctgcgggtgcgcgcgtgcgtgtgcggatgtgggtatttttttcttccccaacctctgctaatgaggcataaactggagctgcaacccagctccgcactgcaactttcactcgggctgcagctctactgagacggttttgtttaaatcatgtgaggcttcattatttttatgatgagacatgaaatagatgcaggcggaagatgttgatggaaggagggagagcggctgcggcgcggaacgtctcaagtacgactcgagtggataatagtcaaagttcaccatgaactgcagtatttccacacccctgactcccggggagagaggggcagggagagtttggaattaggaagtgtttgctcccagcccataggaaaagaattcagtcctgggtgggtttccggacccctcccccttacttgctggaattcatgaacccccacttcttaaagagttgatattacaatcttttggtccttgttgacgcttctgcctctctccacgcagccataataacaaaatgttgttcctttgccgtggaaaagtggctgtgtttgggcatgggggcggggggggggggcaggcgggtaggggcagaagtggctagaagagggaaggtccctggaccaaggtgcctatatcctaatagattgagattcaaactgatgcagcacattttttacggggactactcagattgctgttatgaaatacaagtcagatttatgatctttttcatattgaacatgatatgctatgctaacgctgcatgtgacagtttaatcaaatccatttgttaccaggaagctaaaaggggccgctgggattttaggattacgggcagagttagggaagcatgtggctttgtcattcgccatcattttgcacactgcgaggggctccgtgtgtgcgccctgtcttgtctggccgtcctcatcccttcccccaccccctgccgccactccgacccgctcccaaagtggcttcacaatagtcggtcctcggcggtgtaggctgcgcaccaggtccacacttaagcgaaatcaaggagacccccttctacttctacctttgggtttggtgctcaatgcgaagctgctgcaactcagacacgcctaagtcaactcatgcagaaaaaggagaaaagttttggtaaggttacagtctatcatagatgcactttgctggcgctctgcactcctggccgctcaaaagcctttctgcttttccgctgcttttgtgtctttctgaaagaaccgaaatattattgttgtaactgctttgaaagactgctgcttaaaccaattaatcttgctagatgcaacaaatactgctacattctttgcaaaccatccctgtgtggctgcaaagacacaaccacaaaaggctggagcataaactccgcaagggattctttgttagagtgtatgtatgtttcttattttttttttttattttgcatgtgagctgcatcaaaattgaactcagtcttgcaaatctcttgttggcctttgccaagcactagcactttgctgccatggtaactgtaattaaactgataagagtggaaaaatgtcagtatctctgagccttgcagctgcattggagaaaaagggaatcaaattggttcccagctccattgctcaaaaaggggaggggggtgaaggatagggaagggggctgggagttgaaggggcagaacagagttaagcagctccagtgcctgagatctggggacatctatttgcattgttgtcccttagggggctgcagcctgtagggatgctctgggccagtgaacagagagaaacaagcttttaggcccaatccagttttccaacctgggttgggggctgggaagaggatgaagatgggcaggaggagagaaaatcttttgtctggtgcctcttggcaatcgaatggccatgttggccaaattcttttaatctgtgtcaatgctcccagctgcagaacctgcattcccattttagcatctttctgaagcacctcatctcttccaaccccctttatgtattccctcttcctcttccctctcccaaattgttctctgtgaattttccgacggacaaaatgttttctattcactctgtgtagttagtccaaaaatgtaagactgtgtctaagtgctgcaaatctttcattattattattttttttaaacccctgtgtgttgtggagttgtggttactttgttgtgttaactactgaagctgagactgtgcggatgaatggtacagaacaagggaacataatggaggcaatcaaccgttaggccgcttcacaatgcaatccaggcaattaaaagctcaccagagtttaaatgaaatggttctacttatttctgcacaccacactgcacaggctattatttatgtcttttttttaattatgatttcccttaaactgtcaaataactcagaatggcagggtctcagaggcaataagaatttccctcagaacaatttacatgccaatctaaaactagttatgagttctgatgtgctatgagcaacttgtgaaatgtttcttagctacaaacacgtaactctacccagacatgttcttctggtggaagaggggagactgctgactgctttatgccttttaagtacacggtaacatggtgactacaaaatagttcttttgctacaattgttaacttgcatggaattcaagagattccattttcaagagaattgccatgatgttcttcaaataaggtaccaggatggagtgtgaaatatcaaactccttttatgcccaaggccaaacagaatgtaagagtttcaaatattaattggcctctgagtgctaaattaaaatgtcaacacaacaaaaacattttgtgaagacaagtagggtagtgttacttgtgccaaatgttggtatcccctgtcttggttgcaaagcattttgaataaaacagctgaccttctatgcttgatggtagaaacacaactgtgggaaatataacttagctgctactgggatttttttttttttcgatttttcatctttgagctttgtgataaataaaaataatagccttacaaatttaatagaatggccgttaattaggatggcttaattagaatggcttctcttaatatttattatctaggtgttttcagtaacaccatccagaatttcactgagtaaatcaaaacttccccttccccctagatatgtggttaacaggcacttggatctgttgttcactgtaattaatgggattcactccttgtggaaccttgctagaagaggataactagttctgatcaaagaaacttcatttgttagaagttctagagagtgagatttagcagagctatcaagggttatgattaatctacactaggcccttagctccttcaaaggaaaggaacagaaagcaggctatagggataccacctgctcttcttacaaatccagctgttagtctgcagctccggtgactacagctatgcttatgatgcagaaagaaagaacagctactctgctttatttcctgccattccctacacaactctaccagacgagttattttctaatgaaagttcaacatcctaacaatattttgtgcaactcatgtattatttgtagttagaaaagttattccgctctgcggatgccttgatgtctcttaccagtgggattttttttttaaaaggttgtgaaagttgtgatgggggtgaagccttcatcataagatatcagaggaaactggaggaggtttagctgttttggagaaggaaaatgtacaaaagtgcagattatagcttgacatttcttatcctataatgcatgcacatttggtgttttgtatccttctacatgcaagtttaaaactttatgcctaggagagcaaacataatgcagcagaagggtctctggactgtaagaaggccatttggctggagtctatagcgtaactgtctttcagctttgagcaagtctctgaacctctcttgggcctcggtaacataatttgtaaaatgagggaatttggaattgatgatgtctgcagtactttatagtgcttaaaatgagttatttgataaatatgaggcattggatagttggtccagcttcttgctaaagctgggtgttttaatacctaggaaataagaagacactcaaggtgaatgtccattcattcaaaagatttcaatcaaactgtaaagcccatggaatccagctggattccttatttatgatggatttatacctttaaaatatataaatgtttctatgtttagcatagtatacatataacatgtatatatttacttatatatgtttgtataattgtatatatatttagatcttgccttctattgttttttctttcctttataaaacaaataattgcatgtttatggtaataaatggtataatcatatactttaggtttacataaaagcatatagtatatagttaagtaatctgccattaatataggtgctgactgatgcttgtgagtataaatgttatatttgaacacaatgaatactttgaaatatcaaggacatagaagaagtatttggatgcaagcaagaaatataggattggtgagctttttgggtagctgttctgtgtacttaactataaacacctctactgctgaataaggttagtgtaaccccataccaggtgccctctccttccaccatcaagcacatattaagtgaaatttttaaacagttaagcaaaactcatttttttacttgtagggactgtgcatagattaatttgttaaatagctttcttttcagattgttatttactcacattttctttctaaaggaactgctctatggggagaatgaagatactataaaattatttaatgttattgaacttcatatttataatgtcaatttaccatggtcaacatgaatttattattattgtcacttggcatgtgtaactttttgaatgatttaataagcacttgataaagtttgagactttttgtttccaaaattgggtttgatttcagtatagccctaaacaagaaaagctaacactcctagaataaggaaatattaaatatttaacttgtttgaggtctttttattctgtctggtagtctcagctctcttttttgcttttgtcttcctttaggtatacaaatgctctcagtccagccagacaccaagccgaaaggttgtgctggctgcaaccgaaagatcaaggaccggtatcttctaaaggcactggacaaatactggcatgaagactgcctgaagtgtgcctgctgtgactgtcgcttgggagaggtgggctccaccctgtacactaaagctaatcttatcctttgtcgcagagactatctgaggtaggaattatccttgcacaccagtgatgactggatgccttttaaagtacttttgtaagtgtattttttgtttgcttgtttcatttccttactgccagcttatattcctgaaagaagttacctgtcagccttcaaagcgttgccctgtgtgtgttactcaaattaatgcttaaggaatagccaacaaaccacaatatttaaagtatttcaatttggcttgcctgcacactcaggcagttggttatggcgctgcctatgttgaaactgccagttaatgtcaaggatgtatttggtcgaaatcagcattcaggttgatttacttattttttcttttttttcttttttttttttttttttttttttggagcttaagggggaatgggggttgagcataacacaaagaaattgatcagccatttggcaaaatatcttaactatttttaaaaagttcaacttgaaaaaaatggactgtgtaaaagagtttaattgttgcctctaagttggacctgaatttagtcttctaaagttattcagctgtcttctctgtttcaggtgtgtcagaggaagtcaggtgcaaatccttggttaatatctattagtgcatttattgtagagttttgaaaactttccccaagtgtagatacatcttcctctcgccccacctcatgacattctaaacgggaatctcaaaaatacaactaagcaattgaaccgcctcagacttgccagtagttttatggataataacaaagtaaagacctccatcattataggaaaatgacagccactctccaacctgtaaacatctgaatgctttcaggacaaggcaggtgttcttggttatggagctatgaagcctactaaagcttgttttccagcattaagtactcaacacagaatttctgctgaaggaaaattattttgcttttcaggcaactttgtgacttacttcagctgcaaattacttatattaataaagtaggatctatcaaattagagaaatgatatatggcatcattgggattttcatatttaatacaatttatcatttttctggtctgacattaagcgatttatttggaattttttcccttatgacaaaatttatcaatcaatggtaactcctttagtaccttggtcatttgatgaggtgttttctagggaatttggtcgttcttagtatataattcagctattttcagtcagatccaatctttagatataaaaatatatcatttgattaatggtagttacaagagggtgaaagcggtactgtttatcagattctactccttctcgctcttaggacggcctcatctgacagcctcctgactaattatggccacttgttactacttctctgtgttccaagtgcgtaaaacacatgcaaggtgccaacaatgagaagtcactctctccagccaggatttccctcattgtgttggcacaacgaatcaaaattaatgtacaatgttcatttttttagaactctccggtctttgaactttcctctttgaaataaaaatttctcttctgcccattgtgaattagagcctcatttccacataaagcatttgtatttgcttttagtgatttaatactgctttttagttttgctttatctgtactaaccaatagtcatagctttttgactccttttgacttttacatttgtttgtaatttcagtatctcaagtggatttatgttaccatttcaaataaggagtttatatagcccgggcaatgttaaggtgttttaataaaccaaaggacaaaaattaagtaaacttgaaagaatgtcaactgaaatatctggggtttttgaaaacaaaaataaaaatttgccaaggaaatacctatattgtgagtataacatgcttcttagctgtcaacatagcatcgagcaaagacagtaatcttagatttgttttgttttctttttccttgtggtagtaaaaatatatttgatagtctcaagtgttttgctaaaacgcatttatcaaaaatagttttcatatcagaagtttttgtatctctataagagtgtatgtggctttttgtagaataactttcagttacctcctgataggctcaaacttttaatggtggttaacttattaaaagtatataatattctttcaaatataaaccctggtcctgattgccaatatattcatttctcagagtacgatttccgcttaaattggtcattaccacattaatggccagttgttatgttaacagcctaacggttgttaacatttcaaactaagttgttaacagcaatcttgtcccttatttaaactgaaagtttgttgtatataatgtgacttatttggcaacttcatcaacacttaaaattgcagaagtgaagtggagaattggtgtgtgtaaaacactgtgttacgtgttatagattatgccgcagatgtggtatttagttttatgtggaaagcatgtgtctcagtgaaattgtgtagatgttcaactgcatatgtctctgattggcaaattaaaatagtctgattctgtatggtaaatcaacaaatatagtcaagcagattttatttacaaattaatttctttgattagatacaaatagttgttcaaaaatgtttattaaatgcttactgtgtgagaggtatgatttcaggcaatgggtgaaattagctaaaggaaaaaggaaggtacacctaaagttgccactatctaattgtttatttaattacatagaatctgtaatataatcagtgaacaagtaatattctgtggttattttcctgagctttaaaagtaatttttctcattttcctccaaattcagcatacttccattttgtattttatataaccaatgtttaatcacttaagttctattttaaaagttgttttatttttggccctttgatattatgtaatttctctgaggcaccaaactgaacataaataacttacatatttatatttcatgtctaaattattaagaacataagtaagaataaggaaagtaataaaatagtaatttgcctgtccacatatattgttggttacaagtattgtcctgggccagataattttttacatacagtgaaaagtaaaatatttttgccaattacatttagcttcttaatacacttctccctccataaacagaaagaaagaaacactcctaattatgagcaatgagacttaaagatctgtgttttacttgtgttactttgagtagtgataatgatgatgtgatttataagttctttgaatgatgatttgagatattaaataatatgaaaatataataatttagactgtaagatattttcttaagggttatagaaactattattatggaaaatttgatgtctttccattttttttctcctttatggcactagtagctatatttaagagaaaaagaaagaaaaatcttccatagtttgtacactaagtatcaaatcttaacagtggaatttttcactttccagaactggactggcatatcattcatttagctgtggaacataaaatgtacatatctgatgagacagaatttgcccatttgtgggattgctttcctcctttggaaactcattagctaaagaaagagaaggactgactttttaaaacttcctctaacatgtttctgactgaaattatgaaatctacccagtcaatatttatatgccaggcagaccaagaaatgtatctgttaaaaatctatccaatgcatttataattatttttatttttttgaagagtaacttatgacaaattagatatagaaacatctttgtactttaagttggagcttaaaattgatattgtctaaagtagattaaaaatgactgtgtaaaaatagcaaagttgtagtgataatgtttaaggtactcatcactgcgatctatccgccttatttcagtttgaaaaaatatgaataaagtagccagccagtgcataatcagagtcttagaattaggaattctacatgcttttatttaatgttttgcagcaagcattaaatagaactaggagaaataccaaaatactttctttttcaacttgaaggcaataaaggatgtcagaatgtaactggaactcaacttctgggcaatttttttgttgttctttctttgaacctgcaactttttgtgacgtactttaagcattaagtctatataggctgtatgtatcttgtatctctatgaatgatatcttgccagagtttattcaaagctgtttgctgtggtatgtgccatggaagctgcttatagcttttcctatataagaagctgtaaaatgtcttatataaaatttaatgcaatttgctatttttatacgtgaggatgatttgtttaaaatgaaactactgggaaagagtgatgcttcatgcttcaccatagttgctaattaactaaaatgatttgaagcttgctatgctgactacaaattttataggctttaatataataatataataactctaaaagagaaaataaaaataaattgccacatagggcataaatctagctgtaactttatctcacgctgatcaaacctggtgcttctaaatttttatgtaaggtcagctttatattggtacataattataagtgtaaaggtaaataggaatatgttgttaatattattttatctggcaatttatagcacagatgcttttttaatgttgatacaatattcattcttttttctttcattgtcatctttttaataatcatttggaagtatttttccaggaaagcaatgtattcttattatttgaaaaaccactttttactgttctaaattctgaaagcataaacttttatatgaaatggaactctacaaataagctttatttctataagcttcatttgagcttttaaacaccatattattgtcataatttttatgtttgaatgtctaagttaattttagtattatgaaatattttgacatgagcatattgaactccatatctgttacaaaaatactgttatattccttaaaaattatcttatttgcagctttataaaaagttacaattttaagatcatttttccctttattgtagaagaagcattattgaattctgttttaaatattttagcgtttatactaccctgaaccaatacaaattaggagtgataatttttttggataattcttcagaagagtgcccctcattctggaaaatagtaggtgaattcacattagacttcctgagcaaaaactgcccccaaacaacttctattaaaaatatttactgcacatacagaatttcttctcattggtaaatttatctgcaatatctttctatctttaattctataatgcattcattttcagtaaatgagtatttaccaataatataattattttacttttgtggctttttgttttagtttgttttgtagacttgagatagtttcactggaaatttcacgaccccccagagtattaaaaatattttataatgtttctgtatctttatagttttttatcttttaataagtatgaaatacttcagtcaggatagtttttacatgtaagatggataagttagacatacctgacttagcagaaaaatattctgtttctacaagtgtatttaggattaaatgcatctggaaaacctacatttgagaattgctaaaattgcttattttgcactttataaatacatagaattctgggaaataatttctatttttggttgctcttagactatatcaaagtaagccagcacttcatttataaactcaccattaacttccattaagtgactaataataaattttaatggtgtgttttgactacataaacataatttgttaagcaatctcatttttaaaatatgctgaaagtagtaattttgtaaatggttttgatgaatatataaattgtagaaatgtattatgtagttccattttctgcctcacataaaaatgaaatagcctaaaaaaagaattgcaccaacctaaatgaccgttgtatttcccttcattacactgtggggcactgaagtcttattttggtatttggtttgaaaacatttttccaactcgtatgagaatgtcttctattattcaaagccatgtactgcatcctcatcctatcttctgaaaaaattagccaatgtttctcacttttatcaataaaaaatacaatatatgaagtgtaaatgctggacaagatctggaaaacaaagggaataaaaataaaaatagcaatactctgttcaatttgctaggtatttttataaaactccatttgtattagccatgtctctataaatggcctttttctttcttttttattttttagtttaattggcttataaaaattggtttgtgtatatgattacttctgctgacacatggcacttcctcttgttaagcatttgaagaggtgtggatctatatacatacatgctgcacatacagagattggaatctgtgtaaccttagaatggccattaccttttgtcatcattgactttagccaacaaatcaccatagcttggtaagctttaaaacttgtaaaattcaaacacctgacgccagctaattcgttaatattgcaaactatagcactcatctattcttacaggatattaatcagtctaacatgtaggacaacttttataaaactacagaatgcctaaatttatttccttgtgattttaaatatctaattctgtttttcttagctccgagggagtttgatactgcctgttctagttctgtttttactatgataatatacttgttttgatgattaaccatgtatttcccttttcaaggtgcttacacgaagcttattttgaagtggaagtttatactgtgaagcaagaaatgtggcatttagcttttcatttctaactttaaaacaattcctttggcttatgcctttcccccctttattatcagtattaatggataactttctctaaaggaattaggacctaagcatatcctcttattatagaagccaaacgttttctatcttcacaaactaactacatcagccaactgtgcatttgcttgtgccattttttgcttctgtgctgtattatgaaatcttcttgataaacctttttcttctcaacagtatttttgtagttatgtaatgattctcttttcgccgaattcctttgcgctatcatgttagtgttttctgatgcaaaaatctctagttgtgggctttacaagtttaaaatgaaatcacacttgagatgaataatcatcttggaatagtcaaatccctgatttgaaggtggaaaattaacattaagctgcatgtattaagttagactctaatcagcatgtgttgttatgattcaatttaatattaaaactctccaactgggctactgggaaaataaaagactcttaggaattgaaagagtatttgcagaagagcacaccaaagcaatatttaagtaaaattgttatcactaatgcagtgaagcatcgtccacattaaacccaagctattaataaaaagagaaaatcaattttagtaaacataaatatcagatatgacaaggactagtaagcaggcatggaacttcataaaatgtgctaatcctaatgtttaacagtaatccagataccacagagaaaaaataaattcctgtctcatttatgctgtgggatcccaacaagcaacaagagggaaaagctaattttagatgtcattactttactcctagtttctaaaacttttagaacaatgttatgtttttattttagcagttctaacagagatgtttatttacctgtttttgaaattattttattctttttgtttttaaaagattttgaaatctctttagtaattatttttaatgttttttaattttccatctctaggatagtgttttttgacatactgctcacatttcaccaaaaaatagaagaatcaagactgttacattttaaaataccttacaacattaagcataccacttattttttgtttattagctgctcaataaaaatatattcttaccaatatctatgtataaagttggtaacatgagtggatcagtacctgttcctttacctgggtgggtaggagtaagggaagtggatggaaaaagcagttgtaacttcatgcaagtattagtttccatgagcaggttatttgcattttacaggtgagatgctcacttatactgtgaatgtaattttagagtctataaatattgcatgtgaatatccactgaggaacatttgcactttgggagatacaaagaaattataagtaattgccttcaaatttataagccagtattttctgtgaccatttattaggaaaaatattagaaagttcctgagctagaagaatctcttctttcacggtgcaacccttgctgagaggcaggattggggtttgtgtttatgattacttgctttgctatctctttaaaagttctacaatgaaaccatttagtcacttgacaaatatttgagtgccaatacttcgttcttataaataatgaatgtgaaatactacatttctaattaattttgtataatatataaagtacaaagttatacatactttcttttgtgaagaataagctatccagtctgggaaaattggaaagaacttaagagcaagttatttttcaaattttctacacctgataaacatagtcactattattgtcaaataactaagtagaatatataaagagtttcactccaattaagtcccatggaaccaatatagagaatgacaagaggtatgatcaggagagattagaaaatattctgaagcagggaggttataaagtatctggacttcataaaaattatttcataagccagtggtcctcttatgaaagctgagctttgagcttcacgggttatattttgggtgcagagcaagacagacttagcttgtaactttcatgctatttgtattgttccatctcttatcacagatatcagtaagttatcaataattgacaccccttgcaaaatgcttatctttccttgtacaattgatacctcttgcaaaacaatcatccccattcccattttttcattcaataaatgtgatcattctgtatattctaggtactgtaaaaggccttgacataagcactaaataaaacacaaaaatacctgctccccttgtagagtttatattctacttaggggaaataggtaatcaacaaaataagtatagggcatgaggagatgataaacacaatgaggagaaaatgaagcagtacaagaggtttgtagaattttggtttgtgtggagggggtgcagacagcctcactgagacggtgacttgagtaatgacctgatgaaagtgaaggagctagccatgatcacgtatgggaaggacattctgggctcaggaacatccagtacaaaggccctgaggtgggagtttttctcatatgtttgaaggacatcacagatactagtgcagctggggtgtgggagagcaggaggggcaagaataaggggtagtcactgtgtaggtctatggtaccacctatcactgttgcaacaaacaatgccccgtatacatttctaaatgtcccctagaaaagtgataatacttcaatttgaaaaccattgtaaagcttattcagtgaggcagttgtgaaatcaatttcatttgggattatagaattcatctgctgaattgaatgagattatttttcatttatttactggaagtttttttggatgtctttttatttggccccattgatgaccctgtgtgattaagtaatagttgtgaaatatgaatttgaaaataggcttctggatttggtcacgtgatgatctgttgccaatctaagggggatgatatagtcgcatgtttgattttaaagtgatgcatctacattcgtctattaatatggcaaatggaatatctatacatcatagtatttcaatgtgaaattcaaggaaatgcctatattgatgagctaggactgccaacacagcatttatgagagtaagatcttgaccaaagatgtcatcaaactgtcctgatcacaatgataccgatttttttttttaattcttaggtaatacaaattgcaaagatgtggatttttcaaaggccattaattttctactcttgaagtccgctattctaggtctgaggggtgatattcttgtatttttttcactttttaaagtcaagccaagccctatttaattatcttatagttacaaaacatgtaaaataatatatttgctctagttatgataaatgtttctaaatccagcacttagagaagatacattaaggacatattgttatttaaaacaatttcgtgaattacattcttgatgagacaaatgttacatgagagtttgtttatgcttatatttctcaccactaacctaacccactaaccttaatcctagctcactaatgttagttttgcttcaagaagagctaagcataatcctcaaagccaaaagttaaatattaatttctatttataacagtgggatttgtatgtacaaagtgtcttttaaaaatgtttaagtttaaactttgggtacaaatcaaagttctcgagcttgcatgtatatttataaaatgggctgggatatcttcatgcatacttggctaagaagctatgcaaatgtgctttgaatcttataaggaggtacaggatgaatgggtgggctttcaaaaacggtggcatttatacttcatgcacaaaaaaatccaacacatacttcccagaaagctagacggagacagtagccagagagctttacgaggcttaattcctactgtggtctgcatcttgggggcttttttctgttacaatttctaacagtccccctctgttcttcctggcagatgcttttcttgtccagattgagttgaggaacctatattcctaatcacttggtgatcctcgtcttccaaggcagatcaatttgagcttgatcttaaagaaaagttgcttgatcttgacctgatagtttgcttggtgtttaaataatctgaaataatcttgtcagtgatagttattaaacaaaccactgtctttataatagagatgatgtgcttatttgattaaatatgttacattccttgtcttcttggttagctcttgacttctgcagcaacctaaaaaagacataatttttcaggagattttaaattaatttttcttaaatttttccttcctaatttatacggaggctttcatctgcactacgacctaattttttactgtgaagtcacaagtaaaagtaaagccacaagcttatactgcactcatagtaatatgtacagtatattttaaatgtctcatcatgtgtttctcattattctactacattaggtattgccccttctccatcaatgatcatcagtggcagataacttatgtattcctattaggatgcattcatctactgttgttataatcttctgtgaatatcacttcattaaaaaataaaaagttacatgagttcttgtcacttccctaaaatcttccaaactgggtgaggttacatctaattcgtagatcttagaggcatgtcaggttgcatcacggtgaggtatccagacctgacgtcgacccccttctgctacaccccagcttcacattcctaggcaacttactcaacctctccaagtctgcgttttcttctctagaaataggaatcctattcataaaatagttaggggtgacagtggaccacagtagggaaagagcggtacacattggctgatactcctccaatgtcagcttctgttgttatgaagggagaatggcactgagttatgaagataagataagggagaaattaaacatgaggagaagattgaagaagaggtttaagagtgattaataatgaagaatatgaaaggctactagtataatgaggtcgtttaccaacttttcgtgtgcaaaggagatgggtggagaaatgtctaaatatgtgcactttaggctgtatggaaaaaatatctcaacactggagattattggaatttggaatggattgttaaattaagattgtagtgtgctttatataaattaggatgaatttggatctttgggagaattactgaaaattctatttcctttgtaactgaggtgatagttttctaaaataccttatatatccatgctctccctgttttaccttataaaagttctatggccttgtaaagcattatatttaatattccatagagtagaattatattataaaattttaggttgttttaggttttctttatagtgttgattttgcatctttttctcaggtggcaaggaaattgaataccaacttttttactcacattatttttcacagtgttctttaaacaatttgattatatatctttattcttaaagaaatttgagtgcacaccttcaatttgtatatttgtatatatttataaattgtaaatactttattatacattttaaaaattatgaaaacaatgtttaaaggaaaaagtagaaaatgcatggaaatgctaataattttttaagcatttcttggagtattgcaccttaaatttggagagcactatgtcttagtagctttttatgtttaattgaaagttgtttgataaagatacttgtgaataaaagggggaaaataccaaagcttgggaaagaagtcgtaagagaaagacagggtaattatctgaaagaaagggactttttaagcatgaattaatattccttgttttgttcatttaaaattaaatcaaggttttctttcatgagaaatgtagcaatgcttgtggactttttctaacactataccatagctactggcagcattaatatgagacaaggttcctctccctccccctgaaaccccccattcaggacacagtgagatttttagacagataaatgctaagagaaccctgtgtaccaaaggcagtgtttactgcatgtaatacatatcattgtttgtctcctgtagtgaaaaatacttgtgtcgtgctgttaaaatgcactcctgacagaccagtgcttgctattatagggtccattgcttaaaaaaatgatacactgacagaaatacaatttaagaaaatttaacaccaagggtagtcaaccatgtaggctactattaaggggccaaaactcaaggccaggggtttatttaaaaaagaggcacagtttatttgctagtagtaggcaaagtaaaagaaaaaaaaatcgaacttgaattccttgctctctagtctgtagaaaattaatgaaagcaacagttcaataagattttattgcagaaatgtttaagtgaaacgttttaagaatgctttggaatttttaaacagttacttaccatttagaaagctgtaacactgcagtgcgtaacaaattgttagcattggatcctaggcacacccagtgattttcttaaaatggatagtcagagctgtttaatctgaatcactttgttcatttcattttcgtgtgtgtagcttatgaatatatttgagattgacaggtcagcagcacccacaattgctataatttaaaatgtaagccattgtccaagtacccttgtgggcatagtttggtagttaaatgcattagatttgtaacaagaccttttgagaaggaaaataaccaaatatgagatgtgacgagatatgttggatttttagaggagtacagaatgttctaatgaataaactgctactgaatgatgataaagcatgtgtttttaagctatcacatgactctattattagaggggagaattccatgaatttagatgagacgtattgtctaattttaccattttaaaaacaaatctgtcatccagtaatatttgatgccaactgtgtatggcttacatgttcctttgggagaaaggttacaaaagtaatgcaataaataatctgagccacaggagcttagctcaagtaccagagaaatggaaaaaaacatcatctactgcaatggggggtcaaaagatgtgtatcttgaaatctctaccccgacggtatagccttattgccacatcctaggacaggctttgggagacaagtggtcctgccaagaaaggacgtccaaagatgaaatgcagtgtctttgcatatgtcctccagaattcagttggcctgaatctgacaatattatacaacagatttttttctgtggacgtagaagataatgcttagcgtgagatttgtccagacacattgtccagggcctctgtgactcagctgtgtgttggaggagaaccagaaagccttgctggggaagattaggatcctccgctctccttgccacagccatgcagtggttctccattcatgcacgtgttttagttgtttcttagttgttccgtatgtggacttcatcgtatcatgacatcttaacactctgtgttcttgccagagattacaacttcaaatgctgcttttccattcttatgttttaagaagtcatctgaaggaaatagtatttatggcagattacctgaaaaactggatgttgaattattccttgtgatggtttttaatttatccttccctgtgtctttgatcttgacccctattgttttggcccctcaaaaatttttatggaattgtacatcaaggttttgctgttttcctgtgttgaagattttcattaacagctgcaaaaacatcagtgtcctaaggatgctattggggactttgtttactgtatcacacaatgtcctaccgcctcactggtgaaatgtcgcccagatcttaggataagcaagatttctgagactataaatgactaaatgatgttttacttgggcctgtgaatcatatacatgttgacattttccctcttttctttgtttcctgggaagcccagatcaaatttactttctaacaattgtttagaagtatatatgttaattgattctccagccttttgtaatttctcacccatattttcctttctattattatatttggagctgcttacatcacctgaggattagttttgacatcattcaaatgaaatcacttaaataattggaatgggtggacttcaacggaaagaaaatacaggtgggaacatagggcctgatgcatgagagatgctcagatagctgagtgagaggaatttaggaaaggggagattgtgatgaaattagttttctaatctgcaattatatgtaaaattaggtgaatttgaataatatttgggaacaatatttgaaacaacatttatgctcactgtgtaggatgaagatggtagcaaaaataacctttaatataggttaatattaatctttgtggccaagtgattgtttaacataaagttaatccactttttaaaaatatatacacaaatatgcaaatcctttttcttgaagcagtaatcaataacttgttttctaccatgatacttgaatgtaaataaaataggctgaattatttatcttgccaagggctaagacgggaattacaaactcaattgcctccaggttccggagtctggaaggaaaaataacgttgtgaactggggcttgcatgcgccacccaaagggggaagccatgacttaattccagcacactgtacgaatgtgggcctaatgttgctgatttttctggataaaccagatattttttctagatatttcagtaaaatctcttgtatataagacattggcaactaactctaatgtggcacacagctactagtatgtaactttttggtcagaatcataaaattctggtttcagataactgatcaggccctttaatgtgtacagttcgctaaggtgtttgaaaatatttcctcgcatcctgaattcttgaagagaggatcagagcccttcatccaatgtataccagttacactcctgcttcagaaatctcctgggagctttcagcctaacaaggagtcttggcactgctttgtgaggcgagaagcagcccgtcctgataaaagaaatctcttgctgtttcttgaacttcatggcagccattgcaatatgtttggacttaagtgggatattttctgggaccctcactgtgccaaagctaagacatctgaggccatccacctctaaacaggcctcttaccccccccactcctccacttgccaatgttaatctaaaacgtctcttgtttccattcctttcctcattctctgtatatttctgctgttacgttcactcaacacttttccactgggtcctccagaaacctcatgtccttgtcaataacttttgctgtgtccacaatcttttggccagatgcctttcccatcaaaatattgttttaactgaatttcatctgttgccttacctgaaacttgcctctcctttaaggaggcaacttttctttcagctgtcaacaggtgcaaggtactacttactcatgtaaatcccacattccatgaagccaagaggagaaactggcaatcttagatacacataactctccccactcactactaaaaaatgcatcctccaacaaaactcgtacatctaattatactaccttttacccctactcactgctgtcatttccctcttaccacaattctagggattctaaaaggcttagagatgactcacttgaaaccaagccctaacttgttgagcctccttgaccctactgaacatcagcctgccatcccagaattatatacagtgtcttttccttatggaaaagtatttcatctcaggaatcttaaactccacactgtagtcctgtttcacttgtaatagcactgatctttgatttcagacattcagctctcctgtcatgtctctttctcctaatttggtcaaacctttaagacttctatctttcctgcccactatgaacccaactgtcaatcaggcaagtccccttcacttccatcttctgtgtctcctcccatgcctgtgctagctcaattttcaccactgctccagtctaacaaattgccatgggtatgctaccctttttcaatccattcctacagtgtggttaagcattgctagaaacaagcaaataacatacagattgatattccctgatgttttttatcaggtttgatataaatcagcctcttacattttatctgcttttccatttatctttaatttcttttatcccatctatgggaatgaggtcttcctattccttctaaggccaattttatgtccttggctccattccctccagtattctgtgtgtcttcattttatgaggtaacttgtttttcttcagtctttagtatcttcttttctacaattacttgactgtcaacatatggctgtacccaagatttttctgttctgtaaaaagatgctttatccctcaaatttatgttactgttatcaattcccctattgtctaatttttttaaaaaaaaagaacagtctgttgttgtcatccatactccctcaacctcctttgcactccttacccacttgtgatctggcttctgtctctcaccactctgctgatactgctgttactgacatccaattgctaaagccaatgggcattttatccgggatcatcttacagtctctcttctcttttaatagtgttgatcatttattctctttaaaagctttctactgtcttggatgccatgaccctacagtttagattttttttttttttttttttgaggcggagtctcgcactgtcacccaggctagagtgcagtggagtgatctcagctcactacaacctctgcctcccagcttcaagagattttcctgcattagcctcctgagtagctgggattacaggtgcatgccaccactcccggctaatttttttattttagtagagacggggtttcgccatgttggccaggctggtctcgaactcctgacctcaggtgatccactcaatttggcctcccaaagtgctgggattacaggcatgggccaccgtgcccggcctagttctgattcttttctgggcgtctcatcccaatcagatacttaaaagagtgagggaccgtacctaggaacggtgatcttgttgtggtatacttatttttcctaggagatgttatttgtcctcatggtttcaatccctcctcttattgtgatggctcaatctctacccgtagcccattactctccaacaagcttaagcaatgtatatctagccacttccatagtatccacaattaagtgttacacaggaagcttaagttcaaaatatgtaaagcagcttatgcaaaactaacataactctaatacagtaccttgacctgataaagacaatataaaatataaaacactaatgctatttttgcatacagatacaaaaacttgaaagatattagcaaatagtctgtcactgtctaaaatgaataatactataggaacaggtaagatgttttctagaattcagagaatgaacaccaggacatatctcaatctaattcattgtattatcaaactggaggaagaaacaccatagttatggcagtctgtaccaaaaaggcaattgataaaattcagccatttcaaaacttccaaataaagagaaacaggaagaaaccagttaaatatgattaagaaaatttactgaaacctaactgcaaatttataaaacagctaaatactaaagtaatttccattaaagccaagaaaaagccagggatactcattattgtccctcatatttaatgttttaaagggtctagccaatgtaataagataagaaaacgaagtaaataaatataaatagtaaaaaagataattattttatctgcagaaaatcgagaaaactcaagaaataggtacatttagcatagcagctaaataaaaaagtaaatcaaatttatagttttattctatgccaaaaatagcttgttaggaatataaaagaaattaataaagagtagtaatacaattattaaaatatatatgctttagagttcagcattcatatgaagaaatctttttaaaggaaaactctgctgaaaaaaaagtcctctatttttctgttcttccctgctagataagtatcacagaaaaatctcaatgagactgatggtaagcctgttataatagcaatggaattttgagtgtttgttttaacattgtgaaagaaagtcaacagaatgaaactcagatcatggcaaatatttcttgaggatttactctataatgggtagtgttataggaactgaggctccagcagttaaaaaaatggacagaaatatttgcctttatgtatcttatattttagtattatttttcaggtattctcaatgagttatatatgtgctaagtgctgtacagatgtaatctcctctagcccttgggaactacagtattattaaacccattttagagaagaaggcactgaggctgagggtaattaagtcatttagtcaaagttcccaaggtgcaagtgatggagctaggattcaaatccagacagtgtgactgactccagaacccatccttatgagctgtactctagtgtttagtgactgaggacatggcttcagggacttactccgaggtccccataaattgatcctgtcatctgtaattgaattttcaatcattcaaactcaagcactgatgaacttcctttgtttctctccagataaccaatggttttcttgtacctaactatttacaatgttgattaattgtagattagaaaaaaatttgttagtggctgcaatttcatcaaaacattagttataaaatagcacaacaaacataaacttgagggatgactgaatgtctgtgttgtatatagcatgtccaatacacagtatacttattcataatagatttaaaacaaataaggtgttaacagtggtcaattctgtttctttgtataattaataaaagcttttattgcaaagcaactataagaacatcgtgaaaaatttaacaatagagattagcaaaaatgcagtaacaaaatcaccatgattctaccagaacctactaatgtttgctctaattattcatcattccaaatctttttctacctgtatttatgcacatgtatgtattttttatcaaattgagattgtatttacattctgttttgtaacctaattttttagactatgatctacatttttccatgctagtgaaattttatataatctactacctgatccttgttcagatttctctagttgtccccagaaaagtcctccaaaggttttccaaatcaagatccaatccaagatttcactttacatctgatggtcatgtctatgaagtttctcttaatcttgaacattgtcattttcatgacattcacttattaaagagaccatagaagtggtcctctaaaatttttcacctacttcatttggttggttgcatccttgtggtgtctttgctcttgatccttctattcctagtgctcccagtaaaacagaagttgctttaaacattgacaaaattcagatattgccagaagcagtggcatgcacctgtagtctaagctactagggagattgaggtgggaggaccacttgagcccaggagttggaggccagcctgggcaacatagagagatcccatctctattaaaaaataaaaataacgtaggtgtatattttgttttagaatacatgataaatgatatcatattgtataatatcaggaaatacataatatctgttatctcactatttgtgacacttaaattgatcatgagatgataaactgatcctgcttttgtacagttacacctttctcattgtgaccagaaagcaccctgtgcaacattacttaaataccaacagatacctggttctctgttggcaattaaacctagtgggtataaataacaatggataatcattatctaaatcagtacaggttgaaaaattagattgtcatcctatcacttctacatttataagctggtatttttctgtaaagtatcgcattcactcggccactgaatctattggtcattctgaaatgctatttctactggaaaaacaagataaaaattttctgaattcttactgagtgcctagtaggctaggtggggttgagagagaagaggcagcctcagccttcctactgagtaagacttcaactaaaggattccaccaacgtgatctttctttacttagagccattaccctggctaagattctaaaatctttttttcaaattattaggccataatgccgacaaataagaagcaagggaactattcacttatacatctgcgttggcttttaagctactgatataccatcaccaaattgttagtcaattaaatgtaaacttggaaggttatgtaaatcctaccaaaaaaattgtttctcatcagtggcatcaggcacatttgattttacttcttttctgaggctcaccaaagacctccttgtgaaacacagctattgtttttctggtaataattatctgaacaaatttggacaattcttgttcttggtttcctaattctattggaaaacagccaaaccatttaatgacggttaccctaaatatctaaattatgtgtatctaagggaatatatatatacaatttaatgctagaagagaaaacatgttgttctcttcaaaaaaaaatccctgtggaagtttatgacctttataatcagtgcctttttaaaaaactaagctctagagagtgtttgggttggaaaaggtcacctatttgcaatgatacagtctgtcaagagtgtgtacaaatgtaatatactagaccttaacaatgcaatatacttcattagaataaagaactttttcttttctttttatttcaagtgagactttgttaagtatagaaccatgaattatttctccttgaatatattcttctagtgaattaatgttttgttgttgttgttgttgttgttgttgttgttgttgttgtttgagacagaatctcgctctgtctcccaggctggagttcagtggctcgatctcggctcactgcaaactccgcctcccaggttcaaggaattctcctgcctcagccttccaagaaactagcattacaggcatgcaccaccacacctggctaatttttgtatttttagtagacatggggcttcaccatgttggccaagctggtctcgaactcctgacctcaagtgatccacccgcctcagcctcccaaagggctgggattacaggcatgagccacggcgcccggcctaatgtgatttttattttaatactttgaaacttttatacctaaggtcagacctgagcatgggccagcctgagaccatctactccaaagagagcacaactgcttcttctcttccctgttcctccatcccttctacctgacccctcccctttctccctctaccccatgtagagttaaaagtaggaagttatttttaatttatattgttcaggtaagctaagtaaaatacaattgttctcaaacttgagtagtttatacaagctttggaagaaaaaattctcttagaattcccctaaacattcattgtacatgaatttgagaaaattgcagtactgtcactttaggtagttagttaacattttctaagtttcatgaaactatgagtttaaagaaaaactcagtctctgttgcctggcaagacttctgggaggcgatgaggtgccgtgagcaatgaggacagaatatatttcttatgaaagttgttgcctactgaggactggagtccattgtacatctaattccaaatgagatggtggaattagttgtagtgttgccagacaaaatacaggatacccaggtaaactcaaatttctgataaataatggataattattttagtctaaaaatgtcacataaaataatttgtgatcctaaatctggcagccataattaggtgacacatttagaagaaagttagaaagaactgtggccctgttaaattgatccagagaaccatcatgggcaacctgaatattattatgttggtgagatggagccattgtaagttattgaacagatgagtgaaatgaggaaattactgccttaaggaaaaaaattctcctctagatgtgtgcagaatgatttgttatgagatgagaatgtcctttctgtttgtttgttattattcttacttgtcctcttccaaaactataccacaaacgttttgtgaacaggggaaattcttatttgttttattatatacaacatctagtagaaaatctggctgataataggtactcaataaatattgactggagggtagaaggagggagtggggtagaataatatatttaggaatgctgaaataaatgcaataagatgacaacctatatgatgaaaataatgaagaataactgccaactacttaggaaaatgtgattttaataactcagcttatttaggaggccttcatggaagaattgtgataagagatggtcctagaagctgaaaaggaaatttaggagatgatcctaaaaagaagaaagtttacggcctttcagaattcaggtgggtgttggtgcaccttctgactgtctgcctaagttaggtatataatatcatgctgtttgttaactctttagagtaatggggtaatgatggtaaagaaatatcactagatatgagggatacagatgttaccagtcacaagttttctgcatctgctaatattagaattctgatgtgttggcacctaaaccatcttgagtgtgatcaaagacagatggaattggtgctaagtttcagcaagtagattctcatgttgcctagcaagcttccagtgtagttttactcatatagctttgcccttattgggttatttctaaaatagatagtttaggaaagaacgtggggagggtggtataatcatttctttgtaacagcttttaagtaatttatttttgacttccacctacaggtcttatgtccattgtacactgaatttaaaatggtatttaaaaatagatggtactaatctaggggtcataagtaaaatccctgtatgcagtctatatagttggacaatgcaagaatgttaatttccatttatatatctctacattctaattcagcagttatggagcatatgaacatcacatgtgttaggtgcagagtaaaggagaaggcaagttttcagggagcttattatgtagtgagaaagagacaaacaggtacgtaactgatacagattctgaaagatgaagtagtatatgaaaacaagtgcttaaatgtctaaagaagtgtgttatttattctgcctcaaggaaatcagagaggcttcatagatccattgacatttgatctgaatatgaaaaaaaagcagcagtagtcttccaggaagaatagatttagtaggaactcagcaggcaggagtggtaggacatcaggtgtgaaagtagatgctgagtccagggagtagacagcacattggggctgaggctcagtgatgggatagaagacagaaaagaagacagacaggatggacctttcatgcttccctgcatctatcctgcatacagtaggggagctatggaaggttataagcaggatcaatgggttggagctgtgttatagaaaggctaccggctgcagagtggaaggcggacagcagggcagggcaggctggtggaaagatgttcagctgggaggttgtagtatgagtgcaagggagaagcgatgcgcgctagaagtagcttactgagacaaaagaggacagatccccttttaacacagcggcagggctagatttgggggtctgagaagaggaggcaaattcaaagttaagttcaagacctgtggctcgagggacttgcaaatgttccgacattcatttctacgtgcattgaacatggggagagggagggtaatgtagtctgcagaagagaaggatgtcacgtagggagaactagactgtaaggccctggtgagtagaaagtgaagaatttagctttatgtataagcacttcctacaggtcaggacatgaaaagtgatctttaagaggtagtagtgaatagcctctgaggctccttctgttgttctcttgacacaagaggggaaatcctaaatggctcagtgtgtggagtccagctctcctattatctatctatgtgacgctgggtgtattacataattctgcatgcctcattttcctcatccataaaatggatgaataaacctgcctcattcagttgtcctgaggattaatgaaataactcgtgtcaaatgcttagaacagtgtctggtacagagacagggctcaataaacattagctcttatacactaagcccttacataattgaccaaatttcgtattgatattgatttcagatgtttctttaaaatgtaagcaaagggaaatctttggactaatttgtctaatttgcggaggtatcattatcagagaggacttggtcttttagttgctttttccattaaaaaggcttcgtagacagtatgacgtttagtgtgtggaaattgaccttatgcctatatttttgaagataaacaaagcttccattttagtggggttttattcatatgggtttatttatgaattttgagctgcaaaagagaatagggagctttttataaaaacatgacggacatcataatgttaagtttagattataacttggaagtcagtaccaggttacataatactgtagattgccctgttatgtttttctaggtaaaaataaacaaacgaaaacaccttttcttttgtgtgttttgtgtttgtttctttttgttactagtttgtcatactatgtatcatacttcaattgagggtaagaaaggaggtgccttatgtagggagcacccttctaggtatcagaacacatagactcggactcggccagatttctatcactgctgttaatgactatgagatcttagacatgtcactgctacctctctatacttctgtttccccactcacagaatggatgccacctaccacctctcaaaatgtatggtaaggattaatttttctattacagatttatagaagactttcttttctaatggccgataaatcctttgcggttggaaacaagccatttttcttctttatgtgtcttgcagttaacagagcacagataggaattagctccattgtgtcagtaagaaaactgagatttaaaatttaaaaagtggtacaaatagggggaaagttcctaagtcaccttttatcccctacctaaaacacatcattggttaagtgctttgaacctgtcagaaagactataagaaaaaataccaagtaatatcagcctgctagtctgggctgttgggaatatctattatgccatctgtcacaggagattttaggttggagagcagcaaatccgtgactggggactcaaagttcaaaagcagaaggtctctcctctctgcacaccgtgtggtgtctaaatcactatccgagagacaggcgttttcgttgatcagacatcctgcatctgcaacttcatttaaaaataaaaggtttaaagagtcatcgtttatacattgttccaaggtccctgtaatttaaatcaatgtgatcgagatatgtaatacaaaatttctagccctactgtcttcctctaacttactctgggtcttggtggtgttgcatttttataatggagcaaatcggcagagtaggtggaggaaggttggttttccaaagggatcaggtaagctgcaggtccacgtggacacatttgttacttcggggaagcggggaagcggagaagcagcaattaggcagtggagtaatgctctgaggggcacggactccagttccgtaatacattcctttcttaatgtgacttgatgtagatagagtgagggcctatcaggtgtgaaaagccctgctgctcctggcgtggagtggcctccagacggtgatttggcgacgtcaatctagtcatgcttgatttcgacacttaacgtggtaaagcaggatttctctacccccgatcaacttctcaattagcaagctgccttgtgtaacggccttgttttgcaatccctcagggctgcttcaggggtcattagggtgagaaaacttgagcactcgctccagctcgagcagagcaggaagggagcctcagagatttcctaaatacgtataaccctttttcaagttgtttgctttcatgggattgattcttggcacattaagaagcttaaggctccagtatcttcttttaactgccccccttatcgcctttgcagctgacaggtttttttgacaggctgagagtaaaaagagataactagtaggttagtactttatttatacatgtggacacacaagcacatagaaagacacgcacacacgcgttcaaatatcttttaagttgtcttttcagggccgctggttaccactgaatatcagctgtcaaatgattccagtacctcatgtttttaatattcaatatgtctgagttcaaaatttttgtttcaactatatctgacttcattcactaatgattttaaattggacctgccttattcaatattctctctaaacccccaaatagtatttatatgaataatatgttaatatgaggtttttgtccggggcacttatgaatagacattggaatatatttatttaatgttttttcctatctgtgatttgactgagtggcttactcctaactttcataggaaaaaaaaaaggtattttttctttccttttataagatgtatctggatagagaaacacataataaaaacaggaaaattttaagaattgcactcctttaaaaaaatctctactttcaagcattgtggatttcatatttataatttcctattttgatgatcaattttatatccacttgctgttatcaaactgttaaaaattaggtgaataaattcatatcaaataccttagcaggtttggccttaatgtagtatccttagagcaaattactttaacctatattttgtgaacaggttttcccaaagtggttggtctctgttttttacaaaaatatttagtttattaacagtgagcagagcattatatggtttataatatatttaaattatatataatatatttaaattatatatataatctatatatttaagtcagaggtaactgacttaaatatattttacaagttagaagttggatatacgtggatattacacaccctaacacatactctatttatgaagggtttgacatccagttttagatctgtttgagaaacagttaaaattctaggcactttggcatagcagcttctaagaagtacttcaaataataagtcctaaaggtgacccaataaaggaaatagcttagtagctctgttttttttttaataaagaagatagatacacattctaaaatcgttaattaaagtcagcactgtagaaacagctctttacaaaaaaaaaaaaaaaaaaaaaagagtttggaccactatgcagaaaacatagagaatgtttatgaacaatattgtatgtgaacatataaatatgtaatctacaggttttattgtaattccttctgtagagctttactacgtaaaagtacaactttagtatttctccttcttaatactggattgagagttgtggtaatttattatggaaagcatcaagttttaacaaattaatactaatgaaatgtacctttttcttgcaggataccattttgtctttttgaatctctttccttttgttaatttcttattccaaaaaggagttcatctaatcctacaaataattgctttcatggctttattttgataatgtgggatttttctcttaaatcccactttgaggcaatgcaaaaatccttttaaggattcacaaatttaaaaaatgtgtatgtattttaaatactagcttatattaaataaaagttatatgccttcccttttcaatgagttttaagacaatgttacaagttcagtctgaaaactaagtcagattttctaaattagtgttagctgaatgatccagttacactttgattagaatgaagaatcacagaattttataattacataaatatcttgaaagggtatttaattcaatctgcatatttgagtcagtgaaggaaccaaagaacagaaattgtgaaacctttgagttctcattgctctttggctattactagggttgccatataattttctacccaacccaggacatttttgataaagataacatgagtatatagactaggcaacaggtttatatccaggattgtcctagaaaaatggtgacatatgaatacccttgcttttagagatattcaatctatatattttttcaaatgattgtgtttagagtaccttcttaaagaatttgaaaacaaatatttatactatttatactaatgagataaatggtgttggatattaaatttgctttgcagaaagtactttaacaaaagtgaccaaatagaatatgcttcatgaatcttaggtgcttatgtcaaagaaattcagtacaataaaatactgatgcctttgtaacgtaatatccttagttaaatacaaggatgaatatctgtgataacactttttgcatcccttttctttggaaaatttaacttatacaataggtgacacaatgccccaaaccctgctacttaccttaaaagaaaacattagtagttaggttgtttcttcaacgaggtaagataaaatattaaataaaatttcaaactaaactgtagataatagatttttttaaaatttattattattatactttaagttttagggtacatgtgcacaatgtgcaggttagttacatatgtatacatgtgccatgctgataatagattcttatataggttgacattattctcctacacagcactttttcttgaagtaagtaataataattaaccctagaagaaatgtttgatcatctgaaaatttactggctagctgcaagaattaaataataccttacctattcaaggtaagtgatttgataactttttgtgaataatcaggtgactgttgtcactaaatcacaatctctggatataaaagatatcctttacatcagaacaagtgagttttgcattgcagtccagattacaccaatcactcgttcgtgtttcacagtggagctttgctaagcctgtgttagtgcctgagtgagtaagtggctcttggaaagatggtgaaattgacacatgaaaacattaaatggcttatttgacaaagatctaagaaaatgtcattcccaggattatttcccaactgttcacaaaatgaccatgatcattttcctataatgcttcttttcattttctttatttttcttttctgttgaaaatttcagtatttgaagtgccttaattacgagatgagtaaaaaaaaatattttcaaaccagatacctctccacttaatttcttgttcacttttatatatagtgtatggaaagaaaaggatgaaaaagaaagatagaaaagaaggtaattatgagtctctaagaagtctgtaaagatatcaaaagacttcaatgccgatttttaggaaagtattacttacataaaaagtttcacctagaaaaccctattcaattttaagtagacaaagctttctgaaactcattatagaatagactatcacaaaaaattcttaaaagcttttattatgaaattgtgtaaagcatattccaattagcattaattgtactgtggctgaaactagcagcttcctgagctatatcaagggagagatgtgtagtatctaaatttcccacgatatctaaaatagttgtagatttttatgctcgtataattgtggctgattggcctttccttcattataaacttaccttaaaattagaacaaggagctatagtgattagataaaatatttgtttctattactttaaagatatagttaaaatatttctgttttagtacatatgtgttatcctttattttactgtttctttttcccttctcccttttaatactctagttctttccataactatgtctaaaagtttgaaaaatcctgtcttttaaatatcaaaacaataaatagcaagcttgacacatttcttttattctagcaacaaaagattcttttcagatcgaagattttgtgattctatgaaatgttggtacaattgccatatttgcctggaaatatttttctcatcaaatgttaagggaaaaacattctattttacttttctctgcatagcttctcccagtaggctgctgtgctgatcataaatagcagtaacacctgctcgtaaggctttggaaaatgggtatgagaagaaattgacaattatttgttgaaagggaaagtataatgtttaaacactgtttgcaacttttaagagtcaggtgtagaaagagacatgatgattctatgtagaccagccattaccctctgtcagtccagaaacctagagacttttattcaaaacaaccccttcttgccccatttttgcagggaaaaacaaagaagtatagtgagaaggaaaaacaaatttggataagggatataggttctcttgctagctctgacactaaataattgtgtaaggttttgtgtgtagacatgggatattttctgctctctatagcagagctaagacagggccaattagcccaagcgtcaacccatttttctttacatattgttgttgctgtcttcatggagcaggaaatggcaagtttagaaaggaattaacactgagtaagcctgaaactggaacaataggtggggcattgtcatctatttcagattatgagagagctataatgattcacactattagcatacatatttttaagtttcaagttagaaaaaaatgtctctggcctgtattttttcttatctttaagcttagaacattataagagagatttctaggatggatttcagttagaaaattttggatctccatttgtttcaaagttataactgtcatatatccagggatgtaaagaaagctgaagctatagaccagcactgtccaatagaaatagaatgtaatccacatattaattttaatatttctagtagccaaagtagccaaggaaagtgttttaaaggtgaaattagttttttaaacaacgtatttaatgcaatgtatccaaagattaccatctcaatgtgtaatcaatattttcaaaaattattcatgaaatatttttcttttttgtgctaagctttggaatctggtacatatgccccacttagagcatctcaattcagactcactacatgtcaagtagtcattagccacatgtggctggtggctaaaatgctggtcagcacagcaatagacagtaagtgaatgggtacttagcttggattatgagtggattggaggttggggagaaaccagccatttggtaaaactgaaagatccacatccagagtatggagggtattgcttttctgttttctatgtttctctgagtatctcaagtctaaaacaatctattttgaatcacaaccttcaaactggaatggattctgtaattgtttatggcaggtattttatacagattattcacagagcttgacttgattcttctgtaatgctaggttcttacaagtcttgtgtagttctaatgggaaatcaggtttccattaacatacaatacccagagaaaccgatgacaataactttcaccaagatctctttcctcacctttagtattcctttttattttctattgttgccagtgtagtactaagtctagatctcaagaattccaaaaaatcaaacagttaaatattctttctccctcctgttcagggataatttttacctgtaattttattacccccaccatgttgttaaaatgggtcagatcatgatcgctactcagtaagtccaactagtggttggcggatcttaggagtgagccctctgagtgggcttgagcacccactgctgcctggtggtgttctgtctgattgaaggaagtgtggagttttgcctgagtgtaggagagggatgatattctgaggattctcttaaaataccaacttaccaaacatgaagcttctatcatccaagctgtcatcacccatccaggctgtgtaggtttctctacctactccacctaacctccaccaagcagactactaccatattggtcatttaaaaaatagcctttaaataaaccctgatcttgaccacatagaggcttctgctcaccctctaacatcatcccacgatgaccttctttcagctccccgcagttctctacttgtgaaatgccatgtcattcaagtcctgcttcagctggtttgtcttccccagtcctccagcacaagcctaccaagtgatgtaccatcctcccctttattgtagagcacttctcgtattctatccctgagttatccttctcactggttgcctggcaacacacacccatagtccactgaacatttcccacaaagtaccttgcacgtagtaggcatctactttcattaaaaaaggttcattgaacctcagctttctctcaataccatgaattattgctgggatttcaggtaccaagttgtagttttttgtttgtttgtttgtttgtttgtttgttttgaggtggagtttcactcttattgcccaggctggagtgcaatggcacgatctcagctcactgcaacctccgcctcgcaggttcaagtgattctcctggctcagcctcctgagtagctggaaatacaggcgcctgccaacacacccagctaatttttcatatttttagtagagatggggttttgccatattggccaggctggtcccgaactcctgacctcaagtgccaagttgtagtttttaacatatatatatatgactatgtagcatgggcttttggtagttttttactgaaattgtagttaggcacttagtaagtttaacttaattcttcttctctttccttttcattcagtgtagtatctgcctattatgtgtgtatgtgcatgtttggagagagaatgaatatatgtactatacatgtatatatttatacgttgaactttcagcaaatggcttttatgtttctgttttggcatgatctgtatgtgttaataaagaaaaatattatttacaaaggctgaactaaataagctagagttaatatagatttaattatgaaataaataatctctaaggttttaaaatagaaaatgtcttttctttaatatatggtcaacttttaagcttttttgaaaatttctttttttaattagcaccttataatggtacatatttctagggtacagtctgatgtttcaatgcatatatattttgtgtaatgatctaattagggtagttcaaatacccatcgcctcatacattatttatcatttttttgtgtgttgaaaacattcaaaagcttctcttctacctattttataatatacagtaatttactgttgcccatagtcaccctactgtgcaataacagaacaccagaacttatttctcttaactgtcattttggccccattgaccaatctctccccttcctccttccctctctgctccctttcccagtctctggtaatcactatgctactttctccttctatgatgtcgactttttattttagcttccaaatgactgagatcatgaggtatttttccatctatgcctggcttatttcatttaacatgatgccctccaggttcatccaggtggtcacaaatgacaggatttcattcttttttatggctgaatagtactccattttatatatatatatatatatatatatatatatatatatatatatatatatatatatatggcacattttcttcatccattcatccattgatgggcatgtaggttgattccatagcttgactattgtaaatagtgctgtaataaacacgagagtgcagatatctcttcaacatactgatttccagtagtgggatttttaatccagtagtgggattgctggatcatatggtagttctgtttttaatttttttgaggaacctccatactgttttctgtaatggctgtactcatttgcaatctcaccaacagagtgtcagtgttccttttttcagccttttaatcttaacttcaggaaaattcaaaatcatccatgaaaatatttaatatgtggtagacctaactgcaacaattagaaacacagttcaaaataatgttaaacatttatatttttatatgtacattctaaaatgttcagtgttttcttttttacttttctttaactttcataatacatttatctctatgacagtggagcacatgctgagaacccaaaaagagaaagaacaatagactcaactctctacagcctgtaatgggctaactttttaagttgaaaacaaaagaattgaatgtttaaagtgttttcattttctatcactaccttccttagttgaaaaagtaaaagaagaaagtagatgagaagcatgtttgtaatagacaaaaaagcaattgtccttcaatctgtgaaaatgttcattccttcccacaaaacatattcaataaaacttttccatccaacagtcaaaagttaaaaatcttttcaattgattgcaatttcatagtcttcgaaagccaaactttcctttctctgttcatctgtagttattctatagttttttttaaagataggattataactaaactagtcttatccttaatattttaacaaatactagaccgggcatagtggctcacactataatttgataactttgggaggccaagttgggaggatggcttcagcccaagagtgtgagttcagcctgggcaacagagagagaccccatctctacaaattttttttttaaaaattagccaagtctgttgatatgcacttgtggtcccagctacttggggagctgaggcacgaagatcacttaagcctaggaggtcaaggctgcagtgactcatggtcacaccactgcattccagcctaggtgacagagtgagactctaaaataaaataacttctaaatttatgcatatttatctcattaaatgaggattgcttgactactgatctgatctttactcagaattaaggtttactgcagtgacatatttgtgcattttcctcaaatattaaattactttgagtcaaatactatgctttacatagcttggaggaatttgatttagtgacttgagccactgacctggttaaaaaaatctatagaaacatctggtgctgtgaaataaaagacactaatacaatgaacactcattttcccctgatgcctgtagtaaaccacattcattattgctatgttaaatgagtatatgtcttgagtttttccctacccccagtccgcaggaacgttagaaatggatatacactaaaccataaagagtttgcttgctttatggcaatgttgccgaagctgttgaacatttagtaaaaatgcaaaatgttctggcacctttaaaaacatctaaacttgttttgtcttagttcttgcaatgccacccatacacaaaagttattaaatatttctctgtgcatgctcactacagtgtggcaggtgtaatacagcatacaggtaggccgtgttcttacccctaagaaagttagaaagttgtctgtttgatttttatattcatgtctgtttttagatagacaaaatgaggtagtgaaagcaaaaaaatggaatagaaaggggacagaaacatctctgggatttctacagatattaatagttatatgcactgatattgtatggccggtacttgtcaccttttacattataagcctacttttggaagtgtgtcagaaacaagataaaggtcatattgcttaaggcctactatgaacataaatgatagggaaaaatctagcccataaattggcaaattaccatgtatcatgatttaataatctataagacatcttaaaatgagcaaaatagatcaatgagcttatttttttccttaccgtaaatgtataagctggtatgctgtgattaatttagatcaaaatttcaaaatgacttcctttttaaaataatgctttgtctgtctcagtgtacgactaagaactcttaggccctcttatctagaggatgtgactgtacaagcactacaaacaagaatttacaaggatctccagcttaaatggaaaagtggatctatgataactttataaacgagtgtgggagtaaagagtgcagaggaagaggttacaagaattatcaggattatgagtactcaaaatgaattagatagttaagagactgtttttaaatatttcctaggcacaatctgaaaaaaaatcttacaaaggagaactatgcctgtcttatgcttaattgacatatatgaaaattcttttgcctcgaaacccaaatgtcatgtttggaaaccaaaggataacattatacatttgaaaatcccattttataaaataatactttgtttattttcccagagaatcctgggtttgtcccactgagaaaaaagagaactcgaatgtagctatagaatgatctcttgatccttggacaaaactgaggaaaaagtctaacaaatgcatcgctttgcagtaaattagatcagatttccgcatctccacactcagtctgtgagctgacagttcagtaaaatgttcccttgtaagattcgccctcttaggaaaaggggcaataattcatcattaggatatcagagtccaggtgtagatggaaactgatggagcctccagcgaggcagggaaagtgcgtggaagaagaaaattttatctgaagcctaattccctggttacagcagagaataattaagataatattgcttcaagagtcctttaatgattaaaaatcacatatgcagaatccataaattggagggcaacaaattggaaggctataacgtcagagaactgttttgtgcacattgtagtggaaagtacactggtagcagtgcgccgtacgggcagccatcagagactcggaccattccaaggactttgtttagatgcaacaaatcatttgtctgttattaacccagagcttgtaattatgcagattgccatagattttcctgggcctggaagtgagattgagggttgttcacagtatagcaggcagctcagggctggccatgcattactgaacttgccacatttatcatgttgactgatggcagcagaagcaggtctcaggtcccagtggttaatgtagtgggtaattaactgtcatttgcctagtaataggctgatgatcaatggtttgtgtggaaacaaattctaatcaggtagctgataaatgctcagctagcgagagcaattgaaatgggggaaaactacgtccagaatttcaaaatggcattgtgtgtatgtttattagatatgaacaaactgaataattcttaaaaacggctttatcgcatgttaaccagatgttatatacacaagtatatctatattcattgaataaagaacttttaagtttttcttatttctcaaaaataataaagaacagaagaaacaatggcacatgtaagtgatctcctaagcagatctcctaagcagatcatgttaagtacactgaaaaataaatatgaaatgttagaatgaactaaaaaattctccttacaaatgaataggatgaaagctttagttggtgatggtttcatttttgatgatgccagtaggaaattaagatattacattttcgagcaagttctttctttttaaataaatattatttatcaaaatacagattacaaaaggagaacatgaaggttacttgggttatagtccttaaaataagcatactaaagtattttttaattcattaaggaaaataagtgtctaacaattatgaatttgatcttcttgaatgtaaacttcgcttactttttatcaagtgcacagactatgttagcaaagtctttaaaatgcatttattgtttctaccttcaaggcgcttatgctcttcaagagacaatccaacaaaaatatgagcataaacattcattgcacattttgccagacacttagaaaccattctcacaactgtttccaacaactgtcattatcctggtaaaaggaaatagttataaacttgaaaatgaatatgcatgccttaagaaaagacttctctttggagtctacagaaagtaatgagagacttcagcacatttgtgcctaatccttaaattcaataaaatgaaaggctaaggtttttaaaagtacatttttataaccaaaatgagttttctctatagcacctttgaattcattagtttagaactgcttttaatttggtctttcccatgagagccattatattttcctcctgtcagcctgacactggagaaaaaagaaaactggcagatgtggtgtttttcatctagtttgcttcctagtaaaaaagtgcattaactactatgcatggaatattatttgtaataattcttcccctccattatcaactttaaagaaacttggtttaaatattgccagtgcaaatggataaaatatttcctcacgttatgaaatgagagacattttattttgtacttcttttaggtcattacaataacgattctcaggaatctgcagcaaataggaattttttttaaatcctagacaattccagtggttctgacagtatattatccttcaatttctggtctagctatatatagtttacagcctcatttactttaatgtgctacttgaataacataatcatagctataactatggtatagagccataaggtgcatgcatgcgcctctatgttttttgactatttaaatggcttcttcataaatgtatttttaataataatggcaaaccttttagtaactaaatgtcaaaaagtagtgaatcattcattagttggttcctttcccaactaaaatgtttaatatataacattaagagcaaagttatattgcttttatattttctatatactctaacccagagatttttgctatgaattcacccccattgacttctgtttatgtgcagttacgtaagcttcctaatgtatttgtcttttccttttcttctcaaacaagatgtgattttcatcaaggaaggtcaacggagaatatattgcagaagaatatttatgcatacacctaggataaaatccacttgtgtacatcataaagcattgtgtattgtagctttacagagtatattaacatcatctctcttcacgatctcagatttctctgtaagagtttgtaaaaaaaaaaaaatgtttcttattctaggctctttggtgtaacgggaaactgcgctgcctgtagtaagctcatccctgcctttgagatggtgatgcgtgccaaggacaatgtttaccacctggactgctttgcatgtcagctttgtaatcagaggtaagcaggtctctttttggtctctaagaaatggttaacctctctgtgctggctatttatttaataggtggaaattatattcatacatttaaagcaatcaatctcagcgtttttctgttctgtaaactttaatcccatgccagagacaagctactaaggagaagaaaggtcttaagacttacttctacctgaaagaaaagcatcatataagagcaagtaacagaaaatggaaacactaccgtaaactctgacttcttttactcattccttcttttattattttcctgtctttttaaaagtagttttaaatatctacttttttatactacttatgtgagtaaataaattggcaatgaagcaaatatacaggaatttgttgcaggtattttatattcttattattttttatattttaaattccttatccctcatgtttttgtttttgcttttttaaatacaaggtctggttctgtcacccagcctagagcgcagtggcactaacatggctcatgcagcctcaacttctgtgctcaagcaatcctcctgcctcagcctcccgagtagctgggagtacaggtgtgcactcccatgcctggctaattttttttttttttcattttttatagagatgatggagtttcactatgttacccaggctggtctcaaactcctggcctcaagcaatcctcccacctccacctcccaaagtgcagggattataggcatgagccaccacccccacccaatctagctgtttaccttaaattttaaccctgtcctatatgtacttttgcagttacttcaaatatctttgagaatcagtccagatatagctaataattaaacaattattatcattggagaggagcatttgaaaaagtgttgaacagggaacctggaaacctaaattctaatatgggctctgccactaataagctgtgcgatcttaaaccaaacaaacaccttccctctctggacctcaggtttttcatttgtaacatatgaagctggattagttcatctcagagaattctttcagctgaaaagtattatcacttaattccattttttcttattgaaagttatattttttatttctgtgaaaactatatactactggcacctgttttatatgataaatggagaggattttagaacattaaaatgtacgtattaaaaatacaacatttcaaaaattagaacacttgatagattttaatgaaaatgaattcactgactttctgtgagaacacctggcagagtatataatcaataaatattagttgcatcaagttctcagttattgtaatttactctgaaaggtactatttgatgcagaatcttcttatgagaccctgtagaatagtagaaagaatgtgacatttctagtgagaacgggattcaaatttcagcaccaccatatattagctgatatattagctgtgtgatcttgagtatgttacttaatctctctgaatttgattcccacacccataaaatagaaacactaacacctctcttgcagagtttgaaacttaaatgaaataattaatttatattaaatgtcaggaacacaacaggttctcaaaagttagttatctttataatttaccaaataatattccattaacttgactttcccacaaggcatgtatcacaatagtgtttcttgctaaatgtagatattcagattgttgcctaatgtaccttataatgtaatagttacccagacagtcatgtaagatgttatcttacaatgtcttgactcttcccagcaagtactgagaatcaaagtaagttcattcagtctagggtaacatttagacgaaaataaattggcaaatgcacatgtttttggtagggataaggatatacaaacacaaacattcccacatccatacagacacctttatgtgcatgtatatatgtattttatacattttaaaggtgtcttagtagtaaatttagaatacttttgttgacttgtcatgttgatcaactaatagcagccagtaaccatgcagttcccattatggaatcataaagtcattgcttttctacttataaaagattacatattcatagtaggaaatttagaaaatagaaaatgataaaaacaagacattgtcccatgtctcattcttctaaaagaaaacattttaatattttgatatatagccagccatacatgttcctatgtctataggacaaatgacattgtataaatattacactcacatttaagcaaattaaagttacaagggagaatcctaatgtttgatatttggactttttcactcaatttatattttgtgccttttttacctgccattaaaaattcttttaagatattttaagcttttctgagttcagctttatggacagagcttcacatatgtcttctatcatcagatatataagttgtatcttcaaaagtttttgtgctgtaaatattatcagtattatcaatataaaaatggaccttatgagaccctgtagaatagtagaaagaatgtgacatttatagtgagaagagattcagatttcagcaccaccatatagtagctgatatattaactgtgtgatcttgagtatgttacttaatttctctgaatttgattcccacacctacaaaatagaaacactaatacctctcttgcagagtctgaaacttcaataaaataatttatgttaaatgtcaggaacacaactggttctcaaaagttagttatttttataatttaccaaataatagtccactaacttgactttcccacaagacatatatcacaatagagtttcttgctaaatgtagatattcagattgtataaaaacaaatgctcatatctctatctggttaaattcacagagcatgattacttaaacaaggtatataacagtttgaaggcatatgctgtacattgcttaatgatctccaggaaagttataccaattattctcctagcagaaatctacaaaactacgcattccctcacattcattctaaaacactaggaattacgtttaaaaaaaaaaaaaaaaaatccttgccaccttaagggatgaaagatagtatttcattataatttctaactggcatttatttgatccctggtggtcctttggtattccttcttttagagaagtaggcagtttatgtcctttgtccattttcttctattaagtagggttacctattttatccatgttctacatagaaaataaaaacattcaagtgctaaacccagcctaaattctattatgatgcaaagtaattgtaggttgttaatgctatttacaaatcatatatctattttatttcaccattgaaataaaaagttgcattcacaattaagtctgtctcctcaggagaactcagtcaagtaagacaaacactcctaaattttgactctaaaactgttcacattcttattgctgcgaaatactattctagtatcattattaaagtacctaatatatttctgtgttcgcttcatttattacatgccataatgggactgcatatctttagtgccggttatgcacaattagcacttagttattgtcttgtcacttcagcccctacaagacaaactaatgcgggaagtcagctaatcttcatcagtcaagcaaagcagacaaattttgttacccaggatacagaaggttttcatataggagattctccttttactctgaagtttgcttcagtctcctccaggaaacccatatcccacttccagtagccaaatcattgtcgcaatattgcacttttcaagtgaaacacaaggcaaataggtaattcataggcattttctcttaagcaaactttattgacgtctaaagttgtggaattacgcgtttgtgaattgtattcagcagtcatttcatctttacctttaaatcaaagtatcattaagatccaaagcatttctgaatgttttaaaaagtagcagtaataataacctttcaggattgattgtcccttatatatagatctcctctgccccttttagaggcgtatagctaaaacgtgaatcctgcattaaaattcggctagtttctctattttaaaaggtaccgcaggagggttatttaagcttattttatgatatcttgaatctcattcagaattggaagattctatataacaggttaatttcttaaaggtgaataagccccttctccttagaaaacacaataaaactaaatgatagttttgtaagaaaaggaaaaataaaaagcttgtgatgaaattttcccaaatatgtaaaattatgtaacaattaattaattttcttttttttaagaataaagcactgtgctaggctctgtggaagctgaggtggataaaatctggtttatttcttagaggtgtccggagctacgggagagacaggacatcaaagactcacagaagagtgtaatcgatgctaaatagagctatactgagggaagagagagccatccttcttgaagtgttagggaagcatcaaaggcctgatatgctgggtcttgaaaaaagaactccctagaactggttgacttacaggaagtgtgtctgctcggggttggggaagatgagggagccagggagcagtgaggaaaggaattttcaggcaaattgagcaacgtgcaaaggcatgcagatgtgaaagcatttgacgtgtttaggaaatgaaaagcggctcagtatgttcagagattagagaagcggtttggtaggcacatggaggagtagaaagagagcaagcacctagaggaaatgaaattgtaaacttagtctttgaaaagccattaaataaaagtcaaaatgaatacaaatttaaattagtcatctaaaatacatttgttatttaaagctgttggtttctggaataaatctaccttaaccaatttttattgaccacacaccttaagtggtagtacagtttatgatggttctgcaaagggttcaaaagaaatataactcgtggtcatttaccgcagaactgctgactataatggcaaaccagttacacattcatgagaaattttgaaacaccaaaataaacaatacaccaataaataagtgctttgggaaacatcagaataagcaaatttacatggtcagaagatgttgatggaggcaatgggaactcaaggattgttacaatttaagtagacagaaaaaggggagaaatatttcttgctagggaacaacttaagtaaaggtgaaaagattatcattaccaaataataatgatagcaaattctgataaagtattagtcaaacaccaaacaccgttctgagtgttttacatgtactcattcgtttaatactcaaaatatcccataaataggtagttattagcttcatttgacagatgaggaaagtaaagtataggaaatgtaagtaacttgcccaagattacagttagaagaaagtggtagactcaagatttaaacctggccgggcgcggtggctaatgccggtaatcccagcactttgggaggccgaggcgggcgggcggatcacgaggttgggagatcgagaccatcctggctaacacggtgaaaccccgtctctactaaaaaatacaaaaaaatgagccggtcgaggtggcgggcgcctgtagtcagagctactggggaggctgaggcaggagaatggcgggaacccgggaggcggagcgaatctggtctccctctccggagtcaggcccatttcaagagaggtattttattttctgactaagagcatataaatgtgaatagatatagtggacttaaagtaaggtaaactttgaataatgtatagcaagatttggggtgtgggtagtgtcatttgatacactaagggttgttagcagtgagatgtataatgacaaccggactgtcagtgggaaagacagtaaatttgttcacaggtgtatagtggaggaatgagtacacaacccggacttcttattgaaaacagtatagtatagaaatctctaacttacagttaactgaagatgtggaataggaaagtatagacactagaaatatggattggagctccctagctaagtgttgtaagatagaaattaatcataattgtcagtcactaacattagggaaagaagatggctaggctaacatttttatttcttaaaagggatgttaccagtggaggcttcttagcataggcttttgataacctgcttaaaactaagcactatattttataaggatgatttactatttacacttgtttcatatacttctcaagtctctaagactatatgaagtcagctaaatcactcaaaaatatctagaaattacatctcatattaattccaaaacatcagaattagatggtttaataatctaattgggcatcttcttattccttaccataatttttttaaatgagggtaaaattaattgaactgagcatactacaagtaattagggtcagattacaagaaagattatgtttatttttagtaattgtagcctgttaatatacttacagtatcctctggctatcactcctttcataatgcttttttttttttttcctgcaaatgctgaatctcataagaagttggttaaatcacactggaaattagcatttcttacaaaatcacagttacagattaatttgttaaatacatactatctgtattgctgtctctgaaatttctttatatttatatatgaagcattttttaaagaggatgtcaaccttaattgcataccagtcgtaatctgctcttaaccacagctttcaaggctgttttgtttgagtcatatgtgcaagtgtgacatccctcatccatgttcgtttcatcttgacctttaagtataaattgaaatgcatataaaatgcactttatccagttgataacatattagtaataaaatatgtcaggtaggaatattttagaaaagttctgtctctctctcgctctgcctctgttgctctatatataccacttaattgaatagtaggcagacttttttaaagttatgcaaaagaaataatagtaatacaaaaaacacagttacaccctgtataaccatttaatcttcacattattcttgtagcctgcatgctttactgccctcaggtaaaagcttgagtcttgaatccaaaaaggcctgggttatttttcttcctttactataaacgttttaactacagaatcttgggcagggctttgaaattctggcacggagtcttaggtttttcttctgtaaaaagccatgacaatgcttactttctaggttggatgtagggaataaatgtgatcatgtacatacatgcttagcatttagcacatggtaagcataaaaaggtggctattttacctatgtttcaaacattgaggtaagattttagatatttcatttctactccttgccacaagcctacaaagtcgactgatgtcacaggtattaaaaaccaaagttttattttcaattatcataagtgggaaggtagagtttggaccctactggttgcagtatacctctctgcctttcagacacttttcatttgataaggatatcaaactggcttgcacaaacaccattattgaagtgcaacatttaaagtatacaggttacaactaatacaaagaaaatatacttaaagccccaaacttgaatgttcattgtatccagtagctttgaccacaaacaaccctaggatttcaagatcagtgcatagtctgtgctttcaatcaacatcatcagcaggcagtaatcctggggaaaaaaagtaaattccacaaatagaccaattttcctttaagaggaaagctaattcttttcagtctactttttttattacactattttcctctctatctacttagctagtataaggataaatttccaaagctacccagttggaaaaaaataggttcactgtttgtctagcattccaatctttgcaaatgtaaatcagtccaactgctcctcatttaaaccttcaacttcacaaaacattaaagggtggctttcactacacaatttaatctatccactaagatttctgctggaacatcatttgaaattgactatctgataaagagagactactatcaaaggtcatagaggtcaacttgtataattacaagtagttttactgggtcaactctaccagacaccactatttgaaggttaaattgttacaattaaatatatatacagatctccccagagttactttattgttaaatgtaccagaaacagaaaaaacatttatttctgaccttaattgtgtccaaagtgtcaccgtggggaaatcatacagaaagaacacttattaaaaacattgcagtcttgcacattaaacaatgctttatgaaataaaatgcataattagctattggaaactagtttagtttatcacatcaatattaagtagttcatttaggttactccctttggttgaattggaagtgctctaagaaatgacatctactatttcatgttggtgaacttgccacaaacaaaggaaaatggctcagcatcagaatctgatgctagagcaactttcatttcagaatgatcacttctagattactaacatttaatcacattttaataacagagtaaaagaaagctttaaatgggaagctttaaaataggctattttctaattgtttgattcattttaatgccttttacttttttattaagtgcctaaatggccagagatgaaatcatccataattactgcagtgaaacattattatcattctttcttttattttaatgggtgtaaatacagatcagttctttttattttttttctttccagtgtggtttaaaaaaaaaaaaagcaagtcatctttggtgcccaaagtgtttatctcaatatccttagaatttttgcatgcaaaggcaagatttcaaatgtgtgcaacatttcattaaatgaagtaaatggtaaatggtctaattctgataatgaagacaactgtctaagccaggttttcagattcagggaattaccatgcgaaactattaataggaaaataaatcttcaaatttctagatccaagtgaaatggtcttaaccacattttattgtttaaaatattttcagattttgtgttggagacaaatttttcctaaagaataacatgatcctttgccagacggactacgaggaaggtttaatgaaagaaggttatgcaccccaggttcgctgatctatcaacatcaccccattaagaatacaaagcactacattcttttatcttttttgctccacatgtacataagaattgacacaggaacctactgaatagcgtagatataggaaggcaggatggttatatggaataaaaggcggactgcatctgtatgtagtgaaattgccccagttcagagttgaatgtttattattaaagaaaaaagtaatgtacatatggctggatttttttgcttgctattcgtttttgtgtcacttggcatgagatgtttattttggactattgtatataatgtattgtaatatttgaagcacaaatgtaatacagttttattgtgttaccatttgtgttccatttgcttctttgtattgttgcatttagtacaatcagtgtttaaacttactgtatatttatgctttctgtatttaccagctattttaaatgagctgtaactttctagtaaagaattgaaaagcaaatctcactaatgatacacagatagataaagcaagtctatcaacattaaaaatactaaaaaataaagacacacacagagcattttagtgacatccactacttattgccgctatgagttagagtctatcagtgttcttgttataaccccctattttcagggggttaaaaatcagctttaaaaaaatacataaaaatttcatcttaaagcactttcattttataccaacgtgaaaagtgccatttttagaataactttaaagcttaacaggtttccttttaatatcctttttttgtgtgctctttacttacacaatggctttgttttgctttttcagccacaccccttatgtgaactagtgcctttgggtatcacgtaaaattttttccaaagggttactttaaaaatctgttaccacaattatgagatgatttttaagtgataaattaaacttcttcttgtataaattctgcccagatctctccacaagagctgagggtttcataactttatggcttaataaatgtatgacactgaaaagatttgagtgtgaatctactgaaatcactataatgcacattgaagctatgatggtatttgagtagtgaggttacttttgatcggagcaacataatgctcatagaatcttctagaagaagagaaacaaagggattgataaaatgctgagaactagtgattatatatttttctgtatttacctgacatttattttaatgttcaaaaagtaaacactttaagtttgatgtgttttactctctcattgttttaagtaattgccaactcagaatacatcattcttaggctgaaatttgtctttccattttttaaggtgaaatagtactaccttacgtgatagcatacaaagaagaaagctctagaaagagaaattatggagaatgattatttaaattacaattaaggaaatgagaatatgatcccctcttccgagttgcccacaaacttgcttctttgcttttgctccctgtaatagaactacttttcaacaaatctaattttgcacggcaccgttaaccatattttcactacagcaaacttagtgctatgggttttctttttctttgtttttttcttgatcacttgtataggaaacaatattttccagtgttatttgcatatatattttgtccttccaatatatgcattacagatgaaaattaaatgttatacctgaattcttgggttggggccaaaatattaagctgaaaataatgctggtgtggatttgttttaaaacaaagctttattatgaacatgcatgtgaatctggatattgcctcttatttttaagaaaatggttctgtgaaaagtgaatgatatgtatttttccaaatgcttcatggttaggagtcttcaagttccatgttccccagatttgagatatactaaagaaagaaattcaaaagtagctatttggggcccacaaaaataactattattttagccttagagccttacacttgtttcatgaagagaaaggacttgcataaccaaaataaacaaagcaagacaaattaaaaatatgtgggggagagatcagtgaaaagtggttttcttaatgcagccctgctggtccccattaacaattgcttgaaattcacatggatgtaaaattataattgtcaggatcttattcagatgatcttttaaggtttaactggttttgcttttgtttatctatatgtcaaaatacttgtaaattgggaacaaacttctctcagcttcttgaagttgttcaactatccttgccactggaagaccaaacaaggttttcactgctttttcttttacataatatgctgagaattatttcttatgctttttactacaaacaaaattactcacctggattaaagattaaggccttaatctgtttagattatctttaatctccatgaaatcgtgaaataagacaagaatagtgtttcagctgtaggccattttacagctaattgcccataaattgtagcatttattgacctgaagtactaagctaattgtcttgactactcaaagcccctgaattgttgtcaactttcccctttgtgttgtgtagccctaacgtcatttagcttgttgtctgatgcctccagtaggacacctccgatggagctttgatttctgagcagcgaaagctcccttcctaagatgcatctcgcataggctgcctatgatgaaggaccgtgcacctccactccaacagagtgctgagtttaaaagttgacctgtgtttgtaatttcactttcatcttgcttaataaatatctgctggattctttcattcacttttttacatttggatttatgtttttaataaaaggggtgttacact

SEQ ID NO: 36603 - DNA, 13521 bp, Homo sapiens
ctggcttcggcctcagccccaccatggtgacgcttgctgaactgctggtgcttctggccgctctcctggccacggtctcgggctatttcgttagcatcgacgcccatgctgaagagtgcttctttgagcgggtcacctcgggcaccaagatgggcctcatcttcgaggtggcggagggcggcttcctggacatcgacgtggaggtgcgggctagctgcccgcagctgaggcttggtcgcgtggccactcggggattggtggcacctgggaccggcgcggggcctgtgtggggagtgggcttggaagtcgctgtccgagtcctggagaagcccaggccgccaccccccgccccgccccggccacggcgacctcctaacggccccttttcccgcgacttgcctgggttccgggatcccttgggggctccttcggcatgcttggttgctttgggttttctccttgaacgacgggttcctgttggaacctctcgctgagctttgtgaatcaggcgccgcgtgtcagtccgggccccaaaggcgcttctcagtcacagttagctggtggcgggtctctatccagttagcacctgccttctttcgtgttacggattaatgctggaacgtggcacggaaacttttccaaaaaattgattaaaatcgattgaggattaaaaacctattgagtgctaggcatactttcgcgttgtgtttatttttcatagaagcaaccttaaggttctactctttacgcctccagctacctcgtttagtctcttctgccaaggagagatggggagttgggtcatgcgttttaggagtaagcagtgcagtgaagtatcaggagaagacaggagtttaagaaaccagcagtccctaaatctccactcatgttttgtaaaccaaaagaatgatgtgttgctagtttttattttaattcacctgctagcatgattaattgggtctaaggagtttccatttgacagtgtactcagtagggctgggcacaagttacacaatacaagtgaaatccaaaaataaggggataacggaagggagagactcttacacttagctaagaatttagcgatcaactattacagtctcgaagttatgcaagtgacatgcactttgaaagagcgactgacttgatcacagcctaacagctgatttgtagcagactgggatgagagtttgggtcttctcatttccaggctagtcctttcccctaagccttcaggcatctcagataaagcagaattccttcactgtttggcagtaatctggaaaaccttgaaatgtgataaaaattcatcttgtttatattttaaaaaaccacaaacgtttattacctcatggtttctgtggccaggaattatggagaggcttagctgggtggttctggcttggagtatctcatgaggttgcaatcaagatgtcaaccagggatgcagaaattctttattttaaagagatttcttttttcttgagttttgctatcagtcacagttccatgtttgttggtgatattaggccagttagagaccacatttaaggtgagctttctgtttctgaggggtttaataaggataaataagacataaatgtcaggacctaaaggtgttttagaaagccatgaagtcaactcttattttataaagtgggagaattgcagcccaaaatggttattatcacttaccgaagtgaagctaagtgaaagttacatattcttggtgaatttcttttttttttttttttttggaccaagtctcgctctgtcgcccaggctggagtgcagtggcacgatctcgactcactgcaacctctgcctcccgggttcaagcgattttcctgcctcagcctcctgagtagctgggaatacaggcgtgcgccaccatgcccggctaatttcgtgtttttagtagagacggagttttaccatgttggccaggctggtcttgaactcctgacctcaagtgatctgcctgccttggcctcccaaagtgctgtgattacaggcgtgagccaccatgcccagccatattcttggtgaatttcttactgccattagacattacttataaagtctatgacttaatcttttgtgacattttatgcatttctctcttgcctccagattacaggaccagataacaaaggaatttacaaaggagacagagaatccagtgggaaatacacatttgctgctcacatggatggaacatacaaattttgttttagtaaccggatgtccaccatgactccaaaaatagtgatgttcaccattgatattggggaggctccaaaaggacaagatatggaaacagaaggtgagatgaacattcagaagatttacatcacattccaagagctaattttagttctatacatttttacctgtctgagtggagtacttattttttttaaatttcttaaccaaaacctttttgtgaaatacgctttttattttttgcaagtctcctaattaataaaaaagtttcttgaggctagtgtttgtttttttgttgttcttttttcttttatttatttattttaagattgtgtctcgctctttcgcccaggctggagttcagtagcgtgatcttggcttactgcaatctccgcctcctgggttcaagcgattctcccaagtagcgtcaggcgtatgccaccatgcccggctaatttttgtatttttggtagagacggggtttcaccatgttggccagggtggtctcaaactcctgacttcaggtgatccacctgcctcggccttctgaagtgctgggatttttttgttctttacatttgtcccttctaacagattttcttagtcattttgtgctcttgtgagcatgtaggttccatgtgtcttcagttattttttctgtttatttgctaatcctggcatatactttatttgctcatttgtatacatgactagtttagctaaactttttgttggttctttttgtgttaagatatcttaacttttctttaggtggtggagatacctgggatggtatgtggattgctttttgacagcatcctttttgcatctttttgtttgctaatgtctaatttctgctttcttttttctaacctcagtttgttggcatgagagtgtttttttctcttaaaaaacccctacaactaattggattgatattttttttggtggttttttatttcgttgacaggaggtataggttaggttattttaaactaatagcactgaaaacacagttgacattttagtagtaacatctttgttctttaagatgaatgctaaagagtggaaattcaatgataaggggacagaagtcccaattaaacatagctcatagcaaatggtgcctttgactttgtagaaagtcattttgtagacttcttaacctgaagcttagttggatatgaaatgcagttctaggagccatatgttgatatgaagacaagagttcttttagccatatgttgcagttagagtgttcattgctcaggttaccagtaataaaccctgattggttcttggtggttctggataaattgcttaccgggagccagcacatttggtggtgtttttttttgttttttttttccccacagtgcatgccagagtttttgaagctagtcattgtttcacacatttcatagtatactattagcgtggtaacatttctcccagatattcagtatcagtagagtgttaacatcataaagaagctgagttgtttggttggattttgaaatctatagaatttagagagtcctactacttagtaattcctgcactcatttttcagggccacttatagggtaggacttgactaattttcagggagaatgaggagttctgaaaggcttttttggtttattttctggagtttgatcctacttaaatagtttgaaaatgttggttgatgaatgtgaatattgaacttcttagataattttttaacatatatccaaaattcttgcttttgcttgttaatgtcagtgaatggcagctgtcaaatcaagccttcctctaaagcagtggttctcaagtgaggatgcccaggggatatttggcaatatctggaggtattttttattcggaagactgggggtaggtgctacaggcatctaggactggaggccatggaggctgctaaataccctatagtgcatcagatagcgccccacagcatagaaaagcatttggtccaaaatggagacaatgccactgctgagaaaccctgctctatcagttccatgtggtgcatggggcttccaaagggaaatttcgagtgagggacggtttgacattccaattcaactgccttcaatggtagaggcccttggtttctcctaagaaacttggggttgtctgcgagaatctggaatcccagaagagacccagtcttgggcagggatgaagagatccccctttcccaggaaggtttcctggtgctgtttctctcctgcctgtctgttcattctcataacgtggcactacctagaagcacatgcttactcttcagaacagtgccttgtgtgtatttttggttcaagagggatgcctggttgaaaacttgtgccgctaagggcttgtctctctacttacattgcctgctgttccccactatagtgaaactattactttgtcaaagaagaatgtttgagttggtgtggattttcctaagagcgttttaatgtttttctctgctcagctttatagagattaagagtctgttttggtgctgctcctgcttcttaattaatattagagttacatgactcttagactttatttgtaggattacattttaaaaatacaggtatttattttgtgctcttagtcccctctcctcagtgttttactacttttgctgtagttaatagtcagtatagtgaacttcacataacaacattccattagaagaaatttcctggggttgttttcctttccttagtaagcattatatagtatgtttcctaccctgaaagaggtttctctactgggaagggacttttaaaaatgctttgagaattaaattgacatgattcatatcagtagtccaaattgatgtttgaaccatttcaaaagtagcttcttttgcaggccttctctgaggattttgaaaagttattttatattattttatattttatatttattttataagtgtttttcaaaaagagattgccccagcctaggcaacatagcgagaccccgtctctaaaaaataaaaataaaatggtagtcaggcatagtgacgcacccctcaggaggctgaggcaggggattgcttgagcccaggaattttaggttacagtgagctataattgcaccactgtacttgagcctgggtgatagagtgagatcctgtcttgaaaaaaaaaaaagatggctgggtgcagtggctcacgcatgtaattccagcattttgggaggctcaagcaggtggatcacctgaggtcaggagttcaagaccagcctgaccaacatggtgaaaccccgtctctactaaaaatacaaaaattagctgggtgtggcagcgtgtgcctgtaatcccagctactctggaggctgaggcaggagaatcgcttcagcctgggaggcagaggttgcagtgagctgagattgagcaccactgcactccagcctgggcaacagagcgagactctgtctcaaaaaaaaaaaaaaaaagacattgacaaatgtgttttgttttcaaatccttctatagctcaccagaacaagctagaagaaatgatcaatgagctagcagtggcgatgacagctgtaaagcacgaacaggaatacatggaagtccgggagagaatacacagagccagtaagtgaatgccgtcactttgcagcagtgtctgatggtgaaggttgttttactcaacagcttgctcgtattttcctcatttggaaactttgcaaattttatgtgaaagcattgactttaaaagtgtacctacacgagatattttttgagcatacacatgtgtggagctttgtagtttattattgggacattcattgtaaactagaaaatgctattaagatttagtacaagtttttaagagtttagttttctggccgggcatggtggctcacgcctgtaatcccagcactttgggaggctgaggcaggcggatcacctgaggttgggagttcgagaccagcctggccaacatggtgaaacctcgtctctacaaaaaataaaaaaattagctgggtgtggtggcgtgcacctatagtcccagctactcgggaggctgaggcatgagaatcacttgaaccgggaggcagaggttgcagtgagctgagattgggccactgcactccagcctgggcaatggagctagactctgtctcagggaaaaaaaaaaaaaaaagtttgggtttttaaaaatgtatggtgagctaaggaataagctaattgttttcttaaatcagaagggaaaaatgttgtaaaatgcgtattgcattggtttttaatcacatacctgaaacttatgtaccagtgggattaatattagatgctgagatttaacctttttactaaaatggaaagcttaatatagttagactagaaaacaccaaaacatgagtacagggaagtcaccaggtgaagatcagtttgggtcctcaagtttgtaagttgggaatttggaatgtattttgctgtggaaacagtgatgattgaaatcttgtgttaggttgcaaaagtctgtttagaactggatagagcattaaaaatgaagcttttgcatttaaaattaagaggtactatattgacagacagaccaattccattgattaggttcagggccacaccattgttcagtgttttcatcctccaggtagttcttggggagatgaaaagagcaaggtggctgggggcagtggctcacgcctgtaatcctagcactttgggaggctgaggtgggcggatcacaaggtcaagagactgagaccatcctggccaacatggtgaaatcccacctctactaaaactacaaaaattagccgggcatggtggcacgcgcctgtagtcccagctactcaggaggctgaggcaggagaatcacttgaaccccggaggcggaggttgcagtgagctgatatcatgccattgcactccggcctggcgacagagcgagactctgtctgaaaaaaaaaaaggaaaaagagcaaggtatagtgacgcatctctgtagtcccagctactcaggaggctgaggcgggggattgcttgggagcaagctcttgtcttaagggcagtgattttatgtcaggaatctttgttctgagactggagtaggaagtgaagagtgactcaaagagataagcacagcttgaatttcttccagatgtgctttctgtttttcctacccttaaatctgttcttgctacttatggaaacaaatcttcaggatctagagcacagacatcagcttgtgttggcaggaaggtgtgtaaatgtaatagcctggagaactcccctcatccccacttgttttaggagtggagtggggcatattatggaccaaggcttgtctacaattactccagcctcttgcctcacaattttgtctccttgcctccactcttaatctcaccagctgggatcttcactttttctctcttatcttgttgggactcatatgttgtttaccttgttcccagatggggaaacagcccattctggagttggaagggcactgaactaactcagagggcaagttcctctactttgcaattttaactggttcagaccagatggctttcaagttatagaagttcttgggaacacagtggccagaggaagcacatgtcttccgtctttagggtgtccaaccttgttctctcacccatgatttgagtggagatactcctgtatttgtttcacaaatagtgagctatgtgttcatatttaaaagtgttagcaatttctagaattgagtttataggcattcagtttaaatttacaaagcaaatggttcccataatgttttgtttttgtgagtcttcctataggacccactcctcagcagtgaacataatgagatcctttcactacagtgttgtaataataatgtgttgcttctagatcaggctgatatatgagtggcatgaggacagtgtcccaggtcactacattctgatgttactgtgcttcaatgtgttctatttaaacttaaaggtgcatttttctttgggaggccgaggcaggtggatcacctgaggtcaggagtttgagaccagcctggccaacatggtgaaaccccgtctctactaaaaatgcaaaaattaggccgagcacagtggctcatgcctgtaatctcagcactttgggaggctgaggcaggcgaataacgaggtcagtagttcgagaccagcctggccaagagaacagcctggccaatatggtgaaaccccatctctactaaaaatacaaaaattagccaggcacatgtaatcccagctgcttgggaggctgagatcacttgaacccaggagttgcctaggctggtcttgaactcgtgggcttgagtgatccacctgcctctgcctttcaaagtgctgggattacaggcctgagccactgtgtctggcctattttctttttacagactctctggtttttgttgttttttttttagacggagtcttgctctgttgcccaggctggagtgcagtggtgctatctcagcccactgcaatctccacctcctgggttcaagcgattctcctgcctcagcctcctgagtagctgggactacaggcgcacgccaccaccaaattttgacgttgtaaataattgcattttggataactgtgattttgaaataattccttaattttttgtagaagtcagttttctgattcagcaaaatggatagtaatataggacgtttcaatggtgagggagaaagatggttggattgggtgttaaccctagaattatgaccttgggcaagtcaccttttcttctctgctccccgtatacaagcggaatggacttggctgtacccagtgaatctttaagcccagctaatttttgtatttttagtagacggggtttcaccacgttggccaggatggtttctatctcttcaccttgtgatccacccgccttggcctcccaaagtgctgggattacaggcgtgagccaccacgccaagccctattttctttttagagacacagggtcttactctgttgcccagcctgtagtgctgtgctgacaatacagctcactgcagcctcaacctcctgggctcaagtgatcctcccgcctcaacctcccaagtagctggaactacaggcatgtgccactacacctggctaattttttttttttttttttggtattgtagagactgggtttctccatattgcccagggttggcctctgactcctgagcaaaagcagtcctcctgtctcagcctcccaaagtcctgggattatagtgtaattgtttttaatgttggctatttgcagaaaaataaaacactacatagaatttttttttttttttgagatggagtctcgctctgttgcccaggcaggagtgcagtggtgcaaactcggctcactgcaagctccgcctcccaggttcacgccattctcctgcctcagcctctcgagtagttgggactacaggtgcctgccaccacgcctgggtaattttttttatttttagtagagacggggtttcactgtgttagccaggatggtctcgatctcctgacctcgtgatccacccgcctcgacctcacaaagtgctgggattacaggcatgagccactgtgcccagcctacatagtaattaaaagctaaggctatagaatttgactggagagttggacacaatggcttgtgcctgtagtcttagctgcttctgagcctgaggcaggaggattgtttgaggtcaggagcttgagaccaacctgggcaacacgagaccgtttttaaaaaaataaaataaattggccaggcgtgatggctcatgcctataatcccagcactttgggaggccgaggtgggtggatcacctgaggtcgggagttcgagaccagcctgactaacatggagaaaccgcatctctactaaaaatacaaaattagtcaggtatggtggtacatgtctgtaagctcagctacttgggaggctgaggcaggagaatcgcttgaacccaggaggtggaggttgcagtgagctgagatcgcgtcattgcactccagcctgggcaacaagagtgaaactctgtctcaaaacataaaaaataaaataataataataataaaatacatttaaaaataaaaagaatttggccaggcgtggtggctcatgcctataatcccagcactttgggaggccgaggcaggcagatcacctgaggttaagagttcaagaccagcctgaccaacatggtgaagccctatctctactaaaaatacaaaaattagccaggcatgggggtgtgcacgtgtaatcccagctactcaggagtctgagacaggagaatcacttgaacccaggaggcagaggttgcagtgagctgagattgcgccactgccctccagcctgggtgacagtgagactctgactcaaaaaaaagtaagtaaataaaaagaatttgatcagaaacttgaatgtaacaaatagagtatagtaaatatagagtaggtgtggattttactttaaggatcaaatccttagtttgagagcaggacagatgagcatagtttgtcttgtatttgatggtctggtagtaactgtcagtatggatccatataactgagtaacctcttccattgagaacaattgacaagtacacaggtgctcaacaaatatttgtaacatatttggggaaaaagacactcagactgccatattttgatgttgtaaataattgcattttggataactgtgattttgaaataattccttaatttttttagaagtcagttttctgattcagcaaattggatactaatacaggacgtttcaatggtgagggagaaagatggttgtattgggttttaaccctagaattatgaccttgggcaagtcacattttcttctctgctccccatatacaagcagaatggacttggctgtacccagtgaatctttaaggtttcttttaaaaatctttgcttctactttgggaggctgaggcaggaggatcagttgaggccaggagttcaagaccaacttgggcaacatagcaagaccctttctctacaaaaacagaaaaaattagtcaaatgggctggtgcatacctgtactcccagctactcaggaggctgaggtggcaggattgcttgagtacagttcaaggttgcagtgaactatgattgtgtcatggcattccagcctgggcaacagagcaaacaaaaaagtctttgctttggagtatgttgagttgcttggagacaaaagtatttagagtataggtgacccataggttacaatgacttcacttagaaattttcagctttatgatggtgcaaaagtgatgtgcattcagaagaaactgagcatcaagtacccatgcaaccattctgttttttactttcagtgcagtgttcactaacttgataaataaaatagaaaataataataaaatgcagtttaacgtgtatgagatacacaacactttattataaaataatctttgtgttgttagatgcttttgctcaactgtaggctaatgtaagtgttctgatcgtgttttacgtaggctaggctaagctatgatgtttgctaggttaggtgtattaaatatatttttgacttatgtattttcaacataagctgggtttattgggatgtaaccccatcgtaagttgaggaacatctattctatgagtggtgtacacaatattactttcacacagagtgaagactaaaatatttatgatgcctatgtctttttgggggagaattgttaaattttgtttgtttgttttgtcctcaacagtcaacgacaacacaaacagcagagtggtcctttggtccttctttgaagctcttgttctagttgccatgacattgggacagatctactacctgaagagattttttgaagtccggagagttgtttaaaaagcctcttcctgatgatcccaactcagaattcactgtttaccaaacaccttggtcataataatgtcattagtttctccatttttattttctgaactgtacattcacaacttatgtttctttgagattaatagatattgggggaaaaacgcctttttaggaaaattatagtgaaaatttgacagttgattggcataatttcttgtttgaatgctgcctccattatataggtccttccaggaactcaaacactgtaagtgaaatatgggagtatagtttttattatttcttcttttccttttgttttcataatataatgcagtttgttcaggaaatcagcacaaagcctgatagtactttactaaaatgactgcattctttggattccttcagtctatggttcaagtcactaaagattcatttttgttgagtccttatgagaaacagcagtatgaatcttgacggtttctgcccgtcctaatggcagagctctctgacttgggtgtatgctgccaggctgggtactttcatactttgttttcttgttttgctttaaaactacgactcagcatacattttcccacatacatttttacattgtaccttaggactcagtcatctccacttaaattgatgacacaagcagctaataaccatttctgggtttctgcctaaccccctaattgtctgttaaagccaattctctgggtgtcccagtgagtggtggctttttttctttccacattggcacattcacttctcccactcttggcatgtaagaaataagcatttacataattggaaaaatctggatttctgatgccaaagggttaaagcttcttggatttcatttcattgatatacagccactattttatttttgatcagtggcctttgggccactgttcagggtactgaccatcagtgtcagcattagggttttggtttttgtttcttttgggtctttcttttttggcacatgtgaatcttgttttgtgtaaaatgaaattactttctcttgttctctgatgatgggtttaaaattaaaagagcatccggttttggtatggggatgatccaggattatgttgtgactgatacatattagttacttgtgcttttttttttttttttggatctttgcaagggcaaaactacaagtaacgagttttatataattaatttaaatttgttacaggttttcatgttcaggataaaccatacttccaccttgggtgagaacacttgcaacagtttattaatgaggtgactttcaccttaggacaactgttgcatgccaagttttttgtgtgtgtgaaacacttcaaaactgatttaaaagatgtaaatttaaaattggttgtatctaatatgccccaggttcggtaaataaacaattcttttt

SEQ ID NO: 36604 - DNA, 13521 bp, Homo sapiens; identical to SEQ ID NO: 36603

SEQ ID NO: 36605 - DNA, 32664 bp, Homo sapiens
cttctctctccattcagtgcacgcgttactttggctaaaaggaggtgagcggcactctgcccttccagagcaagcatggagcaacaggatcagagcatgaaggaaggggtgagtgtgttgctcagggaaaggggccaagagcaggcttggctgccagggcctgtgcagccttcctggagagtcgctggggggctcctggtgttgcagagggaactctgtgttgggagggattatggtggggagagggggaaagtcttgtccagcaggtggtcttttatagggaggagagaggtttagagacaagtgctctgtggaaatcattctactggaacagcctttaacagcaggatctgtaactgaatggaagagacccaaaggattcatttgtcccaacttgaaccaaacatgttagctgcaaaatccttctatggttggtgagatgtttcgctctgctttcgttttgcttttggcttcagggcagttaattttttcagcaagtaacatagctgagctgcatgaaagcaagataaactcagaaaaggcgttgcttgatttgaatttagttcagatctgtcacgtaggtttcctgccttttagatcctgaggctcccttgttttagagaggaaagattttcatggactcctgcaacgtaattgcagtttactttctagattcccttgattgaggaaaatgcataatgtcagaaaagtaacactgacttattaacactttataagaatttgcatttattcatcacaatagcatctgcttatatttggagtggaggaaggatagtgcacatttttgcaaaacagcatttgttcaggcatggatgtgagaccctcaccataggcagactggaaacatgctctgtagcacatagattaagagtgggtcttgggaggctgaggtgggtggatcacctgaggtcagcagttcgagaccagcctggccaacatggtgaaaccccatctctactaaaaatacaaaaattagccaggcgtggtggcaggtgcctgtaatcccagctactcaggaggctgaggcaggagaatcacttgaacctgggaaacagaggctgcaatgagctgagatcacgccattgcactccagcctggtcaacaagagcgaaacttcatctcaaaaaaaaaaaaaaaaaaagagtgggcctgggaagtagaagcccccaggattcattcctgctccatcctattctagctgtgggacttgggtaagttctttaactcttcagtgcctcagttttctcatttgtaaaatgggagtaataaccataccgcctcatagggtgctggagcaattaaatgagataatgcatgtaaagtacctggcacagagtgagttccccgtaaatgttactacttttctttctctctctctcgcttttttttttttttttttttgacacagagtcttgctctgtcacccaggctgaagtacagtggtgcgatcaaggttcactgcaacctccaccttctgggctcaagcgatcctcccacctcagcctcccaagtagctgggattacaggcatgcaccaccacacccggctaatttttgtatttttagtagagatggggtttcaccatgttggccaggctggtctagaactcctgacctcaggtgatccgcccgcctcggcctcccaaagtgctggggttacaggtgtgagccaccgcgcccggccatcgtaaatgttactacttttcaatcattctttaggctggtttctccacctccgcgtgatttccatttggcactggctaacgcttcgttgtaggggctgtcttgtgtgttataagatgtttagccgcgtccctggctctaccttctagacgcagtagctccctcccccaggagtgacaaccgatgtccccgagagggcagaatccactcccagccctcaactgagaggcactgctttggagtctactcagccccttcgcttgggtcatcttgtttgtcttacaactaagaaagtgttagacaaatcaagtgtcatcacctccattttatagaaaagaaacggaggtgatgaggacttaggtgtttggggtccagggaggtcctccgctgtccagagaaaggcacaactgccacgttccccacgtccaccaagtccagctgcagaaaggaatggaaacacccccacgtggcaggccctgaaactgagtaacacattgcgaaaggaaatgattcagatggccacatgcgagaggcatgggctgacccagctgcctgctgcctcagccctccagggaaggaagcctcctctgggccagagggatgaaggtggggatgggcttcccgctcctgagagcagcctgccccttggggagaaagctggggcgtgctgggcttcccaaaacactctgaaggaagcgatcccaatggtctgtaagaatccgggaaatcattaagtgcagccgagaggggaggtaggagccaaggagaaatgcgggggcaggcgaaggctacagaggctgcgcggtccggggaggagggcgtctggcagtatggagccagctgcctgcccctcagtggttgtgtggcagtggcctcactggccttttctcttctttttctttctttttcctttttttttttttttaattttgagacagggtcttactctgttggccaggccagagtgcaatggtgggatcatagctcaccgcggccttgaagtccggggctccagcaatcctcccacctcagcctcccgagtagctgggactacaggcatgtagcaccacccttggctaatttttaaatattttgaagagacggggtctcactatacccaggctggtcttgggctactgggctcaagtgtgccttctgcctcagcctcccaaagtgcttggattgtaggcctgagccactgcactcagccctgcttttctcctatgtagagggcaaacactgacatctatcagatgtgcaccaaggactttctgccaggaagaaaagactgttggtctgaaagaaaaaaaaataaaatggattaggaaaagaaaaaggtacaacaaggtattttacaactacataagaattgagggccaggtgcagtggctctggcctataatcccatcagtttgggaggccgaggcaagcggattgcttgagcccacaagtttgggaccagcctgggcaacatggcgaaacttggtctctacaaagtgtacaaaaattagctgggcatggggaccgtgcctatagtcccagctgctctagaggctgaggtgggaggatcgcctgagcctgggaggtagagtttgcagtgagcagagatagtgccactgcgctccagcctgcgtgactccagccagagtgagattctgtctcaaaaaaaaaacaaaggattgttgaataaagttccccacctcaataaaaagatgccgaagtgctttggaaaataaagacacatttttgtggagtggctccaccagcaactagttgagtatcctagagcaactgacacccctctgtgctctccgggtcctcactgatattcatttgtaattaatggattaattaacccatttgtaacacctactacagaccaggcatggtcctaagtgttctataccagtgaactcatttattcctgtggtggtatcattatcctcaaaaaaaaattttttttttgaggcagggtctggctctatcacccaggcaggagtacagtggcacaatcacggctcattgcagcctcctgggctcaagagatactcctgccttgtttttaaattttttcgtagagacgaggtctcactatgttgcccaggctggtctcaaactcctgggctcaagccatcctcctgcctcggcctcccaaagtgctgggattataggcatggaccaccaggccaggcccattatccccattctaaaggtgaaggaactgagaagctcagggagttgcccaaggccacacagcccagcagagccaggcttcgagcccacactcctgggctccagaaactgtgctccaaaccaccgcagcggctgacgatgctcatctctccctgcccctcccactacctgtttgtgaaactgagttcaacagtgtgataaagtgacatagcttgaagtactgatcctccatgagcgctaactactccggggtgtttgcattctgactgcagattcctaacaaggaaaagctttgaactgagagaatgtctctctgacaacagaaacttcaggatggatttctaagggagatggtttgggcttccttcccagtgaccttgaatcgtaccctgtcagaaggtcagccttgaggattgtcaacctaaaaaaagaaactgtagcaaaatgaatgtagagagtgtactggggccaaggttgaggactgtagccctgggaaacactgggaagtactttggagagcataggagaagttcaagtttttaaagaaaaaaggacaaatcaggagaggagtgattacaaacggtgtttgttaggaattctcactggtttagagaaatgacattgatttagtgataggctatacattttttttttttttttttgagacagaatcttgctcttgttgcccatcctggagtgcaatggtgtaatttcagctcactgcaacctccacctcccgggttcaagcaattctcctgcctcagcctcccgagtagctgggattacagacgtgtgccaccatgcccggctaacttttgtatttttagtagagacggggtttcaccatgttgtccaggctggtcttgaactcctgacctcgtgatctgcccacctcggcctcccaccaaagtgctgggattacaggtgtgagccaccgcgcctggcctacattgttgactgtagagtatgcgctgtggtgtccggtgtatggcattgttaggctaatttactgctacttggtggcaacactcagtgtagagtccacatagcaggcagatgacttagctcacgtgggaataagatgtgactgctgctgtatttcagtgctttgctggcccggtcatttaaaggggtacacatcccccaaaaagtttcttttctttcttggggtggtcgttattactaaagtctcaaaatgttctctgtattatgaaagggaggaagctggtttactgacagcatgaggaatgtggtttctggttttccctgaagcacagctcagcgtcttggcaacctccttagcctctaaggagagaccctcccggtcacggctgggggtcactggggcttctcattttaacaagctggccagagacccgcacatcctcttcagcccctcccttttccttatgccctaatccagcccagtaccaaattctttttgttctccctcctggaaagcaaaaaaagaaagaaagagggcttaagccttctttctactatgtgccttttaaaatgtagtactgcatctttattgagaatatatctcaataccatacaatttcacccctctaaagtacacaggcccaggctggcactgtggctcacacttataaaaccaacactttgggaggctgaggcgagaggattgcttgagaccaggagttcaagactagcttgggcaacatagcaagaccctgtctctataaaaaatgtaaataggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgaagactccgtctcaaaaaaaaaaaaaaaaaaaaaaaaaaaaaaagtaaataatagcctgatgtgttggctcacacctgtaatcccagcactctaggagcccaaggcaggtggatcacttgaggtcaggagtttgagaccagcctggccaacatggtgaaaccccgtctctactaaaaatacaaaaattagccaggcgtggtggcatgcacctgtaatcccagctatccgggaggctgaggcaggagaattgcttgaaccgaggaggtggaggctacagtgagctgagattgtgccactgcactccagcctgggcgacagagcgagactctgtctcaaaacaacaacaaaaaaaatttaaataaataaagtatacaggctgggcatggcagctcacacctgtaataccagcactttgggaggctgaggcaggaggattgagaccagcctgggcaacaaagtgagactctgtctctacacacacacacacaaagtacatattaatatataaaagtatacaatttatcaccaaagtgaaataagccaggcacgggaagacaaacactgcatgatctcacatgtggaatctgaaaaagttgaactctctaagtcgaactcacagggtgagaagtggtgtctcatgctgatttttatttgcatttgcctcatgggatagcaagtctttttaatttgcatcctcagtagtcctcaaagctggtacttttaacccctaccgtggcccgttccattacccaagtgcccatctgctgtctgttggcctctgcagtaacctggtctcccttctgctctgcacgtagtagctggagtaatttatttatttatttatttattttttgagacagagtcttgctctgtttcccagactggagtgcaatggcgtgatctcggctcactgcaacctccatctcccaggttcaagcgattctcctgccttagcctccctactagctgggactacaggcatatgccaccacgcctggcttatttttgtatttttagtacagatggggtttcaccatgttgctcaagctggtctcaaactcctggtctcaagtgatcctcccgccttggcctcccaaactgctgggattacaggtgtgagccactgtgcccagcctggagtaatttttttaaagttcaaatccttccatcccactccttggctacagagcacatggagggaacagatggagtgaatatggagtgaatacccagtcttttctgtggccctcaccccggtttgccctcctttccccacgctccagccacactggccaaattccagatgctcaaaggttctgagctccgcctgcctcaggccttcccacatgctgttccctctctctgaatcactctcttctccttcctctcctcagctgaaatattgctccccagacctctctttttaaccactcctgtgtttttcttcttagtacttactacagttacagtttattacattctcatgtagtttcttaatgtgtgtctttaccattgacaatagtctgctgggggcagctgtcttgcttacccgagggtactgtgcttcctggagtccagttagctggtcatgcatatttgtttaatgaagttggctggaccggcagggttagcgagaacccacctagaataactttgctactcccaggagagtgagccatgatttctactgcgcccacagaatgtgcctgtggcttgaattcagggaggcagtgaaagaatggagggtgaattgaatgctctatgctcagagactctatagcctgatcatttagtcgctctgatctctcctccatagtctctctgatcatttttgctgggatcccatcaaagcggtcagggagctggctctccatggtgcctggcagaacccccaactctggggcatgagccctgggaaccagccagctccaccagctgggctgtgcttgttggctgtgctgctggccagaaccccacccctgaccccaaaggacttcaaaccttagggcactcatcagactgagggagtggtcaagagctgcacttggctgtgtgaatgaagctggttgcactttcgtcttactgagaagagaattagaaaagaattttttttttttttgagacagggtctcattttgtggcccaggctggagtgcagtggtgcaaccatagctcactgcaaccttgaattcctgggctcaagtgatcctcccacctcagcctcgtgagtagctgggaccacaggcgtgtgccaccacacccagctaatttttaaaatttttttggtagagacaggatttccctatgttgcccaatctggtctcaaactccagggctcaagtgatcctcctaccttacttagcttctcgaagtgctgggattcaagtgtttgccatcacactcagatagaagggattttttcttttttcttttttttttttttgagacagggtcttgcactgtcacccaggctggagtgcagtggtgcgatctcagcttactgcaacctctgcgtcccgtgctcaagtgatccttccacctcagcctcctgagtagttgggattacaggtgcacatcatgcccagcaaatttttgaatttttagtagagacgaggtttcaccatgttgcccgggctggctgagaactcctgggctcaagcagtctacccatctcaacctcccaaagtgctgggatttataggcatgagccgtcgtgcccagaagagaattttttaatcaacattttcttcccttcccctcacccccacccctctctctttgtctgtaacaaaatcaagcagtagaacagctataggggagggatttttgtctgtcttgtttgttcaccgctatatccccaacacttagagcaatgcttgttcacattgggcgcccaatatgttgaatgattgaatggctgaatagacgagtgaatgaatgaatacacagagcgaatcagatgggaggtgagccaagcctattgtgtgtgcatatgtgtgtgtggggggtgggctgtgtgtgtgtggggtgggctgtgtgtatgtggtgtgtgtgtggggtgtgtgtgtgtggggggtgtgtgggctgtatgtgtgtatgtgtggtgtgtgtggtgtgtgtatttctgcctatgtgtgtggggggtgggtgtgtatgtgtgtggtgtgtgtgtggggtatgtgtgtggtgtgtgtatgatgtgtgtgtggtgtatgtatgtgtgcatatgtgggggggtggggtatgggtgtgtatgtgtggggtgtgtgtgggaggtgtgtgtgtgtactggaggcatgtgggggtgtggggtgtgtagtgtgtgtacatgtagggggcatgtgtgcgtgtgtgtatgtagtgtgtgtacatttggggggcgtgtgtgcttgtgtgtatgtagtgtgtgtacatgtgggggggcgtgtgtgtgtgtagtgtttgtgtacatgtggggagtgtgtgtgtagtgtgtgtacatggggggtgtgtgtgtattgtttgttacatgaggggcgtgtgtgtagtgtgtgtgtagtgtgtgtattgtgtatgtagtgtgtagtgtgtgtagtgtgtatgtagtgtgtgtgttgtgtgtgtgtatagtgtgtgtgtattgtgtgtgttgtgtgtgtagtgtgtgtgtgtagtgtgtgtattgtgtgtgtgtggtgtgtgtgtactgtatgtgtgtagtgtgtgtgtgtagtgtgtgtgtgtgtgtgtgtgtgtgtgtagtatgtttttgctcttcaccagggctccttgcaggtgctgctcttcagaggttcactccaccccatctggggccccatgacaaggcaggaatgatcattgtttctctccctttctggctcctcacttacctctctcaagacatcctctttaggccgggcacagtggctcatgcctacaatcccagcactttgggaggctgaggcaggaggatcgcttgagcccaggagtttgagaccagcttggacaatataatgagacccctgtctctataaaaatatattttttaattagccaggcatgatggcatgcacctgtagtctcagctactcgggaggctgaggtgggaggatcacttgagcccaggaggttgaggtcacagtgagctataatagcaccacagcactccagccagggcaagaaatgtctcagaaaaaaaaaaaaaaaaaagattctctgtagatttagataccgtgggatagtgcttgtcttgtcactggagggccaagcatgaacctgtgttacctgtgaaagggggctctctggccaggcgtggtggctcacgcctgtaatcccagtactttgggaggccaaggcaggcagatcacgaggtcaggagattgagaccatcctggctaacacagtgaaaccccgtctctactaaaaaatacaaaaaattagccaggcgtggtggcgggtgcctgtagtcccagctatttgggaggctaaggcaggagaatggcgtgaacccaggaggcggagcttgcagtgagccgagattgcgccactgcactccagcctgggtgacagagcaagactctgtgtcaaaaaaaaaaaaaaaaaaaaaaaagaaagaaaggcggctgtccatcagagtagatggaagaaggtcctttgatggcaagtcagagagcagcgtcccaagctctctccaacagcagattcacctctgcagctagacatggtcgtaattaatcctggcaaacactctggtagggagtgtgattgtcctcatttcagagatgaagaaactgaagatcctagaaattaagctgaaaagtggcaacaggtagattcaaaactgaggcctgtagattttaagcccgcagctctttccatgtctgtctcctgctcttcattactaatgaatttcctcttgtcattaaagattgtctgaaaggaaattttcagtggccaaaatagctaaaattttctctttttctctttgattttctgggagtttatgtttgagatggtgcaagagcacatttgctgcagttggcaaatgccccacgtggcaggaatgtcacaggagcaattcaaacagctgcagtagctgcagtgttagagaagtaggtttcagcttctctctgatccagtggttctcaaatggagcacttccccaccaggggacacttaacaatgttggaagacatttgggttgtcgcagctggggagaggggtgctactggcaccatgttcacaggatgctgtaaacatcctgctgtgctcaggacagcccccataacaaagaattatcagaccccaagtgtcaaaagtgccatggttgagaaagcctgtaacccaaggtgggttgagggtaggtttcaaggaatggagtagtctcaagactatggatcttcagattctgttacatctttctacgaaaccgaagtaaagcgggagggccctggaaccctggggctgcttcctgacctaagctgtgatctctgcagaggctgacgcttgtgcttgccctggcaaccctgatagctgcctttgggtcatccttccagtatgggtacaacgtggctgctgtcaactccccagcactggtaggtcactgtggtgagcaagatgtggggaggacgtttggagcagcccattgcctgggtgggactggccagcgtggggctgttcacgcagtgggtcctgaagcaaagggagagggaaacaccctccggacacagcacagacccgagggaactcgcagacacaggtctcttgggatgggccaggtctggatggacacacagtgggccgggctctaggagggggctcagatcttctgtggccttgctgtttagagggaatccgggggggccaggggtctcccagctgattggaaaattggagtcatccctttctggctgagaaacacccagggtggtttgctgctgagaggcttcccagccctcccggtgggtgcccacccttctcactgctcctgaagctctgtcctgcctcccatcaccccccggttaataaggttggtctctgtgtgcccaggttatttcattgggtgtcctaacagctaatgttcttcttgcaaaaccggatcaaattattttggtgttctgttttgctttgtctcctagctcatgcaacaattttacaatgagacttactatggtaggaccggtgaattcatggaagacttccccttgacgttgctgtggtctgtaaccgtgtccatgtttccatttggagggtttatcggatccctcctggtcggccccttggtgaataaatttggcaggtaagggaaggtgaatttttaattccctgaaactcatagacccccatcagagctaaaatacaggcctacaactgaaatccttaccatgagactaagataataaccactgtggtcatttttcttttttctttctttttttttttttttttttttttaatttttgagatggagtcttgctctgtcagccaggctggaatgcagtggcgcgatcttggctcaccgcaacctccgcctcccaggttcaagcgattctcctgcctcagcctcctgatcctgggatcacagatgtataccaccatacccagctaatgtatttctagtagagacggagtttcaccatgttggtcaagctggtctcaaactcctgacctcaggtgacccacccgcctcagccccccagagtgctgggattacaggcgtgagccactgcgcctggccggtcatttttattttctaatggggtcagaaaagaagatcagacattgacagtgtttggggacctaggcagggtctcaggggttagaagcaggggtggccagggatctacaggccctcgggcagacccggaaggagccgtgtgtgcttgtggagacccaggacttgcttctgctcatactgcccttttgccccacagtgtcatctaggacatctctcttgtgacaccagcctcgtgaacaaaggggtcagggctgtatctttgcccctatttctagaaacattagaaatgccatattttatttcaaaaaagtgtccttaagatgtcacgctcccccgtataaattccatggacattatggaagacctagttagaaagagaattttagaggtccccttgtccaacccgtctagggatgaggagcacgtggggctgagtgaggtcacagatctagtgagcccagagtaacccagactctgactcctcctccagtatttcaagaaaagaatctgagaataaaaacacacagctgggcgcagtggctcacgtctgtaatcccaacactttgggtggcagaggcgggcggatcacctgaggtcaggagttggagaccagcctggccaacatggtgaaactccgtctctactaaaaatacaaaaattagccgggcatggtggtgggtgcctgtaacccccctactcgggaggctgaggccggagaattgcttgagcctgggaagcggaggttgccgtgagctaagatcgcaccatcgcactccagcctgggcaacaagagcgaaactccgtctcaaaaaacaaacaaacaaaaaacaccgctgcagctttgggatctaacatcctcttgagagattagtgttgaacccacagttttccctgtgggccctcatggagcagaacatccctccagtcagaatcagacctgccggacacttcttgagttaagagcacgccgcttggcccacagatggagctgaaggttgctaattgagctgtctacttaggagtctgataaacactatttggctatttgccgttttcttaagtatttgtgggtgttatttatttctttattttttgaggtagagtcttgctctgacgcccaggctggagtgcagtggtgtgaaattggctcactgcaacctccacctcctgggttcaagccattctcctgcctcagcttcccaagtagctgggattacaggtgtctgccaccacgcgcagctaatctttgtatttttagtagagacagggtttcaccatattggccaggctggtctcaaactcctggcgtcaagtgatccacccacctcggcctccccaagtgctgagatgacagaggtgaaacactgcatgtggccagtgttatttaaatagcaactaacttttattaatgagttcctatgtgccaggcactgtcctgactgtgtttagaggtactattacaatcctcactttatttttatttatttatttttgagatggagtctcgccctgtcacccaggctggagtgcaatggtgtgatctcagcacactgcaacctctgcctcccgggttcaaacgattctcctgcctcggcctcccaagtagctgggattacaggcgcatgccaccacacccagctaattttttgtatctttattagagacggagtttcaccatgttggccaggctggtctcaaattcctgaccttgtgatccacccgccttggcctcccaaagtgctgagattacaggtgtgagccaccgcacccggctaatccccactccattttaaagatggggaaatggtgcacagagagacactgtaacttacccaagatcacacagctgggaggtggccaggactccaacccaggatgtttcacttctgagcatgagcaagtaatgtctacactctacttttgttacttagggaaaatatcttctcaatctgttgctttatttttttaatcatacatatagtaccttttttatgcaaaattttaaagtcttcaagtggtcaaatttatagattttgcttctcaactgaggacacttacaaagcaaacactataaatatatatgtgtgagacagggtctcactctgtcacctaggtgggagtgcagtggcatgatcacagctcattgcagccttgaactcctgggcttaagggatccttctgcctcagcctgctaaatagctggaactataggtgtgtgccatggtgctcagctcattttttagtttttgtagagacagggtctcactaggtttctctggctggtctcaaacttctgggctcaagcaatcctcccaccttggcctcccaaagtgctgggattacaggcacgaaccgctacgcctagcctcttctatatttttaaaatttatttcacaattttgttcttccagatagatctggtgttttattttgtatatattgagtgatgagagaaaactaattttattttatttttccaagtggaaagtcagttgctttcaaatttatcttagttattcatgctcctttactcttccatttaaaattttaagtcagcttctcaaaatcccggaagaaagattctgactggcattgctctgaatttataaattaacctgaggaaaactgacatctctacaatgttgaccttgcccactcatgagcaaactagagctttccattgtcttcaggtcttcttacatgtcctccaataaagtttcatcgtaaaggaccaaggatttagttttctttatcctgggagtcactgtggttccttgtctgaagtttcatgtctttgtcatcagttctgagactttttcagccaatatctctacaaatattgcccctccccgattttctccatgaagttcctccgtgtctttgaatctcttatatttcccatcttcttacctctctcgggtgctttctaggtaatttctgcaggtctaccttcctattcattaattctctcttcggatgtaataaacctgctacgtttttaatgattatatttttcatttcaataagttctatttattcgtttttaaaatctactttctatcattgttttagataacttttatagttttttgttctttcctatagtactatttttattttatttttttatttttttgagacagagtcttgctctgtcacccaggctggagtgcaatggcgcaatcttggctcactgcaacctctgcctcccgggttcaagtgattatactgcctcagcctcccaaatagctgagattacaggcacctgccaccatgtccagccaattttagtatttttagtagagatgaggtttcaccatgttggccaggctggtcttgaactcctgacctcaagtgatctgcctgccttggcctcccaaagtgctggaattacaggcataagccactgtgccctgcctatttaaaaaatatatatataaatatatataatatatataaatatataatatatattaatatataaatatatagataaaatatataatatatattatatataaatatataatatatataaatatatataatatatataaatatatataatatataaatatataatatatataaatatatataatatataaatatataatatatataaatatatataatatataaatatataatatatataaatatatatagtatataaatatataatatataaatacaatatataaatatataatataaatatacaatatataaatatataatataaatatataatatataaatataatatataaatatataatataaatatataatatataaatataatatataaatatataatatataaatatataaaatatataaatatataaaatatatattaacatataaatatatgtaatataaatatataatatatattatatataaatatatattatatattaatatataaatatataatatatattatatattaatatataatagagtaagaccctatctcaaaaaatatattttaaaaaatatttttaaaacatatatatatatatatttttttttgaaatatggtcttactctgtcgcccaggctggagtgcagtggcacgattgtggctcactgcagactccacctcctgtgctcaagtgatcctcctctctagtagctgagactacagggatggggtcttgctatgttgctcagtctggtcttgaactcctggcctcaagccatcctcccaccttggcctctgaaagtgctgagattactggcaagagccaccatgtcctgccattaaaaatagactttattaaagagcagttttaggctcacataattgagaagaggctatagagacttcccatgtacctctcctccaatacatgcatagtctccccctttatcaacatctctcaccagagcgctgtatttgttacaaatgatgagacctgcattgacatatatcatcacccaaggttcatagtgtacattagggtttactcttgatgttgtgcattctatgggttttgacaaatgcgtaatgacttgtatccaccattatagtatcatatagagtagtttcactgccctaagaatcctctatgctctgcctagtcaccccctccctcctctctaactcctggcaaccaccgatccttctactatctccatagtttgcctttcccagaatgtcatatagttggaatcacatagtatgtaggattttctttctttctttttttttgagacggagtctcgctctgtcacccaggctggagtgcagaggcacaatctcggctcactgcaacctctgcctcccatgttcaagcaattctcctgcctcagcctcctgagtagctgggactacaggtgcacgccaccacacccagctaatttttgcatttttagtagagacggggtttcaccatgttggccaggatggtctcaatctcttgacctcgtgatccgcccacctcggcctcccaaggtgctgggattacaggcgtgagccaccgcgcctggcccagattggcctcttttactaatatgtactgaaggcttctccatgtcttttcatggcttgaatatttcattgtctggttgtaccacactttatcggttcagtaccagaggacatcttggttgcttccagcttttggcaattatgaataaagctgccgtaaacatccatgcacatgtaagtttctgtgtagatatacgttttcagctcctttgggtaaataccaaggagtatgtgattgctggatcatatgagtacagataagcatatgtttaattttataggaaactgccaaactgtcttttaaagtagatatatcattttgcattcccaccagcaacaaatgagggttcctgttgctccagcatttggtgttgtcagagttctgggtttttgttcttctgacaggtggtaccttattgtttaatttgcatttcccctataacacatcatgtggtgcaccttttcatatgcttatttcccatctgcgtatcttggtgaggtgtctgttaagatctttggcccatttttaaattgggttgtttgttttctttttaagttttaagagttctttgtacattttggacaacagtgcttttagatatgccttctgcaaatattttctcctagtttgtggcttgtcttttcatcctcttaacagtgtctttcacagagcagaaagttttaattttaatgaagaccagcttatcctttgtttgtttgtttctttctttctttctttgtctctctctctcttttccttcattccttccttccttccttttctttttttccctccttccttcttctctttttctttctttctttttgcaataaagctttattgtgatttattattgttataaaattacagacaattgctcaggaggggtgtactaccttaaaatgtccacctccctccttgatatgccactggttcctatctttagcttgttctttgtgaattgacctactattctgagaggccctttcacgtgagcaacttcagaccagaattgttggtttacctcttcctccctggaatttcatcagtccagttgacgctgtatgtattttgaggctgtgttggaatcgtctctgtttatgatagttatatcttctttgccattatttcttttacttttatgtaatgcatataacacctctgtgttttatgacatttttatctcaaatcatattttgtcaggtattaagactattacccaacttccctttttgtctttattggctaaagattttatattttctaaccttctgtctttcattttaaggatcaattctttctttcatggattatgcctttggtgttatatctgaaaagtcatcgccaaacccaagactgtctagatttttttttcctaagctatcttctaggagttttatagttttgcattttatatttaggtctgtgaccactgtgaattaatatttgggaaaattctaaggtttgtgtctagattcattttcttgcatatagatgtccagttgttccagcaccattttctttccttttttttgttttttgtttttgagacagggtgtcactctgtcacccaggctgagtgcagtgacacaatcacatcttgctgcagcctcaaacttcctagctcaagcaatactcccgcctcagcctctccagtagctgggactacaggagtgcaccaccaatagtgcccagcaaatttttgaattttttcttttttttttttgagacagagtcttgctatgtcacccaggctggagtgcaagtggcataatctcagctcactgcaaactctgcctcctgagttcaagcaattctctagcctcagtcttctgagtaactggaattagaagtgtgtgccaccatacccggctaattttttttttgtatttttagtagaggtggggtttcgttgtgttggccaggctggtctcgaactcctggcctcaggtgatccacccgccttggcctcccagagtcctaggattacaggcgtgagccactgcgcctggccaatctattatttttttctagagatggcgtctcactatgttgcccaggctggtctggaacttctgtacacaagtgatcctcctacctcagtgtccaaaagtgctgagattacgggcatgagcacggcacccagcccagcaccatctttttgaaaagactgccttttctccattgcgttctctttgctcctttgtcaaggatcagttgaatagacttaacgtgggtctatttctggactctctgttctgttccattgatctatttgtctattctttttttttttttttctttagacagagtctcgctgtgtcacccaggctggtgcagtggggccatctcggctcactgcaacctccgccttccaggttcaagcgattctcatgcctcagcctcccgagtagctgggattagaggtgcgtggctgtagtagagacgacgaggtttcaccatgctgaccaggctggccttgagctcctgacttcatgtgatgccgcccgccttggcctctcaaagtgctgggattacaggcgtgagccaccatgcccggcctgtttgtctattcatttactagtaccacgctgtcttgattactgtagctttatggtaagccttgaagtcaggtgatgttggttctccaatacagtactatttggattccttattttatgacactaatcattttaaacattttatagtccagtctgattctgttgtctgaaggtgtgctgttagtataagcggctctcacgtgtggcaagtttctcagtgtttaggaatgctggagctccactcgctgacagcttcgtccatcatgagggtcctcatcatgagggctccattgcgagaggcccctccagagaagtttgctttgcttctgtcaggatctccagggtaggcttgttcctgacttcaatgggaaggctttccaagttttattaagtgtgatgtttgatataggttttaggtagatttcctttatcagcttaaagaagttcttctatttatagtttgttaaggctggttttaaaaaaaatggctgggcgcagtggctcatgcctataatctcagcagtttgggagactgaggtgggcagatcacttgaggccaggagttcgagaccagcctggccaacatggggaaactccatctctattacaaatacaaacacttagctgggtgtgggggcacgtgcctgtaatcctagctacttggaaggctgaggtacaagaatcactttgacctggcagaccgaggttacagtgagctgcgatcactgcactccagcctgggtgacagagcgagactctgtctcaaaaaaaagaaaggaggaaagaaacttaggccaacttttaaataaacaaaaatttaaaaatcataatggtgttaaattttattgacttcttttgctgcttctattgagataatccgatgttttcccccaatataatgtttgtttacttatttatttatttattttttgaggtggagtctcgctctgtcacccaggctggagtgcagtggcacgatctcagctcacggcaacctccacttcctgggttcaagcaattctcgtgcctcagcctcctgagtagctgggattacaggcacctgccaccagtgggccctgctagtttttgtatttttagtaaagacagtgttttaccatgttggccaggctgatcttgagcacttgacctcaagtgatctgcccacctcggcctcccaaagtgctgggattacaggcgtgagccaccatgcctggccccaatataatctttaatatggtgaaatacattgaaatatttttgtatatgctgttgaatttaatctactaagatttcatttaggattgtggcatccacgttgacataagtgagatggacctatacttttcttttcctctaatgtccttacccaggacaattttggggttggctttcaagattacaccaaaattataaattagctaatgatttcaaaaaccctttactatatcttaatacagagccctttctccattttcaccactgacgccctctggactgtggtcatttccatttgctccccacactgagcgtattcccacaccaggccatgcacttgacctgtatcagtctcaggtcccagagagctaaacgcacagcagtaaagctgctgtaactgctggagcctatgcagaggagacactccagaaacatttcttgaatgaaagagtgaattcttcagcaaaactaactgatattttgtcctctgcagaaaaggggccttgctgttcaacaacatattttctatcgtgcctgcgatcttaatgggatgcagcagagtcgccacatcatttgagcttatcattatttccagacttttggtgggaatatgtgcaggtaaacaatgctatgctgtattgccattctgtgagggtcgtcaaggaggaggacaacaggttcccagggactagaaccaatctgtgatgtctgaagcgtgtagaaagcgttcctatacctctgctgtgaaacagatggttgagccctacctggttctcaggtgcagagctttactgtgatgtttcctacaaagaaacatctttgaaagactgaaatgcagaatcttaacctgggaagtgtcattccaatccaatcctttatctcaatattttctcaactgcaggtcatgaccagttagtgggtggtgatgtctgtttagtgagcagcattttctttttaaaaatagaatagctgagtgcagtggctcacacctgcaatccagctactctggaagccgaggcgggaggatcacttgaaaccagcctgggcaacacagtgaaaccctgtgtattagtctgttttcacactgctgtaaagaatactccccaagactgggtaatttataaagaaaagaagtctaattgacttacagttccccatggctggagaggcctcaggaaacttacaatcatgatggaaggggaagcagacctgtcttacatggcagcaggcgagagagagagagagagagagaagggaaactgccttataaaaccatccgatctcatgagaacttggtatcacaagaaaaacatgggagaactcgcccttataatccaatcacctcccatcaggtcctcccttgacacatggggattacaatttgagatgagatttgggtgaggacacagagccaaaccatatccccatctcaaagataaataaatatatatataaatcaataaataaaatggaagaggcagtgttacgtgtagtaaagataagtattgcccacttttgtttcacatacacacacacacacacacacacacacacacacacacgagaaccaggttgcagtggaaaatgtatttctgtattttttactgtgggtgagagtcaaaaaagcttgagaaacaatctaatgtatgaattccactaccagaaaggtgctaacagtgccacattttaagttttatagggcaatttaaagtttgccaagggcgtactgagttctattcctgaaatgcccacctgctgagcgggtgctgactcgctgagtcctctcatctaacaaactgggaggtgttttttcctaatcccactctgttgcttccaagcctaggctgccaggctgtacagtggtgattttagaaaactctcccataattgcttcacactgaggagagatgaggggtagagccgtgccagtggctttccctgagttggcatccttagtaggcagtatttctcactgccaggtggggagaggcatctaggatggaagctctcagggtcctacaggtgcagagtgggccccttgagggagcccctcccaggtgcctcactgcctccctccagtcactttcccaacattgccaaggaactctcatttgttccttccaaacgcagggatagggacaaatggataatttggctggctgtccataaacccctcagctaggattaattggcagtaacagagacgtgaaaaaaagatgagaagacatttcccaaacagagactaagtcatgccaaagggaggatggtgagccccatggcaaacttcacttagtgctcggctttccctgagagcacctggctgggtctctgccatctttttttttttttttttttttgagatggagtttccctcttgtcacccaggctggagtgctgtggcatgatcttggctcactgcaacctctgcctcccgggttcaactgattctcctacctcagcctcctgagtagctgggattacagctgcccgccaccacacccagctaatttttgtatttttggtagagatggggtttcactatgttggccaagctagtctcaaactcctgacctcagcctcccgaaatgctgggattacaggcgtgagccaccatgcccggccggtctctgccatcttgccctgacctgtgggttttctctgcagtgggctcaacattttgaaaaatacattcctaaaagttgccaccagtaagcaggtccaatcacttttctattgaccattaacaatacagaattgtttccagcagagaaatattaggctccaatagataacaaatcagttaaaaatcccagcctttactctaaagtcagcagttctcagtttttggtctcagacccctttacacacttaaaattattgagggctccaaagagcttttgctcatgtgggttacattgatcaatatttactgtattagaaatggcaaccgagagacatattaattcattttttaaaataagcctattacatgaagagtggccttgtttgacatttttgcaaatctctttaatgtctggcttaatagaagacagctgaattctcagatgtacttctgggtcaggtcagttgtgatgtggcctggcaagaagtctctggaaaactcccatatgctcatgagagagagagaatgaagagcagatatcatctctggattattatgaaaatagttttgatctcacagacacccttaaaaggtctcgggatccctgggtcctcagatcacggcttgagaacactggccattaggggcataatccatttgccaacagtttttcacatacctccagcaagtcagcaaagtggatcatcaagctgtgtgctgcttagacactcattttaaaaccacgcatatggccgggtgcagtggctcatgcctgtaataccagcactttaggaagctgaggcagttggatcacttgaggtcaggagtgcgagaccagcctggccaacatggtgaaactcggtctctactaaaaatacaaaaattagctgggcatggtggagtaggtctgtaatcccagctactagggaggctgaggcatgagaatcgcttgaacccaggatggggaggttgcagtgagccgagatcgtgccactgtactccagcctgggcaacagagtgaaactctgtctcaaaaacaaaacaaacaaaccaacacaaaaataaaaccacccatatgaacaagaaccacattgctcactctaaaatgaagtaaacaactaccttgacaaggggggtgccaagatgagtatgacttttactggaacatgctcacagttcactgatttgttactaatcaacttcttggcaggaagactgaaggtattcattggctcagaggaatttaaactttttgtttgtttgtttgtttgtttgagatggactcttgcttagttgcccaggctggagtgcagtggcacggtctcggctcactgcaagctccacctgctaagttcaagcaattcttgtgcctcagcctcctgagtagctagcactgtaggcatgtgccaccgtgcccagctaatttttttgtatttttcatagagatggggtttcaccatgttggctaggctggtctcgaactcctggcctcaagtgatccacctgcctcagcctcccaaaatgctgggattacaggggtgagctacagtgtccagcaggaggaatttaaacttcaaaagccaggccaggcacggtggctcatgcctgtaatcccagcactttgggaggccgaggcgggtggatcacctgaggtcgggagttcaggaccagccttgccaacatggtgaaaccccgtctctactaaaaatacaaaaattagccaggcgtggtggcgggcgcctgtaatcccagctactcaggaggctgaggcaggagaatcacttgaacctgggaggcagaggttgcagtgagctgagatcgcaccactgcactccagcctgggcgacaagagcgaaactcgcatctcgaaaaaaaaaaaaagccactttgctctgattctcgtatcagaactggctggctgggaggtcctagtggagtcattttaaagacaaaaatagagattgctttccaccaacgtacaggtaaccccatctcttcacaaacctcctgaggtttgaccctttattaatatccttcaccaagatgctcttgctgctaagtggctcttgttaagtggtgaggacacagcctcccacttcagctcccaggaggccttcctttcctctgcagccctttgccctgggcctgtgaggtgttgctccctcttcccacctagacatgctaagagctgctttaaagactgcccctctttgctctgcaaatgaggaagaatcgatattaatgaactgtgatgtctcttttcaaatactgagcagagacatctgtgggtagaattgccaaacaggaaaacatggcctcaggtaccctcctatctcagttctatcaaataccccgccatcaacagcagctccaacctctgctcactccaaactctgttcctgagagcctcccttcagagacccacgtccctgagcctccatttgactcaggatttggtacctgatacttggactagtgaaacttcctctccatccccagcctctggatgtgcttttaggagaattaaatagggcaatatatgtgaaaatactttggaagctgcaaaattaaattctgcctatgtttttttaattgacatcaggcaacacgtcattctataaaatagagtaagttttccctccaccagattcaagtatgatgggaatatttacaagtttaaatactggggattcagaagtagtccaggcattacagaaatcccagaaatgcagatattccgtaatatgtgttgacattttaaatgcttatagagacatataacttgttcttaaaggtgtatgaaactatctctgcattggtttatttactgttcctataaggtaaagctgggggctaggggtcctgggccatacacacatacacacacatacacacatgccatatatatacatacacatacacatgccctatacacacacacacacacacccaggccacacacacacccacacacacacatatatatacacatacacacacacacacacacagaggccatatatatatatatgtacacacacatgccatatatatatacacacacacacacacaccaggccatgtccatatacacatacacacacacacacagaggccatacacacacagacatacacaccatatgtaaatacacacaggccatatatatcatgcgcgcgcacacacacacacacatatacatatttttagtggaaacggttccactatgttgcccaggctggtctcaaactcctgaccccaagtaatctatcctccccacttagcctccccaagtgctgaaattacaggcacgagccatcacacccagctgccttgccttttatgaaacagaccctcctcaaaaagcagaaacgtgagtgggtctagactcaggccagggagcgggaaggccgtagatccagctggccagtgtccccagatgatatgggccaaagcaagggcccctgtgcatgagctcctttgatctgtttctctttccttaaagtataaagggctaagaattaaaagaggtgtttgctttctcctttgcagttttgagagagttctggcccaaataatgttattgctaagaatagtatacttgaagacagcttgtccctgccagactaattttttctgatggtgtttctatttcacctcctcccaggtgtatcttccaacgtggtccccatgtacttaggggagctggcccctaaaaacctgcggggggctctcggggtggtgccccagctcttcatcactgttggcatccttgtggcccagatctttggtcttcggaatctccttgcaaacgtagatggtgagttcaggacatctcgggagcacccccaccccttcaccactacccttggccccctccttgtgttccaaagccaccaccacaggacaggactttctgcagactggtctcttctaacaggctggatgtccttggggggcccatcctgtcccgagccaacatagcaggccatggacaaaggcgcgataagggactggccagcgtttactatctagtccctcttaggagatggatgaggtggctttgagtgatgggcttccctgcctgctcagcagctgtccatatggaggcccgtggcatagcaatgacagccaccagtgtgccaggctctgtgcttggggcggacccagcatcagttcataggaccctcccagcaacgctgctgcctgggactcagtgattatcccattttgcagaccagaaagagaagtaccaggagtgagggtggcctggccccatgggggaggtggtgaggacatcccagaccctgcctccaccttccccaagacagcctggggcctggcatgcggcaggtgcacagacacctgtaaccggggttgtttttgcacgactttccctttaaactatcatcagtcatcccgtcagccaaaacataagccagttcccgccagggttctacacaccgtctgcaagtcagtcaagtggatcatcaagctctgtgctgcttagacactctctgtagaaagtgcttaccgtgagccaagtgccaagtcttttttagtaactcatgtattcctcagaacagccctattaagcctgtaccagtatcatacccattttgcaggtgcatcacaggtacagagagattggaagactggtccaaggtctcatgaggatgcagacccagcggcacagacctaggtccctgtttaagtaccacatgctcctgcctctccttcactcctgcatgtgttggggacacttacgccaaggcgccgcgttctcattaggagctgggaccagaagtgaataagccaggttcctgtctcagggagctccatagcaggactcagaaccacacacggccctctaggcatttgtgaagctctgtgcttcatttttttgctttgcctctagttttgcctttgcagtaccaatgcagccagcccatgtgtcccctctatgtggaatgttaacgatattcccactgtttctggtgtcctttctgtaatcagagctgccgtgaccattccagttcaggcatcctggtggcctggcttctctgggcatagagctgggagtgggcagttgggtcaggccgggtatgcccagctcctccagcccctgcaagactgtcctctgaaggacacggggacgttctcaccagcacatggtattaccggcctcgtcggtgtggtctgtctgatgggcgcaggggtgcgtcgctgctgatccctgctgcaggtgtttcccgagtgtccaccgtcgggagttgctgttcttagggctgggaaagctgtgccctcctggagcctgcaccccactcaggatgacggggctggggccggctctgcagagggcgccttcggggtggtggggaggccgctggtgccagctcgctgccttcctcccaggctggccgatcctgctggggctgaccggggtccccgcggcgctgcagctccttctgctgcccttcttccccgagagccccaggtacctgctgattcagaagaaagacgaagcggccgccaagaaaggtaacgagggctctggcgggggcggcctccaggttctgctccccagccctggtccgacggtgccgcttctccccagccctacagacgctgcgcggctgggactctgtggacagggaggtggccgagatccggcaggaggatgaggcagagaaggccgcgggcttcatctccgtgctgaagctgttccggatgcgctcgctgcgctggcagctgctgtccatcatcgtcctcatgggcggccagcagctgtcgggcgtcaacgctgtatgggccgggctgcggctcgggagctggggagggctcggggggcgcggggcgcaggtcctggggcgccgggcgtgggtcctggcgccgaggccgcctcctccgggcagccgcccagccccgcgcttgccttgcagatctactactacgcggaccagatctacctgagcgccggcgtgccggaggagcacgtgcagtacgtgacggccggcaccggggccgtgaacgtggtcatgaccttctgcgccgtgagtgtcctgggagctgcccacagcctccacccaaggcccctcgggccccacgccccagcctcggcgccgccaaaagggcagcccgtggccccaaaacgtggaggaccagccgctactacagaaactctgtgtgggaggtggccccgcaccagcccctcacacttggggctgccgagccgcaccgggcccggggccaccacctgaccgggatgtaggcgtgcctggaccaggcagcgcccactgctgggtggctccgagcccgggctacccggagtgaggctcggccacctcgggatgggagcaggctccgtgggggcagcgtctccggtgcatgcagacatctggcctcccgagggcaggaatcctgaggctcagggttgtgggattaggaggccctagagctgagtctcaagggtgggcagctggggtcccgcatcacagccacagccgacttcccgctggctgcccaagggcatgtcttgcacatgtgaatgtgagtgtgcgtgcacatgggtgggcacccggtccgcccagctctcctcacagctgccccattggagggggctggagggaggtgaagctgggcctctcccgcctgagccctgccaccctcctgtaggtgttcgtggtggagctcctgggtcggaggctgctgctgctgctgggcttctccatctgcctcatagcctgctgcgtgctcactgcagctctggcactgcaggtgaggacaggccagggtcccaggagcccggagctgcaccaggaagaccagtgcccctcccatcctgcgcctccacctgccttaaaataaaaggggtcacaatgagctgttttagcaaatacaactggccagacatctggggaccgtgtgtcctgccagctcatagcccacgttcagctgatttcccagtggctcatcgaggtggcactgctgggggaggagccaggtgccatcctccacccaccagggcaggttggccgccccctggggtcccgtcctagcttgtctgctccaggtgaaccaactgctttctctccacaggacacagtgtcctggatgccatacatcagcatcgtctgtgtcatctcctacgtcataggacatgccctcgggcccagtacgtacccaaagctggcctcagggtgtcacaaccccccctggtcccagaagctccgggctggagctccttagagataccagggatggccaatgcagcctggaaatggcatctcttcccccgtccaccgcaagggggtgggtggcacataatgagagcgaaatggtaaaatggtggtgtgggtgggaacacacagactgtgcaggcagcagagtgggcctaacgggtggttgctggcctgccatccctgtacactgccgtttgccccctacgtgctgccccacatgcccaagagtcctggagacgcctctgtcctggggccagctacctggtgggtctgcatggccaggcctgggatgctcgggcccgctctgccttcagggaggctgctctcctccccctacaggtcccatacccgcgctgctcatcactgagatcttcctgcagtcctctcggccatctgccttcatggtggggggcagtgtgcactggctctccaacttcaccgtgggcttgatcttcccgttcatccaggtgagtggggcccggggcccacgctcaccaccagatccccatgcagtacagtgcgagcccctgggcaaaccacgtcccacacgtgtcacctgcccctcttcccgcaggagggcctcggcccgtacagcttcattgtcttcgccgtgatctgcctcctcaccaccatctacatcttcttgattgtcccggagaccaaggccaagacgttcatagagatcaaccagattttcaccaagatgaataaggtgtctgaagtgtacccggaaaaggaggaactgaaagagcttccacctgtcacttcggaacagtgactctggagaggaagccagtggagctggtctgccaggggcttcccactttggcttatttttctgacttctagctgtctgtgaatatccagaaataaaacaactctgatgtggaatgcagtcctcatctccagcctccccaccccagtgggaactgtgcaaagggctgccttgctgttcttgaagctgggctgtctctctccatgttggcctgtcaccagacccgagtcaattaaacagctggtcctccactttgctggttcagccttcgtgtggctcctggtaacgtggctccaccttgatgggtcaacctttgtgtggctcctggtaacataacaacaacagttactatagtggtgagatggaaggaatcaaattttgccagagaaactaacttggtggccccgacaggtcttccggggccatgggcatttgtttagagccaaattcatcctcttaccagatccttttccagaaatacctgtctaggaaggtgtgatgtcagaaacaatgacatccagaaagctgaggaacaggttcctgtggagacactgagtcagaattcttcatcctaaattattttgttagtggaaaatggaattgcttctgtgtagtcaataaaatgaacctgatcacttttc

SEQ ID NO: 36606 - DNA, 32664 bp, Homo sapiens; identical to SEQ ID NO: 36605

SEQ ID NO: 36607 - DNA, 26086 bp, Homo sapiens
agaacgcggagagtcgccgcctggccgggcgtagacgcggtggcagagcccgcgcggcgctggaagcgagtggcggagcggcgggacctcggcggactcgccatggaggaggaggtgagggcggggcccggcggggcgttgggctggggtcctcgagcccctcacggggattgcggtcctgggctcaggccctcgttcctgcccgccccactcccgccagtctcacctcaggaagagcctgggcaaatggggcaggggcgaggggctggatccatatcggggacttcgcagaccgcgtcctccttcattctcgctgactttctcaccagttgtggggcgtcgtggttgttaccgttcccattggattgaccaggagactgagactccagcgagattgatgacttgctgaaagtggcctgggtgactgggctcgaaccccgattaccgtggtcggatcctgactctctctctctctctgtgtgtgtgtgtgtgtgtgtgtgtgtgtgtgtcggatcctgactgtgtgtgtgtgtgtatgtgtgtgttggggggttcctgtctcaaggatcggatcctgactctgtgtgtgtgtgtatgtgtgtgttggggggttcctgtctcaaggatgtgaccatgctttggtggcaggaggattggagaagttgcttttttctcccttgtataagtctctgtatcttttcccccactctctccccgctccacatccatctgagcagctagctgtagggaaggaatcgggagtccggcccacctagggtctgatcttagtccctgccttccccacccgagggctggaccaactgtgtccctggagcctccttctaaccactcaaaacactcttggcctgggattgggtcttgcccctgcccctgccctttacttgcaaactcagttctgccagcagccgctttatccgagggtccagcacgcagcaagcacttaatatatgcctgtggaatgattaagttaaaatgaggggcctgttgggtctagaggaaggtgaatttgtttcttatcccctgagggggtcccagcttcagcccctctcagcccaagggaaggggcatgtctttgcctccttggatggggaggaaagatgaagttctctgccttgggggaaccctggccagctgggaagccctgagtggaccggactgcctgtgtcccttcagtgcccacctcccacttttccagggccatggataggagcagctagtggtccgtcagggctccctctaggccaggccctgcctttctgtgggatggtagataagtcacttcccctctcagccttcatttcctcttctacaaaatatagtgcctgtcctcctcatactcctggcctgacagtggccggttctctcagtgggtgaaggtagggggcaaagtcaggcctctgtgatttgctgcggtttctttctggctgttaggtggggctgccatctgcctgccccaggcccctgctgcaagggctgggctctctggccagggcccctcccctgctcccagaggatgtgggtcaggattactccatctcctgatctgcgctggcccctgattaagggaagttctccggacacctcctgggcccggctcagctctgtacacccttggtcctgaatctctcacattgtcactttcttttctttttttttttttttgagacggagtttcgctcttgttgcccaggctggagtgcagtggcgagatattggctcaccgcaaccgccacctcctgggttcaagcaattctcctgcctcagcctcctgaatagctgggattacaggcatgcaccaccacgcctggctaattttgtatttttagtagacatggggtttctccatgttggtcaggctggtctcgaactcctgacctcaggtgatccgcctgcctcggcctccgaaagtgttggggttacaggcatgagctattgcacccagcctatattgccactttctgactcctagatgcccaaagctctctaaatatctgggccatctaagttcttgtccactttacccaagcccctgcaagcctcacccccacagcaggggcttcctttccctactcccctttggcatccctaactctgctttcctcccacttctcccagtagcttccgcttgttgcactaggcctcagtgcccatctttgtttctctaaaacacctcttaggtcatagccacatgctctgccccatgatcccaggccatcttcatcatctctttcacatggctgctttcagccctcctgctagctttcagcttcctccctgtgcccggccaccctgggccaaggtccctcagcctcagtgacctcctctatgcaacgggcaggctggtagctcttgtcaggctgaggcttggggaggagatgctggtctgggcactgggcatctgcccacctgtgtgctcctggcctcggttcctcctttgtaaaaggaaaagggtgggtgatcgagcaatgtgatgatgtatattcaaaagctgagaaaactgcgaatatcagtgggggtattattgctgccattggagtaagggtggaaatcctggacctaggctttcccttctgtactctggggctctgtcctctgccagcagtcatgcctttccctggcttctaggctctccacttgccctcaccatctagagacaagcagggcagtgtcctgtcccagtactgtttctgtcccacggagtaatctcttgccctttctgggctgtactttctctttctatagtaaaggggttgagggggcaggggctttgataaccttttgtgccttgccttctctggaccaaggcgtgtgtctcttcccctgctcagagccctccccaaaccctaccttctgcaggggtctcccaaacgaaccccaagcccttatctcatcagagagctaggaccggtgcatccctctggttaagtgctatgtctctgccaataggctggagcctctcaagcaggagattacccgctccccaccagacaggggacttatcttatacagcgtctctgttacccacctcagactgaaggttgccctggggcagagcctgtgcttcctctctctcaatgccccggcacaggactctgacacggtggattcttagtagagttgggtcagaacatcactgggttttgtcaaagagcaaaggttgtcataagcttcctgggatgtgaggtgccaaccaagtttcttctagtctctgtctctcgtaacctgtgttgtggttccatctgtccccttctgtgtacagagttgaggtgacctggcttctttttttttttttttttttaatgagtgatccaagggaggcaggctggtgcctaggggtgcctcaggagctgctcacagtgggcaggaaagggcctgggtgaggagggatgggaggggagagggcaaaacaggaagaacagcggtcagctgctcagtgaggagaggaggccgagaaactgggctgagcaggacaaaacctcccctgtgaaccctgccaaggggaggggccccttattaaaacttactggggcatagccaggcccccctggagggagggggtctgaggggcagggaagggggctgggtggaggcaactaggactctggcctccagccagtcctcccctgggtggctgtttctgtggctgggctgtggttcacaccatctgtagcccttcagttgtccccttctccataccaaagtgctgtttcgcctagtcctgccctggtcccattcattcttcaaggacctggacttgtttctgtaggtaatccagtcacagtattctctaggctacatcagcccagaagtgacagtgatctaggcacaagttccagctgtggccctagggagcttccagagggtagaaagttttcaggagaggtcatgagtggagagagtttagaaaggggtgtgagatcccttggggtggtgggtgggtcccctgaaagcaagaggcgagcttggagctcagaggtgggtggctgggcaacagcttcacactccacagacctcactgccttgtttaagagaaaccaagagtctgcccatcaggtggaaggcctggcaggggctggtggtgctgtccttgctgttgccgttgcagtaggagggttgtcagtgtgaaatgtgggggtggggtttcccatttccctgttcttcccttctagccctgggcctatgacagcctgcagggctcgctgaagtagtgttagggccctgggggtgtcagtggtgatgtggggaatgggagttgagtgcatgatggaatgggagagcctttcccttcttgtcaaagggtgctgaaatccctcttctcctggacagggtggctcataatcggccagccttctacttccttgttcctatatctgggaagaccttttttttttttcggagacagggcctcatcctgttaaccatacaagagtccagtggtgcaatctcggctcaccacaacctccgccttcctggctcaagggattctcctgcctcagcctcctgagtagctgggattacaggcgtgcgccaccaccgcccggctattttttgtatttttagtagagttggggtttccccatgttggccaggccgatctcaaactcctgacctcaaatgatctgcccatctcggcccaaagtgctgggattacaggcatgacccaccatgcctgtagaagaagaccctgggaagatcatttggaccaccccacttccccatttctcttgccatctacaagttagggagagaccccaaggtgggaccccacattcctggagctcctggagatctgaggccagcagctatagaccagaaagggcttgtcctgacttgggaactgggcccagggagagggtccctgagagccagagaggatggcagtgacaatagtaacaataatgacagctgccgtttactaggtttagggcatcctgggaactgctctatatgctttgtctttactcagcaacaaatgtttattgaacacttactatgtgccagtcactgtctaggaactgagggtacaggagtgaacaaaacaaaaatcctgccctcgtggagttggattccttacaacttctgctgttagtagctgcatttcacagatgaagaaactgaggctcagagaggttaagtggtttgcttcagtctgcatgactgcagcttctaagcccagattccccaccactagaatgcgcagttcaaaagggggtgggggcccacagtgagaaccaggctggggttcccctgccatgacagagaccagggaagccaggtcttcccagctcctgacagtgcaccacgcttacatctgtctgggcttgttcttccaaaggcagctgtggccacaggatatccctggggagaggcacacctcttttaactggggccccttttttgaattttatgtaaattataacgtagtcaaaattagtccatgctaatttccttctagcagcctctagattctgacacattcttgatcccctctccttcaccccccacttcacactcacgactctgggtacctatcagtgaagcaaagtggttagcaaagggtgtgtatttttattttcatttcacgcgtacctcttgagcacccattatgtgtaaaagaacagggctgggtgctggggacccagaagtggatctgaccccaaccttatttggtaggcatgtatctggcacccagccacccaagcaggcaatcaatgaggcacaagatgtcagtagctggccccaaggctccagggtgtctacccaagtccaagagaagggcttgaatttaactcctgtgccagcctgtggtcaaagacagagtccttggaaccctcaccagatgtggtggccaccctaaggtccttgcctggagtggggaggaggggagaggagcctcctgctttgggtgggaagcggaaggggctgcagagtgggttctctagaagcatagcggtagagaggcagattgccactcagcctgcctgtccttccagtctttgttctgggtggccttcctgggccaccccaacctgaactgggtcccccactgtcctctcgctgccctttgtgtgtttcctgtatagcatttcacacaggttgatgggtatgcctgggtatttatttgttcagctcctattttcccgcactgtgagctctgaggacagagactgccttacttttattctcctgtgatgttgtaagcactcagtacatttgttgactgattgaatgaacacatggaagcagaatggtggagtgggaaaaacgtggggtcagagagacctgctttgaattctggctctgtcctctagcagtggtttgccactctgtcgagtcatcctccattctgagctttagtttgctatgacatgtggataatgaggctaccatcttggaggggagttgtaagagtgaaatgacactatgtgtatcaaatgttatacagtggctcagagtaaagtggctgctgctattattgttgttattagctctgatcctgggttaggaatatctgccttgggggttgtggggaagctcacatattatgatgtcattaggtacttagcctagggacacatcccttgtgtgacctatgaacctgtgacctgtgaccccatggtagcaaccctcatggtatgaactggtgctgtgttacagggtgtgaaggaagccggtgagaagcctcggggagcacagatggtggacaaggctggctggatcaagaagagcagtgggggcctcctgggtttctggaaagaccgatatctgctcctctgccaggcccagctgctggtctatgagaatgaggtgaggacctgcttggccctgagattgggggttctgggacaggggcaaagtgagggcattcaagttagtaggaggaccctgggtctggggccagaagacctgctctacttttgccatgctgtgcaaccttgagcgagtacctaatcctctcttgggtctctgtatatggggataatacctccgaggacaaatctagggtttctagatgagagttcttttcttatttttttaaacttaattcttttttttttggtgatggagtcttgctctgtcaccaggctggagtgcagtggcgagatctcggatcactgcaacctccgccgcctggttcaagcaaagcaattcctctgtcttagcctcctgagtagctgggactataggcatgcatgccaccatgcccagctattttttgtttttgagaaagagtctcgctctgtagcccaggctggagtgcagtggtgcgatctcagcttactgcaacctccatctcctgggtcctggttcaagcaattctcctgcctcagcctctggagtagctgggattacaggcatgcaccaccatgcccaactaattttttgtattttagtagagacagggtttcaccaagttggccaggagagtctcaatctcttgacctcgtgatccacccaccttggcctcccaaagtgctgggattataggtgtgagccaccacgcctggccctcttttttttttttgagatggagtttcgctcttgttgcccaggctggagtgcaatggcacgatctcagctcactgcaactgccgcctcccaggttcaaacaattctcctgcctcagcctcccaagtagctgggatcacatgcgtcagctaccacacccggctaattttgtatttttagtagagacagggtttcaccctgttggccaggctggtctcgaactcctgacctcaggtgatccacccacctccgcctcccaaagtgctgggattacaggcgtgagcctgcgtgcccagcggagagttctttgaactgtatgtgcatctagtgtgcaagtcttttcctgtccctgggcaaggttccatatgagtgaatgttatggaaaactgaagcctgctccattcagcagtggtagtagaaataataattagcaggccgggttgtagtggcttacacctataatctcagcactttgggaggccgaggcaggcggatcacctgaggtcaggagttctagaccagcctgaccaacgtggagaaaccccatctctactaaaaatacaaaattagccgggtgtagtggtgcatgtccgtaatgccagctactcaggaggctgaggcaggagaatcacttgaacctgggaggtggaggttgcagtgagccgagatcatgccattgcactccagcctggacaacaagagtgaaactccatctcaaaaaaacaaaaaaataataagtagcactcgtacttgtttggagatatgctcttacatatctccctatgacaaattgcaatagtcccatgagagtggtcttcatgttagatttttacagaagaggatactgaggctcagggtgacaagatgactgttcagcatctcccagtgaatggaggagttaggtctagaagcaagtccagcgtgctttctaccaagagacgccagcaagtaaactccaaaacttatttttgttagaaaatctctaaaatatgttaaatattctccgctttcttcaacagaagattctggcctaaataaaatctttccctggtggctcagtgtcatcacctgtcagacccacctgcagagtgggttctctagatgcacaggggtaaagaggcagattgcctctctgttttgaactggcaggaggctgtacttctcatcttttctttctcctttaacatcaagctgctggttgcaacttctgctgtccttgtgcctcgaatagccctcacttcttcccacttcagatgcttgttccccttctgatttcagcaggcttgggatttggacaaccaaggatgctaagcttgcgtgttaactaagagtcaattaagatgtaggtgaagacttgaggaagaaaagtggtttttacttgtagatgctatttgtgtgctgtggttgaggctatcggagggcccatccactgaaaacagggtagcaatatatgcctttgacaaatgaaatacctggggaagaattggcctgggggcagaagggggagcctgcctcttcctcatccacctctcccagcctgcctcaggctatcttggcaaattcacagttgtcccaggacaagaaagattaggcaacctggatccaaagtgtttaaaggagctgcctcggagaaacaccttgtctgacctacctgagttgctggctcgtggagtttgtttgggtgtcagagaagcagtgggaagagggcaagggaatgagggtgcgtagacagcacccccagatgttctctactgctgctcccaccaaaataggatgtgccacagttgagaatgaggcagcagggggaccttttttccaataaagggggttgtcacagcttcttccagtgccagctgccatgagatttaagtaacaggcttcagctgtcagcctgtcaggtactgtcagacttgtcctaaactgcctctctgcatctggccacagctgggaagcaggaaggatttcacatctcccaaacatgaaaaatctaaatcatgcttttttccccttgtttgaaaaagattgctattaaaaatgtaaatgcaatttcaggaacttaacacttaggggtgggggagcttggccctggagtaggaattgagaaatgcttattagctcaattcctctttctgatgtaaggaactaggcgaatgcgaatggctcttggctgtttctttgctgtcagagaggctgacattccaaagatgcttccctcacccattgcctactggtttatccgtttttctgagctgcagaagagctgggatgattcagcgtcttggggtggggtggagaggagacccaggacaggcagctattgggagcttaatggtagaggtggatggactttttgttcccaggcagaggagggtgtattcgggccagtggcggtccagttagtggaggcctgtggacacggggcaagtaagctgctctctctcaagcaaggattcttccccgggcagtttccctgctccagattcccggggaggaggagacttcctgagttctcaatctggataaggcactcagaaaactggtcctacatatgttctgcttgagggctgctgcttgtagggtgcagttgggggaacagaaggataagcagatagatacacagagaatggggtagagaaagatggccaagcagggagtcaggactgtgttttcccatggcaggactcggctcctagcacctcatagggtgtctgcatcttgcaggtgttttgtagatgtttgcatccccctggcagtaaatgatgggatggagagcactcaagttcaggggttcatggttgggggcaggggagtttctcagagcaagaggatttttctggtccgtctgtttagttgaggaatctggaaggtactggaggctagagattggaaagggatgtatggatggaagcaaaaatgagaaaagatacttgatttaacctggttgggagagataaggccaccttggccatctcttcccctttctctgaggggctgacgagagagtcgattagtagttatccacattagatatacagtcatctgctttaaaatatcctgaggtctgggccttgcaccccaagagattgtggtataattggtctgggatgtcgcctgggcattggggtttttaaaagctcccaggtgccaccaaggctgagaacctctggtgtagagcagtggttctttttttttttgagaaggagtcgccctctgtcacccaggctggagtgcagtggtgctatctcggctctctgcagcctccgcctcctgggttcaagcgattcttctgcctcagcctcctgagtagctgggaccacaggctcatgccaccatgcccagctaatttttgtatttttagtagagacagggtttcattatgttggccaggctggtagcagtggttcttaactgttcgcatccaggccaggcttggtggctcatgcttgtaatcccaactctttgggaggctgaggcaggtggatcacttgaggtcaagagttcgagaccagcctggccaacatggtgaaaccatgtctctacaaaaattagccgggcgtggtggtaggcacctgtaatcccagctactcggggggctgaggccggagaatcgcaggtacccaggaggcagaggttgcagtgagccgatatcatgccactgcactccagcctgagcgacagagtgagactctgtctcaaaaaaacaaaaaacaaaaaaaattcgcatccatcaaaatccctgggggctagttagaacgcagattgccaggcccaccctcttaggtgtaatgattgagtggggatgaggcctgggggtttgcatttctttttctttttctttttttttttttttgagacagagtctcgctctgttgcccaggctggagtgcagtggagcgatcttggctcactgcaagctccgcctcctgggttcacgccattcttctgcctcagcctcccaagtagctgggactacaggtgcccgccaccacgcccggctaactgcccggctaatttttttttgtattttttttagtagagatggggtttcactgtgttggccagtatggtctcgatctcctgaactcgtgatctgcccgcctcggcctcccaaagtgctgggattacaggtgtgagccaccgcacccagccgggagtttgcatttctaacaagctctcaggtggtgcgaatgctgctggcctaggtcccaaccttggaggacccctcgtgcagagcaacctactgcctgtgactggaaggagtgtgctgtgctggaaagggccctggcctgggagtcagaggctgtggtttgagttggggccctgccccttatatttgggtctgtgtgcctagggcaaatcccttcacctccaggcctcattctttccttctaaaatgaggcagatatggggctgcaggctttcagggttattgtgaggttcagagactcagggatgcagaagtgctcactaagtgtcagatttcttctgttaaacatcagcaagggtttccttaactttttggcccgtcccagggtggtgtaccctcccccaccaaaggatctgcttctgcttccctggactctcctggatgacagagtgccacacccaggaagttgttccagttgggtcttccctggaagaggaccagttgaccaccactgagggaggagcttttcccaggcagcttgctggacaggcacctgatgggtggagcctgtggagaaaacactcaaatgtcaggagtggtgggcaggaagacagtctggctggtgtccagagatggccgggaagaggctgggcactgttctggccactggccctcctaatgatgaggcctccgagtggtggggtggggatgggatgcgcttcaaggagcccttgcctgttgcttgtatgtagcctgcagccttggatgaggtgctgctctcccaagccagggctccgcagggggtgatgctgagtgaggagcacaattcaggatggctgtgctgaaggcagggcatgtagccccaaatttgccttgttcacacttccctctggctcttcctggaaagtcgttgtcccccgtccccatcccactccctgcctgccattttgtggcatcctgcattcttcttctggctttctcttccacagatctctgcctggcctctgggcatggctggaccccagacagccttttcttatcctctctagcttcccctctgtttcctcctctggccttaggcacatacgcgcctctgggctatgtgcccatctcccatctggatggggagccttgtgggcatccctccagccagcatgcacttgccagggtctggacaccacatcttggtgactgattggcagcctgaggtcctccctctaaccaagtgatgtcctcgctgagtgggatcagggtctgggacatgagtagttgagggtggtggtgggtctgactgtcaccagctcatgtcccttctgtctccctccccaggatgatcagaagtgtgtggagactgtggagctgggcagctatgagaagtgccaggaccttcgtgccctcctcaagcgaaaacaccgctttatcctgctgcgatccccagggaacaaggtagggcgatgcctgctgctgccccatctccctctagcccagagtcagcttgggaggcctaagcaggtttaaggcaggcctggccccttgaaaaagcctgttttccgttgcgtgtggctgaggctcagccctagcagccaccataggtcagacctttgctcattttgtctcggaatcttccaagcccctagttgataagagatgcacttagggctctgttgagagacctctgctccccttttcctcttgcaggcccagggcctccatcccaggctgtagttggaaagtagcctttgggaggtggggcacttggctgtaccccagaccctgggggaggcccagggctgaggcaggagagctgtggttgaggcctccaccctgccaggcctcaacaccgtgatgcagcctggggcagagggggagtgtgtggcctcccttcatcccaggcctttgtgggtgggcccaccctggactaaggactaggaggcctgcagccccccagctttcctccccttgcactttcctttcttggctgtagctggggaaggtccctggcttgagagagtctttccctgggacatgctgtgtgtacagatgaagtttgctgtttgcaccacatttctctggcggggagtctggtgggtgttgacacatggtgtagcttcacagatgtcaggagcgagttcagatttgaggctggcatgcacagcacctctcgccagcttgcacccatctgcggctgggccattccttgccttgtcctctgcatgtcatgtggagcctcgcagaatagggctgagtcacagaggctgggagttggggagcaagtctggtctgggcctgctggaggccattctgtttctcccccagctttaggggataggagcccagtcctctgcagaccctgaagaccacaatgctttactcattgaccctttgtcctactgtgcagggggtgggggcgcagaagcaaccaagatagcagtggagggggctgtggagctgtgatactagggagctggaagtgtatcccagggtagcggctggtataattatagtgttatgagggctcatgggactgggcccaggtttcacttgacatctgctgcttagggctctttgaggacaaaaagagtcacattttaatcttttcaaggcctggagcccctaccctgtcctggagacccacttccttcctgagtgggcactgtatatgtggatgtgtgtttgagagagatgagatgcaaagtatgttctgtgtgaagatctgccacctgtgtgtctggcccttatgtgtgtatctttttttaatgcaggtgagtgctcacctggccgtgtgtctgtctgggtgtgtgtcttagtatgctatgtggatgtggggtggagggggacctagcctctctggcctctgcctgtgctgttctgtgggccatctcttccccagctctgagaatcagctggtgatagactaggtgggcttggctcagctcagggtgggacatcaccttcagagaagcctgtttgtgcagctgtgttctcagctgcttcagccaacaccctccctaccagcccccaaccctgcaagaatttaggctggctctgagaacaggacaagaatttaggctggctctgagaacaggagatggggctgtggagcaagtggtgggtgctgcggatgaaacagtgcatcctggttccagctcaagggtccctgaccctccccaccccaggagctcacacagattggggctctccagaggtcagttggtggacctggcccagggcaccacattcccacatcctctcaccctcctttctcagcagcctgggtgttccccgtcctcagtgaggcctccagccggccaggaggtcacatgaccctggctgtctggtcctgaggccgccttttttcccctctaatcaaataaacaaagactccaatgtcttacatgcccctctccccctgcttctccagccccacacccctgcccatgaggtcacaggcagacgctgccaggaagcagggtggccactgctgggccttgctgccctgctggtctcagccagcttggccctttcctctttcctgcctcctctcttcccctcccacttttttcctctctgccattttgtccttaaccttttcccaggccttgtgggcctagtctgtggccagtcctgttagcatctaagctcctagcagtgcctatgtccctggggcttcttggaagttctcagggcagggacctgtacagcctgtggcccttcaggatggtttttggggagaggcacagcttcttggtattcttattttttgagacaggatctcactctgtcacccaggctggagtgtagtggcattatctcagcttgctgcaacttctgcctcctaggctcaggtgatcctcccacctcagcttctgagtagccgggactgcaggcacacaccgtcatgcctggctaattttcatattttttgtagagatggggtctcactatgttgcccaggctggtaacttcttggtattctaattgtttctattgtggtcatccttgtggaatgcctggctcgttcagccagatacagggttccttaggagggtggagctgggtcctgtttaaccttgtcttccttctcctgtgggagccttttggcttgcacaataggtcttctctgaggccatttctgcttctcacaagggagcagaagagagccgaggcagcctgcttcaggtgggctgggccagtggggaaggagctgcagtttgggctgggtccagtggttctgttcttgtccctttgaggtccagagtaatgaagcgagtagaacttggtaatctgacttctaggcctgctcttctctggcctcctcttgttccattggctcctgagttcagctgtacacttttcaagctccctggatgctaaatcctgtaccatgcaggggtcacaccagctctgagcctgtgaataggaggagcagctgggtagaagggctggccccagactccctttctagcaggtcccgtcacagagttgggtggccttagcgaccccagatgcagtgtggtctgtctctgagcccccagcagccctgatggctgagctgaggcagttgccaaggtgccctggggtttctgacttaactgaagatctgcttccaggatcaaatttaccctggtcatgcaaatgagcatttggctgtgcctggcatggtgggggtgggacccagggccctgcatgaggaggaggcagtggcagccaggaggaaattatataatgaggatgctgagggggccaggccgacctcggtgttacataactggagagtggagggaggggaggtactatctaacaccagggtggaggatgggcaagctggcgaccgccaacaaagaactagggcatcttgaggtcagagagtaggcagtggtccaaaaatggtgagggaaggaaacttgagccagttcattaattttttggctcattcattcaagaactatttactgagcacctactatgtgccagtccctgcttttaatcatgtttaatttccccatcattgcttggtagtaggcagtgttatcccatcttacagacgaggaaacaaactgttttgtccagagggaaggcaatggtgctaattcctattactgagtattcactctgcctagctccagatttagtactttagatatatcttttttccctcaattaaaaaataaaaaactgtggtaaaaaaaaatttaccatcttttccagtttgaaattgcacaattcagcggcattaaatacattcatggtgttgtacagctatcaccaccatccatcacataactctccatcgtgtaaaactaaaactctatgcccattaaataataatgccccattgcccctctccccagcccctggcaaccaccactctcctctctgtctctatgattttgacaactctaggtacctcatataggtggaattgtacagtttttgtctttttgtgtccagcttatttcacttagcacaatgttttcaaggttcatccctgttgtagcatgtgtcagatttttcttcctttttaaggctggctgataatccattgtacgtatggaccacattttgcttatccattcatctgtcagtggacactgaggttgcttccaccttttggctgttgtgaacaatgctatgagcatgggtgtacaaattggatacatcattttaaaaatgatcttcatggctccatgaggcaggttctggtggtattctcttttacagttgaagaaactgaggcctgaggtcagacacctgtaagtggtggactgtcctgctcagaggccctactgccttgtccactgcgtgaggcagcccctcagtttccatgacctcactccttcctcttatttcctgtctggccattgggcctggcagggtcagggttctctgagccaccctctgattctaacaggagctcagagctcctacctgaattgggaaaggactcatgggtggtgtggggtgggtttgaatgtagactggggctattcctacttttcagagtaaacggaagcccagagcccaggcagctggcctgggggagtcccatggagctggaccagatccgggctctttccacaaggccaggctgattcgaatctagacccagctgcatactggtgggcagtggggagggcttctctgtgagatctttccctttcctggcccaaagccccagtgtcatacttaactgtggggtcattttggtttgactttgggatctaggtaaggaagcctccttaagatgccaaatgtgagctttgttaaacatctgccatctactccatccatcttgcccacaggtcagcgacatcaaattccaggcacccaccggggaggagaaggaatcctggatcaaagccctcaatgaagggattaaccgaggcaaaaacaaggctttcgatgaggtgcgatgcagtctgtggacatggacagctctgtgtctcctttcccactgcgtgtgatctaggagaggaccctgcccctccttaccccagactaccccttgattatgtcactgctatggggcattgttgttaccttctatagtcctcactacagcccctcatagtaggtggtgctgtccttgttttacagatgaaatggaggcctaaggaaattaagtaacttgtcttaaactggaaagcagataagtggtgggctggaactagactggtggcagcatgcatcctttctaagcctggcctcagctggaagcagcaggtgggcccaggccagagagtgctgcagagtgagccgacagctcccttttcagtttgaccatgaagtccagggcaggctggctctcagctctgggcctccctctctgtctgcaatgaccattcagccctgcagacctcagccccctgtgctgtactggggactgtggcaacagtagccacaatctggcttggggcaggcagagcatcccatggggccaggatctcctaggaagatttgtctttgacatcacggatctttggttatttgggctaaaatggacctgggggccacctacagtgatgccttggattatgtcaaggagcaaatcttcccaagcaagtcccctcttaatacccaggttccccgactcccagcccatagctcctatgtcgtgtcctgtgttacatgtcatgctcagcccttcactacctaggggaaaagtgtccccgttccacgggagagggatgatgggacatatcatagatattgggggaggccataggagccatgggctgggcctcagcccactgagggacagagggacagagggacagagacagctggagtcacatgtgggcctgagcccccactccccatcatagggccaggctgctccagggttctgagtctggacctcccatgtgactcttactctgagacttcccagccaatcctgaccccttctgttaccctcagagagaagatgctgacctccaggctcccagactcaaggggcagaggccctgctctctctctgggctctctccaggggtcctgggagggtggcagaggccagggcagaccttttccagaaaccaggtaccaggggagcataggctgctttcaaccttctctcctagctaagccccaaagccacctcagggctgcttatatatttgtgatatactcaggggcaagggccgatggcccatatttgggcaggaagactgaggcaaatggcagctgcagagagggagagcctcagactttgcaagagactccaggggcattgcagagttagagaagcagaggccagggcagggagattcccagagagggcagcggtggggcactgaccctggctctgagccaggtccgccctggctacttcccacactccccaaggcttggcaggggctgatctggttccccctccctccaggtaaaggtggacaagagctgcgccctggagcatgtgacacgggaccgggtgcgagggggccagcgacgccggccaccaacgagagtccacctgaaggaggtagggccttacccagtgtggatgttggggttagttgagcctaggacctcagctcctctgggcggcagccaggcttggggccacatttttcctgaggacacctggagctggggcttcctgaggagtagacaggaagtgatggggcacctgtgttacacgtgctcagggtatggatgtccttgagcctgtagccttttccatttgttcaatccacacacaaatgttgaatctgtccttagccagagttggtgccagagggaaactgaagcccatgaggccagtccctgcccctcagagctcgtcttccagctgaaaaataggcctatcccacagactgctccatgcaaagctgtgtctgatttttgtgcggaggaaggaaggctctaggaggtcagggcaggagggaccacaaggagccactggcattttagctgacccttgaaggatgggaggggttcacttggtggacttggagtcaggggattctctgtggagggagtgctgtgagctgaggcacagcgggagggtttgaggtatgcggagcagctccatttgcctgggagatgggtctgagaagggggttgtggggaggaaattgtggaggccttggtgaagaagctggagacaaggaagggagagtgcgtttcagaggtcagtttgaggctctgggtaggatgggttgggttgagagagggaaaggcaggggccaggaaggaggtgggggaggcggctttccaggcccctggaggggatgaagagggaggggttgatgggaggatgttaggaagcaagagccacctgggcttgtgattgagtcaggggattggaccaagggaaggttgtctgaggttccccaagcctggagactgggagcatggaggccctgggcacagggaatttggagagggtatgggcaatggggaggggggaagggaggagactcttttagaccagtggagctaatgctgcaggggaggattttggaggccaggaaagaacctcagcaagtgctacatttagggactggagggaggtcagctagcagggaaccaagaaagaggaagccagaggcaagtgccacatctggagagagatgggcacaagacctggtgggcatcagccaggttggcagccgcaagtcacaagggcaggaccaaggacaaggcatttacaacatattttctttttcttttctttcttttcttttttttattattatactttaagttttagggtacatgtgcacaatgtgcaggttagttacatatgtatacatgtgccatgctggtgtgctgcacccattaactcgtcatttagcattagttatatctcctaatgctatccctcccctctccccccacctcttttttttttttttttttgagattgagtctcgctctgtcgcccaggctggagtgcagggtgcaatctcagctcactgcaacctccgccttccgggttcaagaagttctctgcctcagcctctcgagtagctgggattacaggcaccctccaccacccccggctaatttttgtatttttagtagagacgaggtttcaccatcttggccaggctggtcttgaactccagacctcgtgatctgcccactttggcctcccaaagtgctgggattacaggcgtgagccaccgcgcctggccttgcagcgtattttctaaaaggagtcgatttagggctgtcccggggtgcagggctgggtttgccggagggagggacccaaggtcgtgggaggtctgtttttgagttgcagcagcctgtgcctgtctgtcagctgagggataggatcctgcagagggagcactgaggtggccacagagaaaaggaatgcctgatgggggccggggacggatgtagggagggccagccttggagggaggggccctctgacagaagagttcagggaggcgctgtgtgtgtgtgtgtttgtgtgtgtgtgtgtgtgtgtgtgtgtgtgtgtggtgtgttaggggtgactttctggtggtccccagtgcctgatgtcagccaggtcctgtgtatgtataaaagggagtgagagcaacaaagggagatgggcatcgtggcacatgcctgtggtcccagctactctggaggctgcagtgagctgtgaccatgccactgcactcagcttgggtgacagtgcgagaccccctttttttttttttgagacggagcttcgctcttgttgcccaggctggagtgcaatggcatgatctcggctcactgcaacctccgcttccagggttcaagcaattctcctgcctcagcctcccgagtagctgggattacaggcatgtgccaccacacctggctaattttgtatttttagtagagacggggtttctccatgttgctcaggctggtctcaaactctcgacctcaggtgatcagcctgcctcggcctcccaaagtgctgggattataggcgtgagccactgcacccagccagccccatctcttaagaaaaataaggtggcaggggagagtaaggatcccagccaggacccccaccatctgagggaccttgggaaaggcctcctgcccagccctgctggggcctctgaggctctctgggagggtctcatgactgtgggactgctggatatccctattggtccctggagcctggtgggggtgggtagctgccttctggtgcagctgttctctggcagtcagctgtggtctgggaccacatctgatgacatgaggagagtgggcacaggctgccaagcagctggacaggcaaaagctggagagaagctggcagacggaacagaggtctccaggaagggcaagcagaagtcagtgagcttgagatgaactggaagaagtatgtttgagtcctggtcctgtctctgactgaccaactggttgtggggaccctgggtatggtgatgggtaggtgggttgcagagaagggaacctctgaaggccatacagctaggtaggggttagatgcagggctggaactctgtcccctgccacccaggcttgtatagtccagtccaggtccagtatcccagaaaccagcctggggctccaagaggaccctggctgtgactttcctggcctgtgattccaaaacagggaattctttggtggtgagggaaaggagaggaagattcatcaagaaatcactttagcttctaattaagtagccacagaagccaggacagagggaggctggggagctgggggcctggacaacctggatgggagagggtaagaactcgtgtcagtgggcacacctgacccaatggctagtcagccaagatgacacccatataccatcccccccaccaggtggccagtgcagcttctgacggtcttctgcgcctggatcttgatgttccggacagtgggccaccagtgtttgcccccagcaatcatgtcagtgaagcccaacctcgggagacaccccggcccctcatgcctcctaccaagcctttcctagcacctgagaccaccagccctggtgacagggtggagacccctgtgggggagagagccccaacccctgtctcagcaagctctgaggtctcccctgagagccaagaggactcagagaccccagcagaggaggacagtggctctgagcagcctcccaacagcgtcctgcctgacaaactgaaggtgagctgggagaaccccagcccccaggaggcccctgctgcagagagtgcagaaccgtcccaggcaccctgttctgagacttctgaggctgcccccagggagggtgggaagccccctacacccccacccaagatcttatcagagaaactgaaagcctccatgggtgagatgcaggcttctgggccacctgctccaggcacagtgcaggtctcagtgaatggcatggatgacagtcctgagcctgccaagccctctcaggctgagggcaccccaggaactcctccaaaggatgcaacaacatccacagcactgcccccctgggacctgccacctcagttccatccccgctgctcctcccttggggacttgcttggggaaggcccgcggcatcccttgcagcccagggaacggctatatcgggcccagctggaggtgaaggtggcctcggaacagacggagaaactgttgaacaaggtgctgggcagtgagccggcccctgttagtgccgaaacattgctcagccaggctgtggagcagctgaggcaggccacccaggtcctgcaggaaatgagagatttgggagagctgagccaggaagcacctgggctaagggagaagcggaaggagctggtgaccctctacaggagaagtgcaccctagggccttctgggccagaggcaccatcccttctggccatccatcaagtccatcaaggcccagccctgctgagaaatgtgcttctgcttctacagcaatggctgcaggagggccattgggcatgtcagggtttggccatgacccgaagagactcctggcgtccttcctactctgctctggccagtggtgccaggtgccacccagggctactgcctggctatctggcctggcctctgggctggggctggggctgggagcacacacgctgggacctatgtgtttgtgtggtcgttccaaactgccccagggctttgggggcggcacttggggtttctgggaatgacatcatctctgttccccatccccagtagtttacattcctgacttctgaatacagcacagctgagccccctgcagctcccatctccagctattcctaggcaaagagcctcatggctaaggcagcctcaaagccagcccctcctcccacctattctgagtagctgcagaggccttgggtccaggctctaggttcatccctcagttggggggaacgtaggacccagctggagcctcttgagggagatgagaggcctctttgtgaggaggacattagctgtgtggcctctctctctttggccctgtttccttttttgcaaaacaaggacattttctgcagccccttcctctcagtgagctatgattggagggcttaggtctggaggattcaagagtggaagaggaatttaaggggtcccctagtctagtctctgcccctggatagtgtccagccttgtatatttctgaagaggtggatcccagagtggctctgatgtccacattagaaaaacttacttgtaatgatcatgtcagccttcagaagagaatccccaccaacttctgtgcctcctcagatggggatttatctggatctctgtggttccttctcagccgaaacaggtccagtatcccagtcatttcttcaaatgctgataggggtatgttggaatccgaagccacttccccgccttcaagccccagatgggctgctctcctgtaactttctaggagaagagacattttcttctttccctttcctggtccatccctgcaccctggtcctctcccagcctctcccccacattgtccctgactctaggggcacatccagtctccatcgtgctgcagcagctggactgagggcagagcctgtaggtgcagaggccctggctcccgaggtccagccactctccctggggcctctggggtgagagcagcttccgataggacctgcccagatttctgcatgtgcacttttgtttactgaaagagagaaaggggggggtcacagcaacatgccctggcctttctgctctgttccccaaccccactgaggcctgctgcacaggtcaatgccttcgttatcgttattgtactgtcactttgttcttgaggtagtagtcaaggatcaggaggggcagatgtcttctctgggctgcgtggggccggagcagaggtgagcagcaatgcactggttcgggagcccccatcagcctccttgtgcaaactgggcccccatgccacagtctggctttccctccatctgccccaggacaagagcaagaaggacatcagttgcccagtcatgtgatcccctgccatcttgccttaggaacagccttcccccaccagcagccatggctggctggggctttagccaagccacctactgccaggaattggagcctcagttccctcctgtgtcaagtagctaactgcagcagctggactgagggcagagtctgtgggtgcagagaccctgcatgtaggtcacaggttgaggcccagccactctccctggggcctggtgggtaggcaagtagctctggggccacctcaagtgaccaaatgctattaatttccatcctttagcaggctgggccctaggcaggaagctggcttctgggagaggagtgagaacgtgcagggcctgcctagcttgcgtgcttgaggaaggtggcattccgtgcttgcctccttgaggagggtggcattctgtgtcttctgcttatgaagcgcctttcttaaagtttggcaataaatccatttttatgg

SEQ ID NO: 36608 - DNA, 36652 bp, Homo sapiens
aatgggagacgtaaaaggtgagtgcctctgaaaccggggtgttctgaaatagctgtgcacctcaaaccctaattttgtttttgtttgtttgtttttgagacagggtcttgctttgttgcccgggctagggtgcagtggtgcaatcatggctcactgcagcctcggccttctgggctcaagtgatcctcctgcctcagcctcctgagtatttgggactacaggtgtgtgccaccacagccagctactttttaagtttttttgtagagacattgtctcactatgttgcccaggctggtctcaaactcctgggctcaagccattctcctgccttagcctcccaaagtgctgggattacaggtgtgagctaccatgcccagcctcacactctagaaaattttttacatgccaggatattcagaatattgggggatattggcatgttaggaaatctagtatgtagggggagggcctggaaggtcaggaaatctagaatatggtggtgttttgtaatgctcacagatctagaatattagagtcatttttttttccaggccggagaatccagaacgctcgtgttgctgaaatgctggtcattctattcttatttcatgtttaaatttttattattttctttatttcttttttttgagacagggtctttctctgttgcccgggttggagtgcagtggtgtgatctcagctcacctcaacctctgcctcccgggttcaagtgatcctcccaccttagcctcttgagtagccgggattacaggcgtgcgccaccatgcctggataatttttgtattcttagtagagacagggtttcactgtgttggccaggctggcctgaaactcctgacctcaagtgatctgccctcccacctcggcctcccaaagtgctgggattacagacgtgagccggccttattctgggggagggggtggggggggagagagagagagggagagagagaggagaatttgggatgttagcaaatctagaacactgaagagctgggttttttaaatgctagagatagtattatcctagtatagtattaactctgtgtgtttttgtgcgtgagagggcatggggggaggggtggaagattctggaatgcggggggactagaactctgagggattctgaagggttgagatgagttaggattcaagaggtgacatagacacgatcctgggagatagtgacactgatgggagggatggggagctggggactccaaattctagggggaggggaggctaacgccggaagttgcagtggtgagccagaggatgttgcctagcaacaagcattgaagatgcgctggatcccggacagaagggagaaatttcagcagcgcccccagcaaatgctccagccacagggtaggaggtggtgaggggggaagcgggtagggatatgctgtcctgcagggtcatgtgagcaggggtcttgggggttatacaaaaacagggtcatggagtacagtcatggggcagagccgggctctgggacagcccacgaatagctgtgaatggagtgtgagtgccgtcgtcacctgccccagggactgtgtgtccctggacggtgctggacccagatttctgggtgtcagtgtgggatggaggcatggattgctgtaggtggcagtaatggtgtgtagccgtgtgagtcagcctgtgtgtctcacagtgagcgggggtgaagggcttccccgtcagtcctgcacaccctcctggattggaagaaggagcaggagtggggggtggggggtgcaactggatcagttgccattcttggtctggggtgggctctgtggtcacggcgtgtggcctagtaccctgtgtgggtggagcctgggatccacgaggtgggggcggggctaacgctacagaactgggaagcttaagaatccaactgctttgggatatggggcctggaaccccaaagcgaagcaaacatgaaaggggtgggcttgggatcctacatgtggtcacgtcccagttttctgtgggaaagggtgtggcctgaaactctggaaaaagaggtgattaggggcagagtgaagctctgagggtggtgccttagggagagaaggggcttgtatttcagagaatatagggtggagccttgaatttataatgatcttctcaaagaattgatcccttctcaaggccctaggcttcaggggttccaggctcaccatctgcaaaagcttgctccccgaagctctgtccctcagtgaacccagccaggctctgcccctgacccacaggatctgctcccagggggtcctgggggctcctggctctgccccctcctgcacctcacttattgccatccccagagggtatcagacccccttccttgcctgagtctttgaatgctcccaagagctttgagtctcaagctgggcttgagaccctgagtttgaaggcttgaagcctggaaccccggtgtggacggggtttaagggcccctgtggcttgcagctcctagtggtggagactcttaggcaaggaagggatcggtactctcttttatatagttttatgtatttatttattattgagatagggtctcactctatcgtccaggctggagtgcagtgcagtgcagtggtgccatctcaactcactgcagcctccacttaccaggctcaagtgatcctcctacctcatcctcccgagtagctgggactactggctcatgccaccatacccggctaatttttggatttttttttttttttttttttttttttttttttgagacagagtcttgctctgtcgcccaggctagagtgcagtggtgtgatcttggctcactgcaacctccacctcctgggttcaaacgattctcctgcctcagcctcccgagtcgctgggattacaggcgcccaccactgcacccagctaatttttgtattttttagtagagatggggtttcaccatcttggccaggctggtctcgaactcctgacctcatgatccacccgcctcggcctcccaaagtgctgggattacaggcatgagccaccgcgcccggcctaatttttggatttttaatagagatggggtcctatgttgtactatgttgctcaggctcacctcaaactcctggactcaagcgatccacctcggccttccaaagtgctgggattacaggcccgcgccagggcacctagccggaactgggaactctctaaggagaaagtctgcaattctgggtggtgggaggctgctcttgggagcattcaaagactcaggcaaggaagggggtctgataccctctgggggcggcgataagtggggtgcaggagggggcagagccaggagcaccctgggagcagagtttgtggatcaggggcagagcctggctgggttcactgagggacagagcttcggggagcaagcttttgcagatggtgagcctggaatccctgaagcccagggtcttgagaagagatcaattctttgagaagatccaatgtgaacttgggaccctcagaggggcaggacctgggggctggtgcagggttggtgctccatttgcagaatcctcagtctctctcgtggaaaggggtacccgtggggggcttccagcttctacgccagcgagggagctaaattctgaccgaattctcccagaactgggagcagagagctgaggactgccagatggagtccagcttaggggaccctgcccccaaccccgctcccgtatccctcccatttttaagcacccctacgcctgggacctctgttccacgagaaggttcacggagccagtatccgagtcctaatttccccccaccgcgtggggaactcgaggtcccccgcgcccctagtccggcacctgtccctgctgcctcctgattggccgcgcggcgagcgctggcggcgccgggctgtgattggcgggaagttcgcagcccgtggctggactgtggagaaagtgagtcggcctcgggcgggggcgggggcgggggcaggggcggggccggggctagcctgacccgctggacagaccgcccgcccggagcgggactcggcgcccgacacgatgccgaggcctggcaccagcggccgccgccccctcctgctggtgctgttgctgccgctcttcgcagccgccacctccgccgccagccccagccccagccccagccaggtcgtcgaggtcccgggggtccccagccgcccggccaggtaagccccctgcttccttgtgccccttccacccaataagtctggtggtccaggaggaccacggctttcggattcaggggaaactcgaacccactgcttcgatgtggagatgcaaagagggcccttggatttattaggcgccctcaatttgtaggggttagattcggggagtactgagatttttaggggaaagagtcccctttattgtggtggagaaggctaagtctccagagaatcctggggttagttcggggaaaggtctctagtttattggggcagggggtggggggctgagctctcctagaatgatagagacgtgtggggtcttcgagctaggatggagcgccccaagtttcttgggcgcgtaaggaggaaaggtgttgggggattctggagggactttatgaggccgctgagttgtcctggttttctaggatttgggggctctgtgttcatgaaaagcgacctttgggtttttcgaattggtcaggaagacatagactcttgcgttgatggtggaggggcttgtggggagtggggtcgggtgggggagtcctcaggcttcagaacggttggggatgctcaagtttcctagaattagaggactctgggattgaatgaggctccagtgatttcaccgcgagagatccaggattccctatagatctgggggctataggcgcccttcctgtctgcgggtgacgggactgaaggaagccgtctgcccagcacccccacccaccctccccgcctggcggcccagcgctccgttacaaaggccccgggctcctctcccgcctgggtctctgcgaatgcgtttagtaacccgagccgcggcgggggcggggccgggaaggggttaacctggagaaaaggcgggagggatgacggcaagatcggggatccccgaggctccccaccagatggcctcatcctccactcggccccacccacctgagaggggcccacgcgctggacacccccctctctgcacccccccactgctctcctctcggggtctgggcgcgcgccctcgtctctagacccccttagcctggggataatggacttgtctggggggccccttcattgcgacgcacttgaaccggagctggaagctccgccactgagaccctctgggctgggagatgtctgcaagaacggcacctttctcctggtcaggcgggaaactgaggcccaaagaccaagaaacgctggcttctggacacacatcgtggaagggcaagaacgggctagaactcaggctctgggattctcagtcctggactgtgactcccgttatccccctccacctcagcaccctgctggacccacagtcagagggaagagccttccctccccagctgccgaggcctgtgaaaatggcgccacctgtcggccaggctcaggatggcgtctgagtcccggaccgggatgtgcgggagggcggggttctagattcccagacagtgcgggcttagaaatgctcttagaaatcgagtcttttgtttttgtttttgttttttaatcacttttaaaaggctttaaaataacgtattttttcaataaaatcgtacgccaaaatctcttcataagacaaaagtacggtttctgtgcccttcagcccgaagtctaagccaatttgcctcccattgtacagatggagaaactgaggcgtggggagaagaacctcgttagtcatatacctgtttcaagccccctcaggatgcgtcttggtttcccctccccgattgccctcctttgcagagttctggggtgctaggggcctgagtgacttccactccactatttatagcgttgctgtttgtcgctgctgcccgggccagacgtctaggaggagccgctgcatccgaggtgggttctggaagatggagtatgagtagggggcaaaagggaataggaggagaggggcagggagctccccatccctcccctcatcccagtgggagagctggatgcatttggtagagaagtacttggtcccctccttccccacttagtccctggctgtctccgaagccttctgcagggtccgaagctgccagcccaaaaagtgtgcaggcccccagcggtgcctgaacccagtgcctgcagtgcccagtcccagccccagcgtgaggaagagacaggtgtccctcaactggcagccactgacgtgagtgggcagtccctcccctaccaaatcctccctcaggaactcctagctttgcccccgtttccgctcctcctcccttcccctctccctctctctcccccctccctccccggctctttcttttgctatcagcctgtctgtccgtttctatttcatcccttgcctgcctatctcaggctcttcccatctctgcattatttctgtctctttctgtttctttctagttacctgtctcttttcctctctctctttctccctgtgtctcactgcctgcctctatgtctaagtctctctgccccttctctctttctctcccccaacccccatcatctctctttctctcagggtctttgtttctctcccactagaggcctggtccccataaataggtgttgtggggggagggttgggcagagccgctactgaaagacattttcctggcatggaggccctttggtggggaggtcagtttaacccggtgacagcagcttttccgtcctctcccacccaggctccaggaggccagagctctactgaagcggcggcggccccgggggccagggggccggggactactgagaaggaggcccccacagcgtgcccccgctggcaaggccccgggtaagcacatccgcctttcctccgcctggggcgaggggggttccgggccagataaagccgtctggttcccacggtccagccgccgcctacccgccccccgttgtagctcagcacccacccccaggacgaggccccctctagggaccccagcgtccggccgtgcgaggtgagcccgggacaggaccagacacaggccagaggcactgacccgcgggggtggggccgggaagccaggcgtccgggctccccgcggccgaagagggagggcgctggcccgttagaaagctccgccgaaccagcccagacaacaaaagcgattgtgcgggttggcgcctgcctgggcaccaaatgctcaagattgtggggcggctgggggccaaaggcctcctcctgtttcccgaatcttccccctgccctcctcccgctccagctcttgacccctagtctagaacacccctcatctcaaacaccctcaaaaccctcctcttgctgtagccttcagcccagatgtgacccctccccctaaagtcttccagatgtgagcctcgggccagatgttagtacccccgcccacagcctccctttatccattgtgacttctcccgccaggtgtggcgttctggccagatgtggctacatcttcacatgtatcccccccacctccagcctcctgcccaggatctagacgcccaattcctttatgtgcccaggtgtagcgacccttctcccatccctcagatgtcccacctggctgtccagatgtaccatgatagccccctatcaagatgaagcccctttctctgtgccccgggcagaagaggatcaactcttagctgtctccccaaatgtggcccccactactcttaatggatttcctctttatggattcagctctgtctggggggaaacccgcccgcccccacctgttcccttccccgccgctcccctacaggcccggtccacttgttggtgcgcggatggggacagagggggcgccccgctcacccctgcgagtctagcgcccagcctgcgagcctctggctaagcgcccagccccacgcgcccccgcgcggccgccggggagggagtggtgaggagggggggcctgagcgggggcgcgggcgacctcccccgcgggcgggcgggcgggtgcggccgggcccctcgggcgggctggggcggcggcgcggcggagcgcggcgctgcagccatggcgggcggcgtgcggctgctctgggtgtcgctattggtgctgctggcgcagctagggccgcagcctggactgggccggctcggagagcgtctccgcgtgcgcttcaccccggtcgtgtgcggcctgcgctgcgtccatgggccgaccggctcccgctgtaccccgacctgcgcgccccgcaacgccaccagcgtggacagcggcgctcccggcggggcggccccggggggacccggcttccgcgcctgtgagtgcggggtggtggtcccgagagagcggctccgggggggaggaggatccctggggatggaggagacagtcctccagggagagggagcccagattccatatgcaatagtgcaagggaatatcaggggctatttgaggaagggggccccaaattcctggcttttggggttgggtcctgagggttccgattttgcaagcaatgagggttcttagaggcctgtgatgtcccacgtgagggaattggcgccagctttcatgctttgcgtcaaaatggggatctcagaattgaggggcctgagaacttttgggaggggggctcgaattctgagacgctgagtaaggagtccccggggaccaagcaagagtctcaggaccgcatgggggacgtctcagtttctgtgtgtttgggtgggaaggttctgtatgggaatgcctgtgaggtggggtactagagagaagaaagttaatccgaagaactaagagggagaggggacagagacgggggttgtgtgtgtgtgtgtgtgtgtgtgtgtgtgtgtgtgtggcggcgggggtggggtgggggtgtctccgcaggacctgagttgcaggggtcccacgtgcgacagaaatccagataagagggcttacggaaggggcgccccctgggggcggaggggacaggaggtgtatgcaccaggcactcctagagatggggagccttgggggttcaggtgaggtgggggagggcgcaccacctgttgttccaggatgcaaaagtgggcagactctctgggatcgggccttcctgccccctaccccgcagaccctatggagtggggagtgggggcccctggagcggagaactcgcccagcctggcccccagccagcccagcccggccggcgtgagctcatctcccgcctgagcccccgcccgctgccactccctctctcctccccttcctccctctttctttcactctttcccggcccagccccaacgtgcctgtgccaggcgccatgcccaggcgggtgccaagcccttgggggtgcaaggagtggcatgtgaagtgggggctgacctcaaagggacccctatgtcctcaactccccgcttggccagggctgtggggcatgacgttggctgtggccatctagtggcccaccctgggtgtaggcacccccagggagctggcctgcgggcctgcattcaggccaagagaaggcagagaaatgcctctggagcctgggaaataccctcagacctggctggtttcccaccccctccatcagagacccttaccattctgcaattttgattcctagttaagcctctcctaggccccactactcaattaaaagcccccattagaccaccctggagtcatggccccacactcctacctaagggagctgagtttttgctccaggccctagacccgctctccaaccatggcaacagactttagagaccactcctccagtgaaattccctctcattcttccctcccacctcccaaactgtgcctttccccagataactctgtagtattgtccagaagtcctgttcttctagctcacccccttccccaggaacttctgatcccatttatcttcagagaaccccagggttggtcttgataagtgggttctcgcaagaggactccagacattgtgctccttacaggcagccattaataaaaagcctttggcacttaatccttagctgggaggggaggggattccacagagggactcggccaattgagcctcttaagtgctgatgacttccaggaattccacttcactatctaaaccctgttttcagcaccgtcaaactggttgtctcctaggcggcactagagtcctgttttctaggtaactgtccacaaaaggactcctgctgaaaggacgcctcagtttcctctgagctaggttcctccatcccagaaacctccagccgtctttgaactcgagaggactgccctttagtcgatctcctcccaggactccagtccctttatccttctaaacggaggtggctctctgcgtcctttcctctctacagttgtggctcagaatcccacacgcgcctcccccggccgcctgcctcctccctcccctccgcacagctgtctccagctgttctctgcagccccgggagagagagggagggggtgccctcgcaggacagcccggcctcctttggctcaaaggtcccggggctccccaagggtccggaatgtggagcctccgccctgcccccgccgcacctctctctttgtttaccccgccgcacagctggcagtgccccgcccagaggtggcctggggcccagcgagggcgcgcagaggggagtggaggcgcgttcccgctcgtggctccgccccggtgctactggaggctgtaaggccgagctagaactctaaagccccagccagaaagaagttgggcggagacacagcgcggtgggcggaactagggcacccggacagcctggaggtggggtgggaggggcgtgaacaagtgagccgggcgaatcagagtgcggaaaggaaggtgggaggggctagaggcagcaggttaagctcctggataggcggggtttagaatcccgcgggtagaaggtaatgtgagaggggctacaaagggggcacagccagggggcggaggtaggacttcgtggaccaagcagagggagtgtgggcgggcatagaatgcgaaggagacagagttgggcggggagttatgccagggagtggttaaaatgtggtttgagtcaatggaagggatcagcattgggtcggaggggctggaacagcaaagggttccgtcggactacggaatgggcggggtcagcgccgtctgggctggtctggaactccgtggactcagccagaaattgggatccgagaggttgacatgaaagtgaataaacagcctgagggctggctgggctcacgcctgtaatcccagcactttgggagactgaggcagaaggattgcctgagcccaggagttcaagaccagcctggccaacatagtgagaccccgcctctaccaaatttttaaaaaacgtagcccgatgtggtgcacgcctgtcgtctcagctacttaggaggctcagatgggaggatcacttcagcttaggaggtcgaggctgcagagccataatcacgctactgcattccagcctgggcaatagagcgagatcctgccgacttagtgggtgggaccgtacctctgatggctgaacaactggactgggccaatgctgatgccagaattggggcggggccacatgacagctaagggcggagcgacttagaaatgaatgataccttgagggagtagggaccccaggagaacctgccaggaatggtggcgcccctgagtgtcctcgttctcctcccagtcctgtgtcccttgatctgtcacaatggcggtgtgtgcgtgaagcctgaccgctgcctctgtcccccggacttcgctggcaagttctgccagttgcactcctcgggcgcccggcccccggccccggctgtaccaggcctcacccgctccgtgtacactatgccactggccaaccaccgcgacgacgagcacggtgaggaaagggtggccagagtcccctccgacccctgtcaagcatttcactttgcccctgaccctcatatttcccgccttcccgagcacctttgcccagctcgccctccccgccttgtctagccccaccccgtaagaacccgtgtagacatccgtttgcccggccgtgcctcccctaggcgtggcatctatggtgagcgtccacgtggagcacccgcaggaggcgtcggtggtggtgcaccaggtggagcgtgtgtctggcccttgggaggaggcggacgctgaggcggtggcgcgggcggaagcggcggcgcgggcggaggcggcagcgccctacacggtgttggcacagagcgcgccgcgggaggacggctactcagatgcctcgggcttcggttactgctttcgggagctgcgcggaggcgaagtgagaggaggcccgtggggaggggcccggagcttgcctccgcgcgggggcgcgctcacccaacacttccccgcagtgcgcgtccccgctgcccgggctccggacgcaggaggtctgctgccgaggggccggcttggcctggggcgttcacgactgtcagctgtgctccgagcgcctgggtaagccccaggacgtccccgaagtgctcggagctggggagtggtgacaacctcaccgttcctcctactctgccctagataaacccagttcacaaattgtagccacgcctaccccattgtggaggcgacttccagtcctgagcttttcataccgctctgggaccacccaccccattttctgactttggccactctgttctcaccctgcctttgtgccttggccccccaccatatactttgggagtctccaatgttgccatttcaactgccaacctaaggctgtccctgcacttaaactacagccaacatcttttagtccctcccaccccgtcttcgtctctgcccactccattctcgctctgcccacctgtccctggcccacccctctcctctcgccacagggaactccgaaagagtgagcgccccagatggaccttgtccaaccggctttgaaagagttaatgggtcctgcgaaggtgcaacggggcaggggtgggaggggcttggttctgggggcgggatttgcagggatcaagttcctgactccacggtgacctccccaaccctggcagatgtggatgagtgcgcgactggcgggcgctgccagcacggcgagtgtgcaaacacgcgcggcgggtacacgtgtgtgtgccccgacggctttctgctcgactcgtcccgcagcagctgcatctgtgagcaaccagcagggagctgaggctgggtcccgccctccctgccctcagaagtcccagagcatcctggggcctttaattccctcggacccccccagactcccgggttcctctgtcagccttagagccccctcagaacttctcagattcttatacagcttcagcatccctggaccacctttagacctttcaagccttttggatccagatccctccagactcccagacttttttttttggagatggagtctcgctctgtcgcccaggctggagtgcagtggcgcgatctcggctcactgcaatctctgcctcctggtttcaagtgattctcctgcctcggcctcccgagtagctagaactacaggcgggcaccaccatgcccggctaaatttttttgtatttttggtagagacagggtttcgccacgttggccaggctggcctcaaacccctggcttcaagtgatctgcccacctcagcctcccaaagtgctgggattacaggcgtaagccactgcgcccagctctcccagactttctggaatccttctcagacccccaaatcctctcgtccccctcaacgactcgactatcttcagatcttgagatccttctcagagtctctcattcaccactgacaccccattgaggctccaagcccttctcagacctccagagcccactgctctccttcagaccctctcagacctctcccaaatgcccctcgcacccaccaaccccccacccccaaccccagaaccattcccctctctcccaaatccctcagtgctacagcattcccagccccgccctgaaggatttcctccctgctcctcgcagcccaacacgtgatctcagaggccaaagggccctgcttccgcgtgctccgcgacggcggctgttcgctgcccattctgcggaacatcactaaacagatctgctgctgcagccgcgtaggcaaggcctggggccggggctgccagctctgcccacccttcggctcaggtgagcccctgcggcagtgcctagccctacgcgcaacacatgtggcgctcattctacgccccaccctccaaccctgagttcactgccccaacctgactggctgggctccagccttggccacgcagcagcctctgagacccgcaggcctcagactggacagcatccatggctccacctccatctgtagccacagccacccctccattcgtagccacagctaccccggagctcccaagttagtttttgtctcctgagcgtcaacgcccagtcccaccctgtccctgaactttgaccaagtccttggcttctgagacactgccttcagcttagccccaccccaggcatgcccctccctgagacacctccctggcattctatcttctgcttaaaactaaatctcacaagggagctatttcctagcctccaactctgtccctgtagacccaaccggaccctgccctcaaccctgttcctaccaccatcccaaatgtgggaaaacgctcttggccccacctgtagcctctaagacattctactctttggccaggacaccaccccatcccagcctccagctcaaacccctgacactctccagccaagccctgcccctagccaaggccagagtctgggctggccatcgttttcttcccgctctcttgtcctctctctgtctctcttacctattcccagagggtttccgggagatctgcccggctggtcctggttaccactactcggcctccgacctccgctacaacaccagacccctgggccaggagccaccccgagtgtcactcagccagcctcgtaccctgccagccacctctcggccatctgcaggtgagctggctctggcagaagtgggtgccatcttcaaggggctgccccagccccatagtgaaaggaggcaagagaggatttgggctccactcgttgataccccttctttatcaggctttctgcccacccatcgcctggagccccggcctgaaccccggcccgatccccggcccggccctgagcttcccttgcccagcatccctgcctggactggtcctgagattcctgaatcaggtttgctagaaagaactgagggcattgggcctgcagcagtggctcacgcctgtaatcccagcattttgggaggctgaggagggtggatcaccaggtcaggagttcgagaccagcctggccaacatggcgaaaccctgtctctactaaaactacaaaaattaactgggcgtggtggcagatgcctgtaatcccagctacttgggaggctgaggcaggagaatcacttgaacccaggaggcagaggttgcagtgagctgagatcgtgccattgcactccagcttgagcgacactccatctcaaaaaaaaaaaaaaaaaaagaattcagggcattgatgggggtattacaggtgggattctggggtaaaagactccaaggtgaagattccaggttacagcaaataggaatggtatgggcagagataagcgtttgaagggttgggtggtagttagatcaggagctggagtcacagttgggctcttctgtgtcaatcgagcaagccatttaacctctgagactcagttttctcattggtaaaatggggatggttgttgagatgcctctgaagtgtctgacacctagtaagtgctcagataaatacttatggtagataattatttttcattatctaatattagataattatttctcaggtagggcactaagaatgtatctcaggcggagggttggagagcaaactattcaaagccagagaccttggggtggcatgatgaggggattcggccaaggatctgatgagaacgttccaggataaaaaagatggagatcagaagaagactgggcttgcttggggaggagacatccatgaaggtgttttatggatgtctccgggggtgggggttttactgggatgaaaggaacggaggattcagagatgggggaaccctggctgactggaccccccaggtccctcctccggcatgtgtcagcgcaacccccaggtctgcggcccaggacgctgcatttcccggcccagcggctacacctgcgcttgcgactctggcttccggctcagcccccagggcacccgatgcattggtgagcaagacggagggcgcggaaggaggcggggcggggggctttgcctggtcaccttgtcaccagccccctccgtgtcctcagatgtggacgaatgtcgccgcgtgcccccgccctgtgctcccgggcgctgcgagaactcaccaggcagcttccgctgcgtgtgcggcccgggcttccgagccggcccacgggctgcggaatgcctgggtgagaaatttgccccacccggctccaggcccaccccagggtctcgctcctgctctcactccagagcctctccagccctcccacgcttcccctctcgggtcccgccccaggactgctctgccctggcccttggccctgcccttccctgacccgcctccacccagctccagcctccctttgaccccacccctacccagctcccaaactgccagtttctatcggggcctggtcgcaactcgtattgctccgcccccacgcccaggccccgcccttattggccacgcccctccctgactaactccctcccccaggccccgccactgtcctgcaactgcggcaaccaatctcctgaccgcgaccccgattccaaccctgccacaccagagccctatccccaaactgctcctttcttctctagcccctaccccaccttcccttagcttggtccccaaagctctcctttctgcccttgcgctaccaaaccctgccctccacaattgcctctctcactgtgcccctctccggctgtcctggccgggtccccatcctggctctggcccaagcttggtcccgctcccgcttccctctacccctgcctccttgcgtcgcttctcccggggctgtctgccccagtcccagccgcctggtctgtgcctacagatgtggacgagtgccaccgcgtgccgccgccgtgtgacctcgggcgctgcgagaacacgccaggcagcttcctgtgcgtgtgccccgccgggtaccaggctgcaccgcacggagccagctgccagggtgagggcctgggaggggcagctgggaaggggtgtgagcggttgggtagagcgcagtgatgagggccagagagactgaacaatagggcaaagcgagttgatttggagacagaggccaggctctcgagcagacgtgtggcctgatggcagtagagagagacctgggatgcagaggccaagtgatgggaaacagaaaggctgagtcatgaaagatggagaagcagaatgaggagggatggagatgtcagtaatcgggtaaggggagcagagttatggaggaaaggggagaaggaggccttctcatggggactacagagacagaaccagccaggcagcttagtagggattggtggaggatgcagagtcagatgatggtgacaaggaggaatagagatggggtcacggggacagaatgttggagggtggaaagccaaagtgacagaggtcagggaggcagaggggaacaagtgaccccgggccccctgccctgtgcagatgtggatgaatgcacccagagcccaggcctgtgtggccgaggggcctgcaagaacctgcctggctctttccgctgtgtttgcccggctggcttccggggctcggcgtgtgaagaggatgtggatgagtgtgcccaggagccgccgccctgtgggcccggccgctgtgacaacacggcaggctcctttcactgtgcctgccctgctggcttccgctcccgagggcccggggccccctgccaaggtgagggtgctgagcccagccctactccatcactgtttgctgtggagactggagagagattattgaggggcagagaggcagagtgatggggctcagggatggagaacaggggctgagggatggggacctcactccagagtcttctctcctttcaacaaaataaggcagtcctccccacccctcctccctttttgaaagatactcttgtgcttatgggaaccctgaggagggggtcacctgaggcagggcaggcaacatggagttggtgccttagcccccaccttagtagctggagagaccattgaatggggacacgaggaaggtgtctgtcttcctgggaagagggagcagcctgaggcaagtccagaaggcaggctcaagactggaatgctggggtgggtggtgatggccatgggaatggattcaggccccttcctcagcctcattggtcccctctgccccagatgtggatgagtgtgcccgaagccccccaccctgcacctacggccggtgtgagaacacagaaggcagcttccagtgtgtctgccccatgggcttccaacccaacactgctggctccgagtgcgagggtgaggccggggagggagggaggagtgtggatgggtgaggggggagttggaccacttcttcaaggccaccctctcccctgccccccagatgtggatgagtgtgagaaccacctcgcatgccctgggcaggagtgtgtgaactcgcccggctccttccagtgcaggacctgtccttctggccaccacctgcaccgtggcagatgcactggtgagaccaggccctggctgtgaccttgggcctgcatcatgacccccgacccttgacccagatcacaactatgacctggccgtaacctcctgacctggacctcagtccctcagtccccagagcctgtgactcctgaccctgacctggaccacaactcttgaccctgaatgtgactcctgagacccaacttgacagtaacatttgaccctaaccatcacccttgatgatagtccctgcccataccctgatagcaattgtgaccctcatgactctggccctgaatgtgacctataactcctgaatttgactgtgacatttgaccctaatcataaccactaaccatagcactgaccataaccttgactgtgtgactcttggtcctatctctttcacagcccctgcctcttctcagaatcccttctctggaacctggttgggttcataatccctgaccctggcccctgacttgaggcagaattctggaccctgactataacttctgatcctaactggattcagattccagtcactaactctgacccatggctcagccgaatcccatccaatgatcctagtttataatacttgactggtcccttgccctagttgatttctgatccctgtctgatccctctcctgactccaaaatcctggcacaggtagttcctagaaacctagacccacaggacttgcaaccatggtccccggaacccgagaaccttggtcagccctacccacctctgccatagagccctcccccagcctccaactcatgagacttcccaccacctcccccagacaccctactccaaggggattggtcgggtgtgtcccgagactggaccctttctgaacacccccaccccccacagatgtggacgaatgcagttcgggtgcccctccctgtggtccccacggccactgcactaacaccgaaggctccttccgctgcagctgcgcgccaggctaccgggcgccgtcgggtcggcccgggccctgcgcaggtgagcagcatagggacccgccagagagtctgggagtagggcctgggttccagggcaaagccggctggaaaggtggaggcgggaccaaggcgctgtgggaggagcttagaaacctggcattggtgggggcggggttactgcgatgtgggcggagcttgtctgggaggccgggtcccgtgactccgcccaatctcccgcgtaccctagacgtgaacgagtgcctggagggcgatttctgcttccctcacggcgagtgcctcaacactgacggctcctttgcctgtacttgtgcccctggctaccgacccggaccccgcggagcctcttgcctcggttcgtacccgggctgatcctggccccggaaagggtgggcttagggcaggaaaaggcgggacggggagaagagggcgaaaaggggaaaacgagtttttagccggggtattccagcaggatcagggggcagctggtgggagtctcgaggcagtgagggggggcggggcgtggagatgaaagggccgagtctgggtatttggaccgtgattgtaaagaagctgttctaaacccgtcggggggcggtgtttgcagggagggaagtagcgtgaggcaggttggggaaggcgtgagaggcctaggagagccgaggggcggtggaggggtgtggcctagaatgttaggcggagcgggaggtgggccgggccttcggacgccctgtcccgcagacgttgacgagtgcagcgaggaggacctttgccagagcggcatctgtaccaacaccgacggctccttcgagtgcatctgtcctccgggacaccgcgctggcccggacctcgcctcctgcctcggtgagaggccccgccccggcctgatccctcctcccttcgactccccgactcgccgattggcctcccacctctgtctttcctcctccgcttctcccctccccttacctctttcccccgcctcctctcctagcctccccaactctcctctaccccaatcttctcctgccctctcctctgcttccccggcctcccccttctgactctcctctcccctctttgtatcccccatcttgcctccctgcttcccacatccgaccacccgacctctctcctcagacgtggacgaatgtcgcgagcgaggcccagccctgtgcgggtcgcagcgctgtgagaactctcccggctcctaccgctgtgtccgggactgcgatcctgggtaccacgcgggccccgagggcacctgtgacggtgagcctgcccccacccgccttcgctagcgcttgcaacgcggtgctggaggctgctcccttggggactgaggaggggcgccctgcttcccagacttaggcggagggaaagaacaccctctcaccgtatctctgtagtggaaataagccgccaccgtgtccatgtattttcttgtgtcaggatcacggccaagcctcccttccagccgcagtccattccccctctgcagctgaagcccggtccacattttaggctatgcccccagtaagacaccgccccaaaactgttaggccccgccccttccaatcggcctctggattaaaaccccctcttcaggccccttctcttcctaacagaagtttggacgtgccctttccgcgccctccaccagtcctacttccagccttccctccaaagaggcccaatcccggtggccctaggccccattctttcccaatgagaaattcccaaggtgaaattctcctagcattggcccccgcccgtttaagctctgcccttccttggtctctctagacagggctttccattcgctcggatggctccagtctctcgaacacttaggccctcccttcctatctttgctccgcccacagacccgccccttgccttttcttactttccaggccttccctcccgccccgctctttcacccctcccgggtcaggctccagcgaggcaggagggtggggctaatcttccatacagtatatatttttttgtgtcggcgggggggggggggcggtgatggtgtgtgagtccgcatcttgtggaacacatgaaacaaaacatctgtgggctgccgttgactctgctagacctctgactcatggaaatctagcttcataagatctcattcattaattccacaagaattcactaagcacctactctatgccagcgtctggaaaaggtaataagagcaacaggaaataagtcatataaaaacccctgccttcctggagttattgtggggtaataaatatgtaaataaattcaagatttatacagcaggccaggagctgtggctcatgcctgtaatcccagcactttgggaggccaaggcggatggatcacgaggtcaggagatcgagactagcctggccaacatggtgaaaccccgtctctactaaaaatacaaaaattagctgggcatggtggcatgcgcctgtagtcccagctactcaggagactgaggcaggatactcgcttgaacccgggaggcggaggtggcagttgagccgagatcgcgccactgcactgcagcctcggcgacagagtgagattgtctcaaaaaaaaaatttatacaacaaaaaactggggggcaccttactatatgttgggcactggagatgtagcaaggaacaaaatagacacaaatccctgctattgtagagtttgtattctagagaggcgacagttggcataccaataaatacatacgtataacatcaggtttaggaaggaaaacaaagcaagacaaatgggacagagatgacagagcagtggatggaggagtgctaggagggcttgacctagacaccagacagaagcgagggaggcagccatgcagagagctgaggggagactgttcctggcagagggaagagccagtgcaaaggctctgaggcaggaccatgcttttgagaaatggcagtgaggacttgagagttatcaactatgctaggtgtggtggcacaagcttgtaatcccagctactcaggaggctaaggtgggagaactgcctgaacccgggaggttgaagctccagtgagccatgatcctgtcactacactccagcctgagcaacagagcaagaccccatttaaaaaaaagaaaaaaaagctggatggggtggctcatgcctataatcccagcactttggaaggctgaggcagctagattgcctgaggtcagaagttcatcaccagcctggccaatatgatgaaaccccatctctactaaagaaaaaaaaaaaagatagtggctgggcgtggtggctcacacctgtaatcctaggacttgaggaggccgaggtggacagatcgcttgaggtcaggagttcgagaccattctggtcaacatggtgaaatctcatctctactaaaaatacaaaaattagctaggcatgatggtgcatgcctgtagtcccagctgctctagaagctgaggtagaattgcttgaacctaggaggcaaaagttgcagtgagctgagattgagccactgcactccagcctgagtgaaagagcgagactccgtctcaaagaaaaaacaaagttttcaacattgttgatcttcagaagctcaggctcctagaataccagattgctaaagacttcttagtcttgggcaccggaagtggtgttagaacttctgaattcaggcctttgactcccctttcatctcctccacactctgcagatgtggatgagtgccaagaatatggtcccgagatttgtggagcccagcgttgtgagaacacccctggctcctaccgctgcacaccagcctgtgaccctggctatcagcccacgccagggggcggatgccagggtgggtgtccatcaggcatcgggtgagatgtggagatggtagaaggtccagaaatggcctgactgtctggtggttgcagatgtggacgaatgccggaaccggtccttctgcggtgcccacgccgtgtgccagaacctgcccggctccttccagtgcctctgtgaccaggttacgagggggcacgggatgggcgtcactgcgtgggtacgggacttcaggaggtggatgggaccaaagggggtgggggaggttggtcaggccctgtccctccccatatatctgaacaaatgggaattttcgggttgtggaatttagactttggaatataagatcatcttcatgccaggcacggtggctcacgcctgtaatcccagtactttgggaggccgaggcgggcagatcacttgaagtcaggagtttgaaaccagcctggtcaacatggtgaaaccccgtctctactaaaaatacaaaaattagccggatctggtggcaaatgcctgtaatcccagctactcaggaagctgaggcacaagaattgcctgaacccaagaggtggaggttgcagtgagccaagattgtgcaattgcactccagcctgggtgacagagtgagaccctgtctcaaaaaaaaaaaaaaaaaaaaaaaaatcagaactgttgtagtggctggtgacagaaacctgacttaatcaggttttatttttgtgtgtgttcttttaaaaatgtataaagtataaatgtataaagtactaatcttaagtgttcataaacattaatctttcctaacattttatgaggaaaatttctaaacacaaagcaaattgagagaatcatagaatgaacacctacctactcatgatctagattatattatcattttattacacttgcttcctcacatatctatccattaatccatctaattttttggacagagttaaaagtaaattgcaggcaccagtctgcttccccataaattcttcaatatgcatatcactaaccagaattcaatatgtgtttaccaatgtattcttctcttctctcttttttttttttactttgaggtggggtcttgctctgttgcccaggctggagtgtggttgtttgatcatagcttactgcagcctctaactcctgggctcaagccatcctccctccagaactgagcttccgagtagctgctaccacaggcacacgcaaccacgcccagctaatgtttttaatttttgtagagatgagttttttttttttttttggagacagagttttgctctagttgtccaggctggagtgcaatggcatgatcttggctcactgcaacctccacctcccgggttcaagcaattctcctgcctcagcctcccaagtagctgagattacaggtgcccaccactatgcccagctaattttttgtactttgagtagagatggagttttgccatgttggccaggctggtcttgaactcctgaccttaggtgatccgcccaccgtggcctcctaaagtgctgggattataagcatgagccaccacgcctggcctgtagagatgagttattgctctgttgcccagactggtctcaaactcctggctttaagcaaccctccctccttggcctcccaaagcactgggattacaggcatgagccattgtaccctacagatattttcattcaacgttcaatttatatacagtgaaatgcagcaatcttaattatacattctgtaaattttcacaaatgcaaacacaacaggttttatttctttaaagggaattaaaactataaagtcttgggatatatttgaactccaggcataactggatccaggaattttaacaaggctatttctatcttctctgagttctgctttcttctattgcatgattttcaggcagattatttttcacaatgatgaaggtggccctagaacctctgggctaacatctccagtgggccacccgagagctaaaaagggaggtttttttttcaatatttctagcaaaagcgccaggcctggctttgattgacccagcatgatcactgcctatgtctgaaccagagaaatgccgtcatctgtttggtcattcctggaacttgtgcccacctctcagagtagatatagccctactcaaagaacaggattgaaaatagaggagcacagggttcccaagggaaattcaaggtttctcactagaagaaaaacagatgatgggatctgggccattaaatatacacattatatttgaaagctgagactttcggacctttggaatcatagaagcttataaccactgagtccctctcccctgttgtctcctgcttacagatgtgaacgagtgtgaaacactacagggtgtatgtggagctgccctgtgtgaaaatgtcgaaggctccttcctctgtgtctgccccaacagcccggaagagtttgaccccatgactggacgctgtgttcccccacgaacttctgctggtgagactgatgtgtctatttaactgatggcggctggccccatgggaaaatcacgtggtctaatcattcctgatgtggacagctaccatcagctaaatactgttgttttaaacatcaacaaaagacacataagttaacatgggtagtgagactgtgtcaggagaattagaccctggtcctgactctaccagattctttcattcaacaaatgttcacagggtgtgcactgtgttcaggccatcttctgggcactgagaacatagtagtgaccagaagggatcactgtctgtcctcaaggggctcacaagccaatggggcagacagagatatcaccagatagtgacaacccagagaaatcaacaagactgtgacggggaaagcccaggggggttttggaggaggcgcctggcccagcatgagaagaggattagggagttcttcctgtaggagacgacatctgaactgagagctgtgggatgaatagaaatgagccaggcccgatgagtgaggagggcattctgggcagaggacacagcaagggcaaaggcctggcaaagccagagagcatctggcatgtgagaagaactgaaacaggttcaacatggcatgatttagagagcaaaggaaggggtagggagagatggggccagggaaagagtcaggtgcccgatcacactgacttatcacagtaagagagcactgcggtaccgtggaaggggtttcggcgttttttttttgaaaattttttttaaatgttttttttttaagacagggtcgtactttcacccaggccggagtgcagtggcgtgatctcagctcactgcaacctccacctcctgtgctcaaggaatcctccaacctcagcctgctgagtaactgggactacaggcacatatcaccacaacagctaatttttgtattttttgtagagatgtggttttgtcatgttgcccaggctgcagtatttttttttttttaatttttaaatgttacatatttaggctaggattggtggctgaaggccataatcccagctctctgggaggccaaggcgggaggatcacctgaggtcaggagttcgagaccagcatggccaacatggcaaaaccctgtctctactaaaaatacaaaaattagctgggtgtagtggtgcacgcctgtaatcccagctattcgaaaggctgaggcaggaaaatcgcttgaatccaggaggcggaggttgtgggattgcaccactgcactccagcctgggtgagagaggaagactccgtcccaaaaaaaaaaaaaaaaaaaaagctatgtatttatttatttttaataatttccatctttactttagattcaggggatacatgtgcaggctttttacctgggtatatttcgtgatgctgagctttgggatacaaatgatcccgtcacccagatagtaagcacagtacccaacagccagtttttttttttctttgagacggagttttgctcttgttgcccaggctagagtgcagtggcgtgatctcagctcactgtaacctccacctccctggttcaagtgattctcctgcctcagcctcctgagtagctgggattacaggtgtccgccaccacgcccagctaattttttgtatttttagtacagacggggtttcatcatattggtcaggctggtctcgaactcctgacctcaggtcatccacctgcctcggcttcccaaagtgcagggattacaggcgtgagccaccatgctcggcccaacagccagtttttcaacccttgtacctctgtccctcccccatctagtggtccccagcaactattgtgggcatctttacatccatgagtacccactgtttagctctcacttgtaagtgagaacatgtggtatttggtcttctgtttctgcattaatttgcttaggataatggcctccagctgcatccatgttgctgctaaggacatgatttcattctttttcatggctgtgtagtattcatggaagggttctaagcaggaaagatagaatcagattttgaaacctccctctggccgccatgtgaaggtgattgaagcgggtgatatggaggctgggagctcagggaacaggctggggcaggggcctggacaggagagaacagggctggaccaaggcaggggctgtggaaggggaggagaaggtggtgggagaaaaacccaagaggccatgtggacaagctgtggatgtctgggtggggaagctgtgtccaagacaaggcataggttttttgtttgtttgttttgtgacagagtctcgctctgtcgcccaggctagaatgcagtggtgtgatctcggctcactgcaacttccgctcccgggttcaagcgattctcctgcctcagcctcccaagtagctgggattacaggcatgcgccaccacacccggctaattttttctatttttagtagagaccgggtttcaccatgttggtcaggctggtctcgaactcctgacctcaagtaatccaaccgcgtcggcctcctgaagtgctgggaggacaggcaggagccactgcacctggcgacaaattgtaggttttgagatgaagactcagccagtttgccacacactggataagagacccagagaggcatccaggaagccagggaagttccctcaccacccacccaagctgttagctgcagtgacgggaaagtgtgaggtggggaggcaagagatgcagaaatgacaggaggtgacagtgggagaaagagaaacagtgacagaggagcgtgagaggtgtggagtctggttctgccactgatggctgccaccctctgtttccctatctatgccagcctcagtttccccatctatgatagtggcggggctggggattcagcccacactgggctaaagctccttgtctccccaggcacgttcccaggctcgcagccccaggcacctgctagccccgttctgcccgccaggccacctccgccacccctgccccgccgacccagcacacctaggcagggccctgtggggagtgggcgccgggagtgctactttgacacagcggccccggatgcatgtgacaacatcctggctcggaatgtgacatggcaggagtgctgctgtactgtgggtgagggctggggcagcggctgccgcatccagcagtgcccgggcaccgagacaggtgggcatgggctgatggggacacagggctgagggcttgggtggaaatactgggtggggtgtgggcctgggacaggggacacttttggacagggccttgaggtactagtactgtcagggcaagggcgagctgccaggcaggtgggcatgggcagacataaggctgagaggtgggcactaacaggcacagggccagagggacttttgtgacaagtgggcacgagcaggtcagggctggggctggggctctggtgtcctggctcaggcttgtctctgtgtgtagctgagtaccagtcattgtgccctcacggccggggctacctggcgcccagtggagacctgagcctccggagaggtgaggccagcctttgaccctccaccccactcagctctgaggcccagcttcgtctcttcctgttttctttgcctctgtctctcaccctttctgtttctctgtatctgtctccccgaccccacccatactctgtctctttctttcttttctttcttttttttttttttcttaagatagagttttgttcttgtcgcccaggctggagagcaatggcgagatcttggctcactgcaacctttgtctcctgggttcaagcgattctcttgcctcagcctctggcgtagctggctacagacactagccactacgcctggctaatttttttgtatttttagtagagacagggtttcaccatgttggccagattggtctcgaactcctgacctcaagtgatccgcccaccttagcctcctgaagtgctgggatttcaggcatgagccaccgctcctggcctctccatctttctttccctgtctctacttcttggtctatcaccagctctgtctctgtcttcccacgtcatgccctcacacactccacccatccagcccgcccccatctctctctctgcttttcgcacagacgtggacgaatgtcagctcttccgagaccaggtgtgcaagagtggcgtgtgtgtgaacacggccccgggctactcatgctattgcagcaacggctactactaccacacacagcggctggagtgcatcggtacaagccccacctcccccaacccccggcaactctctccaacccctagccttgccagctcccctctggaatgtggccaccaccagcgggaagtctttcctggagtctagactccatccatcacactgccaatgtgctgggaagagaaatgggaaagggtggggagagttgaaggggatgcctcttaatcatcctctccctagacaatgacgagtgcgccgatgaggaaccggcctgtgagggcggccgctgtgtcaacactgtgggctcttatcactgtacctgcgagcccccactggtgctggatggctcgcagcgccgctgcgtctccaacgagagccagagcctcggtaaccccgcccacgccatccaggccctccttcccttggctcggcctcacacccgcacccgggccacacctttgcgacggccacgccctccgaaggccacgccccatgctcctggctcgaccacgccccactgagccctcactcagtctctgtcccactgtctgtctctctgaggcgagctggctaggtggttaaaggcaaaagttttagggcaacctttgcatgttgcctcttggactccaggtttctttctgcacactgggtgaatagcccctaccttatagggtggctgtgaggaattttatttaattttatttatttattttttgagacggagtttcgctcttgttgcccaggctagagcgcagtggcgccatctcagctcactgcaacctccacctccggggttcaaacgattctcctgcctcaggctcccgagtagctgggattacaggcatgtgctaccacgcccagctaattttgtatttttttctttagtagagacagggtttctccatgttggtcaggctggtctcgaactcccgacctcaggtgatccgcctgccttggcctcccaaagtgctaggattacaggtgtgagccaccacacctggctgatgaattttattttattttattttatttttaatttttaatttttagttttattatttattttttactaagtaccacatgagtgctgcctgttattatttatctgcatctctaggtctctgtctctttccagctgtttgtggatttctgtctttggggttttctctgaatttctgacaccctctggatctttgttttcaggtccctttctcctgcctctgtatctttgttttcctgttttgagtctttgactctttggatgtgtttctctctctctctttgggtcttttttctcccttttcgtttctgactattttcctatctctaggcccctaacaacttctgctgaagctctgtctcttgaacactctacttgtcgttgtttgttttcatttttgagacaagatctcgctctgtcatccaagctgaagtacagtggcacaatcacagctcactgcagcttccacctctcatgcccaaatgatcctcccacctcagacttgcagtagctgggagtccaggagcccgccaccaagcctggctaatttttgtatttatatatatatatatatatatatatatatatatatatatatatatatatatatatatatatatatttttttttttaaagatgggtttttgccatgttgcccaggctggtcttgaactcatgggctcaagcaacccccccacctcagcctcccaaagtgctgggattacaggctccaacacactctctctgtgcttcttgccacctctctttttgcccactgtcccaaccactcttctctcatttcctgtgccttcagcacttacccccatacagtgagatgtcagacaatgctcagagaagcaaagcaactgccccgaggccacacagccctccagaggccagacttgggtagacccctctcaggccctacctcccagtcattggacaccttcttctgccctctcctcctatatgacagtctccttgttcctcaatccagaaccctggagtgacctcagagaacttccagagttagatcacagctgatgagaaggatttgctgataggcagagggtgcctgggctgctcagcaggggaagggtccagcccctgggaggacctgagtgccaggcccactctgacacatgctgtctccacctacagatgacaatctgggagtgtgctggcaggaagtgggggctgacctcgtgtgcagccaccctcggctggaccgtcaggccacctacacagagtgctgctgcctgtatggagaggcctggggcatggactgcgccctctgccctgcgcaggactcaggtgctggcactggcctaggctgaactcagaggccttgccccatgggctccaaatctaggccctcagatccccagtcgcagaacccccagactctatccaaactctgtcccctagaccaacccctatgtcgcagcccatcccaaaatcttggtccccgattcacactccaaagacttccaagtctcagccacagacatcccaaggcctgacccagcagatcccatagtaccagacccacaggcccctgaggtctggtctctcatatgctcagctcctggtctctagaaccaccagacacagcctatgagatgtcctcccctaaatcctgggcccttagacctgaaatgccagttgctcagacctcaccatcctggccccagaccccctggtcacagccccacagacctccaagtcccattgccttagacaccctccaagtcccattgccttacacaccacatccgggtgcctaagaccccaacacacagccccagagattcccaagtcttggtttctacaacctctgagtccctcagtcctcagcccttaggaacccagttccaaagccccagtcctgggtcctcagacctccaggtcccagtgcctcagactgtctcccatgcatcctgccccctcaggtccccagcagcaatccctgggattccccagtcctggtccacagaacacccccatctaatttcttcaggtccctagtcctagctcccatgggtcgctccaattccagcctctcagaccctgattcttagcaggcttcattacccttgatctcagcacgtccgaatcccagtctcagccttcagattctcagcgctggctccagaaaccccggggccacccaggaccctccccatccagtcctctgcctcctctcccaaggggggtatgtgagtggtgggtgtgggggccagcaggggctgattgtttgccttggctcctgttcccagatgacttcgaggccctgtgcaatgtgctacgcccccccgcatatagccccccgcgaccaggtggctttggactcccctacgagtacggcccagacttaggtccaccttaccagggcctcccatatgggcctgagttgtacccaccacctgcgctaccctacgacccctacccaccgccacctgggcccttcgcccgccgggaggctccttatggggcaccccgcttcgacatgccagactttgaggacgatggtggcccctatggcgaatctgaggctcctgcgccacctggcccgggcacccgctggccctatcggtcccgggacacccgccgctccttcccagagcccgaggagcctcctgaaggtggaagctatgctggtgagcactgccagcgcatgatgagactgagatgaggggtgaggtgtgcacggagagaggagggagggaaacagaaggcgggaggagagacggaacacaggtgcaactggagagagccacagaaagggacagagaagtgtctatagcccggcaaagaaagagaaggtggcagagggaaagctggcgagagaatgaggtaagcttactggccccgcagcacccgccacagccctggagcgggatggacagtttacagcgagaaagatggagccaaggacgcgcacccaccgttgtgggtaaggggtgaaggcagggacctcaagtcatagggtccccgcatttcccacaggttccctggctgagccctacgaggagctggaggcggaggagtgcgggatcctggacggctgcaccaacggccgctgcgtgcgcgtccccgaaggcttcacctgccgttgcttcgacggctaccgcctggacatgacccgcatggcctgcgttggtgagggcgggcccggggccagcatgcgcagggagaggcgaggcttgtccagggagggtggaagccctgactagggggtgctggtcagggacgggaaaggacctcactacaggggacgggccagcgcaaaagggaggagtaattcttccacctgggtggggcttgactgaagaaggcggagtcagggtgccagcagggcagggcttaaccacggggctggagccgggccttgaagcaggatagaggaatagaatagtgctggtgtgacttgcagtgctaccttgggcagtctgcaggacctctttggagagcctcagtcttcccacctgtaaaatgggaatattaatcaagtctgcctaatttggatggcagtaaagccaagtgattaaaatcaagaacatagccgggcgcagtggctcacgcctgtaatcccagcactttgggaggccgaggcgggcggatcattaggtcaggagtttgagaccagcctggccaatatggtgaaaccccgtctctaaaaatacaaaattagccgggtgtggtggtgcatgcgtgtaatcccagctactcgggaggaacccaggaggcagaggttgtggtgagccaagatcgcgccattgcactccagcctgggcaataagagcaaaactccgtctcaaaaaacaaacaaaactcgaggaggtcacatagacctcagactcagtccagcaacttgctgtgtgacgctggacaggtcactgtcccttacctaatttttctgatatgaaaaatggctacagtcaaagatcccatttcatagaattgcgaatattattaacactgatttacaataacattgagagtcatgtgcaaatggaggcacatgcgtaaaacgaattacagtacctacctaataggggtattagaaggacaaagttaatacttgtaatgtgcttaaaacaatgcatgaacatttattgttgttgacaccatcatcagtatttttttcttcttttttttttcttttcttggcgacagagactcactctgtcgcccaggctggagtgcagtggcctgatctcggctcacagcaacctcctcctcccaggttcaagcgattctcctgcctcagcctctcgagtagctgggattacaggcgcccgccaccatgcctggctaatttttgtattcttagtagagacggggtctcaccatgttggccaggttcgtctcgaactccggcctcaagtgatccacccgcctcagcctcccaaagtgctgagattacaggcatgagccaccgcgcccggccattattattttcttaacaaaatcctagtgcggtatgggccaccatatccatcttacagaacacgaaactgaagcacagtgaggttaagccacctggccgggctcacacagttagcagatggcagaggccagattggactccaaactgctcagcatctgtgctcctctgttccaagaacttaaggggccaaggaggcgagcttctggggccccagccttcagcagcgatcgttgtctcccctccgcagacatcaacgagtgtgatgaggccgaggctgcctccccgctgtgcgtcaacgcgcgttgcctcaacacggatggctccttccgctgcatctgccgcccgggattcgcacccacgcaccagccgcaccactgtgcgcccgcacggccccgggcctgagccctggcacccgctggccgcccacccgcgcccgccactcggggcccctgccgcgcatcctgcagcccgcttatgcgtatgtgcacggggccgcccgcctggacctggagaagggacctacggacgcctggaagctgcgacgccctgcactgctcccgcctccaccagcgcctcccactgatgtcgtggtcccgggcctggcccaggggcccctttacatgccctctcccttttataaaattttccattaaaaaccacctattttct

SEQ ID NO: 36609 - DNA, 11121 bp, Homo sapiens
cgcaggaaggccgcctcattggtccgcgctgtcgggcttcggcggcttttctctttagcgctcagggcgctgacccactgctcttcctcttaagaaagtgctccattccttccggcgcccggagctgctggcccaaagggatccggagcgagctagggcaggtaactgcattggggtccaccgggaagcggcagcagctgcggactacgggagggagtggggttggcgagcttgggtaaaactgccccttcttcgctctgtctcgacccccaagttctccgcgtcttcctcgtcccctttcctcctctggccccacctcccccgggcccttccagccttcccccaaaagctccacacacccctctgcttcccgtccgggggccccgcctcctctgctcgcgtctccagggggcccgccctcgtctcctccccgcagcggtccctcctttaggagcgcaactccttccctcccctccgccgctgctgtgtcccccgcttggcccattcctgggccttaagtttggttttgttccttcttggcacctccacctgtctctccatgatccctgtctcctttgcatctgactgctggagtcctccgattctcccgttgacccaggctgcgagtttagcaaattgtgcagcggcattgtgctgggctttggggatagaggtagtgactagaggtccctacgttcaagaactccttgcccggtgggagagagtcactttgtaaatggagtatgataggcccggtgataagtctttaaggcagccgcattcctgctgaattctcaagcaggcctctgggggctaagctgcatcttttcatcagaatgcccttggctacttctgatgcagaagcctggtcctttatatttttagtttttatttttttttgaaacagagtctcgctctgtctcccaggctggagtgcagtggcgtgatcttggctcactgcaacctccgcctcccggattcaagagattctcgtgcctcagcctcctgagtagctgggaaaacagacacccgccaccacacctggctaatttttgtttgtttgtttgtttgcttttactagtagagacaagagtttcgccatgttagccaggctggtctcgaatacctggtctcaagtgatcctccctcctcggcctccctaagtgctgggattacctgcgcgagcccggccatcatagtcctttaaacccttgggagttattaaaatctttgtatgggcccttcttttaaactgtcagaataggtagcgtttcagagaccatccatccaagccctcagggtgttgtctgggaagttgaaggctggtgacagagagtgattgcctagacaaatagtgactcagcattgtactcttgatgcctctttttggggtttttcctgaggatacttaaacaatttttcaattaggcagcagtcttagctggtgggaaaactaaaagcacagataaaaccactagtcagtagattcctccaagccagtgcaggtggcttgtacacttaactcagactagagtaatttatacctcaggctcttggagtcaggaatccctggggtctggtcccagctccgtcattcgctgttaagcttggtgaagactcttcctttatctgagcttcagttttaccttctgttaaagagtgtgataagccctaacacacagggtaacggtagggatttgttaagattttggttatgaaaataatcactttagtgtcctggaaattgtaggatctcagcacaggcgagccccctatgcttcagattcatgtctgtctggctcaaatcagcaaagaacctgatatgctttctttttccagacaccatgaccacccttgatgataagttgctgggggagaaactgcagtactactatagcagcagtgaggatgaggacagtgaccacgaggacaaggaccgaggcagatgtgccccagccagcagttctgtgcctgcagaggctgagctggcaggcgaaggcatctcagttaacacaggtactgagaaaccctgggctctgggaacaggcttaaaaaatgtacattaaatacatattaattaaatacatattaataaattaattctcctgatcacttttaactctggtcccactttcagaggtaacctagtcttttcattatgtgtgcttctagccttttagtgcacaatacaaatgtatgtgcatagcagcatggtaatgaacacagactggcctggatttgaatcctgcatctcgtattaacagtttgatatctcataaatcacaagtatgagtatatgggtagtgcaaattcctaaaaatggcatatttacacttgtacattttaatattgtcaaattgctgtcagttgagttgaggtggcagtagtttatagtttaatcagcaatctgtgtttctccgtacacttgacctcctactgtgttatgaaactccttgatctttgctattgtagtaattcattgtaggtttatttccgcccccaccaccttttttttgttttgttttgtttttttgttttttaagacaagttctcaccttgttgctcaggctggagtgccttggtgccataatggctcactgcagcctcaacttcctgagctcaaatgatccttctgcctcagcttccatgaggttcctctcttaaaaagctgggaccacgtgtagctgggaccacaggcgcttgccaccgtgcccagctaatttatttctttattttttgtagagatggggtctcactttgttgcccaggctggcctcacactgctggcctcaagcgatcatctgcctcagcgtcccataggcatgaaccaatgcactgggcccatatttatttttaagagggaacctaaacttcttttcataattttaagagagatttttatatcctttgctcatttaaaaaattaggtgttttttttcttcttggggagctataaaggaaattaatctgtgatatgagtggtaaatatttctttcagtttgttgttgtcttttgactttatattcttttgttcttttcctggatgaaaaattttatttttatgtacttaaaagtattttatagtttcttaattttgcattttacttaaaaggcgtttcttcaccctactttataaagggcctcactttgctgtataaaaaggttctcctggctgagcacagtggctcacgcctgtaatcctagcactttgggaggttgaggcgggtggactgcctgagctcaggagttcgagaccagcctgggcaacacagtgaaatcccgtctctactaaaatacaaaaagttagccaggtgtgggggcatgcggctgtaggcccaactactcgggaggctgaggaaggagaattgcttgaaccccggaggcagaggttgcagtgagccaagatcatgccactgtactccagcctgggcaacagagtgagactctgtctccaaaaaaaaaaaaagattctcctatacttttcattagtatttttgtgatttcattttttacacttaaatattgattcatgtggaattcactttgatgcagggtgcagtagggctccagtttaatttttttttagattgctactcagttgtttcagtactgcttagtgaataagccatctttattatcttgagatgtcacttttattatgtactgaatttctctgtttatgttgggtctttagctgtactatgtggtctcttccattgatttgtcttttactgggctgtgtcatactgtttttaattattgtagtgttatattttagtatttggtgaggctagaccctcttcaattaacttttgctttattttttccaaaggaaatttaggagccggacacatatgtgtgttcatgtattttcattgggaatgcattaaatatatagattaatttagggatcattggcacttttgtgatgttgagtatgtctgttcaggaacatggtattgcttttccatttattcaagtctttcaagtattttttgggagcattttaaagttgtcttcatatagatttgtatattttttttctgtgaaaccaatagactccaaagctttagtggcttatggcaacaaaggtttatttctcattcacgttacatgcagcctgtaggtcaatggcagccctgcttatgtttcgtatgttctttcatctaggagctaggctgaaagaataacagcctcagtttggctgtgtccctctatttaggacacaccgttttcatggcgaagcatagagagcaagagaggagctgttggaaacatggaatggctcatacacggcatactttttgttttgctcagacatggcatacttcatatttgctcacaatcccattggccagcaagtcgcatagtcaagcccagcctcaatgggctggggatatatgtactcatcccacaggaggtaccacaagtcacatagcaaggtgcaaggacatataagtccttcggcagcacagggcttgacgggttaagggtagctggaataacagaacaggttgtattacaatcttgttataaaaaaattgttataaaaaattcagaggccaggtgcggtggctcatgcccatcatcccatagcactttgggaggccgaggcgggcggatcacctgaggtcaggagttggagaccatcctggccaacatggtgaaaccctgtctctactaaaaatacaaatattagctgggcatggtggcgcatgcctgtagtcccagctgctcgggaagctgaggcagggggattgcttgaacctgggaggtggaggttgcagtgagccgagatcgcgccattgcaccccagcctgggccacagagcaagactcaatctcaaaaaaaaaaaaaaaaattcagataatatagaagtacagaaagaaaaaagtaaaagatctctctcaccagttgcttagatcctactacctggagacaaccactgttaacagcttacatatcctgcaagctcttattctataaacacacaagtgtatatacaaacatgtatgcatatctatgtacataaattatgtatatacatacaggtcttttttaatagaaactagaggattgtaccgtgatattctaaattttgcttttgtaataacctcatatatttggaatatctttaatggcaggaaacacagagctgctttactctaagagttgctttattttcctttgagtaggtagatgataattttttaaactcatctcctaatgttgggcattagcttggcccttgttgcagggtacatcattgtgtataggccactctgccctgtggcagagtacacagagtccctatgataattgtgcagtagatggagcaagcttcaggcagatgtgaactcctacctacagatgtcagctggtccataattccctgcccattctccttggtcacatccgtgttcaccctactcaggcccaaaaggtgtgatcaatgactggcgccgcttcaagcagttggagacagagcagagggaggagcagtgccgggagatggaaaggctgatcaagaagctgtcaatgacttgcaggtcccatctggatgaagaggaggagcaacagaaacagaaagacctccaggagaagatcagtgggaaggtaattagcagtactcaggcttttcttagagtctgctgtggctgctagagctgggtgagtgattcaagaggtggaggatgcttgatttgacctccaagaagttgtgcagtgcaggagaaatcatagagccctgtcaaaactcaaacccacccagctttggatctcagttctgctactagtgactgtgggagagtctcttcccttctgaatctggtgtttcaatggttaaatgatgtatcctccccgtgcagggctgtgttgttaatatgcccatcacagtgtctggcccattgaaagtgctcagtaaattttagtttcccttcttttattgaggttttatcttgggccagaaataaccctcttagggtggtggtattatccccttcttacagataatggaagcaatgcttagagggcattagaggcttgttcagggcaatgcaactggtaaattctagtaggcgctagggttctaacccaaatactcctgtttcttccatgatgttgctatttcatctgaagcctattcatgagaatttattctaaggaggcattataataagcaaacagatactctggaagatatttggaagtaggcacctgatggcctttttttttttttttttaatagagacagggtctatgttgcccaggctggtctcggaactcctgaggtcaagggaccctcccaccatagcctcccaaagtgctaggattacaggcgtgagccgtggtgcccggcccgtgatggcctcttatcctatcagtattaaaagggattcactgtttctctggatgccctctgagtgtggacgaatgtctgtgagtgcctgagatcatttagttatggcccaaagctaaaataccacacaggatcagggagcagataagaggattaagctgggaatcattcaccttgaccaggaggctgattttaggacattacacttagccaaagacttcaataggtcagaagaagccactctggtagactgagttgaagtggagggctgcaagatgggaggaaaattggcaataagtaaaatagtgaactcagaatgttgctggttatgataaagtaacaacgtgttctgatctagtgtgatctcccactccctgttccctaatctatgcaacattaggcagagttaggttttatgagaggagcgaggatgtcttgctgcaccggggcaggggtaagatgctttcgtagcttaagctgtctcttgggcattgtgcctgctgctcacagctgcttcctgatactgaggtgagaggccagaatgaggcaacatcatatcatcacatggatcagtcttgtgagaggctgttcccgtcctgctgatttatctgcaatagaacagaattggaaactgtctggcagaattagggaagtgattaagcaaagtgacacattatatataatttcataaaaatatttggaaacatgaggaaatacttataatcgtgctaagtctcgaaagcaggttatggcttaattggtacacccacagctgctgctataaaagcaaaactattttagtatgactggtaataaaaataatttttagagtccatatgactctgtgtgtgtgtgtgtgtttggggatggtgtggggcaggggttatgagagttttttctaaaattctgtaatgtcttgttatctttcaaaaaaaaagtagataaaatattgtcaagactgacaaaaagaaataagctcatgaagtgagattatatgatgctgcctatttggattgagaggaaatgtgatattgtagttaaaaacatgggtttttaaaatctagtttgagtactggtcttatgcttactgggtgaacttgttcaaataatgtcaagttttggaacctcatttataaagtggggctattaaaagtcccttcccgatggagttatggaattcagtgagatataatgcatgtaaagtacttagcatggtgccttatatattatcagcatgtagtacatgttaactgttttatttctttttatttttttggagacagggtatcaccctgtctcccaggctggagtgcactggtgtgatcttggctaactgcaacctctgcctcccaggttcaagtgattcttgttgtgcctcagcctccagtgtagctgggaccacaggtgcacaccaccatgccctgctaacttttttttttttttttttttttaaggagagatgaggctttgccatgttggccaggctggtcttgaactcctgacctcaagtgatccgctcgtctcagcctcccaaagtgctaggattacaggcgtgagccaccgcgcccggcccatattaactgttatcacgagtgttcagttttcatatttatgctcacttgctggtccgcctgcagatgactctgaaggagtttgccataatgaatgaggaccaagatgatgaagagtttctgcagcagtaccggaagcagcgaatggaagagatgcggcagcagcttcacaaggggccccaattcaagcaggtttttgagatctccagtggagaagggtttttagacatgattgataaagaacagaaaagcattgtcatcatggttcatatttatgaggatggcattccagggaccgaagccatgaatggttgcatgatctgccttgccgcagagtacccagctgtcaagttctgcaaggtgaagagctcagttattggcgccagcagtcagttcaccaggaatgcccttcctgccctgctgatctataaggggggtgaattgatcggcaattttgttcgtgttactgaccagctgggggatgatttctttgctgtggaccttgaagcttttctccaggaatttggattactcccagaaaaggaagtcttggtgctgacatctgtgcgtaactctgccacgtgtcacagtgaggatagcgacctggaaatagattgaactgatagtctagttgcatagatttctcattgtttgggttggaatacacgtcattgtttatttttgttcctttgtcttctggcttttcagctgttctttgtagtcccttttattatgcataaaataaagaaattcttagattaaatcagaatgctgaataaccttgtagctagcaataaggtgacttacagttgtataaacaggaagccaggcttttgaactgtttacttaagattctgtggtgtgacatctctgttattgtttccagtcaatatttacaaagcatcctaaagacagggtcttggaaattgtcttcagatgatcttagaggtctctgccaagtctgagagtataattctgtaggtattgtgttatttgcaacgtaaatagtgcattttcttaatcaaatgattgtaaattatatttacttgtaatcagttccatagctttagacggtggttagattttttttttccccaccagggtcttgtttaaaggggtgagccaccgcacccagtcctgaggggtggcctctgctgctggatttcatgtcttcctccagcatgactaagtctggaacagcaggaagggttgatgcttactgacctggtgatgttagaagacaagtagtttatggatttaaacattagagctggagtggggctggaaatctttgtaaaggaagttctttcagtaagatgcccctgcttgtctttgtctcttttttgtttaacaaggtaactttttgtttaacaaggtaactttttgtttaacctagattttttttaaaactttttttttttttcatattggaaaagtaattcatattcagtagaggaaaactgaccaaaacagaagcaaaaataagaaaattaaaataatctctaatcctactacctagaataaaacactattaatattttggtctgtttcctgccaaggtgttttctgtgtatacatggatattttgtttgtttttaaacaaaacgatgggatcattctgaacatactgttctatagtatggtcagctaataatatatcagacctttttttatattattaaatattctacaactttttaaaaatgtctattaatattccatcgtatagatgtgatataatttgcttgatggttgtctcttaaaaagaaagatagcaaatactttttttaaattacaaaagtgatagatgttcattgtagaaaatgtaataaacactgttaagacttaaaagccatataattccaccaaccaaaattaatcccttttgtcatatttctagtcatttttatagcctttttttctatgtatttataataattatcatttgcgtttttttcctttttttaactttaaaaatgtatattctagggtcaggggaaatgtaatctggaattaaatattagccttaaaattcacaattttgattttcctggcttttcaggaattgactaactgtaaaagagtcttgaaagtatttagtcaacaaacagagtgcattttttttttttttgactaagaaagctcgttgtagtagaaagggtggaatgtattgaaaattattagaagcagggaagtattgttagtctagcttatttcctttcagtcttttttcaatatttttataaacattgagtacttactgaatttagttctgtgctcttccttatttagtgttgtatcataaatactttgatgtttcaaacattctaaataaataattttcagtggcttcataatatttcatcatttggatatataataatttatttaaccagtctctttatttttatttatttattttgtttgttttctttgagatggagtctcgctctgtcacccaggctggagtacaatagcgtgatctcggctcactgcaacctccacctcctgggttcaagcagttctcctgcctcagcctcctgagtagctgggactacaggcacatgccatcacgcctggctaatttttgtatttttactagagacggggtttcaccatgttggccagactggtctcaagctcctgacctcaggtaatctgcccgcctcggcctcctaaagtgccgggattacaggcgtgagcacgctgcacggcctaaccaatctctttatattggttatttagattctcagtgttttgctgaacacttaatgcctttgtgttttgggctatattttgaattattctcatagatttctagaagaggaattactgggcaaatagggacacttaaaaatagcttttacaaaccatcttctgttctcattgaaaatgagaatatattatgcacttacagggaacttgactttgcttttcaagaacagaagttctaaaatacagtagggctgggtgtggtggttcatgcctgtaattccagcactttgggaggctgaggcagacatagtgaggcctcatctctacaaaaaatagaaaaaattagctgggcacggtgttgtacctctagtcccagctacttgggaggcttagtcaggaggatctcttgagcctgggaggtcaaggctgcagtgaaccatgattgcactccaacctgggcgacagagaccctgtctc

SEQ ID NO: 36610 - DNA, 10088 bp, Homo sapiens
ggctgaagtgctcacggctcactgcagtttcaagttcctgggctcaagtaagtgatcctcccaccccagcatctacagtagctggagactacaggcatgtgccaccatgtccagctagttttttttttttttttttttgtagagatgggagtctccctatgttgcccaggctggtctccaacacctgggctcaagtggcttggcctcccaaagcgctgggattataggtaagaaccaccgcacctggccctgtttgttttttatgagcttccaagtagctcataaccaagtcaaaccatcctgactcctttaatttcatctctcaccaacattcactgaccacatctgccacccagaaatgccctccttggtttctttgtttttcaacttcaatctctccaattcctccttccaaccctaaaagttctttcttagccctcttatttctgtgctctccatgacagatgtctcataataatttcccacaactcttaatcctttcttattcacactgcacttacttagagtcttatattaactgcaaaactcctaaatggctaaccttcccagacatgagcacctccaatagatatggttgactagctttttcaacagtttactttttttgtttgtttgtttgagatggagtctcactctgtcacccaggctggagtgcagtggcgcgatctcggctcactgcaacctccacctcccgggttcaagcgattctcctgcctcagactcccgagtagctgggattacaggtgcccgccactgcacctggctgatttttttttttttgtagtgttagtagagacggggtttcaccatcttggccaggctggtcttgaactcctgacctagtgatccacccgcctcggcctcccaaagtgctgggattacaggcgtgagccaccacgctggaccatttttaaagtaatacttccatcacatccttacttcccagagttttctaaacaaagttcaaatgacatagctttgacactgaattttaaaatagattttcacgtctacatcattattgccccaaatgaagcctaatgcaatccaatctggctctattttttacatttttcagcatttccctacttcaaagtctttcatcggtttttttttctcccttggagtgttccctctcattttttgaatgtcaaaattctacacttcctctgatatgcagcttacgggctaaatccttcatgattctttatcttattatactagggtaaaaataatctatatctcctgcacttccatagaatgtatcgaagtatggctcagattatagatactacctagctcaagggaagagtgagaacactaacatttactggaagtgtacaagtccagcttatttttcataaaaagtaaatattccctccccctgccccccaatctgcaggtcagaaaagagcacagaatgttgctgttaataacggggctagaatttacacttatctttcattccacagagctcacttctttcttagagcttgccatcacaccacacggggtcatttacttatcacctactccgcgctagagtactatgctaagtgcggaggacgcaaaaattaatgtcaaagataatccttgttcacagtattctgtctagcttaagaagagttcttagttgaatgaaagctaattctaacaacttgtgtgcacttcttttgaataaaaaccatcaacttatttgaattcttaagtttcctcctaaactccaacatttcaggaggaagaggtcacattctagtcatctttgcaatctcaaacccaaaggaagcctaacttggtacagtgcatggcacattcaatgtctgttgaatacaagtaaagctcatactacctagtctatttttcagtatctcttgagttaatgacctggttaacaagtcagagtcacagtcccaagggcaacaactttttaaaggctcccctaacgtacttcaggatccctgactgagagtggctgactatggcagtatatgggcatactaatcactggagaaataatagcgagaaataaccaaggaaaagcactactctccaaaaacattaaaaaaaaaaaacaactgaacaactagtaagaaagaacgctggatctgagcaccctgtaagtcgcttccccgtgggccgggtaaaggttttaaaacccgccgcctccaggaagacggccacgtgcacaaggattagctgcaaactccgtgcccagtctggccgggagaattgctaaaaccgacctaccgttaacacccgggctactctgaaattaagcaaggctgtagtcaagtaagtaacccaagaaaaggcgcacagagccgccgccgcaggtgtagcccggggacatcccctcctaccttgcaaacggggcctgggatccggtccctctcttcttcctccacctcctctgctgtggcgtgccgcttagctggcggctccgcatctatttcgtttctttttggcttcttcgcctgaactgcaaagcctccacgccgtttcctcttggttgccgccatcttgcctcgccgcccgcgctcttggcctcctttccggcgctgccgctcgctcctatttccgatctctatggttcggcggctctaagcgctcagctccgcggtcgtcctccaggtctgtgccgcctccttccggtctcggtggcgcggcacgcgcggctctctaggcctccttcagctctgtggtgacggtggccgaggtggagggccggtctgaagagtggcgggactggcttcacttcctccgcggttcctcggagccgcctcgctcctcttcagggactttgctgagaagggctctcgggcgtccagaccccaccgcaaaggtagggtttccgcactcggggaccccgagactagtaagcgatgctgtcccgcgggcgggctggtgaatggggttgtctgggactcttggaggattatctggacactccgggcccgccccgccatcgcctgttttgttggaggcggggctggtggcgcgggctgcacaaaaccgactccccgcggatttgtagctcctgtttggccgggagataccgtgtcagttgcgtgtcttcattcttcacaacttttcacgttattgtcctcttacggagacgaggaaaccgtagcttagataattttcctccagaattacaaagatagttaagtgacataggtggggttcggcctggtcagccgtgttcagcctcccagcccctttccacctctcagcgcaggtggagctcgccggacctcgccagcactgatgggagttttactgtctaatcccttcaggtgtttggcgatccgccgagaagttgttggccccaggagcatccctcggggccgaatgcgcagtggacgatgccccttctgacccaacagatccaagacgaggatgatcagtacagccttgtggccagccttgacaacgttaggaatctctccactatcttgaaagctattcatttccgagaacatgccacgtgtttcgcaactaaaaatggtatcaaagtaacagtggaaaatgcaaagtgtgtgcaagcaaatgcttttattcaggtatggaagtaggcgcctttaagcctgtgccatagatactctaaatgtaatttaatgaaatcggaaggtttcagtagacaaaataacttaatagtcataataacttgtcaatagtcataataaataacttaataaataaataatagtcttaagttagagaacaaaacgtcattacttgaattttttttctctcccggtaacaaattcttttcccatcttgttttacagagataatggttagtaatgactaaagtttattaaactaggctattggctaggctacagtcttcttattgtttaacttatttaatcttaacaatagtcctgtaaggtaggttctgttattattcccgttttatatatgtggaaacgaggcacaattttaagtgatttgccaacagtcccacagctggtaagtggctgaattgggataagaacgctgaatatttgtttccagaatatatgctcttttttccactgcgatatgctattactaaagagtatttttttcctttactggttgtaatagaatttttgttcttccaaagtaatatttgtgtggttcagataggattgcaagttcaactaagcgttttttaacacgtaagtgcacagcatgatctcagggatagagaggtaaataagacacggttcttgtcctcatgcaggggcatggtatggtggctcacacctgtatttccagctgctcaggagaccgaggctgaagcacgaagatcgcttgagctcaggcattaaagaccagcctgggtaatcatagtgagacccccgtatcaataaaaaatcataataaaagttgaaactaatgttgctcatgcattatcaagtcattcgtctattttccaagtgaccttagcagtagtgataggcacaaaaacgagacaagggagagtcacagagggatagttttagatccaggaatggagataaggatgcttcaaaggatgtctctaagatgttttgattgctaatcagaaattattctcatgggattagcacagtattgtattttttaaacgtataaagtgaaatctaggaccttatattattagtttttattcttttatgtaacaattttcatttttactcttttcataggctggaatatttcaggagtttaaagttcaggaagagtctgttacttttcgaattaatttaactgtccttttagactgtttatctatttttggatcaagtcctatgccaggtaaactatgatcagtataaagacataaaagtgttatacatagtggtcagaaaaatacaggaagttatttggaacataaacattggttcagaaagctaatgccaattcatttttcagtggccacagtcatgggttctaacatttcacaatgttaattgcaagtgtgtttataattcttttcatatttgtaaaagtatttgcattttttttttaatttacaaggctttgagggattgtaaattcgaactggccaaaagaatactttggacatgtcttaaatatttttagcattgtgaaatgttttaattgcttctttttcctaacttgtccagaattactccgctagttagtggcagagaaaaacaaaagccagttctgactcctagtttactatgttcaaaatttgtttcttttaagccatattttataagttatgtctattttgccaaatgattttgtggtgtttttgagacagagtttctctcttgttgcccaagctgcagtacaatggcacagtctcagctcactgcaacctctgcctcccgggttcaagtgattcttctgcctcagcctcccgagtagctgggattacaggcacgtgccaccacgcccggctaattttttgtatttttagtagagatggggtttcaccatattagccaggctggtctcaaactcctgacctcaggtgatctgcccgcctcagtctctctaagttctgggattacaggcataagccaccgcaaccggttgccgaatgattttctttaaaatatatatttttttatttgttaagggaatttttaagaatggtgaaattgaattgctgtgggtataaaactaaggaatccccagaagaatgattttatttcataggaaagcaacctggagattagctaggaaaaattcaatatagttctccagaaaaatgtattttacgtttccacagacaattccactattattaattatacattttctaatacagtgttctccagctagtttttcacagaagcatctgtcatcttccattcctcactgtggctctcaatccagtaaggagaaggagtttgaatatcctgtcatattcctccttccctctagtggtttgcagagttaaaatttacaccaccattaacaaccctctttttctctcaatttgatttttaaattcgaggaaatataaagaatatctcccagttggaaaagttggaaggatccttgtcatagtgagtacactgacgttacagtacagatgacagcaatccactgttacacacattgaaccttcaaggaatagcataccctgttctgcagcaatttagttacttgctgtgttgatccatatagattctctaccctgaaattgtacatatataaaatcaacaagctatttctgaggtgtgtatgacaacctgaaaatgattccaaagaattatgttacattttgttctggttcccaattttcttgtagttttggaattctctacacacaactgtcatcagggaagatgtcatccctttttatgaggagatacatatatgtgagaaattgggcggaataaattattcttgagaaattttatgtatcatttcgaggagaagctgaacccagaactataaagctaaggccaagtatgacttctttccattgcagggactttaactgcacttcgaatgtgttaccaaggttatggttaccctttgatgctgttcctggaagaaggaggagtggtgacagtctgcaaaatcaatacacaggaacctgaggagaccctggactttgatttctgcagcaccaatgttattaataaaattattctgcagtcagaggggctccgtgaagcattttctgaattggatatgacgagtgaagtcctacaaattaccatgtctcctgacaagccttatttcaggtacttgagagcagtgcagttatagttaatgtggtctgtactccatcttcccacttagacatttgcttaggatgcaaaatttttattatccacatttttagagttttcacaactttagacagcttgtactcttacctcataattttatggatcaagaaacttaagacccaggaagattaactcactatttcatatttaggtggtggtggcatctagatgagaagcccagtcctctaatttataaactggtggtgttttcattgtactactccttactttcatagatcaggttacatcatgaggaaaattgggtttaagtgtttggaaagggtgtttgtattatggtatctttttcaagttagttcaggatgcagaagaagatgttttctacacgtggctcattcattcactaagtatctgttgatcacctaccgtgtgcttattcatcttattaagcattgtgggaagaacagcttaaaaccaaggtgaagccaagaaaatgtgaaacagcaaaccattaagtaccaagatagcacacacagatacctgggaaatgctgtataaggatttagggaggattgctcaaggctggcttcccaagggagggcagttttcagcaggagtacaatgtcaaaaaagctgttcttgatagtttaacacaagtctcttttcaggattagactcagagattctagcaatttagagagaggatctaaatattctctttttgaaatatttcagaatattaaagcccctaaatacatatggaataaaaggaataaggtattctttttgtaactactttagaagaattacaggcccggctgtaaaagtgctgtggcagacacctgtaatcccagcactttgggaggccgaagtgggcagatcacttgaggtcaggagttcaagaccagcctggccaatgtggtgaaaccctgtctctactaaaaatagaaaaattagttgggcgtggtggcacgtgcctataatcccagctacttgggaggctgaggtgggagaatcacttgaacccaggaagtggaggttgcggtgagctgagattgcgccactgcactccagcctgggtgacagagtgagaatctgtctcaaaaaaaaaaaaagaaaagaaaaagaatcacaggcccttgtcatgactttggggagttaaaaatttggctcaaggtctgagaaagttaaccaaaatggaaattggaaaccttactttagcagtggaatgaagtaaaaaattcaggtacttaaaacagtatttcaggggatctcctcagtgatctctctcagcctgggtaacgagatggaccatggtatctttcatctccaggatgggaaacaatttggtggtagggaggtaggagttgaaattttttcctggatatgttaaattttaagtacctgcgacactagggagtggctggatatgtagttatggtgctcaggagatccatttagactggaaatttagatttgggaaccatcatcatggctgggtatggatgagacgggtcagagagagagattatattagaagaaagaaaagatggaccccaggaaaaccacacctggaagatgggaggcagaaatggagcttagggaaaaccaacctggatcttatcgccatgctcatataatacttagcaacgtgctaatcctgcagcaaatgttccaggagttcttgcaaattaaatcagcatgttaacacttataaattgtctacaaataacttctggtattaccaagtgaggaaaaccatgcaatagccttaagagcagtctaagatacagaaaagctgtaattcctaggtgtaggattgggaacagacctaagggttgcagtagacttagatcaaggtcttccatgagtcctcaattctctcgcctgttatatatttctgacttaaggatgaggaaaagtcattttcagagtaggattagggtaatgaaattaaagtgtcccctacccttttccttttacaattgattttcttcaaacccattgattagttgtcctgaactccagtgggagctttattatggtacttgttatcgtgtgttataagcatttgtgtacatgtctgtttcacccactagtatgaatttcttaaggaagtgttttctttatttggatcctaatgtggtttatttttggatgaatgaataaatgaggtaatcattttctataggttatctacttttggaaatgcaggaagttcccaccttgactatcccaaagattctgatttgatggaagcatttcattgtaatcagacccaagtcaacaggtcagttcttaatatagaggttgtcattggtgataaagaggaggttaaataccagatttctgttaaataaaaacactttcaatctgttaattaaaatgcacagcattttataaaaatgaatagtagagtgctggacttactaggggatgtagggttctaacagtgaatgaattttaaaacagaaaatattagcaaattggataagtacttgattttattcttagatttgctactttttatcctttacttgggagttctgagcagtgttcactgtgttgatataacagcgttttattttttcttctacagatacaagatttccttactgaaaccctctacaaaggcattagtcctatcttgtaaggtatctattcggacagataacagaggcttcctttcattacagtatatgattagaaatgaagatggacaaatatgttttgtggaatattactgctgccctgatgaagaagttcctgaatctgagtcttgagtatgacaattcactgatatttatgtgtacatttatgatagatgaagttcttattctgagtacagtactctttgtcatttcatattggattttctatagagaagaagcacaatggggaagataggagcaaggtcatgtaccctaatagttactatgttttgtaaatccattttgtagagggcatgtaaataaatgttttcctgtagtcatagattattcaggactgtcctttagttctgtcttttgaactcatgggaataattgtgagtcagcgtaacatttcaagagtctaaaggtggccgggtgtggtggctttaatcccagcactttgggaagccgaggtgggcggatcacctgaggtcaggagttcgagaccagcctgaccaacgtggagaaaccccatctctactaaaaatacaaaaaattagccggacgtggtggcacatgcctgtaatgccagctactcgggaggctgaggcaggagaattgcttgaacccgggaggcggaggttgtggtgagctgagatgacgccattgcactccagcctaggcaataagagcaaaactctgcctc

SEQ ID NO: 36611 - DNA, 112667 bp, Homo sapiens
gggttcagtagtttgggaagggagctgggggaggcagtggcggctggagtaggtaggcgagtaaaaggaggaggaagggctggggagaagagcgaggctgtagcggctgcctgttgagggaggaagaggtggggggtgtggaggagggggaggagagagagatgacatggggagaggaggaggggggttggacgtgggaggaggaggagagggctcgagggaccgtctgtcgcgggacgggctggccagctggggcgcggagcctggaggaggaggcagcggcagcggcagcagcagccctccgagcagcagcagctgcagcagcagaaacaagtaccagccacaaagcggctcctctggcccaagcagccacagtccccccgccgcgatggcgctgcaaagccaggcgagcgaggaagcaaaggggccctggcaggaggcagaccaggaacagcaggagccggtgggtagcccagagccggagtctgagccggagcctgagcccgagcccgagcccgtgccagtgcccccgcccgagccccagccggagccccagcccctaccggaccccgcacccctgccggagctggagttcgagtccgagcgggtgcacgaacccgagcccacgcctacggtagagacccgcggcaccgcgcgcggcttccagcctcccgaaggtggcttcggctgggtggtggtgttcgctgccacctggtgcaacggctccatcttcggcatccataactctgtcgggatcctctactccatgctgctagaggaggaaaaggaaaaaaatcgccaagtggagttccaagcaggtgagtggccccgcacgccccacttggcattttgggcaaggttggccgctcccgctgccaccgaccccatacctcccggtccgaggcgcccctccaacgcgcctctccgactcctccccttaccccttaccccttgccccttgcccctttccatggctctcctagggtgcgggttgcggggctttgggcagcttggactggggagactaggtgcaaggcgtcccgggggtacgaactgggacattcattgatccttggcaagcaatggacttttttttgccctgggacaaatctaaatgcacctttcaggtttaaggtacctttgcccctgtgtgctgggggaaaatatttgcaggactttttttttttttggaggtggggagaagtcatgaggagaggagagaattgagaggcggggcgggctctgagagaagcactgtaccgctgatctccgcagcagccccccggttcctttggggaaacggaggtgttttctgttaaaaacactttaggaatcctgatgactatgagcgaagagtcaaacacatggcaggcgtgcgtgtctgcaagagagaaagggagggagggagttcgagtcggggtgtgagtgcgtctctggccgccgccgttacggcccagctgggcccggcagtcctctgccgccccgcgggagtgaatggatctccgtgccctatgagccgagccccagagcgggcggggaggcggtctccgcagtctcctgccagagaggcgtgaggccgcaggcaggctgggccctgctgctcactccgcaccgcccccaacttcagccctgccttccccggcaacccgcgcctctctgctaccggtggggtgcctcgttcggcctacagcctgagtgccagacccgccattccagctttcccctggagctgacttgatctcagacagagttggggggcatagccctcgctttccaggccagtggacgcaagaccccaggcgtgtgcgctcttctcattgaggccgcctgtgagctgggagaagtcagaggaaccatctcgctttcccagcaaagccgctggcgaaatccctcagcagttctggtgagggattcagacgaagacgggggattgggatgccctctctggcaaggcttgctccctctcgtggctcctcaggacagctcgactcttgccaccagccccaagttcacaactcagaatatgtggcttttcgcagtgttgccctcggactgaggagttccatcctctcgccaacctccaacccccacatatttctactgccatttgaggggacctgggaattattaagtgaacatagaaaccttgaattctggagtgtccacctgtggattccctgggccctctccaggacttgtggttttagtttgcagctttgctggacttccctggcagaaggggctttggggatcttggtgcctcagaccttgtgatccattggcacagcagcggtgtgcaggccccgatgaagatagtgcgtcagtggttgtcaaaggaagtctcttgactacccaggcccactgtgatgctggaatggaggggtcctgggacagtgtagagcaacttctgcggggaagatggctgccacagtcacccctgggaccacctttttccctgctttgatgcagttcaggggctcctgggaaagcaggcagtgtagggactcatgctgttgcctaggttacctccaagggcacctgctgagcattgccctgtggttgaaggcaggctgttggccttcaggatcagtgagtggcaaagtctgagtgaaacttgatgagaagcagtagaggctaggctgaagctaggccctggcatttatatggtgtgaggaggcctagagctgtgatcttaggagtgtataataaaacttggaaaaaccactattttaccaggaagaggctcactgctggggaacagacttcaaagtaggtgatcataggggactcagggggagggctggctgggactttccggtcaagacctcacagtgcagctagagggtgggggtggtggtgggggtgcagttggctatgcagaggtgtggctagtgcatactctgacacagaccaggttcactgaggggctgaggtcactggtttaaattatagtgagtataggtcaggaagaaacagaaaggaatttggtatgtccctagggtctcagaatactttggcttgggtccttgctgtggtgtatcttgaactcactgacattattttttatactagaggttcttagggacaccacagtttttattttggaaaagtcaggaacaccctatcacatggagctcctagaaaatctcatcctcagtactacctttgctgagctcttcaactttcccaagcaaccattcagatcctgagattctgaatgtctttgcctgcagacactttctgctgtttactcaaaatttcccagccgtctgtgccacagcactggtgtctcaaagggatagaagaagctaatagaagtttgtgtcatttttatcagccagtatttgtccaatagccattctgggagaaacagaatgtacacccccacgctcaaggaatttggtgcatcgtccatttttattaatatctgacatgacttccatctctaagagtctatgaatttggtgtttggaggcacctcgtaacccaatttctctttgactaggcctaatatcttcacagacctaaagctgtgttgagtggcttaatgggtggaaggtcctgcagatgattgggattgttgtgaggaagccccacagaaaggtagtttcttatactttatttttagagatgggatcttgctctgttgaccaggttggagtgcagtggcgcagtcatatttcacgacaccttcaaactcctgggcacaagcaatcgtcccacctcagcttctcaagtagctagaactacaggcatgcgccaccacacctggctaatttttatttatttatttatttatttaaaaacagactcttgctatgttgcccaggctggtctcaaactcctggcctccagcagtcctactgcctcagcctcccaagtagctgggaagaaaggtagttttgatgtttgaggaacagctccacatcagagtgcctctgggcatgggaaaaagccacagaagttagaagggatatgggattcaggccttactagagcatgcaatgtgcagtttttgtggaccctttgatgtatacagttttgtggtgtcaccagctgtatatcttatcccctctcttcaccagttttggaggaaagccaactttccctgggtcctaggcttgggtggattggcaggcaaaaggtccctgagagggaggcaagtgatcaaactctggtttagtgaaaaaaggaaaaagatcaggagggaaatgagcctgtatttcttgccaagatcatgggaaatttgtgagttccccaacccagaccaaacagcagacaggacaggaggcaaccaggcaattctgtggaaagtaaaggcccaagcatagcttcttggggtggtagggaagccttttggaggaaagaggggaaagagaagcaagacgccattgattgtaggccccagctcaatattgggaccctaagtgagttggacctgcaatagggttagggttgggagttcagaggacaaggcagaacaagccagagttgctaacattggctctatgcttaagtctttttaaaagtactccagagtaaaacttgactgccggtccaccattgagccaaaaaatatggaaggcatttttgttttactgggcagtttataagcatggtccttgtaagctcccaaggggggtcaaggctgaggctctcatcaccagagaaagggacaatggtcaggaaggttcactactaggcacaagatagttcaggctgatggtccactctgatggaaacagaattttctaggcatggggaagaatgatacactctgcctttgggtgaaccaagagtcccaaggttgggtggggccaggtagagtaggctgtctttctccttctcaccttaggggttttcattgcttggttcagtgtctcactggactgtaacactaaattgctgactttgggagcaaagtgtattttgagcaaatctgccaatctcttgacttcagctgaaggctcttgactactgtccagcagagctagatcaggttggcttagcgcctgctgtggtgcttcaagccacacagcccttggccaggcatctctcacgtcattcccctgccccctttccaaccaaatgggatcttgaactatgaccatgactgatactgaaagggatgagaataagagattgggtcatttggaggccaaccaggaggatgcttgtttgagttggggtagctggttgaggctggatgcctggatcactgtacagtggcctcaaatgctcattctaagtctaaaaaagcaagacccagggccaaatctggactccccaaagctggcagtctcagtgataccagctaggcagtaactgtgacttagacaacttgtgcccctaacttattctgtgactttggacaggcacttcacctctctgtatgtcagtttatctatctataaaatgagagggtttgactaaataaactttctagccctaccattctatccttctaaaattatgtgatatcttattctttactattcatatgtcatacattttgactcatttaagtaaataaaagttcgttaagctgcctgaatgacagtgaggatggattgggagaagattgggaaagcaaggaaaagccctatatacatcatttccccacgtcatttgtatttaaagactatggggctgcccatgggtatagatgtgtttaaaaattacccaatcctttttacctagtatgtaagggcaaccctgcatgtggagctgcttcttccagagtgtcctgattggtatagagctgggtctccaagagaactccctggatttggcaggcaagcagggtgggtctgtatgctgctgttttccagcgtttgaacctgttcctcaaaagtattaaattataaacatttcctcaagcctcagtttggacccctcttctgaaactgaatttcccacagcacagtcttatttctcagaaatgcatagtcagtgtgaccttggtttgctgttacttccagctagcagaggaaacggattcctaaatgaggttcccttcagaggtcttcaaacagggcgttttgatagctggctcagggccactgcctggatcctgctgtggtggggttggggagggttgctactgtgatcctggagaaggcccattagatgcccacaatccctggtcaactgcagcgtcagggcttagctgagagtgtgcctacggaagtagcaggcacagagctctctttccttttccttggaagtcattggccgtattgcctccagcccatgaagagtaaacaagcagctggactgtcaacatttgtagaagtatataaaggatgccatatcaaccttttgagcagaccagtttcccaggaagatgcactgcttttcccaccagcctcattttatggttttgttgcattttgaaaagatgaaaactactcttttcagattgtgtgaatgacggagtgggatttcctgtcttgaaaggtgttgtctcacttgagattgaatgaatgaaccctagagaaaaggctttgttctacacatatacacatgtgcgcaagcgcatgcgcacgcgtgcacgcgcgcgcacacacacacacacacacacacacacacacccataccctacaccctaagccatagattatgaatattccatctgaaataagtcatttcccatctgttcatggaattaggtgtaccagaggcttctgtaaagattatgctgtactagtgcaaaggaaccagactaagaagcttgctaggcgagagtgatgaaaagagtatggccagcctggattgtacctcttgaactggacccatttgcaactccccagcagtggggctgggaaactttattgcaagtctctttctcccttcatcctcctgtatctctcccagtattcaaatattactgggaagcgggtttaggcaaccccagctctctctggctttaggggtgacagaagactaaacctagagagatttcatcacctgcctgaagctgggtgctatggtagataatgtgaaatcgcttgacacctccttgtggatggggaatgtggcctgtttgggtggcttgaggaagtgcagcctcttcaccctaggagtctcaccctcttttatcctcaacttcgctccagtttccagcattggtgggagaagggatgaaattggctgtcccaatcacatattttctcagcttctcctactttcacagtgcattttttatcacgtttgctatatgtgccatacccttttttcccagtattgttccctcttttctttttcttcctactgctcagttagaggaacaattggggtttgggatgttgtataggcccaactcctgccagagtcacaggcccactcctacacatcctacagaggcctcccttccccctttccccttcctttcctctcttactttccactttctgggtgaagggtgactttcgatggagcactcaagagtgtggaagccatcacctctggattttcgcataaagatagctgctatgacaccctttttgtcacttctacacctctttccacagccctagtaacccagctcagaaggtagtattgtagaaagtcttactcaataatattcaacaaatgtcgtcattacttgtattcctttcttttcaaatcctgactatcattgtcccccatctcctgggccagctgaacttccagagatttcatactggtttttggtagcttccgtgtttctggttcattctattttgagcccctgacatctattttcttgccaaaactgctgcacaattggttgtagaggggtcagagaagggagaagacagacactcaagtcctaacgagagtcaaaagtgcctttacaggaagattgctccagcccaggaggttgaggctacagtgagccatgatcaccactgcacctgtctcaaaaacaaaaagaaagaaaaagaaaaaaataggccaggcccagtggctcaagcctgtaatcccagcattttgggaggctgaggcaggaggatcacttgagcacaggagtttgaggccagcctgggcaacatagggataccccgtctctacaaaaaaaatttttaaaaactaggctggcatagtggcacatgcctgtggtcacaggtacttggaaggctgagatactaggatctcttgagccaaggcggttgacgttgcaatgagccatgatcacaccactgcactccagcctgggtgacaagtgagaccctgtctcaaaaaaaaaaaaaaagtgccttcagggagggtggaggtgggggagtgaagctcccagtttagttgctcttctgcttttacatggctgaaggggaaaagaaagggaaatgttgccaaacaagcaatgcccataccatctttttcctcaacttaacccatggatctcctcacctacccgcttatccagactggaaggatatatgcatgcactcatgtgtccagacctatgtgtatgtgtgtacagcagggtgtgtgatgtctgtccaagccggttagcacagttacttagaacatggtgcctatgagactgaggtcacaggttcagtcacttgttcaggtcactgggcttctcacaaagaaaagagctcttcctttgttcatggcccatgtcccttgtgtggaggtgtcactaatgctaggggagaccaggtagaagaatagagatgacttcttataagccttccctgctactgggaaaaaaatgtgaagcacacagcctaatgatggctgctctgctgcattccacggtggagtttcgttgacatttacctccttacatctgcctaatatgcaccctaataagtataataatagtggtggtagtaatagtaataataattgccaacatttattttacatttagcaattaagtctgtgcgaggcactatactaagcactttacatgtaccaacttattttaattctcaacaaccgtatgaggtaggtaccattatttcctctatttcacagataaagagaagcacacaaattaagtaacttgctcaaactcatagcagataatggctgagccaggatttggacccagacagtctgagtttagaactcctgcttttagacctcacctaagacatagtgaaggtgtagggggcaactaccaagggagttgcagtttttcattcctgtaccttccggcatccttatgactcaaggataaaaagagatgaccaagaagtggttaataaatcaaaagattgatagtctcatgatacatggcatactcttctaactacccattttactctacccagatctatatgcaaagcgtcataattcttgagtccaaaaggtccatagaaactttctcttcaaaatgcaaatcaaaaccgcaatgagataccatctcacaccagtcagaatggctattattaaaaaatcaaaaaataacaggtactggtaaggctgtatagaaaaaggaacacttatacactgttggtggaaatgtgaattagttcagctggaaacagtttggagtttgttgttgttgttgttttgagacagcatctcactgtcacccaggctggagtgcagtggcacgatcttcgctcattgcagccttgacctcccagactcaagggatcttcccacctcggtctcccaagttgctgggactacaggtgcacatgaccacacccagctaatttttgtattttttgtagagatggggtttcttcatgttgcccaggctgatctcgaactcttggactcaagccattggccctccttggcctcccaaagtgctgggattacaggcgtgtgccactgcacccagtctcagtttggagatttctcaaagaatttaaaacagaactaccgtttgacccagcaatcaatcccattactgggtacatagccaaaggaaaacaaatcattctaccaaaaatgacacatgcttgtatatgttcattgcagcactatttatagtagcaaagacatggaatcaacctaggtgctcattgatggtggatcagataaaccaaatgtggtagatatacaccatgaaatattatgcagtcataaaaagaatgaaattatgtcctttacagcaacgtggatacaacatggatgcagccagagaccattatcctaagcgaattaacaaacagaaaaccaaataccacatgttctcactttcaagtgagagctaaacattgacatacatggacataaagatgggaaaaatagacactggagactaccagatggggaagggtgggaaggggatgacagtttacaaactacccatcaggtaccatactcactagctgggtgacaggatcatcgtacaccaaacctcagcaacatgaaatttacccatgtaacaaacctgtacatgtacaccggaacctaaaataaaagttgaaaaagaaactgtctcttcttagttgtttagccctgaataagtcacataactttctgggcttcagtattcttatctacaaaataagacatacagtatctactttaataagaaaatgaagggtcaaatcaaagtgtgagtatgtgaaagatctttgtaaattatgaagtggttgttattattattatccttttccagcctctaaaaacagagtccctatccatttctctaaatgttgctctaagtatttcctccccatctcccaccttcccactccatcttttccatctccccactgtgttcttctgcaatttgacccctgtgtcctgtagctaaatactagctgtgttttctttgttcctcagttctctgagagcccagggagaggaggggccagatcctaggtcatatacattcaaggaagcaaggcatgttgaaatatttacagcacttggcaggagctcacaaacctccctacaagtcaaggactgagtttttttagtaggagttgctacgggttgggggcagatggtggggtggagttagggtgtcacttcctcccgagggtctctcacagagcctctgttctcctgcaggtaacgaagaataaggaaagggatatttagggtcagaaggtctgggctaggggacatcaagcatagaaggagctttgctcctttgtattcagctttggagtgggccagtttccttgtgttctgaacaggatagctccagaaaacagaggccacaggattgtggccttcacaaagaaggattgccaaagcggttttgattaagcatttcaatggccactaagggagttttcattaagacaagctagtaggcaaatcagaacaaaaatgttttgcttttttgttgcaaacaacaaaacaaaattcctaaacccttctttaagactaagatttcaaatatactagggctcaccatattgattttcagtaatttaaatgccttctgatctggaaggcattttggaaatcacacagtcttactccctctggttcccatcttaaggtgaaaaactgagacctggaaagatgtgactttaatcagcattgtgagtagatgcttatagtagagcttggtttgtcagaggactggggaataagcggtaggctgctgtcgcattaggtgttccccagctcaatcactggcattcttctcccctttctctctccctgaacttttcaaagtcaatccccaggccctactttgtgaaaagagatggagacaaaattcaaaaggtatgatggtgaaaagtctctttcccactcctatctcccagccaccctgtttccctccctaaaggccaccagtgttatctggtgtgtcccttcagagatactctgtatatgtacaagcaattgtgtgtgtgcacatgtgtgtgtgtataccctacccttaacactttcaacttttactgtagattaaagagcacacaggccaggcatggtggctcacacctgtaatcccagcactttgagaggccgaagtgggtggatcacttgaggtcaggagttcaagaccagcctggccaaaatggtgaaatcccgtctctaccaaaaatataaaaattagctgggcgcagtggtgtgcacctgtaatcctagctacttgggaggctgaggcaggagaattgcttgaacccaggaagcagaggctgcagtgagccaagattgtgccactgcactccagccttggcaacacagtgagactctgtctcaaaaaaaaaaaaaaaagtacccgtgcagatttcttacgtgggtaaattatgtggcgctgaggcttggggtcttaatgatcctatcacccaagccataagcatagtacccaacaagtggtccttcagcccatgcacccctccctcccctgtctagtgatccccaatgtcgattgttcccatctttatgatcatgtgtattcaatgtttagctcccacttataggaacatgtggtatgccctacttgtaaagtacaaattgtaggctaccatccaccttatcctccactttgcttttcatacttcgaactatatcttggtacattaagttcataaagtcttcattttttttaaatgattgcaccatattccattttatggccatatcacaatctatttaatcaacaccttacattcatactgctactaacctttgactatggggctttagtgtcaaacagtgctagattcagattactttccacatgacttgccttgacaaagttttaaaacttcttggagtctgagttttctcatacataaaataagtataataataccatctgttattgctggtgtggagattaaatgagatgaggcatgtaaaacatctagcatacagcctggcacgtactaagtgttcactaagtgtttgtgctctccctgctcaccagccctccctataccttccacctccaattcaattaatattggttgaattcaagtcaataggtctttgacctatgttagactggaccttggatgcaccagagaaggaaaagggtccctcaagaagtgtatgattcccttgagaagacataacacaccaaacaactacagttgtgctaagtagttaaaaaaaaagtgtgtatattacattgaatgcaattttcatgtggtgatgtagaaaaagagaaatgattgtgagggcaggaggaatcaaggccctgatagaattggaatttgaaatagggtttagctaagtggagaattgggcagtggcagagtgggggcagagaaatggacagttgggctgttgcttggattctgggtctttgccctctggcagcctagtgagtcactgttccccattaggccttacccagcaggtggggtggaggggcaggaggagaggaaaatactgaggacatttggggaaaaggacacggggagggggaatgtttgggcactgggccacagaatgaggtgcctacagatggtttgtggcacagcctactcagcccccaccacctgctcttccatgtcagccacccaagtgcatttctaagaggtccaaggaaaagaagagcataagtagcagcagctctcaacccctcactctgtgtcccaaacaggtcctcagatcccataagccctaggagagggaagaatattgaatgataaaaattccctgtgtgtgtgggcattgtagtttacatcttagtttgtttttttttttttttttgagatggagtcttgctctgtcgcccaggctggagtgcagtggcgcgatctcggcttctcggctcactgcaacctccgcctcccaggttcaagcgattctcctgccccagcctcccaagtagctgggattacaggcacatgccaccatgcccagctaatttttgtatttttttttttttagtagagacggggtttcaccatgttggtcaggctggtcttgaactcctgaccttgtgatccgcctgcctcggcctcccaaagtactggaattacaggtgtgagccactgcgcccagccctacatcttagtttacattgacacttgcaacagaggcagttatgaaataaaatacccaattgaatttcatcatgtgccaatatttttggtcacatcaagtgctatgttgggagtttctggaaaatgaaaagtcaacgtggtttgtgttacttagggaaaaggtcactgcagtgaaggactgtatagagattcatattcccactttacagttgcagaaaatggacagcattttcattgagggcaagtgagtgccctgaggtaatacatttaatatttagcagattaagcccaggagtttgaggctgcagtgagttttaatgatgccactgcaacctagcctggacaaaagagcaagatcccatctcttatatatatgtatatgcatatatatatatgcatatatatatgtatatatatatatatattttttttttttttagtggatctgggactacaactgaggcctcccaattccatgttctatgggggaagaaatgtagaagctacctgaaaggtggaataaaaattttcctaaacttagtagcagcttaaagtttaagtgtatgggtaagaagcagtatagtatgatgaaacaaagaactgagagtctaaaagttcaggggctcatgaaaggaaggatctggacataaataatgcctgctggctgggatcaagaaagagcactggactaagagtcaggagacctgggttctggttctggctctgttactggctgtctttctgaccctgccaagtcccttcccctttctcaacttcaaatttctccacttatgcattgagaaagttgaacttcccagagacttagtgacacttagaaccaatggtatctgtaaaccaaggaggctttgggaacttcctgacaaggggctgagggtgatggagagtggtgaggttgtgagtggaagagaacttctctgatgaaaatggaaaacagatcctctcaaatttgagcaaaggtgagttttggaaagggtatctacctcatagtctctatcctatatccttggagaattctatccaagagaggggaaaaaggaagagtgtgtacgtgtgtgtgtgtgtgtgtgcgcatgcgtgcaagtgagcaagaatttcaatgcgaagctaatgtttggtgggacagattgtaatatgctgagtcaatatctctggaaatctctttaataatctccactttaagatcacttttctaagacgttggttttacttttaaaaaggggtttgtgtcttatgggtaagatactattgaaagtccccctttcatggagcccacttgagtgagccacactgtctggattaatcctggctccaccattcactagctgtttattgtggtaaggcacttaaactctctgtgcctctatttcctcatttgtaacaggaagatagcaagagtacttaccacgtagggttgttaaatgagttgatatctatgtctatatatgtatctctagctagctagcttagaacagtgcctggcatatgcaaagtactatgtaaatgtttcctattcttattatctactgagtagactacagctcatgcatctatacagctgggtttcagagagcaaatatgacccccaagtgagcccaaaggagctcagtattacccagtcagaaatttagggagttaggggtttcttatcaaggtaccttctaggctgttctgatgttggccacacctaggaccagattaagacctttagaggttctaaatactggtttactgatggccaaattctgaaataattaaatctatgtttttctcatttgatggtggtcctgcttcactggtgccctaagctcatgctcatccatctattggataatcctgtactggccacgccagcctgtatgctcctccctatgctctggagggaaccaatgactaagaggggtctacacattcacaaagaacagttttgaacccaagctgctccatccacagcggggtgccccgtgtcccagcttctgagagcttaacctgccaagcctcgtgacctccttgccggttgggacctcccatcctgttacttggaaggatggtttatcttctggggccaggggaagagaaggacaaatgcctggaagtccaaataaggccccctgcaggaagctctaaacattagcaagttaaagttctagtgacaagttcagatgactgagcatggtcatgatacggaagaggaatgtgtgaggctcttttgcctccacatgacgaggagatcaagctccttccctgaaccctaacttgttcaaggacttcagttcagtgttcccggaaaacttggagtcactatcagtatcttcattaccctacacatcttggccaggttctaaccatccaaatggtgaacagcacagttttatgttccaagagccagtgttttttgccttaccctagatattttgcctatggaaaaactagccaaaagcaaggtttccttagatctggccaaacagctgcagggacctggtggcctggataacggaggtcagcaggactccagacaggtttatttgctgccttcctcacagaatatctcaaacatggaaagctcaggtgaaaccggtcagaccagatgttgagaaactgcagcttttaggaagagaagacagatagatccacaggcagcaagaagagagaatagggaggtaaaaaacctattgttccagctcctaatcacaggacccccaccctcatcacacacctatgggctccagcatatcacttgctcaagaaggcaatggctcatctgtgtcccatgagtggatctgcttattatctccacgtaagaccacccaacctaaaggctactttccaggccatagctcaacagagactaacatttgccttgaggctctctttttaaaaatggaatctgtttttagcactaaaggaaaagatagccttggagtgggaagtcacaaagaagaccccaaagttcaactctcctttgcctcacttttccacatgctttgtagtatagggtaaggcacaggatcttataacagacagaccagtgttagagtcctggatttgccatttacctgatctgcaatcttgaccaagtctgagcttcactccctatctgtaaaaaaggggcagtgggagcatcataatccctacctcacagtcttacgataaggttcaaatgaaaagatggatgtgaaagccctttgaaaacagctttgcattatcatcatgattaccacatacataagtttatctatagacttgcacatgtgcttatgcacgtatagccagattgatataccacccatgatgcacacgtgtataagcaaccacttatatgtacaaaactacacatacatctgatcttaagcctgaactcatgacacagacaattaaaagtgcatacacatacacatttatccacatggatatactttctccttctctcacacacgtacacccacacaagcaaatgtatatgtatctctgtaagtgtgtgcatgcatatgtgtgtacatctatagcctcatagctgtacaggtgagcataccatacccttcagtttctgcctagataatccagttttccgggggtctgacaaaggccctgtttgtaaattcctccacttgatactgataatgtcccttttgcccttgctgaggcttcttctctgtctccaccttgtttgcagagtagcacagctgctgcaaaaattcaagctgcagtatgtgacatacacatgtctggagaacatggatccttgtccagttgctctttgaatagcactacgactctagcctgcacagcatatttatagccatgtttgcaaagagctgacagcattttcagacttttttcaaaacgtagttaatccagccacaaaaatagtcactggcccatatgccccaaagctaaaagaaattgggcagcgtgcctaatgaaaattagtcacagagcctaaatgaagttgaagttgaatcaaactctctctctccctctcattctctctctctctctggcttgctcaactctttctttctttctttctttctttctttttctttctttctttctttcttccttccttcctttctctctctctctctttctttctttctttcttctctctttctctctcccttccttcctccctcccttccttccttccttcctttcttcctttctttcttttttttttgagacagggcctcactctgttgcccaggctggagtgcagaggtgtgatcatggttcactgcagccttgatcacctgggctcaggtgattcttccacctcagcctccttgtgtagctgggactacagacatgcaccaccaggcccggctaattttttttttttttttttgtagagatgaggtctcactggtctcaaactcttaggctcaagtgatcctcctgcctcaacctcccaaagtgttgggattacaggtgtcacccaccacacccagcctcactcttgcgctttctctctctctcttttcccttcctgccctctctttgccactgctttttattctaaggatctctaagcctagggtatgtgtggtgggggagtggggggtggtaccatgaagtatatttgcttcaaagaggtcctggggtcattagagcctaaggttttggagagacagggaggaggaagagggaaagaagagggaaaagtgagggtattgaggtttataagcaagaggaacatagttggggaattaaatgaggtgagacaaaaaggagaaaagttacgcccactttgaggccaactagaattttggtggctggataacttctcaaatcaaatggcagagtccttcagcctcccctcaatcactagaatgtaggctagaaaattgttttgcttatttgcaaggttggaacaaaaaagaattcctagtgatagagttgaagagttaagcatggttagaggagagcaagatggtttctcaggaagagagaggcctgggctttatgtaatgggctcatcttaggtggcccagccatgaccagggtgaggagggttttagagagggagtagggttatcatatcatttattgtccaaattgggacacttttgagggtgaaagagaactctattaacatttttgttggaaccacaggcataaactagaattgtcccaggaaaaccaagatgtgtgttcattgtaagtttagaacaaatcgctccagcttgccgggaaagggcaaactataagggctcctcacaagatgtctttaaaaaaggtgtgtatgtgttctgttttgtttgtgtgtgtgtatgtgtgtgtgtgttggtttgggcagtagagagtagggcagggagattattcagccttttcagccttgggactggagattgtttactctgaatataaattcctttttttttttttttttttttgctgctgtacataaatatgtaatggagctcttagccaagcgtgtttatttcctggtcaacttcagaagagaagagagagagagtcaattgtggtgtgtggttttgtgtattgtgtgtatgtgtttgtgtcaaagctgtggaaagtatgtatgtgtgtgagtggaattttaagtatatccaactgtgtgtaactatgggcatgcatgtaggtgtggatgtgtgtggacgtgaacacggatgtggtaagaataaatgagggtgtgtgtgtgtgtgtgtgtgcacgcgcatgcatgagcatggatagggtagagtcaggtctgacctctggttcactgagttgtgaactccttaactttcaaggagcaatcacatagacgaccactttattttacacgtgaggaaaaaggcatgtgtaacgagacctacacactttgttttttgtgagagggagtctgtctctgtcgcccaggctggagtgcagtggcgccatctcggctcactgcaagctccgcctcctggatttttttttttttagacggagtctgtctctgtcgcccaggctagagtgcagtgacacgatctcggctcacggcaagctccgcctccccggttcacgccattctcctgcctcagcctcccgaatagctgggattacaggcgtccaccaccatgcccagctaatttttgtatttttagtagagacggggtttcaccatgttggccaggctggtctcgaactcctgacctcaaggtaatccacctgccttggcctcccaaagtgctgggaatacaggcatgagccaccgcaccaggcagagacctacacacttttacaatttgcttggcagtgattgagagtatactagcagcagtcacaataatcctgattgggaaccagctgctaatccatgcattggaataaaagcccagtatttatttaaggtttctgcaaacaatgggtgcttgtcaaggtgggttgagggagctgcctaagagtaagcttgaggtgtctgtaggcctagacttgagcagaaggagatttgacaaatggctgatccaccagacctgtctccctgaaggaccatgtccaacagtggaaactttccagggctttgaatatgttcaacttcccacctctccaaccccaccacctagagatgtggtttgccttggagacaaaccttgatctctattagagatccactagaggccttcacaggatgtaggccagacataagctgaaagtgtccccagactgggcaataagagacaggaaagcctccccctcacccccagtctctgaccttcctgtacctgcccttatcacttcaggttctggggcaggggaaatggctagagatgccccaggagtgtcaggactggctgttgaaatgggaatttgcagccgggtgccatggcttatgcctgtaatctcagcactttgggaggccgaggcgggtggatcacctgaggttgggagttgaagaccagcctgaccaacatggaggaaccccgtctctactagaaacacaaaattagccagacgtggtggcgcattcctgtaatcccagctactcgggaggctgaggcaggagaatcgcttgaacccaggaggcagaggttgccgtgagccgagatcacgccattgcactccagcctgagcaacaagactgaaactccgtctcaaaaaaaaaaaaaaaaaaaaagaaatgggaatttgtgcccccaggagaagggtgggtgtcagccattagtctcattagcgttggccgaggaattggtcatgcaagttagggtagcccattgctaatgaagctaaaatccaaaaccactgttcttttctcatctgaacaaattcatcttgcttgaacctctgtttgggctgtacccatttgtctgaccagtcacacaaaagatgagacaaaagagtgtgggatgctgcagcatagctctgagaaaacagtccaggtctcatgtcctagtgataaaccagttcaggttcagccaatatttattgagcatttactatgtacctaacatgatgttagacttttacaagtattaattatttcattgaatccttacaatagccctgtgaagtaggattagtcccattaagaccctccaagaggtccaggcgcagtggctcacgcctgtaatcccagcactttgggaggccaaggcgggtggatcatgaggtcgggaatttaagaccagcctggccaatatggtgaaagcccatctctactaaaaatacaaaaaaattagccaggcctggtggcacacgcatgtagtcccagctattcgggaggctgaggcaggagaatcacttgaacccaggaggcggaggttgcagtgagccgagattgtgccactgcactccatcctgggcaatagagggagacttcgtccaaaaaaaatgacactccaagaggtgaagtggcttgctcaaagtaaaacagctaggagtggggaagtgagaattcagtcttaactctgcttgacaaaaagaaattattgagaacctactgcatgctagacattatgctaaaatgtttccatgggttatctcacttaggcctcaaaatagctttatgaggggatattcctcccttttttttcacacattagagtattgaggaacagaaatgttaagtgactcatccaaggtcaagtgctagtattcacagtagatccaggattcaactacagacctgtgactctcaagccgagggtcatctcttccctgctcctctgtggatatctgattccatatctagatgattcctaaggccccttccagctttgacattccagaggtcagcaactctatggtaatccttccccatgaactcgagcagcctcgggtcccttggctgtaatctgccattctctcctccccactaggctctctccatgtgtggtgcagaaaaagagtgggtgagtgacccccagtcagctcgggctgagttggcccggggctctgactcagctgcctcactcctggctccaggtctcaggtgaggtactttctgtaacagtatccagaaggtgctctgggttctaggcctgggccctgtaactctccgcctcctgagaaaaacaggaaatatctctttaaattggcaaataagaaattcctgcaaaatgggctcagggaagccactccattccttgtgtgattgtgcctgtgtttgtgtgcgtccttctctgagtgcatgatacagctaggaggagttgcagacagaggctaaccttgattctgcattgtccacagccttcctgggtgggctgagatgaatatttccttccctgcccgccccatcataccttttcctcttggaagctgctgatggattttctatccccttctgcatcttgagcagaagaggaaggcagtttggctcacagagtaatattatccacagtctggtaccaggtgtgtatgtgtgtgcatgtgtgtctgggggcaggggcaggaggaggtggtggtattaggctggctccagcagagcactgctcagggtctggaataagctaagttgcttgtggaggcaacatctgagggaaaggagtttccctgggagacccctgagtagcacttagaaaattaatatggggaaggggctgtggttcagatacaaaaaccactcattcttcatcttctcttatcctcatgctctctgtattccctctccatactgcctccctcttcaatcctggctgtcctggcaccatatcctgcccctgactcctctacccttgttatttgttacaggggaaggagcatgccacaaggaatccgaaagcttgggttctaccactatctgcaaattttaccaatatctccctccctcttcaatcctggctgtcctggcaccatattctgcccctgactcatttacccttgttatttgttacaggggaagcagcatgccacaaggaatccgaaagcttgggttctaccactatctgcaaattttaccactatctccctccctccctgactttgggaaaggtgctttactgccctgaacctcagttccctcatttgtaaagaccagcctgttttttaaagtttgacacagggttaaatgggaaaaatatatggaaaaaacatctaggagatttctgttgcttgttttgaagatcaaatgagagaatgacctggaaatacttggcgagccctaaagtactgttcaaaaaggaggagttgttattgttaatattccctgctgcctgactgcccttccatatacacaataatgcaaatttgcccagcctagcttatatcctgtccacctccactgtttgctgtaaagacgaggtgatcatctgcttctgtaatgtctatgtccatgacagggaatcacacaggattctcacagggtcctctttcctcttccatggacaaatgtagctgggcttttctgcacagaaagaccttgtcatcacacccacaggagcggtgacaacctcaaatcaatgcaaaccataagagagatctatttgggaagttgcagcttgtctctggatattattattagcccattattgcagataaggaaattgagacgcagagaagtgaagtaaagggcacataaataataagtggcaagttctaagttgcgtgtgtgtgtgtgtgcttgcacatgtgtgcatgcattgaggtgggtaggaagtttttctggaagcatatgagaggcaagggatctggattcgctattaagataaccatcagtctccacgaatcaaataaaaccaggcagcaagcctaataaaaattaagcaatggatcaaaaagatactgactgtgcactacctttctgcctccttctctattcggcttgtgttcctgcaagaagacttatttcatttcactatatatagcacattttgctagatgctatgataggagagggtcaaggggagatagagaacgatgtctcatgtctgtatgtcttatgtctgtatgagcagacatacatacactcatgccatacttgaatcaaggtagaccatgacagatctaccttgattataaaccactatatctctccttatgaagcattatactcaattgttagctcttactgttagagctaacaattgagtataatgcttcataaggagagacatagtgattctagcacctaacacaatgcactatacatagtcagtgcttgataactttgtattgaaatgaaatgagggccaggagtgggagaacatgagcttgttttggggaaggcattgtgggcaagaggggccaagtggttcatgcctctcactccaggcatgctgggcaaagccaggatccactgctgacttctcaggccttatttgcaaggctgctttaaaggtgctttgtgtttgggtttgttttctgacatcattgttcttagcaaccaaggtcagatttttagcttttcctttgactgctaaccatgcccctctgcctaagaaatcccacaggaagcctccaagcttcactttgcctctagacacctggcaaatgactctcccacttccttgccctgtccacagactctgatgctagttgcgggtgccaagatttttttgccccctcctcttcccctgggaccaatcagatttctgagctccagggtagagccacactctcactgatcctctgtccaagtctagaattcccaaagcatggtctgcctcatctgtgctccaggtgcaactgggcaggataaatttctcacacattggtcctgtccttccctgggaagcctggctttcccactcccacttacctaagtcaattctctgctttaaggctgggcgcggttgctcacatgtgtaatcctaggactttgggaagctgagggttgagcccagtagtttgagaccagcctgggcaacatggcgaaaccccatctctgcaaaaaaatacaaaaattagccaggtgtggtggcacacgcctgtagttccacctacttaggaggctgaggtggaaagatctcttgagctgggagattgaggctgcagtgagccatgatcataccactgcactctagcctgggtgacagagtaagaccctgtttcaaaacaaacaaacaaacaaacaaacaaaacaaccaaacaaacaaaccaaaattctctgctttattccccttcatgagaaaagctggcaaggtgaacagactcctctcttgctagcccactgccatctttggataggtcaggcagatagaatcctgagttccagtagattctgccacataattatccagggttcaataatttaagcttacctacctcttatgcaaagaccagagtactgatgaggtaaacttgcagcagaagaaaattaagccaaaagaaagaacttctcaacttaggattctaaagcactgtgacagatacagttctccctaagcctttaggttcaacctcctgcctccagccatgccagacagatgaaggtctctattttcttactgtgggaagttcagattttggcctaaggcctgggtgaaggtgaggatgacagaatgacggagttacttgtttgcaacagagaatgcattcctccccaccctgtcctgccccaacatgtaattgaatatctttccttttgccacccctcaataggcttttgcccttctcttcctaaataaggttattaagttattgacttattcaaataaaagtttgtccaatattcaagagacattaagtatgttctttgggtctgaacacatggtcaatttcaatctttgtgagttttcacagaggcccactaactccctgtgtgaaaaaagtacccagacgtaagtcatatgaagggagttgcatgataaaaagctttctgggggcctggtgtagtggttcatacccgtaatcccaacactttgggaggctgaggtgggaggatcacttgaggccaggagttcaagaccagcctggacaatatagcgagaccctgtctctacaaaaaaatttaaaaagtagccaggcatggtggctcgcacactgtagtcctagctactcaggaggctggggtgagaggatcacttgagcccaggaattcaaggttgtagtgagctatgaactcaccactgcactccagcctgggcaacagagtgagaacctgtttctatgtatttaaaaaaaaaaaaaggccgagcacagtggctcatgcctgcaatcccagcactctggaaagctgaggcgggtggatttcttgaggccagaagttcaagaacaccctagtcaacagtcaacatgacaaaaccccgtctctactaaaaatgcaaaaattagccagacatgatggtgcatgcctgtaattccagctacttagaaggctgaggtgggagaatcacttgaacctgggaggcggaggttgcagtgagctgagatccctccactgcactccagcctgggcgacagagtgagactctgtctcaaacaagcaaacaaaaacacaaaaaaaccttttggacagtgacagtgacattgttatgataaagtacttggtccaaacctgccatacagggctagaaagttctcagcagtcatccatcccaacggttcccaaccctagctgactatcaaaatcatgtaaggagtatgttgaacatataccttccctggggctcatgaaacctactgaatcagaatttctgaggtaaggccccaaagtctgtattttaaacaatcttatcaggtgattctcataataggacaggtttgggaactatttgtctggttgaatcctttggatttttttttttttttttttttttttggatgaggaaaccaggctcagaggggcaggagcctacagcaaagtggccagatgggaaagtaagggcagagcatgtctgccttgcttctcatcatctcctctttgcatagaacacctaatattatgttctctcaccctttctgatcaattacttgtccttccatgtctctagaactgtgagtactttgatggtaggaccatgtcagatccatctctgaggtctccaagtccttgagcttgatccttaaagctaggctcccaacttactaggcaggtatacattcttagaccctatgcctctgtttccagggaccatgggttggggcaggagttggtgtcccccttccttcaaaaagcaaggcaggctgcaaagtttgaagtatgtgaaatatggaggccagttcttgtgccgagggagctggaatgtccagtggcaccaggttacctgaagcttgggctggggctgagtgttgatctcaggggaatttgggcgtcattcccattactatcactgacagcagccttacgtgcagcgataatgacatgctttgaaaaatgcctcaaatgtcagttacccagcattgagacagcccctgagagttgttccttcatgcccgcatctttagctgtgcttatcactctcatagcactgtgtttcaccctgcccaattgtgcagggctgtctggggccttggtcttctgttcttggagccaggataggaagtagaataaaaagatggctgtggaaggcaaggcaggactaaccattcagtagtttgcatttttgtgcgttaagatgagctcgtgccaaactggggagggaagtatgaatgaagcacagactgtcattagacctgggttctaaccttaccactgtcatgttcatttgctgtgtgactgtggactaggcccttactcctctaagcctccatttctgcacctgtgcaatgagtagcttggactcacaacctttctgttctaattgagtgatgctaatttaagagccaagctggagggtcaggggtgggtatctaatgagtgatgctcattccctgccttcattcatcgcatatcttgagtccactcttggaaaacatatgttgttagccccaaaggctcaagatataacctccaaagtaacttgcataatatatttgcaccctgctgtgttggctttgtgctgataacatctcaacacagcctggatccactgtactctggttatgtcaacttctcaaaggcagtcagatgcaattgaagactgcttttcccactggatgtgggtgcctgacaatgtaactaactctgtttttcagggtctcctccctggtcctctcttgttcagctctgcagcatctgtgcgacttctcagtgcattgactcctttagccacacacccctctaagtaggttacctgctggcactggctcagtgccaacaggctgtggtttctctaactgtaaaggccttgattcatcctggttgtgaggaactcttttaagtttggcagctgttttactctgggaatttctcctctgcctaacccttctcccatcaacaagcttccttcacttcttccctcccacctccctcaaaatcccctatggataatgggatgatctttgtcttgcaacagggcactatagacgaccaggatggtccatccttcctccaccactagtgacagcaacaaggctagcttggggaattttagcatcgctcaaagccatgactaataaatagataatttaagcaaaactcatgcacttgctatgctagcaagcatcaaggcaagtcctttagtcacctccttccaaccaaattgctttccctaagccctttctattgagaaattatggaccctccacccccattatatgccccagggcctagcacaagggctggctggcacataatagatgctcaataaatatttgttgaatgaataatggccgaacagatgaagactaaacatacctaaaagctaaaggaaataatgctagctgagtcaggagacctggatcagccactaatccatcttgtgaccttgagcatgttcctctctttgggtctaagtctcttcctctgtagaattttgcactgaactcagtgatcttttaggggtcttccatttctgggagttcataattctgtgatccgtactcttgtaccaaataccacttgccgccaccacccctgctctgccccgccccacccaaagaagtaaaagaaacttccatctagtcatcagatagtattgggatcatgctgatagggaaaagaatataacttggggttttggaccaagccaatatcagagaagccactgcttcccattatgccaatggggattgctgattaggtctcactcctatgacacaaaggcacaacattcaaggtcctccgctccttgcctcctctgccttgtctttgatgtcccatgagaagtatgttgaccagacaatatccccttggctctggtagtggttggagtcagtaagctgttggagatctgggagtcctggtcattgcagaacaaaattcttgtccactgttataagcacataggtcttgattttaaaagtcttatgcagccataaaaatatacacagaccaacctgcctgggattaaagggaactaggcagaaaaccagaaaaggtagagtctctcttagtgggcctttccctttttgtctctctgaattgggtttccatggggatctgtgggtaaaacacatgaactttaaacactttttaaaaaaacttaaaatgacatttaagagacctccaatattggaaatcttttattctctgattcaaaatatgtaaccagtagaaaggtggtttgtttcgtatgtgttcttttagtgtgatgagtcaggctgaagctgggattgggcaatgactatgtgagtatgtggtgaatttcagaggggaagtgctgtttgaggaaaggcaaagcatatttatcagacaaagaatgtatgaagcctaaagcatgtgtttaatactttgagaagctggttactcatacctccctcctccttgacacatacagttaggctccatgatcaaacatcagatttaggctagacaatctttgaggtttgttccagttctgatgttttttctctgactgtgtgagattattcagacttgcaagtgcacttttccaatgaatcccctgtggttactttcaatgttttattccaggcaaggaacaaatgactgtaaagtggctaaacctcagtaggcttggccataaagtgacacggaaaattgatagttagtgatgggccatgaactatgaagtagggtgaaccctttggatcctcaggacccaatagctcaaaaatagatcaagaaggaagtgtgtacatgagggaaaattgcttatagtgatgtgcctatttgcattgaaatgtcatcccttggggggtccccccacctgtcatgggacaaatgtcttatagaagaatgtgacagcaaatgtgccacactgatcagatgcttttggcatacttgaaccttcctggtgttataaataggagggaatgagcctggacttaaatatgtcatgctgtcagaaacagaagggatgtgctaccattaataaggggcttagaggatcctatagttaagagccaaagaagccctctatttcgagaagggaaaagttcaatgactgtccgctatcagagcacaatacgagctaaattactagcagtaggttggtccttgacccctttggatcatagggaaatgatgataatagagttggcaagcccccaaggcgccctccagactggacatgcatggaggctgggtcagccagtttccaccacacttccaattgccagtgtactctcttccttggagcattaccaccacactctcagcagggtggatttgggaagtggcctggaatatggcaggccttccctctcatcctgctgggaatagtcttgtccgttcccgttctaggaaagagaagcagagagatgccaaaggctcaggtacctgttgaatcagagagtgagcagtgagcaacacagaagggtgaaggcctagagcatgtggggacctcaaaggttatctagtaaaatgttttccaaaatgtccattataacccatgaaattaatttagaaggtcacaataagcattttaaaaataatatgcactagaaaatttcagagtttgtcacgcagagtagggataattagttttgtgaaatttgcttgaggtatatataaagattatatatatagttttaaatatatatcagttatatatgtgtacattttacatcacgacacatatgtgatgtatacatatacattattgcatatatagctatacacagatatataaatatacacaggtcgtccttcactgacggtcactgacatagtttcaattgtcctcagcctacagttcactctcctctggacacagtcaagttggttctaaagtatggagccccagaacctcagcagcccttcaaggtatagcctactcagagcagaggaaaacatgactatctcctcatttgttctgaccaagtacattttgaacaattcagttcaagatttccaataaggtagaatctcacaacttggtactcattgaacttacagttgcctaaaactcctaggtatctctcacacatgtcactgctaagccctagctcccttactcccttatcctactgctgtgcaggttgcttttttttttttttagacagggtctcgctctgccacccaggctggagtgcagtggtacgatcttggctcacttccgcctcctgggttcaagctattctcccgcctcagcctcccgagtagctgggattacaggtgccacgcctggctaatttttaaatttttggtagagacggggtgtcgctatgttgaccaggctggtctcgaattcctgacctcaagtgatccacccacctcagcctcccaaagtgctgagattacgggcgtgagccaacatgcctggcagcaggttgctttttaatcctagtacagaaactgtcatttatctttgttagagtttacctttcaccttgactcacctttttaaaatgcatttacacatcccatccatgaccatctctatgcatatttaaatctggtttcattggctcagagggagctgcatttaaaccccacgtagctctctctcagaaggtcatatttattttttttcagactgttcctttaaaaaaactgttattttttatttatttatttatttagaaatagggtctcactatgtttcccatcttggagtgcagtggctattcataggcacaatcccattattgattagcatgggagttttgacctgctccatttctgacctgggcatgttcaccccaccttagacaacccagtggttccccactcctgggaggtcaccataatgattccaaacttagtgcagacacccagtcggcacgaggtgatcttctcgtgcttcccaagtaactgggaccacacgcgtgtgccactgtgcctggcttttaactatttttttattgatacataataattgtacatacttatggggtacttgtgatattttgatatatgcatacaatgtgtaatgatcaaatcagggtaattaggtatccatcacctcaaacatttatcatttcttcctgttggggacagaccattcctttcattgctcatctattatttttctgactaccatgatgcccctattctagccaagccagtgtcctcactgttttctttcctgtactcgagacataattctaccactgggcagactgtaaactagttcaaccattgtggaagtcagtgtggcaattcctcagggatcgagaactagaaataccatttgaccccaccatcccattactgggtatatacccaaaggattataaaacatgctgctataaagacacatgcacacgtatgtttattgtggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaagctggaaatcatcattctcagcaaactatcgcaaggacaaaaaaccaaacatggcatgttctcactcataggtgggaattgaacaatgagaacacatggacacaggaaggggaacatcacacaccagggcctgttgtggggtgcggggaggggggagggatagcattaggagatatacctaatgttaaatgacgagttaatgggtgcagcacaccaacatggcacatgtatacatatatgacaaacctgcacgttgtgcacatgtaccctaaaacttaaaataaaaaaaaaaattctaccgctgggcttttgactacactaagccttcacttatgataccctctttgccataatgtctttcatggcccaacttaagtcattatatcctccatgattctttattcagtagctctagatcatattgatctatcctctgaatttgtaaatttcaactgtatttcttgtgtattgcttcacatttagttttgtataagtgtatgtattcttataaaaaatacatataaatgtcttattatctgcattgttggtgcatggctgactcacacaagtgggcactctaaagccagaatgcctgggttcaaattcagatgtacaattctataatttagtagttgcatgtacttgtgcaaattacttaatctctgtatgtctcagtttcttcaaaatcaggataacatagtatgtgttgcataggtttgcttagtgtttaaatgaattgatatatctgaagtacttgaaacagtccctgacacatataaacactcaataaatattaactataattatgattaaatactatacgctttcatatattttatctcggggaaagttagagcagggattgtcatccctgttttatggatgagtaactaaagtttgaaaggttaagtgacagtgtaagattatataagtgagctgtctcagggtcattaggggattaactataaagtagaaaatactaaaggccataagagagggaagcaaaagacccttaggaatttagaagctcttctggctggggtgggtaggaaaggcttgctgatgtccatgaagaagcaatgaagaatgtgcaggatagggtcagccttggtaagtgtccatccagccattttaggcagagagggctcaagtggagtaaggggtagtggaggaggtagggtgtggctcctcctacattttgcttccggtatagagggcatggtcagaggccagaggagaaaaaaatctgaagaggagacatctgggcatggcagccatgtggggagcagtcagtagtagttctgtggtatgtgcaggagtatagtgtgtgggagagagaggagagcctgcagtggcaagacaaggctttggacctgtgttccaaaatacctattcacaaagtccatgaatatttggctactgctctgggcccttagaatccttgattgattagctcaggcaactttatcagattaaccagctgacctctttgaatggcacccactgttcactcagttgtgttaggctgtggggaactgaagagaaggaagaagcaaggtctctttcccaaggaagtcccagtctaggtaattgactatagttgattacgtgtgagttatggttgttgcacgaataaattattatttcatggattgtgttctaattcataagtagggctatcagggagagacaagaagtagataaagaaactgccaggtggcaggagggcactggctggggaaaagaaagtgcagagaagggaggctaagagttggattgaaggtgggagaagacattttgcttccttgcgattgggcagctagccattcttaaagtccagtgtgtgggccaagattcttggccaggcccgagcttggaaaatggtgaattgaaatatgagtttccatgtacctttctaccttagttccctgggtcttcatctgcccaggggagataaaaagaatgaataagagagcagttgaggtgatttcaactccatgggatgctgctacagacacacttgagctgtcattattatgggatgggaaaactggatgtaaattaagattattatcacctgtgcaacgacaacaacaacaacaacaaccactactactactactaagaataataataaactcatgtgatgctgccagcattctaaagagcctacctttgggtactgcccctgcttcatgggctcaaaattgaggagaaactgaagactgtttgcatgcctttcaatcttggatctgcatagacaattccttaggaccagcccttgctagtgagctgggttagaaatgctctttgcactcccctgctagccaagccttgtctgtgcaaagccaccgggtcccttctgtccggtaaatttctagaatgttaaagtacttggaaggacccttacaggccatcaagtctgactcctttgttatactgatagagacatgagggttcagagagaaacagggacgtgactagggtcacacagtaatgcagtggcagaaatggccctaatccagctggccctcccagctgataggccagtgtgcactttccatagtatccatctctctctacttcctatccttctatctccaccaatttcagtcacttgagttgttactggtatttctcagccccagtagcccatcaaaatcctctggggagcttaaaaaaatactgatgtcctggccccaccccagaccaaccgaatcgttgtctctgaggaatggagtgattttttttattatactttaagttctagggtacatgtgcacaatgtgcaggtttgttacatatgtatacatgtccatcaatgatggagtgatatttttaaaagctctctaggtgattctaatgtacagtcaagatcaaggatcactgctcaggagaaaattagcctcatgtctatgaggagacctaaaggacagactcccagtgaagcagacttcccagcctccattgactttgggccactctgcacctcagtaggtccccaaaccctggtatgtggaggacgtaggattctgaaagtatgaatttcagggtcaccaatgctgtccttgagctccattgaccctcttgtcattgcctttcccctcatgctagatcagaagtattttatttccagactttttactttttctttacccatcacgaaggcctctgaggagactgcctgcctccagtaggcacaaacaatttgtcccagcttctgactttttggggagacacacacacacaaggaatgtctcttctttggctccttccgaggggcttgtactgagtatctagaaccacccgccagcctccattccatctacttgccattcccacacatagagcttgcttcccaagaaccagactttgagggacagccagcacaaagcagagagaagggaggcactgggcaccgggacccctaatgctgttcagcattttgcctcttgtcttgctggctatgggcccatagttaatttataaacttgacttgcccagggataagtaagtacagatgtgtatctttttccacaccaccagtggtctttcttttttcagaaaataggattcactgaaatattccacaaaactaaacattagtgatactaaagaaacaaaacatcctcttcaacacattacataaacctgccctcaaataatcaggctagaagggattatcaataatgtttggcaatatatagtcactttgcttttttaagtggcctccccctcatcctagctttattggagcataattgacaattaaaattgtatatatttaagttatacaatgtgatgattttatatacatatacagtctgaaatttaccacaaccaagttaattaacacatccatcacctcaaatagttagtattgttttggtgtggcgtaaacacttaagatttactttttctttttgagtcagagtttcgctcttgttgcccaggctggagtgcaatggcgtgatctcagttcactgcaacctccacctccttggttcaagcgattctcctgcctcagcctcccgagtacctgggattacaggcatgcaccaccacacctggctaattttgtatttttagtagagacggggtttctccatgttggtcaggctggtcttgaactcccgacctcaggtgatccacccgcctctgcctcccaaagtgctgggattacaggcatgagccaccgtgcctggcaagatttacacttaacaaatttcaagtacataatatactgctattaactacagtcaccatgctgtacattagatctccagaacttgtttcataactgaaattttgtaccctttatccaatatttccccattccccacaaccaccagccttcagtaaccaccattctaaactctgcttctatgagttcaactttgttagattttacacataagtgagatcatacagtatttgtggtcgtttgatgccctcccttggtaagatttttaatcttccctctacctctttccatctatgactcagtgttcaggaatttgcttgttaaatctcctggattggtgttgtgtgggctttaaaatgtaaaatcaaagttagagcaataaagaaatccctttgggccagtgttgtgaaagaataacttattctattcagtgcagtgggtggtggatggactagagtgcccagaaagcccagctggatccccttaagccagttatagacctctgctctggcgtttacctgtaactgagccatgactccgatcttgatcaaccatgttatttagcagggtgtggtggtcctcagcatatatatatatatatctcacaagtgttcactgcctcctatcaaggctagaaggtgagcggtatcctgggaagaagaggctgaggccagtgcccccccaggggctggagttgagttgaagtcatggctgtcagcagatagaaatgtcaactagtggtggcctccagtggaaacatcttgcagggagagactgtaccccagccagtccctggagttttggaagacaaaacactcactgaaggacagagtttgagttccccctccccactggggctctgccacttagaactgtgtgactgtgggcaagtggcttagatacattctgttttctcagtcatcaagcaggtatacttaatacctatcagtgcagttgtgtgtagtaatgcaggttaagtatataaaggggaggtgctcaagaaatgttagtttcccaacctttccctctcctatcctagtcccaatagtcacacccactgttggaagaaaacaattgcatctgacactctctccaactcctacctcacctccttggccattctccagactcgggtgattaagaagatagaaaagataaggaatgtctggagcacataagggtccatacattcagggtaactgcaagggcttctggagtataatgactttggtcaacaactagcatgggtggcatgagcatgttagcccataacagaacaagtactgggatgtcagggccgtggaaggaaagagccaagactcaaggtggtctgacttcaatgcatcaagcagaggcttgctggtccctgtcctcttctgttctgctttttaaagactaaaggtccctgtgggtatggagaaagcagctgcatctgagaaaataagtaatacagtagaagctaaagatggagttctgtggcacccatgagaatgttcctggaagacttccaactacggggagcataattgaccaagggtcttggctgctgcactctgaaatcgtcccagcatttgtgctgaggtcacacctgctacatggccaagatactaaggtgggcctgttcttgggagacacagaaatcctctgattgccaactgaccaccaactgaccttggtttcatgaatccatgatggtgttgccaaaccttccttagagtgcagggcagactaggaagcttccacccaaccttccctcatcctctctttcactcagggtcagacttacattgcagtctcacgtcttccctagctttctcagacttcctccctatctgctgtcatttctcttaataaatccctgcatatgcaatcccattttattgcctacttctctgaggtcccagactaacacaaattctgaccaacatgaaatcaaatgtattggcctagagcctggcctgtacccagggtctagccttgggccacttttagaaaacattcagcaggttttttgtttgttttttgagacggagtcttgctctgtcgcccaggctggagtgcagtggtgcgatctcggctcactgcaagctccacctcccaggttcatgccattctcctgcctcagcctcctgagtagctgggactacaggcgcccaccaccaagcccagctagttcttttgtatttttagtagaaatggggtttcaccgtgttagccaggatggtcttgatctcctgacctcgtgatccacctgcctcggcctcccaaagtgctaggattacaggtgtgagccactgtgcccggccaacattcagcaggtttctaaacattggagaagtatccctaaagtttgaaaagacttcgggagtgatataaatttattgccctgctttactctgaatgaatatctcagacaaataagtttcttttatttaatgttccaactcagtgtcttatatgccttcttatggaagatgtttctttaatctaactatagtatttcccaggaagctctcattttctcctgtcctccattttggactgagagtcagagaaatctagctccaggtttgccagtgacaaacagtgtcatattggacaagtccttgtactctctgtaaccttctctttctgaacctcagctcttattttttgtgactaccactttttctgtttcctcagttccattcctcagaaccagtgttcaagttctcctaaaagatattggtgtgttagaaaaggagagaaagggagagagagagagtgtgtgtgtgtgtgtgtgtgtgcacgcgtgcatgtgtgtctgtctgtgaaaaagagggaaagagggagagggagaggaagaattggagagaaggagagaagcagagggagagagagggtgaaagaaagacatctctgtgcagcttatttccagctctgcttggcggttccctcacacgcagtgctaggcaacacacatggtgacctacttttgcaagaaggctctattttggagttacagtcttctttaccttcctcctttgcctgggatggctctgccactaaacagcagatacagatgtaaggaacagaggattggtggctctggtatcattaccaaattttaaaaattgtaaggatgaaaggcattccagctcttagctttgtgttaccagaaaccactccagagatttgaaactgaatcacttacaactcctcctaggaggaattcaggcttaatcccatctccatccccatctagagaggccaggatgctttgtcccaagcccctgaatccctcaaatctgaccctgtcccctgctgtggccaccactctctcctatttcattggagtgtctcctcctgagcctttcagcccagtccaggccagctccttaatagctgccccttcccgtgaactccctcttcctgcctcctcttccctccagtggcagaaaccccacctctgttggcccagtgtctttgaagagagtcctgagatgcccctcggagtttgggtagagcccttgcaggcatccagagaacaactggaatcaaggccctttgtgctttctggttcccaagcgcctttggggcttgaggttctcttcattagtggtggatctgaagtgtttgtttctcgagtagcctgactgctagtgtttcacccagagtttttggttatagtttggtgtttgtttgtttgtttttgagatggagtctcgccctgtcacccaggctggagtgcaatggcatgatcatgtctcactgcaacctccacctcctggattcaaatgattctcctgcctcagcctcccgagtagctgggattacaggcacctgccaccatgcccagctaatttttgtattttcagtagagacggggtttcaacatgttggccgggctggtcttaaactcctgacctcgtgatccgcccatctcagcctcccaaagtgctgggattacaggcgtgagccactgcacccggcaggtttggtgttcttaacccagcatctcacaacttctgtactgagccttctatggatctttgaaaaatgggcttctccagaaggtagggggaactttcacagccctgggagaccatgaccaaagggaaacatgactgaatgggacagaggagtaattgtgcttaggactagtttagcagaaattcattagggggctcaagacatctgtgaaaaaactgaagcaaaatcccataaaaatagaaggccttcagaaacactgcccacagactcaacaaagggatctggcctgagaagcccaaaacacttgggccaccaacttctgcttctttcttgtgagaccacatgcaggtctcttcatctctttgtggctcaatttacccacttataaaatgagggacctggactctatcttttaggatagtgaaaaagtagctagcctgggaaagaagagatatacacaactctagagattcttcagatttttccagggactactgcagagggagaggatggatggggacaaaagaaatgagaaaaaaaaaatcggtggagtttccagtaggctgacaagtgcctccatcacatcagagcattcctgcttttatattatttatgcaatgtacttcagtgtaaaattgcaattggaaaggaaagggggttccatggatttaggaaggttttaactttctaacttctagctgcaagtgagtctgaaaaagtaagaatgtagtttttatagcttttgtaatgatggtagaaacagagaagagggttgaaaataagaatattgagttagttcaacagcatccactatgattaatattttttgctctaaatttgattactttttagagcttattaatgcataactgatgtacaataaactgcacatatttaaagtacattatttggtcaattttttttttttgagatggagtctcactttgtcacccaggctggagtgcagtggcacgatctcggctcactgcaaactcctcctcccgggttcatgccattctcctgcctcagcctcccgagtagctgggactacaggcgcctgccaccatacccggctaatttttttgtatttttagtagagacagggtttcaccgtattagccaggatggtgttgatctcctgacctcgtgatccacccgcctctgtgtcccagagtgctgggattacaggcgtgagccaccgtgcccggcctatttggtcaattttgacaaatgtgtacattcatgaaatcattgcagtaatctagataatgagcatgtacatcatcctcaaaagtttcttcatgccctgttttagttcatccctccctccaccaccatcgtctggcaactactgctctgctttctgtaactatagattaattggcatttttagaattatttatatgtggaattatacagtatttactctttttgtctagagatttttcacttagcataattattttgagattcagaataaggtgtgtatcaatattttattcctttgtattgctaaatagtattacattgtgttgataacacagtttgtcatatctaattacctgttgatgggcagttgggttgtttacagtttggggctgtcaaataaagctgttctgaacatttatgtacaagttgtttacaagtacttttaaaatttaactaatgacttccattttcaaaatgtttccagcagaaactgacttgggaaatgttgcatttgtgtgtctctttgtactcaagctattttttggcagtttttgttgttgttgatattttatatcctttgatgttattacacattgttgatcctacagttgcacctccccaagcattgtgaataggtttctgaaagcctttgtaggaagaatttcagttgaataatttaagacttgtataaggagttttcttgagggggactgagaggcaaaagcccttgtaaatattttatatttactaaaacaaaccactaaatataataccaaataaagatggtattaatttccttttaaacccactggcctagacaaaggctagagtcttcacccagctaggggagactggaagtccataagtgggcaagagacacaaccctaaaatattcagtttcagacctaggctaggtgcagtggctcatgcctgtaatcccagcactttgggaggaggctgagcggggaggatcacttgaggccaggaatttgagaccagtgtgggcaacatagcaagatctcatctctacaaaacaacaacaacaaaaaacttgaggccaggagtttgagaccagcctgggcaacatagcaagatcccatctcaataacagcaacaacaacaacaacaacaacaaacagacctattgctcctccatggagccagggaacatggcaacacagaggactcccatctccagtactaggccagcctatggccagcaaacagctgttgtttcaggaaaggggttcagagagaaattgcatggtgtgaaaaactgttaatgaaacaggatatgagatccatctcatgtcttccttccagtactccccaaggaaatggccatacttgtatttcactcttattttattttacatttccttaataaaattttaaaaggtttcatgaggctatatggaaacgaaggatgactcttcaggccatgaggagagtgtggcatgagattttgccgcagtatggaaaggagaagcctggaatggggaaccaagcacaaaaactttgtcctgggagttcctgcaggtgtccttgagaatgaactatggcagagaaaggcaggggcagaacccttcagagagcattgactcatcagctgctacaacctgatgagccgatcaggttcttgctgctcttgcccacccttcagactctttccctgagcctcaaagccagcttgaacaatatttcactcttctaggctgcctggggagttgggagtggtgctcagcccattttgtgggggttggagactgtttgtgcaccagggcagtccccactagaaggcaggaaagagctggagagggttggagagattcccagtaagaagcatgctgcaattttctttcacaaccaacccccatattggggtgacaattccagggaaatgggatgcattgttctctacttgctgctagcctctgggccatgaacaaagtagtaaattggccctgtgagggaggggacagaagggggaggtggtggaggatatggggaccagaagcccctggggctgactgatctgcttacaaacatcagaacttcccctccgtgaccctcccagcccccagggaatgagaactgttttgctctcctagatcagaaagaacaagatgtccttatctggtgggagagggctggtcaataccacctccaaggagagaagagaaaggacccaagagaactgcaagcccagcaggaagcatcattcttggggaaagcctagaaagaagcaggcaggctccatcccaggcccacagggtttcaggagtccggatgggcggtggattcagactccatactctcccaccagtgcttcaaagccctggtgcttgtggctggtgttaattttttacttttattgtctttatgagctttttctaaacctggcttctaaaaagctatgaaagccaaacagcttttcaggctacagcattctccaccccctttcctgactccctacttaccattcctctgacctttcttgagcacctactttactgtgggagaacagccatccctcagtatatgtgggagattagttccaggaccccttgcagacaccaaaatccacagatgctcatgtctcatgtcctttacaaaaattagtgtagtatttgcatataacctatatacatcctctcataaactttaggtcactctagattacttatgatacctaatacaatgtaaatgctatgcaaatagttgttatactatattgtttaaggagtaatgacaaaaaaagtctgtacatgtttagcacagacacagtcatccattttttttcaaacattttcgatctgctgttggttgaacccactgatgcagaacccactgataaggaggcaaaagattctgtgtagggtctgctgcaaacccatgcttcttccagggctctcagtctctgttactttcctcaccaaaaagttgcccttttgtgtatggtaaaaacaacgttgtccttccctgaattaatttaccaaccttggtctagaagcccatgtctttgtcacaatactcaatatttagtgatgtggccctagagaggttttagactttcagtcaaggttctgatatttttggtctgattctgccaacccagatcattttatggccacagaaccaaatggagctagatgctttcctggcacaattggtgagttttgttcaattcaacaaacctttcttgagcaccatgtcaccatatgcccagatagctctctgccagagagagaggtataaagccctttaagggcccgcccctcccctccatcttcctgcctttttctaccttgctgcacttcttctgcccatacaggctcagctccatctagagaaagctaagctggaaagtggtaaggggccttagatataatcttttcagaacccctcatgatatagacagagaaagcaagacccagaagagtaagaaacttgacctaggctacacagcagattagcagtagggtttggagttggggtctaaggctaagggggggcttctaaaacaaagagaatatcccaggttagtatgtgcattggggtggatgtgggaacatgtgaaaagccggtcaagaccaataacctagactttgtggccacatctaggattggtttgaaggttaccttgtaggcccctagcactcccgcccaaagtatgtctcagaaacagaaatggcacctctgggtaattcttttggagcttgaaggctgtgcacatttaattttccaaaaataaaatcctagtataggcaaagccttgtaggaacaaagccctgagggaggcagctcagaaaagacaattaagaaaaccccagagagcctttgtaactacatagtacaaaaaattctaccagtttaaaaaagatattcttgcctccttccatatattccacagactgattgttgtcaggcatgctccatgacatagaaatctgactttgtcagtccccctcccagaaaccactcatgaatcacatagtcctggtgagattagatccaaactcctggccatgccattcaagttcctgggcaactttcccaggatcatcttttcccacccaactcttacctaaaccacccacacataccttcttcattcacaccatatcattcacatttcaagcctccaaaccactgttcatgctgttccatcagcttgagatacctttctctactttttgattattagattatccttcagggctcaactcaaagatcaccctctattctgttaaacttttaaaaaaatagctttattgagacaaaatttatttgccacacaattaacccaactaaagtacacaattcaatggtttttagtaaattcacagaattgtgtaaccattaccacgatcaattttagaacattgtcatcacctggaaagaaacatgtacgctttaggcatccctaccaccaaaatctccccatcaccccctcgcagaccttggcaaatactaatccactttctgtttctataaatgtgtatgctctagacatttcatattagtggaattatataatatatggtcttttgactggcttttcttcacttagcataatgttttcaaggttcttctatatcatagcatgtattagcaacaaatttctttttatggctgaataatagccattgtatggataaactgtaccacattttgtttatgcacttacaaattcatggacatttcagttgtttctactttttggctattatgagtaatgctgctatgagaagtccagtacaagtttttaaattagatgtacatttttatttgtcttggttatatacctaacagcagaattgttggatgatatggtacaattttaaaaaaatatttaatttaatttttatgtgtacataatagttgcactatttatggggtacatgtgatattttgacataagcatacaatcttataatgatcaaatcaaggtaactgggatatccatcaccttaaacatttatcatttctttatgttaagaacattctatttccattcttctagttatttggaaatacacaattttttgtaactataggcaccctattgtgctaccaaaaactagatcttattccttctatctaactatatttttgtaaccattagccaacccttctttatcccccactccccattacccttcccagcctctggtaaccatcattctaccctttaccttcatgagaccaatcaacctttttagctcctatatatgaataagaacatgcaacatttctgtgcttggcttattacacttaatataatgactttcagttctactcacgttgttgcaagtgacaggatttcattcttttttatgcctgaataatattccattgagtatatgttatcacatttcctttatccattcacctgttgatgggtacttaggttgattccatgtcttagctattgcatatagtgctgcaacaaacatgggagtgcagatatctcttggatatactgagttttcttcttttggatatatacccagcagtgggaatgctggatcatatggtggtaacttgatgtttaatattttaaggaactgccaaaatgttttccaaaacagctaacccattttacattcctacaaacaacacatgaagatttcaatttctgtacatcctcaccaacacttattttttgtattttttttatagctattctagtggttgtgaagtggtatctccttttggtttttatttgcagttccttgacgactaaagatattaggtatcttttcatgtgttcattggccatttgtatatcttctttaaagaaatgtctattgaaactcttggcctgctttttgtttttaaagacgattttagggcagttttagatttgtagcaaagttgagcagaaagtgcagacatttcccatataccccctaccccccagcatgcacagcacctccactattaactccttcaccagaatagtacttttattataattgatgaacctacattgacacatcattattacccaaagttcataatttacattaggttcactcttggtgtacattctataagttttgtcaaatacataataacatgtgtctaccattatagtatcatacagaatagttccactgctctaaaaattccctgtgctttacctattcatctcaccatccccctggcaaccactgatccttttactgtctccatagttttgctttttccagaatatcatctgattggaatcacacagtatggagccttttcagattggtgtctttcacttaataatatgcacttaagattcctccatgtgttttcatggcctgatagccaatttcttttgagtgctgaacaatactccactgtccagatgtaccagagcttatccattcacctaccgaaggaaatcttggttgcttccaagttttggcaattatgaataaaactgctataaacaataatgtgcagggtttttttgtgtgtggacataggtttttgacccacttgggtaaataccaaggagcacaattgctggattgtaccataagagcatgtttagttttataagaaactgccagactgtcctccaaagtgggtgtaccattttgcattcccaccagcactaaatgagagttcctgttgcttcacatcatcaccagcatttggtgttgtcagtgttttggattttggttattctaataggtgtgtagtggtatctcattgtttccatctgcaattccctcatgacatatgatattgagcatcttttcatatgcacattcaccatacatatatattttctggtgaggtgttcatttagatttgcctttaaaaatatcaagttatgccaggcgcggtggctaacacctgtaatcccagcactttgggaggccgaggcgggcagatcaggagatcgagatcatcctggctaacacagtgaaaccccgtctctactaaaaatacaaaaaattagccgggtgtggtggcggctacctgtagtcccagctactagggaggctgaggtaggagaatggcgtgaacccaggaggcggagcttgcagtgagccaagatggcgccactgcactccagcctgggctacagagcgagactccgtctcaaaaaaaaaaaatcaagttatttattttctttttgttgaattttaagagttctttgtatatattattaacaattctttatcagatatgtcatttgcaagtattttctcccaatcttctcattcacttgatagtgtctttcacagagcagagattcttaattttaattaagtccagtttacaaattatatcttttatggattgtgcctttgttgttatacataaacaattaccacccaaggtcattgaaatttgcttttatattatcttctaggaattttagagttttgcattttacatttaggtctatgattagttttgtgtgaatttttgtgaagggtgtaagctctgtgttgttactgttattttaggattaggaatgaaagacagttattataatcctgggacctcatttctctgatggctctaagaacagtggtttatttttcagtttgtttagctttttatttgttgttaggacagagtgataacttccaagctctttacatgccagactggaaaacctttgcccatttgtcaatgttatttgtctttttattgttgaattattaaagttttaaatatatattctggatactcaacccttatcagataaatgatttgaaaatattttctctcattctgtgtgttatcttttcactatcttactggtgccccttgaagcacaagtttttcattgttttattgtggtgaaatatacagaacataaaatttataattttaaccattttaagtgtacatttcagtggcactaagtacatttatgttcttgtgcaactatcaccaccatccatctccagtactttttcatcttcccaaactgaaactctgtgtctattaaacattttctcttcttctcagtccttggcaaccaccattctactttctgtccctaaggatttgatgactctaggtacatcaagtaaatggaatcacacagtatttacttgtctttttgtaactggcttatttcacttagcataatgtcttccaggttcacctatgttgtagcatgtgtcagaatttccttcctttttaagggtgaataatatttcattgtatatacacacatacatacatacatgcatatacatatacattttgtttatccaatcatccatcaatggacatttgggttgttcccaccttttggctattgtgaatgatgcttctctgaactttaggggacaaatatctgtttgagtccctgatttcaattattttgggtatatacccagaaatatgtttttaatttttatgaactccaatttatctagtgtttttttgttgcttgtgcttttaaaattatttctaaaaactattgcctattctatttacttctatgctttcttctaagacttctatatttttaattcttatatgtaggtatgtacttcattttgagctaatttctatatatggtgtcatgtaggaattcagcttcattcttttgtatgtgaatatctagttgactcatcaccatttgctgaaaagactattttatctatattgaattatcttggcaaccttgctattaatcaattcacaggaaatataaaggggtttttaaatggactctcaattttgtttcattaatctgtacgttcattcttatgcaagtaccacacggtttttattactgtacctttgtagtagatgtgaaattaggaagtgtgaatctcccaactttgttgttcatttttcttctttcttctttttttttaaaaagacatttattcagcatcataatcagactattacatttagcaatcaacagcatgggtgcaaaaaaaaaaaacaacctacattaaaacccttcgttggaatgctttacactttccacagaacagaagctaaaataatccgttatacaattagtcacaaatacagtcctcgagtttttttcccatacatatgagtatttgtctaaaacatgtctgctttgtagcagctaggccctgccaccactgtgctttgctaaattcacaaatctgttgtaacctgtagcttccctgccacttctctggctctccgctcctgctaaggtttgtttcctaattaaaatcttctgccactgccacagctactgctactactggaaccatcatagccaccttggttttgtggtttggcaaagaattggcctccaccaccataggggccagagcttctgactccaaagtttcatgggtccataatttgaagactgattgttgtaactgccaaaatcattgtagcttccaccacctccaaaattgcttccatcattaccaaatccattatagccatccccaccgccaccataaccaccaccaccatgactgccaccaaagccaccatgacaactgaagcttcctccacgaccaccacctccatgaccatgatcaaagtttccagaaccacttccacctctggctggatgaggcaatggccaactcttgctttgacagggctttcctaacttcacagttgtggtcattcacactatggtatttctgaatgacagtcttatccatggagtcatggttgtcaaaggttacaaaggcaaaatcccttttcttaccactgcctcagtcggtcatgatttcaattacttcaatttttccatactattcaaaataatctcttagttgatgttcttcagtgtcttctttaatgccaccaacaaatatctttttcaaagttaagtgggcacctggtctttgagaatcttctcttgagacagctctctttggttccacaactcttccatccaccttgtgtggccttgcattcatggctgcatccatctcccccacggtgtcatatgtgacaaatccaaagcccctggagggcttggtgtttggatcactcattaccacacagtctgtgagcattccccattgtttaaaatgactcaaccattttgagccattttcaggttgtttcaaagctcaacccttcaatgaagagcttcctcagctgttcgggccctttaggagatgctgacttagacacgatggcagagtgaagacagactttaatgacgcttcctcagcagtgtccatgggcagaaagctgttgttcatttttcaagattctttttgctattctagttctcttgcattttcatacacatcttaggatcagtttgtcaatttctgcaaagaaaatgcagccagggtttttatagggatattgttgaatctgtaggtaaatttacagagattgccatcttaataatattaagtgttctgatccatgaaaatggaatgtttccaattatttagatatttttaatttcctccgacaatattttgtagctttcagagtataagttttatactccttttgttaaatttattcctaagtagtatatactttttgatgcttttgtaaatggaattgttttaattttatttgaagattgtttattgctagtatatagaaatgtaattcatctttgtatattgattttctatcttgtaacattgctaaactaagttattagttctagcaggtttttttgcagattccttagtgtttttttttttttattatactttaagttttagggtacatgtgcacaacgtgcaggtttgttacatatatatatgtgtgccatgttggtgtgctgcacccattaactcgtcatttaacattaggtatatctcctaatgctatccttcccccctcctcccaccccacaacaggccctggtgtgtgatgttccccttcctgtgtccatgtgttctcattgttcaattcccacctacgagtgagaacatgccgtgtttggttttttgtccttgcgatagtttgctgagaatgatggttttcagcttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaccatacgtgtgcatgtgtctttatagcagcatgatttataatcctttgggtatatacccagtaatgggatggctgggtcaaatggtatttctggttctagatccctgaggaatcgccacactgacttccacaatagttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgtcttttggctgcataaatgtcttcttttgagaagtgtctgttcatatccttcgcccgcttgttgatggagttgtttgtttttttcttgtaaatttgtttgagttcattgtagattctggatattagccctttgtcagatgagtaggttgcaaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctgtgtcctgaatggtattgcctaggttttcttctaggatttttatggttttaggtctaacatttaaatctttaatccatcttgaattaattttagtataaggtgtaaggaagggatccagtttcagctttccacatatggctaggcagttttcccagcaccatttattaaatagggaatcctttccccattgcttgtttttctcaggtttgtcaaagatcaggtagttgtagatatgtggcattatttctgaggcctctgctctgtaccattggtctatatctctgttttggtaccagtaccatgctgttttggttactgtagccctgtagtatagtttgaagtcaggtagcgtgatgcctccagctttgctcttttggcttaggattgacttggcaatgtgggctcttttttggttccatatgaactttaaagtagttttttccaattctgtgaagaaagtcattggtagcttgatggggatggcattgaatctataaattaccttgggcagtatggccattttcacaatattgattcttcctacccatgagcatggaatgttcttccatttgtttgtatcctctttcatttcatcaagcagtggtttgtagttctccttgaagaggtccttcacatcccttgtaagttggattcctaggtattttattctctttgaagcaattgtgaatgggagttcactcctgatttggctttctgtctgttattggtgtataagaatgcttgtgatttttgtacattgattttgtatcctgagactttgctgaagttgcttatgagcttaaggagattttggtctgagacaatgggattttctagatacacaatcatgtcatctgcaaacagggacagtttgacttcctcttttcctaactgaataccctttatttttttctcctgcctgatagccctggccagaacttccaacactatgttgaatagcagtggtgagagagggcatccctgtcttgtgccagttttcaaagggaatgcttccagtttttgtccattcagtatgatattggctgtgggtttgtcataaatagctcttattattttgagatacatcccatcaatacctaatttcttgagagtttttagcatgaagggctgttgaattttgtcaaaggccttttctgcatctaatgagataatcatgtggtttttgtcattggttctgtttatatgctggattacgtttattgatttttgtatgttgaaccagccttgcatcccagggatgaagcccacttgatcatgatggataagctttttgatgtgctgctggatttggtttgccagtattttattgaggatttttgcatcgatgttcatcaaggatattggtctaaaattctctttttttgttgtgtctctgccaggctttggtatcagaatgatgctggcctcataaaatgagttcgggaggattccctctttttctattgattggaatagtttcagaaggaatggtaccagctcctccttgtacctctggtagaattcggctgtgaatccatctggtcttggacttttttttggttggtaagctattaattattgcctcattttcagagcctgttattggtctattcagatattccagttcttcctggtttagtcttgggagggtgtatgtgtcaaagaatttacccatttcttctagattttctagtttatctgtgtagaggtgtttatagtattctctgatggtagtttgtatttctgtgggatcggtggtgatatcccctttatcatttttttattgcatctatttgattcttctctcttttcttctttattagtctagctagcggtctatccattttgttgatcttttcaaaaaaccagctcctggattcattgatttttttaaggggtttttgtgtctctatctccttcagttctgctctgatcttagttatatcttgccttctgctagcttttgaatgtgtttgctcttgcttctctagttcttttaattgtgattttagggtgtcaatttgagatctttcctgctttctcttgtgggcagttagtgctataaatttccctctacacactgctttaaatgtttcccagagattctggtatgttgtatctttgttctcattggtttccaagaacatctttatttctgccttcatttcgttatgtacccagtagtcattcaggagcaggttgttcagtttccatgtagttgagtggttttgagtgagtttctcagtcctgagttctagtttgattgcactgtggtctgagaggcagtttgttatagttacaatttctgttcttttacatttgctgaggagtgctttacttcaaagtatgtggtcaattttggaataggtgtggtgtggtgctgaaaagaacgcatattctgttgatttgggttggagagttctgtagatgtctattaggtctgcttggtgcagagctgagatcagttcctggatatcctcattaactttctgtctcattgatctatctaaggttgacagtggggtgttaaagtctccccttgttattgtgtgggagtctaagtctctttgtaggtctctaaggacttgctttatgaatctgggtgctcctgtattgggtgcatatatatttaggatagttagctcttcttgttgaattgatgcctttaccattatgtaatggccttctttgtctcttttgatctttgttggtttaaagtctgttttatcagagaccaggattgcaacccctgccttttttttgttttccatttgcttggtagatcttcctccatccctttattttgagtctatgtgtgtctctgcacatgagatgggtttcctgaatacagcacactgatgactctttatccaatttgccagtctatgccttttaattgggagcatttagcccatttgcatttaaagttaatattgttatgtgtaaatctgatcctgtcattatgatgttagctggttattttgcttgttagttgatgcagtttcttcctagcctcgatggtctttacaatttggcatgtttttgcagtggctggtaccggtcgttcctttccatgttgagtgcttccttcaggagctcttttagggcaggcctggtggtgacaaaatctctcagcatttgcttgtctgtaaaggattttatttctccttcacttatgaagcttagtttggctggatatgaaattctgggttgaaaattcttttctttaagaatgttgaatattggtccccaactctcctctggcttgtagagtttctgccgatagatctgctgttagtctgatgggcttctctttgtgggtaacccgacctttctctctggctgcccttaacattttttccttcatttcaactttggtgaatctgacaattatgtgtcttggagttgctcttctcgaggagtatctttgtggcgttctctgtatttcctgaatgtgaatgttggcctgccttgctagattcaggaagttctcctggataatatccggcagagtgttttccaacttggttccattctccccgtcactttcaggtacaccaatcagatgtagatttggtcttttcacatagtcccatatttcttggaggctttgttcatttctttttattcttttttctctaaacttttcttctcgcttcatttcattcatttgatcttccatcactgataccctttcttccagttgatcgaattggctactgaggcttgtgcattcatcatgtagttctcatgccatggttttcagctccatcaggtcctttaaggacttctcagcattggttattctagttagcctttcatctaatcttttttcaaggtttttaacttctttgccatgggtttgaacttcctcctttagctcggagtagtttgatcttctgaaggcttcttctctcaactcgtcaaagtcattctccctccagctttgttccattgctggtgaggaggtgcattccttcggaggaagagaggcgctctgatttttagaattttcagtttttctgctctgttttttccccatgtttgtggttttatctacctttggtctttgatgatggtgatgtacagatggggttttggtgtggatgtcctttctgtttgttagttttccttctaacagtcaggaccctcagctgcaggtgggttggagtttgccggaggtccactccagaccctgtttgcctgggtatcagcagcagaggctgcagaacaatggatattggtgaacagcaaatgttgctgcctgatcgttcctctggaagttttgtctcagaagagtacccagccgtgtgagttgtcagtctacccctactgggggttgcctcctagttaggctacttgggcatcagggacccccctgaggatgcagtctgtccattctcagatctcaagctgcatgctgggagaaccactactctcttcaaagctgtcagatagggacatttaagtctgcaggatttctgctgccttttgtttggctatgccctgcccccagaggtggagtctacagaggcaggcaggcctccttgagctgcagtgggctccacccagtttgagcttcctggccgctttgtttacctactcaagcctcagcaatgttgggcgtccctcccacagcctcactgctgccttgcagttcaatctcagactgctgtgctagcaatgaatgaggctccatgggcctaggaccctcccagccatgcacgggatataatctcctggtgtgctgtttgctaaggccattggaaaagtgcagtattagggtgttagtgacccgattttccaggtgccatccgttacccctttccttggctgggaaaggaaattccctgaccccttgcacttcttgcatgaggcaaagcctcgcccggctttggctcaggctcagtgcactgcacccactgtcctgcacccactgtctgacaatccccagtgagatgcacccagtacctcagttggaaatgcagaaatcattaatcttctacatcactcacactgggagctgtagactggagttgttcctattcatccatcttggctccaccctcaagaaaaagtcagtattttctatataaaagatcatgtcatctacaaatagaggtagttttattttttccttttccaatctggatgccttttatttccttttcttgtctaaatgtcctggctgaaacctcaagtacaatgctgaataatagatatgacagcaaacattcttgtcttgttgtttatcttacaggggaagcagtctttcagcaataagtatattagccttgggattttcatagatgaccattatcatgttgaaaaaattcccttttattcctagtttgttgaatgtttttattgtgaaagaatgttatattttatcaaatgctttctctgcatctctcgaaataatcatgtgatcttctttgtcttttattctattgagatagcgtattacattggttgattatcaaatgttaactcaattttacattcctgggataaaccccatttggtcatgatttataattttttctatatgtaactggagttaatttgctagattttgtcaatgattttatttttgcatcaattctcttaaaagatattggtctgtagtattcttttcttgtgatatctttggctgacttcacagaatgagttgggaaatatttcctcctgttctagaagattttgtgaaggattggtattaattattttctaaatattcggtaaaattcaccagtgaagacatttgagttgggggtatatttagggggagcagagcattttaattactaattctatctttttacttgttacagttaaattcagattttctgtttcttgcatagattttggtcgtttctgtctttatagaaatttttccctttcatttaagtaatttaatttaatagcatacaactgttcatagtatttctttatgttccttgtatttctgtaagattaatactgatgtctcctctttattcttaattttactgatttgcatcttctctttatttttctcatgaagtctaattaaacgtttgccagttctgtggatcttttcacaaaaccaacttatgatttcatgtgattttctcctttgttttttactctattttatttgttcctgttaagtttttattattgccttccttctgcttgctttgggtttagtctgctattctttttctagtttctttagttggaatattaggttattgatttgagatgtttttaaatttttttattgagataaaattcatagaccataaaattcaccctttaaaagtgtacaattcagtgttttaaatgtattttcaatgtcttgcaaccattaccatgatctaattccacaacatttcaaaaccaccaaaataaaccctgtaaccaatagcagtttctcccttagtgccctaggccctagctcctaatgaccaataatctactctctgtatctctgaattttcctattctggatatttcatatacaagatttttggttgacagttttttcctttcatcattttgaatatgtcattcctctatgtcttttagcttctattctttctggtagaagtcagccataaatcttattggaattcctcttatatgtgataactaattttctcttgctacttttaaagtttcccttggtttttggcttctgacattttgatgtggtgtgtctgaagtgtctctccttgtgtttatcctatttgttatttgtagagcttcttagaggtgtagattaatatatctttcttcaaattttgaaagtttttcttatttttgaatattttcttctgtttatttctcgctctcttctctttgggaatcccattgcatgtatattggtgtgcttaataatgccccacatttctctgagtctctgttcattattcatcattctgtgtcctcaatcttcttcaatttgcacaatatgtattgatctatcttcaagtttgctaactttatttcctgccacctgaagtctactgttgatctcttctatgaatttttttgttccagttattgtatttttcaacactagacattcttagtttagatctctttattgattttctatttgatggaaagaatttctcacaaattcttttagttgttttttttttcttagacagggtctctctaggtcacccagggtggagtgcagttgtacagtcttggcttgctgcagccttgacttcctgggctcaactgattctcccatctcagcctcccaagtagctgggaccacagccatctgccaccacaaacagctattttcagctaattttgtttattttttgtagagatgggcactgtgttgcccaggctggtcttaaactcctggactcaagtgatcctcttgctttggcctctgaaaagtgctgggattacagacatgagccaccctgactgactcttttagttctttaagcatagcttcctttaggtctttgaacatatttatagtagctgctttgtcctctaagttcaacatctggcctagttcaatgaagcctatttccctgcagcatacagcctctgtgtcactcctcagaggtcacagtcttgggcatgtacacagtatctaccaccagtgatactgtgattttaactgggctgtctgtctccttacctaagatcctctttgagcttctggatgatctatctctaataatatcactaccagctattagcctccacttcttaattccattagtgtttttaaacaatgccctgggaaataaatttttccacattaaaattgggtcttctcaagtcttcaaggcttgcccagaccctaaaagggttcttcttagctttttctctggttctctctgttaaacttctagctggtgaaccattctgcagctgctactagaatcatagtgcttctggtgccctcttgattgcttaccaccaagattgtcgttgttcctgacaatactatagacaaaaacttcttcactctcttttccaaataaagatagactccttggggagagccaaggagctctccattcttaaaactcatctcacctcatggacagaatctctgctctactacactagacattagaggtagggagagaagcttctttcttccagaatgacacccctgctctatgagcagggtgctgggcaggaatggtagctatggattttctcaacttgtttttttctagcattgaacatgcaccctatgagtgagctggggcagagtgatcagagatacagtattattggcccaccatgcttgaggtagagattccattttaccaatgggagctgactaggggaagggcttcccagtcctcttggcctcacttaagtggaataaaacttctgcaacatggagcttgggattagaggatgagagattccagtagactaccctcctagagtcaaactgttgccctgtactaggagctggaggaagagagagctccatgttattgactacacccaactagaatagaatttccatcatactaaactgggaggtagggatgtgttgatgaaaagagtcaaactctgtaaaatatttgaagatatttattctgagccaaatatgagtgaccacggcccatgacacagccctcagaaggtcttgagaacatgtgcccaagatggtgaaagtgcagtttagtttcattcattttagaggggcatgagctatcaatcaaatacatttaggatatacattggtttggttcagaaaggcaaaacaacttgaagttggggcttccaggctataggtaaattttttaatttcctggttgacaattggttgagtttgtttaagaacctgggatcaatagaaaggaaatgtttgggttaagataaaggattgtggagaccaaagttttattgtgcggaggaagcttttagctagcaggcttcagagagaataggttgtaaaatgtttcttatcggacttgaagtctgtgttgatgttaataacagagaggtataatgaggcatattcaactcccatttcccatcatggcctgaaacagtctctcaggttaaattttaagagtcctggctgaggaggaagtccattcagatggttggggagccttataattttacttttggtttacattttcccctttttggccaagatttggcacaggaaacattaaaagccagcaaatctttattttgtcccatagcgttgtcagggtggcaaggctgcctgcaccaggtccattctgtcccttggtggggctctttatggcccagggccttaagagtcaaaagacttaacagctgattaattgctctaggccagataggaatggatgtggacaggcatttattacctcttaaaattcttattttggccgggtgcagtggctcacgcctataatcccagcactttgggaggccgaggagagcagatcacctgaggtcgggagttcgagaccagcctgaccaacatggagaaacctcgtctctactaaaaatacaaaactatccgggcgtgggggctcatgcctgtaatcccagctactcggggggcttaggcaggagaatcacttgaacctgggaggcggaggttgcagtgagttgagatcgcaccattgcactccagcctgagcaacaagagcaaaatgccatctcaaaaaaaaaaaaaaaaaattaaggaaaaagccaacaaacaaaaaaaggcaaagttacaaaactgacttatttttaacttctatgtgttgagctacagtaagcttggttttagttacagacttttagccattcgctaaagaaaacataagcatttttctagaaaaacttaaatatatatagatatctttatatatatatatatctttgcaacttataactgggagtattatactcagaaggccttgtcacaaggtatctttattctaatgttaccaggggatctttgctcttagagctcccaagatggtggaaggctgctcccaagatggggcggccactcccaaatggcgcggccactcccaagatggcagcaagccttttgttctctgacctggggttcttggcctcatggattccaaggaatggaaccttgggccatgcggtgagtgttatagctctattagaagccatgggtcacagaagagaaccgtggaacccagcgactagtgttcagcttgattaggatgaacccgagcacttagccatgcaggaacaatggcgagcctctagcctgatcgggagcagcaatgggtgcctggctggatcaggagcacagtggacaccctgccggatccggaggggtggaagtcagaagtgggtctgggatggtggcaaacagcagtggtggacagcgagtgaaagctcagctcgagccgtaacaaacacggaccagaagcgtgtgcagttgcaagatttaatagagtgaaaacagagctcccatgcaatgggaggggacccaaagggggttgcccactcccagctcgaatgcctggggtttatatcccaatcattgtccctccccctgtgctctcagatgatagattatttgactatttctttacctcctgcttttagcctaattggtattttagtgagccctctttactacctgattggtcaggtgtgaactgcgttccaagccccttgtttaaaggtgggtgcggtcaccttccccagctaggcttaggaattcttagtgagcctaggaaatccagctagtcctgtctctcactgtcagtaaatatttttctttaattctataggaagcagaaaattatttatggttgggatggatgcaaaagtgacacataatagtttagaagacttgttttatcagctgtttaggcatccttgtatcctcttgatttggacaatctgaccttgacctaattttgtccctcaaaactggcccttaaaatttcatgtgctcatcatcactggccatcagagaaatgcaaatcaaagccacaatgagataccatctcacaccagttagaatggcgatcattaaaatgtcaggaaacaacaggtgactttggagaggatgtggagaaataggaacacttttacactgttggtgggactgtaaactagttcaaccattgtggaagacagtgtggcgattcctcaaggatctagaactagaaataccatttgacccagccaccccattactgggtatatacccaaaagattacaaatcatgctgctataaagacacatgcacatgtatgtttattgcagcactattcacaatagcaaagacttggaaccaacccaaatgtccattaatgatagactggattaagaaaacgtggcacatatacaccatggaatactacgcagccgtaaaaaaggatgagttcatgtcctttgtagggacatggatgaagctggaaaccatcattctgagcaaactatcgaaaggattataaatcatgctactacgttacataaagcttgtttaaacatcttaaattttataattctattaacctgtaggtttttatgttctggtcgcaggaactttatttatttatttattttttacccttagatcattttaccttttttggtgaaaaaggatttgggttcccagcagagagttgcattcgtgagacccattgagggacaacaaattctataaggcttctcaaacagttctatgattctgtgggaggggcacccatgtaaaaaggggtcccttaaccctcaaatttaacatgacctgggtaataggcctattcgttgggggatatcccagtcattataaagctagttccacatggctcccatatgaaacatattaactgcttcatctggggtgctctacttggtgttttatagggagagctgggtagtcccctttacagggcaaacagacttacagtggcatttatctggcccactacgctgatcattctctcagaaataaccccctgtgcatttggatcacatatacttatcagtgattgtttaatagtgagttgtgggtcctgcattaacccaaacaagctcttaatttctgcagcatttaaaattaaggattttgtccttaaagtgtttatttttacaatccactaaagatttttttaaagaagtggatgataccaatttacaaaatggaacaatccctttacattatactctccggttttaaaagttacttggttttgcccttcctccacatcaacttgttggtagccacaggtctcagagttaacttttgttgccctggcataattgttggtttttttttccatttagttttatctgtatactttttccttcattttaaagcaactcttaaatagtttagaaataaacacaattttttaagaaaaatcaacatccttgtgttttataaacttcaccaaaaacatattttatgcatttactattttagcttgtagtaaccaaaattcccagtaaaaattctcagttatgttttaacataacattactttaagattttaaattactggagagagttgagattaaatttaccaaattaattttaccaaagattaccaaagtcatgtgaattaaaaggtatctgagctagcctctaccagtctaataaatatgtactttcaaaaaaattacttgattagagctcctccatgtagtttggtagtgaaatgtcacttccatatgacacatataaagatagagatataacaggcatgcagaataaaaaagcaggtccaaaatatatttttacctgttttttaaaaaattatctcccttactttaggtaattaataaaagttataggagtcaagaaaaggtgaaggagagagctattatccaaggcctttttaaaagagaaagaattgaacctttgagatgtttatctgaagaatttttaacagacagattatataaaaatttattgcattaagaataagtcaatattttaaacaaaatcttgttttaaccaattatttagttttgtattagtgtatatatttttaataacaaagactcatctctagaaagactattataattttttcttaatcatagtcaactaaattatacaacccttttttttaaacaaaattcctttttactaacattattacgacttgcatagactattcacaacatgtttggattttctgttttgtcctaaatatctctctttcttgaacaacccagtcattttattttaggacaaaaattcaccacacaagattctttcttatataaaattactttcatttttaccttctttactgaaaaatacctctttatatcattaactttctttccatctgttattttctggttccttttaccttgttttatacataacccttaaataaacttagaattagatgaagatatttaccttttaataagaacactttaaaaaaagttttactatagttttaaaattggaaattacccagatacttaatatttattaataaccttagatcctaaattatatgacaagtttgtttacaagcatttctttcattatatttacctgattgattgatttaattgtttacctagattatatacaaaaactgtgatagtcattccttaagttacttcccggttaaccattttgatagccgtgaatttcaggtgttagtcattctttaagttacttccctgttaaccattttgatggctttgaatttcaggtgtttccttaagtaacaaacttagggttaaatataagggtattttttaccaagaactcaggatttagctgttttcattaaaccagcaatattccatcttacttatcaaaaattatacaagcaaagatcattctgcctttggctgggttttatagttttataacccttatgactaatcttgtattctggaggaataagcatgaaagcacttgatcaataaacacaaacaaaaatgctaataattcttaaaacatttctaatattattttaccaataattttaaagccagcttatttattaaagattttactcaagtgatgtgaacttcaaaaagcatttgactagtctttttttgataaaatattttatttaagcacttgtttttctttaagccaattaattagagctcttttatatatttttagtagtgaaacattgtgtacacaacacataaatacatagatgtattaggcatgccgatagaagtacatcttatagattcataagacctcattgtttcctaacttagacttttaaattcttgataacctgtttcatcaacctagacagttgtcagctaaatagccctacatttgcctattaaaggaaacaactcttaggtgaaaaatcagcaaaatttacatctcaaggtaccaagagagaaagtctggtgtgctagagggaaattaaaacagatttaatttgccaattaaacatgaaattatagaagtctattataaaggtcacacacatacacacacacacacacacacacacacacacacacacacgcaaagatcctatggcttttacttcagaactttagccatgagataaatacaaattcactggcttgcaaaaaaaaaaatagttagatccaagtagtggttgttatctcagtagaaaggtaacagcagatttaaagcaggcagaaaagaaaatagagaaaaagagaacttaggaactttagagtttgcaggttgaccttggggttctttttccttaacgtaaatgtgaaaaatgaccatactattttcattttacataaactttagcaagtagaggtgccataaaaccaatggagtgccccaaagggggtaattctccttgttttctcctcattcttagattatttgtttcccacacttaaaaaaaaaaaaaaggaggaactgagctgtggcctggggcttttgtggagtgggttgaagtgggttgcttgcaggcaggacttcacagtgtgtcaccactgagtcattgtgccctcttacttatctcagttttcctctctggaggtctaagcccctccaggagggctcaaatcgtggagtgaccagctcctatatgtgtttcctgaataagccttttttaaaactaatttttttgggggttccctgtagggccactgcacatcatggggggttaacctccaccagacactcccatgaggcccttggtcacgcaggggcacgttttgcctgggagaagcaaatgtgttttctcttcagagctaaggaaacacagtttctcatttacctataaaaacaacagtataatttatcatgcaaatgcacacagacaagccaaactgagattaattttgggagaaaatgcaatggagaggattctttaaaatgcacgtctgaactagaagtaggatctttaaacaacttcctaggagaaaaataaaatagctcagaataaatcaaggaccattaaccaacgggagggccaaggctcgggaggacttaccagttccaccagaggagaagctcgaagtcaggaaggcttcaatgggcctctgctccttagctctgagtttgggcaacttccttcatggtcctgagtcttctctgaggtcccacgttgggtgcaaaattattgtcaatgaaaagagtcaaactctgtaaaatatttgaagagacttattctgaaccaaatataagtgaccagggcccgtgacacagccctcagaaggtcttgagaacatttgtccaagatggtctgggtgcagtttggttttgtacattttagaggggcatgaaacatcaatcaaatacatttaagatatacattggtttggttcagaaaggtgaaacaacttgaagctggggcttccaggccataggtaaatttttaaatttcctggttggcaattggttgagtttgcttaaggacttgtgatcaatagaaaggaaatgtttgggctaagataaaggattgtggagaccaaagtttaattgtgcagaggaagcttttagctagcaggcttcagagagaatacattgtaaatgtttcttatcagacttaaagtctgtgttgatgttaataccagagaggtataatgaggcatgttcgactcccacttcccatcatggcctgaaacagtctctcagattaagttctaaaagagccctggctgaggaggaagtccattcagatggttggcgagccttagaattttatttttggtttacagatgggagcaggttatggcttaaataccagagactcttgctattcttaccaagatgtattagagtttcttgaataaatgttccttcatttgctgtagaaaattaggacaatttccagagactttgaataattgatatttaaatgaatttcgccagttgcagtttttccttttgggtccacagggctcctcatactcccattctggaactggaagcctctctgttaagtctgtaaacacttcctttcccccaacacagatttcttcaatctgtctaacccaaaaacactgccctgggacaggatgtccctatgtaagcaggacagtgggagaagcctggaatttaaggcccaaattgggtctagacattcttgataaatgtgcctatcctagcgacttgccatttaaaaaggctaaacacaaggtgggacataggggatcagaagggagcaagtgaggccactcccccatactccctaccctgagtcttgcccctaagagttgaatattggtggtgggagggggactcatagaagagagaggctatagctctctatagcaaagcagattagagtagctccattggccccctagggaaggagcctcagggaggctgacttgggtttcacaagaaaaagtacattctaagggtaaagtacataaagagctgcttcaggaagaagtgagctccctgtcatcaccgaggttatctaagtaaaaggtagagggccacatgtccaggaccctctatcattcatttagagttagaatcccaggacccttgggagaccattgaccctaaaattcattgatcctctgtgtttggagaaggaactctgcccagttttgtctagccaagtcaggtgattcctaggatttttgacataataagagttcagaaacaccccagggaccacgggcctttcctggggttttgcaaaggagcagaattagcattcattactcattcattactgctctaatcagcatcttaattgccagtcttactctcagtctttatactgagtacctggtgcatgttcactctccacccccaacgtccagctaagcctgggggcaaacacgagattccctagaccatctgcattccaccttctttccctcccccttttagagagctcaggaaattggttttaatccaccaagctcctgttgcttagtaacagaagcacctgctcctagcaaccaggagccacaaagatgctgcagaaagagggggctgtctgggccctgctcttgctcagctatagacagctggcctccccgatgtttttctcatccagcacagacactctgtctcagatgtctgttcttgaaaagctgatctctggggcagcttctgacctcaacccccaacctgcctgcctggagcccctctgaatcccacctcccaggccaccaggaggcagtcatgttcacaatagtgtggctctgggaagtgccctcactgaagagggacagaggtaagtaaccagctgtgttggttacttcagtctagcctggtgggtgggagtagggtgtgccacacaggctcctataaccctgggtgagagcaattcctgctcggggtggaggttggggagcgtgttgtaatccagtccatttgagcgtgaagagaggcaagagaccatataagataattccctcctagagatcaggaaactgacagtcaggacaggcttgggcccacacagccctttggtgacagccaggtctgaaggaatgccagaacgtggggctccccaacacagtcagcacccatgagactgccaggccactgtgcagtgccagaggcttctgcttcccgtccccgaaggacagcaagaacacacttctccaccacctaagaagaaccctgccctcttgccttctgggatggcccgagctcagggtgatcgccaatgcagattttttcatttgacgagctgctttcctagaattgttgaaataacaagagtttagaagtacccaggagaggtctgtccagagctctaactctgtggactggtgctaattggcatcttccttagtcacagatttctctgaccttcacaggaggtgcaggtgcgtgcattccctctctgtctctctggggcttcaagctctgaaagtagggctgtccaccaggagtaaaccacggaaagtgggggttgtgaggaccttacccccattcccatccccccagccctgggccagactctcaggcgggaacaagccttccagctgtgagcttctttcttgcttctcccctccctctcccctttcttcctcccaagaaaagagcttctggtctctgccttccattgcctggcaaccaaaccagctgccacaggctgagaggagcaacacagatgcttctcaatgaggggctgaaatgagggggtgcagttgctgtctccagtcacaagcacccatcggcaatactgctggtgctcacactttggatacaaggcttttcttacatttgccagtgttatgtgtatttgaaaagtcttccaaaggacagatatgccacaattgggtaaactgctccacgcttctctatttcatatttaaagcatgtcgttatggaaaatttcaagcctatacacaagtggaagggcgtagtgacccctcctgtacacagcatccagcttcaacaattatcagcgcctggccagtcacacgtcattggatccgtaagtatttcaatatggagctctgaaagacaagaacccctttcagcataactacagtgtcgttataacacctaaagtaattagtaatcattccataatatcgtcaaatacccagggaatgtccaaactttaaatgtctcatgtctcatcaatgttatggagggttcatgttatggtgttttttccactttttgtagtcaggatgtaaataaattaatctatgagttcctccttatgaatatcctgaaattacaaggaactaggattgtcctggaaaccatggacctgcaggctcttcctgagacccctgtgagctccactttgatttacagaaggtattgttagttcccaaattttgagatgagactgagattcaagaatgaagagctcagtgtcacccagctactgagggactgggtcaggttgttaactcatatcaggagtccaaactcctgtatgtgctataatgaccacactctgacacccctacctgctctacctccagaaaggtgagggaagcctttaggaagggggcagtaaaggcctccaccactcctgcccccaccctcatactagtccaggtcctacccaggatctgtcaaaaccagtgcaagcccaccttctgtgatctccctggcccatttctctcctcccaggtgactgcccttgggtgcatgtgcctcagtctccccctcacccagaagaaaccttgattcctaaatatctgtgccccacaccccaggtgagccttttggaagcagctccccaaaggagtgctgactgcccgagtgaggggctttctgtgtgtgtgtgtgtggcaggggagggtgcactgcaagtacagggaagtctccggggagagatcacagataccagccagggagccagccatcagcaatgccagagtgacagtgtccctcttgtcctcagcaggggaaagggagtgtccaggcaacatcctgggcctgagcatcctgaggacaggggctttggcctcacctctccctcccacaggccttttaccctctggggacaagaagttctcatctgtacagcaaagatactcgagaaaatcagccaggctgtcctgtggttgaaggaggcctctcagcttggagtaatggaaactgatctggccagagagtcccagcatcaggtcttggtctctgctcttacattatgcagctctgtgaccctgggcagggaccttcttttgtgggactcagttttcttatctatacaatgaaggggctggaccagctgctctctgggggcccattagcttccaggtttctataatctccaggaaaaggagacccatacattccttggtaaatggtttctggtcttaattacctttactgtcaggaaggtcttcctgcctttttgcttctgtctctgagccttgtttcctctggccgaggcccttgtctagataagcatgtttattgtcccagaagtgcctgggcaggcaacaggcattttcatcaccacaactcaagccaccatggtgggagagtggggtctagacccagccaagtccctgctcccgatccccaaggtgttcaggagggggcagtgttcaggccacaggcagatgagagatcatggaaccaactggctccttgctcttcaaggagcccaactgcccggtcttccagataaggaagcaggaactttccccaggaaacacagagctggagaagggaacagctggggacccctcagaagggatctttcctggtcaggggtggggatggtgaagaggagagcctaaggagcagagttagggcattaactaaaagcagtttatgaaacaaatcctcagggagctcctgggtcctccttggggaagacagaaaacacacacacacacacacacacacgcacacacacacacacacaccccacaggagaagagattacaagcatatctgactatcaggtaactgagatgggactctaacttgaccatcccacccaggggccacgagtctcccagcagcttcatgtattcaacaaatagtgactgagttactgggcatcaaacagtaaacaagggggacatggcctcagccctctctctcaggaacttgcagcctagctcagcaggggcagatgctcaagagaggattctgatccagggagctaccccaggctgaagtaagccagggaactgtgggaacccagaacaacccatctcaggtgctcaagaaccatcctgtgctgcaggctgtgtcctggtgaagatcaattagaccctctaccttgtcacaaggacagaggattatctgtatcctgggttcttgccttggtgtaccagaagaatcagatcacatctgggcttggagaatgagtgcaaggttttattgagtggaggtggctctcagcagttgggggaagccagaaggagctagaatgggagggttttcccctggagtcgggtcgctcagtggcctgggctctcctccgagtgtcccagtcaaactccacgttgttctgctggtcggggctgttcgaggcctgcaggtgtgctagtgcctgttggtgcattcttctggacgtccagctgcccctgtgttcctccactgatgcgctcctctctgtgtttagctgcctgtgtctttttctgctgatctgctcctctggacgtccagcagcttgtgtgtgtgcctgctagggtctaggggttcttataggcacaggatgggggtgtggcaggccaggggaggtcttgggaaatgcaacatttgggcagataaacaaaaatgcctgtcctcacttaggtccataggcacaggtccggggtgaagccccagccaggggccaggaccttaaccccttgtatcatttaaagggaccatgctctttccttcctagcacttccatatcactggctgtgcccatttctgggggagtcagttctggttgcttggagatggtagccttagggagcaattggtctcccctcttcaggacagacaaagaagtttgaggatgtgcatgaccttccagcactttttgtcatctcagcgagaattgggcagcttctggggcttggaggagagctgaggctacccttctttatactagaggttctcaaagttttttgtttttggttctcaaagttttggggtcggtaccccaaagctcatggttaaagcttcagtggtttttccaagcagaaattgcatattgaaactgggtgccctttcttttgctggctgtggggatgtgaagtgtgggctgtagggcctcagataatagcacaatttctatcaattgttctgtaaaatcttttcttctcttccctgctgatgcagagggccaaaatgtttccttcttcaaaccagtgcccgtgatttagctttcattgacattgataatgaacataaaggtccctgagcaaggctgccccttttgtacatccttgctgctcttctcctatgtatgggggtgggggggatgacactggaaggaagggggaacgaatgagaaaatgtcctgtggattctatatttaatgtgttcagtgacatgcagagacgtttaagtgggatttttgtaaccacctttgcaaaatgatgacagtaagggaaatctgacatagttgagtccatcttgcttctaacctccaagcagtccttggtcactcctgggtataggccaagctaactttgggaggaatttagtttatggtttaaccttaaaggaaggatgataatagtctttcccaaaactaagcagcctttgtaaaactaatgaaaggccacaagattaggattatgaggagcctgaattctgctaagatgtagggtatagttagacaataaccagccattgttctggaggtcacaagatttgtaacttcttcaattactcctgtggataacatcactattatagaacctaagattggtcttctgagatatttttcagacttttacattctgacaatcaactgaccccacccagaagtggactcaagactcatgacccaactgatcctgttaacccccctcaacccagaggcagtctcagcacatgaccatagttttccacacctctatgattggatcccaaatcagtcagcagcatgcattctctagtcccctgtccaccaaactatccttgaaaaactctaacctctgagcctttggggagactgatttgagtaataactctgtcttctgcatggctgaccttgtgttaataaagcttatttctctactgcaatagcatggtctcagtgaattggttttgtctgtgcaatgggcaggaagaacccattggttgagtacactttcaaggaaatactaaggaaatgctttattttagctgcctggtcagtcccattgttcgggtttctgggtcttcctcttctcaaggctggtttgtaaatcctgagctattgaggagctgtctgttttctcaaaagagcagatgggccctctgatccccgacatgaccccctcctccactgactcttcatccacctgggggtttttgcttttggctactggcccaggtaaggggcctgtgcctatggaatacagtgggtctccagtcctttggggctcagggttccacctcccttctctctcctaggccagaccccagtcagactttggatgaaggagaaggcacaggcatggtggcattggcaatgaatctctttggaatcaaattttagtcaggctcttctaagtcctcttcttggctgtatctggaccttgccctcatcattgctacacctgcatagccccaatttgcagtaatctggcaaagtcagtttaaagagaatcccctcattcttaatatctgattagtctgctctcagaaagaatcctgtttggtcaatctaacaagaatcctctctatccttgatgtctcttatcagttgcaccccctggctgcacccaccactactcttctccttgactaagcattcccagccccacagaattcagtattcatctcctcctcaatattcagaattgggaccagttccatactgaggttttcctctcttgcaataatttcttttttcttttctttctttctttctttttttttttttttccagatagagtttcactctgtcacccaggctggagttcagtggcccagtctcagctcactgcaacctccacctcccaggttaaagcaattattgtgcctcagccacccaagtagctgggattgcaagcatgcgccaccacatctggctcatttttgtacttttagtagagatggggttttgccatgttggccgggctagtctcaacctctgggcctcaagtgatctgcccaccttggcctcccaaagtgctgggattacaggtgtgagccaccacgccccatcatctcttgtaatagtttctgaataaaatattttttttactggtattatccaaaaaaccactaggatggctaaatagtagaaaggagaactttattagcaatattggtctgcaagctgggaagagaaagtctccagcaaagagagtgaccaaaggtactctcttcaaagaagggaaggacagattgggtcttatgcctcacaggactggtatcttacatattcagtaggtttgaggggaaagctatacatatttatgagaagagccaagtgcatgcacattggctaaacatgttgtaacatacatcccaagttcactttggggtgaggttttggcattaaaatgaggtataatttggctttttatgtcaaaactgtcttgggacacaagacagtttgtgcacattctctataaactggctaaaactggcgtaaggtctgccccacccccatcagactttggatgaaggaggaaacacgggtatggtgacatcctgtcccttatttctcagagctggtaattgaggtccagggaacacagggcatttgaccctcttccaggaaccagaaagctggaaactcctgtattactcagttgctagtaatttaaaacagtgcttattgcagagctatattctggaatagaatgtatattttaaaaaaattttccatatgttattggggtacaggtggtatttggttacctaagttctttagtggtgatttgtgagattttggtgcacccatcacccaagcagtatacactgcaccatatttatagtcttttattcctcgccccgccacactcttctctggaagtccccgaagtccattgtatcattctcatgcctttgtatccttatcgcttagctcccacatatcagtgagaacatacaacatttagttttccagatgtacaatttttgatgaatctctcagaggcaattatcaacctcaatgtaattctgagcttcccccttgcaccctgtttactttgtttcacaattggacaaaatgagttctagagaacaaaggtcatttgcacaaaattctacagcaatcgattgcagaactcaaagtaaggttcttttaataataggtatcctttataaatagaatgaccggatgttccagtttataaatattgtcccattctaattattaaaattaaaagtccttctcaaaattagcatggtacatataataaaatatgtttccccccatttatgtgccattaatttttcttcatatattaggctggtgcaaaagtaattgcagttttcgccattgagagtaatggcaaaactgcaattacttttgcaccaacctatattgtttcatatagtctttacaataaccctacaatgtgacaatttctctcattttacagagtaggagattaagtttgaaaggttttagttacctgcctgaagaaatataaatggtaatataaatggtaaatggtgaagccaggcttctgattcaggttttgtggtgctagaactgggcagtcaattgccatattattctttagtgtcgaccaaactctccccagagagacctgtagtatgcccagaacagtttggcctctacttgtgccccaatggacatgctatttacctgggattggcagacagtacagagaacaaagagcctagggtaggaggagggcagagggcttacaatcctcaggcctgttgatgaaaagacttttcagaggcagctgatgacaaaagcactagccagtttcatggggaggttgtagaaggtgcaactataaccctggagcaggtagagcatggaacaaggacccagtgctgctactgctgtctctggtgggccccccctctgctccagcaaaagttaccacatggacaccattagccaaagcccagaccagctgctggcccaccgcatggaaagtgcgtctggggtattccatgcctcaggcctaagggtatggcctcagcgactctcttcaaagtgttccccaaaatcctgtctaccctccacagggacgggagggtacagaaaacatttttggagtcctgtgttcaagcactatctgggatataggtataggcttaagcattaggagatatacctaatgtaaatgatgaattaatgggtgcagcacaccaacatggcacatgtatacatattaacaaacctgcacattgtgcacatgtaccctagtacttaaagtataataataataaaaaagaatatattaatttgaacataaaaaaaaccttgtagtccttctcagctatctcctctcccctctgcagacagactcttgtctcttttgatatcttaaatctttgtgtagtagaaaaatacagtgtgttactttaggctctggtactaacagatttgtgactttgggtgatatcatttaatcttcctgggcctcagtttctccacatgtaaaatgaggaggttagtctagatgatcactgtgttgttattccaaactcttgcgtatgtgattcagtcttatctctgctaccattcagtaggtccccagaccaggctccttcctaccctccctaaaaaattcagataccagcctcatcagtggcagcttcagtcctgcctccatacccttgcggatataataaccacagtcatagtttttaacattccactaggacttgtgtgggctctccagttcctaaaggttcaagtgcatttcttgaccctgtcattcaaagatctctacactcaggagttggtggaaggcttacaacacatttattttgtgaggctctctggatatttgtaaatgaagaaatgccaaaatacagtctcaaaaattgtggtacttttgaaatacttacttttaacagctaaacattgtaacacatatcaagcaaatataatgaaatagatggcattcacaagataattacaggatagataaagtgtacactagagatcttttgtgaatgagaactccagccagatggtccctctaacctccttctcctgctcttcctgttccccacaacggaccctgacaattgacaatagtagttgatccaatccattgcctctcaaacctggcagtgccctcatattacccacatggtgcagatgcagctagtcaagcatggtccacgggctggcatttgggatcaccaaacaagctccctttacatgtgtgttagccttctgcttggactggccagatctttggattgcattactccatagctactacaacccctagcactaggccaaaatcctggcaggttcttagtgttgatttcagagctgaggaccagggtggaaatgtgtttgcaacctttcctgtactcctgttctctccccaccctcttcaggaccatcacagagcctctacaagaagacactccaagcctttaagaccctgacattaccttccttctacctctacccaaattatatgattttttcaaatccctcttgttctaaaggaccctgaccttctcttcagccacctcacacagacccaattaaaaggagatggggagtagactaggtttcttttttctgattttcttttgacccatactgctttctttgctgtcttgtgggcacatacataggtattcaagtgaaacaagcccagacttcaaagttaagaacttcaggagtggaatttctccactcttggtacagtggggagtctggagcaagctgtttgccttctttgcaccttcgttacagatcaggcatcaaggaatgaagattaacccttgaccttgctggaagatggcatgtttacctgatccctgatgttccaatctcatagtgaccacaggagcctggagcatagtaccaagtgtgtgagggcatgccatagataatgcagctgggaataagggaaataacgttagatggagggtcagaagacccaaagttaggcctacttctggtcttctggtactaacttgcttcgtatccttggagaagacattcaaactcttcagcctcaatttctttctttgcaaaatagggtacatatagcataatagctaagagcaaagaccttattgtcagacagacctggattggatgccaactctaccacttactagctgtgtgacctagtctacttaccaagtctttcttggtatgtttatttacttgagggcaagtaaatggaacactaatattatttactttatgcagttggtgtgaaaattaaatgaaatagcatagctaatatatgtaaagaatttgacacggtgtctgtcacatagtaagtgctaagtaagtgttaactattgttactactagtagtactactacttctacttctactatgaagaaaagaaatatgtgaggaaggacatttgctgccctatttatcttacacagttgctgtgaagatctaatgagataagtgctgaaaaagggttttgggagataaaagaactctacagaggtgaggtgagattgacattaaattacaaaggtgttgggaccttcccccttactgccaggtcgctcttgagtccatcgactctggcttgatcagtgctggcatgagtggctattgccttcccttcccacccacccatcttgcctcctggcatattgaattagaggaaggggttagaaactttgacctccaaccttctgctactctaccactcccacccctactacagaggcacctgtcacataagtagccagtacccaacccagacccagagttcactttgcatttgccctactgagggcctgggacatgtgctctcttcattagcagcctggagaagtgtctgtccacatctgccttccccaggactatatttaagtcatacaagccaggtctcttacattagctcacctaatcctcacagaacaatcatttagttggtacttttataagatccattttccggatgagaaaactgaggcttagagatgtgaaataagttgctcaaggtcaaatagaaagtgaggatgtagagcaatggctcacgcctgcagtcccagcattttgggaggccaaggtgggcagatgacttgagctcaggagttcgagaccagcctgggcaaaatggcagaaaccccaactctacaaaaaatacaaaaattagcggagtgtaatggcgcatctgtagacccagccacacgggaggctgaggtgagaagatcacttgagctttggaggttgaggctgcagtgaactgtaatcatgccactgcactccaacccgggtgacagagcaagatcctgtctcaaacaaacaaacaaacacacaaaaaacacaaatagcaggtacatacaccttgttcttaaatccatgtctgtctgactcagagcctgcacatttagcattatacaaacattatagaaagattaattcagcccatccctgatagtttagtggctaggaaaaaaaaattctaaaggaggaaaattcatctatcctagaaccttcctgtagtgacagaggtcccagccttatttcagagaggctaaggtgaggcttaaggaaatttcccagctgggaagcaggttgttaactagccaaccgatgtaatatcctctgtcctgaaggggcttttgatttccttcctctgctgtttcctcattttccccatctctctcagaaaacacttaacaaaaaggggcagtatcctggaaaaggcattttagattgaaaaatgagctctgtccatacttttgcagttcctctgccttcttttcccctacctcccttccttcagacaagtaattcaagggtgctagggattgtcagcctattcctgctcagaggcaggaacatggcctaagtggtctcttgagatttcctgcaggctttcatgcttcatgaagtcgtagcagcaggccccctgacggtggagccaacattagtgcttggctcagctctgaggatcaaagccatattaatcctggcagccagccttccctggattgattaccttgtcatctgccccagaccaaccatcccaggtttccttcctaatgttaaactacagtgtagggagagttgcttctggtaacagagtgataacctgtcccattggggtgcctgctggaagcagctgcccaaactggctgcctctttagctcaaaagtggccttaaagctataagcagggccctattcagtctcaagggtaggaagaggctcatcattttggtacttgtttcttgttttggctttacaaaggcactgatgcttcctgaaagctgagcttagaaaattgttcgtctgactcctgctgcttcttctctggtggtgggacagatcaatggagcagccatgtttccaaggagggtatagagatttgctaacctaataagaagcagctggtgagctctagacatcattgcccagttctaatttcacactcactccttctgacccatgggctcagggttccttttcctaacctcacagggttctggtaaccataaggcctccaacccaccatttaaaggttgcaaggccgagatgctaaaatgacagagagccagacagggaagtagatacggcatggtgatggaggagacctgagaccttgtccctaccctgctataaaccaagtctgtaggcctcatgtcttcatctgtaaacaacagaaagatcattgatcggtctttgcttaatacctctccatgcctagtgatatggggcagggagcctgggaaggggactgtaaaaacctcgaggtaaatctaggctgggaggcactgccctagagttcaggaaggccaagtccataatgtcattgcctaattgaatactagaaaagcacccctggaggcaggtgagtttggctgagaggtaagttgggatttacttaatgtctaaagagagagagaggtcaaagtaaatggttcagtgggcagagagagaaaagcaggtctagggcagaagggagatctcagggactttcccatggagccccaggggagagactcagaaagatgagggcaatagaagggaagatatgacagaacagtcttatcagaggcttatcaggtatcacagtgcagtagaaggagcacaggattaggactccaaagatcggggtttttatcctggcttagttagcaattgacttgctgtatgtccttgagtagtttatgtcctctctgagcttcagtgttctcatctgtgatatttattatttatttatttatttatttatttatttatttttttttttttgaggcagggtctcgctttgtcacccaggctggagtgcagtggtgcaatctcagctcactgcagcctcgatctcctgctcaagcgatcctcctacctcaacacccgctccccccccaaccacaagtaactgggactacaggcccgtgccaccacacctggctaatttttattttattttatttttttgtagagacggggttttgccatgttgcccaggctggtcttgaactcctgagctcaagccatctgcctgtctcagcctccaaaagtgttaggattacaggcatgagcaaccgcgcccagcctcatctgtgattttttttatttttgttttttcaaagctttattgaggaataatttacaaatagtaaaccgcatatatttcaagtgtataatttgacgcatttttacatatgtagatatgcaggaaaccaagaatgtggagaaaagggaacacttatacactgttggtggaaatgtaaattagttcagtcactgtggaaagcagtttgcagatttctcaaagaatgtaagacagaactaccattcaatccagcaaccctgctactgagtatctactcaaaggaaaataaatcattatacaaaaatgatacctgcactcatatgtttattacagcaatattcacaatagcaaagtttacaatattcacaatagcaaagtcatggaatcaacctaggtgtccatcagtagatgattggataaaggaaatgtggcatatttataccacagaatactactcaagcataaaaaagaatgaaatcatgtcttttgcagcaacatggatagaactggaggccattatcttcagtgaaataagttagcacagaaagtcaaataccaaatgacaggatttcattctttttgatggccaaatggtattcccttgtgtatatatactacattttctttatccatttatctgttgatgaacacttaggttgattcaatatcttggccgttgtgaatagtactgcaataaacatggcagtacacttaattctttgacatactgattttctttcctttggataaatatctagcagtgggattgctgggtcatatagtagttctatttttagttttttgagaaatcaccacactgttttccataatggctgtactaatttacattcctaccaacagtgtaattttatagtaagtcttgaaacgagataatataagtattctaactttattccttgtcaaaattattttctcaattctatgttcttttcctttacacttaaatttgagaatcaacttgcaaaattctatcaaaaaaacctcgctgggatgttaattagggttgcattgtatctacagaacaattggagagaattgacatctgacccatgaacaatatatatccctccatttatttgtcttctttaatttctcttagcaactttttgtaattttcaatatagaggtctgacatgttttaaatcaaatttatccataagtattacaaatttttgatgacattgcaaatggtatttttattcgatgtttaattatccattgctagtatatataaatacaatttgtttttgtatattgactttgtatattctgagatcttgcttagcttatttgttagttctagtagctttttttgtagagtcctttgatttttctaggtaaattataatgttgtctgtaaataaagacggttttacttcttcatttcctacctgtgtgtcttctatttctttttgctgtcttgtttgttcgtttttaacttttattttaggtttgggggtacatgtgaagatatgttacataggtaaacatgtgtcacgggggtttgttgtacatattattttatcacccaggtattaagcccagtacccagtaaatatcttttctgctactctccctcttcccaccctcccacgtcttcttactgtcttattgcattagctagaacctccaatggaatgttaaatagaattagtgagagcagacatcctttttgtatcctttttgtttgtttgtttgtttgtttgagacagggtctcactctgttgcccaggctggagtgcagtggtgcgatcacactcactgtagcctccacctccccaggctcaggtgatcctactgactcagcctcttgagtagctggaactccaggtgcgtgccaccaggcctagctaatttttgtattttttgtagagagtggggtctcactatgttgcccaggctggtcttgaactcctggactcaagtggtccacccgcctcggcctcccaaattgctgggattagaggtgtgacccactgcacctggcaccctattcctaaccgtagtgtggaaccattcagtctttcacaagatgatgttagctataggcttttcatggttgccctctatcaggttgtgaaagttcccttgtatttctggtttgctaagagtttttttaaaattttgaatggatactggattttgtcaaatgctttttctgcattggttgagatgattatatatacatttttaattttaagtctggtataactgcatattgcattgatcgatttttgaatgttgaactaaccttgcatttccaggataaatcacacttgatcatgatgttttttccccttttttttgagatggagtctcactctgttgcccaggctggagtgcagcggcgcaatctcggctcactgcaacctccacctcctgggttcaagcgattctccttcctcagcctcccgagtagctgggactacaggcacgtgccaccacgcccggctaatttttttgtatttttttagtagagacagaatttcaccatgttggccacgctggcttgaactcctgacctcaagtgatccacccacctcgaccacccaaagtgctgggattacaggcgtgggccaccgctcccagcctatcctttttagatattgtgggattcaatttgctaaaatgttaagagtttgaaactgtgttcaggatggatcttcatctgtcattttcttttcttgtgatgttttttatctggttttggtgtcagggtaatactggccttatagaatgagctgagaagtgtttcctccaattttttggaagagtttgtgtagaactggtattatctcttccttaaatgtttggaattcacaattgaagccaacttggtcagcccctctatgattcatatgggccctttcatttttaacatcttgcagttctaataagaccctgtcatcaatctttttatgttagatatgtgtgtctcttctctgtctccttatttcttgtctgtctttgcctttggcctgtttcccatactttccattaggtgaatgtctgacaatctgagtctgtaggtgctgggccagccttctcagagaaagatgaggaaactgtttcaagtcatagtttctcccaacactggtgtgttttagtaaaaaaaaaaaacaaaacaaaacacctgtaatctgccttagctactaaagtagataactgaccattgtccaaaaccagtgggttcaaatcagtggccataggccattaagtagagcccagttacccttgaaggactgggacaagagttaaaatgtctcattttcagacttggcatgggcactcttaagtgtaggtctctctgtttgactctgtctcagtttgactctctgtaaaattagtaactgaacccctaaatcttctaactccaaaactgaaagtaaataaacaatagctgcagagggaagcaggccaaataacctaatatggaggtaataagacaacttatattttcagtgaatatttgactttaaaacctttgaaacttgggctgggcatagtggctcatacctgtaatctcagagctttgggaggctaaggagggaggacggcttgacaccaggagtttgagaccagcctaggcaacatagcaagatcccatcgcttcaaaaacttaaaaaaaaaaaaaaaatagccgggtgtggtggtgcattggtgcgtgcctgtagtactagctaccctcaggagactgaggtgggatgatagcttaagcatgggagcttgaggctgcagtgagccatgattgtgccactgcactccagcctgggtgacagagcaagaccctgtctctaaaaagaaaacaaagttttgaaattcaaattaggtagcccacgaaaattggcatgtcttgagacaaaatgtggagagataaaaatgagattcgtggttttttttattttatttattttatttttttttgagacggagtctcgctctgtcgcccaggctggagtgcagtggcccgatctcggctcactgaaagctccgcctcccaggttcgcgccattctcctgcctcagcctcctgagtagctgggactataggcacccgccaccgtgcccggctaattttttgtatttttagaagagacgggatttcaccgtgttagctatgatggtctctatctcctgacttcgtgatcctcacgcctcggcctcccaaagtgctgggattacaggcgtgagccaccgcacccggccgcgatttgtttagatatggaatgcttggaaagtaatgtttcctagtattgctgtgccacccccagaaaaacaccatcacattataatgaagaaaaaagtaagatactgagaggacccaatgccaggacaaatatgaaagtacttttggacttttaaaataaagatttgctagaaatatgaagtagaattctagacacaatggatggatggtgagtagctaccaaagtaaatgggcttagagtgtctgagtgctggaagaaagagcttttcaacacagtgtttgtcagaaaatggaaaaaggtttgaaagaagcttctctgagcaagagtgtttcatctattcactggacagacagttatgtagcacttaactctgggccctgcacaaggccagggaaataattaataaatgacgctcagctggaggtcactcttctggtgagccgcagagataagggctcctgttatctcagtccccaaagaagaacagagtcttgcatttcttccctctggagctccccagctgacccctgaagtgccttcacctacatcctccttttaaatatgtttcaccaattctttcagtcatctcactaatgcgtgcccaccacctggctggatgtgccggcataagtcatcacagtcctaagctgcctgctacctaccacacactgtccccatgccaaaccaataccattccaactatcccatttattcaaactagatgtagacacatcaccatgttctgggaactctgaagaggtgtggtgatggggcagaagcaagtgaatatttccggcaacacagaatccaattcatggtgccattctctccacttagcactgggtatagcagttggatagcttagccttagaacctgtcctcttaatcctatttgctattctctcactgtactgtgcatcttgtcaggaagtaggggctcttgaatagagccatctctgcccctgtgtcagccaccttatctctcttcctatctacccttgacctatctttgacctttatttgactttgcaccgtcattccctcatttgagcttttgttagttccccacaataaaaggaatttatgaaagcttgtgatgtatttggagagtttggctcttggagtaccccctctctctctttcaactcagagaggttggctttcagcagccaaggagtgaggaatctggtctcacacttgaattattttctgagcagtctcctgtacttcaaagacattagcctgagtgcctgggtaaggagccaaggcactaattgagtatttgagtaaaaagactttgaggatgaggaagcttgagggccaacagatccaggatggtgctggaaaagccagagttctggtgttgtgctgcccaggtccaacagaaatctagttagatatgggtgctttgaggaggaaagtaggggtgcctgctgaatacagacatatgttcacttaggtacaggccttttggggccaagtctcactccatgataccataggagaggggtaggccttgttaccgctgagaggggaaggttaaggttgaaaataactctgggaaccactgaggaaaagtgtgaatggtataataattataccattgaattatatgaattataatagttcatcctcaaaatccaaggatctgttgaacacaaaatttattagtcaggaatcagatacttgctcagcacttatgcactgtggattgaaaataatgctttctccctgatggaatgttacaaggttccacctctgatttttccaagtctgtttagaaagataggtctgtacattgcctgttaaaatccacccaactctcccacgaatctcagctgcttcactgaaatctctttctttgtcttccccatataagagcaggggtaattatggggaatgaaagaaactcctagctttgagtccaagaattgttagaattctagaaaacctctacctactctttgcattttccaaaatgggaaactgaatataagaaaggtaaaggataaccagtaacacccaataacacctatctattatcaataaggttataattgtcaccataattgttatcatgactattatttcttcttttttaatacagtcattgcttgattatttttctcttactaaaattttttgataacctatcccactaacagtcccttaagtcacttctcttatataacgctattcttcttcagtcacaatctagctattagattacctttctctccctttatagaaaattttctctcacttggagtttctgacttctctgaaaatctttaaatagaaaattttattctggccttgaaccatgaggttcataaattttattgccctacttaaaaaaacaatgtgttccctactccactgtgagatccttgaagtcaaataccatatgtcactcatttaacatcttgaatgcctatgggatagacatgtgtctgggccagagagaatgttaaataattgttgaataaattaatataacatgtgaattacttcatttttaaaaatatacatttagtattaaaaactatattaaggcacttttctctatacttccaatgcagtacagctaaaaatgctggacattatatctaaaacaaatgtagcaagattgaaaagtggagagaagaaggcacatgggctaggaaagttgggatctaagaaaaaacgtaacagaaaacctgagttttctttttgcttcacatatcttagacctggagctgaagaagccagcaaccaagaaatgccaatggaagcagaccaaaaaaaaaaaaaagcttgatttgtctagccaaaagacgggaaaaggggcagcctagcaaaacaaaaaagctttaaacaataatccctctactccagcctaacaccatgggaaaaaatgcaccccacttgacctttgccaacaaaggcctactggggagccaagacttctacactcacccagctgtaacaaggtgctccaacctccccgcctcccatgctgaggtggtgtcagagaaaacagtaggaagccaggaatttcttcccctctcagcagtaacaaggcctacccctcccccatggtgtcagtagagaccacatagggagcctggactttcactcttgcccgggtataacctccaaccacctctcctactcctggcaaggtgccaaggtggtgtcagtgaaagccaagtaggaaactgggactttcaccatcacttactgaggtaagaccacatgggaaacagtaacaaggaacccctactcctcccaaccaggaagatataaaaagaagcctagtagggatcttgaatacccacccctgctcagcaataacaaggtacccttccttcttagagtgtcaatagaagctaagcagggaacctggatttccacccccatttggtagtaatgaagttgtccctcaatggcacagtatcagaagaggccttctaaaacacaagatttaaataagatccagagtctcatatctaaaatttccagaataccatagaaaatcacgaatcacaccaaggaccagggaaatcttgacttcaacaagaaaagactatcaactgacactaacatgaagataacacagaaattgaattatttggcaaggattttaaagcagccaacaaaaaatgctttaacaaatcattgcaatcacacttggaacaaatgaaaaaaatactaagtctcagtagataattagaagatataaagatgaaataaatggaaaattttggagctgaaaaatatataaccaaaataaaataagcccactggatgggccccacagcagatgagagaagacagaagaaggaatcagtgaacttgaaggcagaacaataataattatccaatctggaccacagagagaaaatagattgaaaaaaatggaaagagcctcagatgcctgtgaggttataacaaaatatttaacatttctgtcatcagaggagtcccagaagaggaaaaaggcagggctgaagagatacttgaagcaataattgctgaaaacttcccaactctggtaaaaacataagtctgtagatttaagaaactgagcaaatcccaaagagaataaactcaaagaactctatgccaagacacatcatagtcaaactttcaaaagctaaacacacagacatgcacgtgcatgcacacacacacacacacacacatcttgaaaacagtaagagagaaatgacacgttaactctaggggaaaaacaattaaaatgacagaagatttctcatcagaaaccatggagggcaaagtgctgaaataaaagctctcttagctcagaattgtatatccagtgaaaatatccttcaggaatgaatgaggaaatcaatacattctcaaacgaaggaaaactaagagaatttgtccccaacagacctaccctaaaagaatagctaaaggaaattatttaaccagaaaagaaacaatagaagaaggaatcttggaacatcagaaagaaagaacagtggaaaaagtaaaattatacataaatgtgacagatattataatataattgatttagatttcttctccttttgtgtttttttttctttcttttttttggagagaggctctcactgtgtcacccaggctggagtgcagtggcacaatcatggctcactgcagcagcctcaacctcctgggctcaggtgatcctcccacctcagcctcctgagtagctgggactatgggtgtgcaccaccatgcccagctgattttttgtagagatggagttttgccacattacacatgctggtctcaaactcctagactcaagtgatctgcccacgttggcctcccaaagtgctgagattacaggcatgagccatagtgcctggtcccttttgtgttttgtaaattaggtttaacagttgaagaaaaattataataatgcctaatgtggttattaatagatgtagaggaaatatttaagataattttattataaatgagggagggtgaggagatataagggaggttaggtttctacactcctctccaactagtaacatgtcgacaccaatgatgttgtatacatatgatgtgataccattatatatatataatgtgatttctttgagtacatttttcagtggccactaaaaaaggtatacaaaggaacacactttaaagcacaataaataaagtggaattctaaaaacttttaaagtaacccataggcaggcaggataaaagaatacagagaaactaaaaacagaaaacaaacaggaaacaaaaataaaattgccctaatgtatcaatgattacatcaaatgtaaacgatctaaatatatcagttcaaagacagagattggcagagtggatagaaaaaaaaatcatgacccagctatatgctgtctataagaaactcacttcaaatatgtatttccagggaattatgctgggtaaaaaaaagtcaatttcaaaaggccacatactgtatgactccatttatataactttcttcaaatttgtgattgctaggagttatgggtcgtgggggagtgggctgagtgtgactgtaacacaaaggagatctttgtggtgatggaatagttctgtatcttgatcacaatggtggtttcaggaatctacccatgataaaatgatacagaactatatgcacatattgtgccactcctaattttctggttttgatatcatgttatagttacataaggggaaacttggtgaagagttcatgggacctctctggactatcttggctatttcctgtgaatctatagttatttcacaattaaaaatttttttttaaatgaaatagattaatttttaaaagctatatcaaacataatttaaagtttctttgactgtacaaaaaattccttataagaataatcatcagttttcattatatcatagacattcagaagggtcaaataatggtcagttctagttataaaatgtcagtaagatgatttgctaaatttaattattttttttctctttgacaatacaactgagctacttttttactctggccagaataaagatacatatatcataaatgagatcttgaactggcactttctgctttcccgccttctccccacctttaaaaataacatcagatttattgagatataattacatatggtaatattcacccttttttacatgctcagttctatgaattttgacaaaagaataccaccatcatcaagatatgtaacatataaagcttagaaaagagagactcaagatgaaacttgataacattttcattacccccaaaaagtttcttcatgtccctctgtagtcaattgtctccctcatccctcctcctgccacctactgatttgttttcctgtccccatagttttgtcttttctcgaatttcctgtaagtggaaggaataatttgagtctggcttcgtttacttagcataacgcctttgagattgttcaagtttcagtagttcattcctgtctattgctgtgttgtattccattgtattaatgtgtattcatttgtttatccattcaccagttgaagtacatttgggttgtttccagatttgcacaattatgaaaaaaaaagctagtgtaatcatctaggttcaggtttttgtgtgaacataagttttcattcatcttgagttaatatctagcagtgggttttcgggatcatggtaaatgtatgactaacttcacaggaggctgccaaactgttttccaaagtgagtactgttttgcattgccaccagcagcgtattacatttccagttcctccatatcctcccagtattaggtattatcattttgtaaaaacctttctttgctgggcaccattgctcacgcctataatcccagcactttgggagactgaggcaggtggatcatttgaggccgggagtttgagaccagcctggccatcgtggtgaaaccccatctctactagaaatacaaaaaattaggcatggtggcgtgcgcctgtaatcccagctacccgggaggctgaggcacaagagttgcttgaacccgggaggcagaggtggcagtgaaccaagattgcgcctctgcacttcagcctggagacagaatgaaactctgtctcaagaaaaaaaaaaaagaaaaagaaaagaaaaaaggctttcttggtaagggctatctcattgtggttttaatatgcgtttctcaacttattagtgatgttgagcatctttttatatgcttaattactattcatatcataaatgtatgtgcacatgtgtaattgtgtaatctctgttcaattcttttgcccatattttaagttagattgtttgctttattattgagttatgagagtcaactcactcttgtatggtggataccggtctattgtcagattttgtgtgctgcaaaatttttctgtctatggcttgccttttcattttcataactatttttgaaaagcagaagttttcaagtttgatcaagtctaatatatcaaatcttttcttttatggatcatacgatttgtgaatatctgcaaaatctttgcctaaccaaaggccaggaagatttgtctcctatatgttcttctagaagttttatagttttaagttttacattaagtctatgatccattttgcattgatttttaaacatgatgtgattattgatatttacaaagttctcttcttatacatataattttatctgattttttttttttctttagatggagtctcactctgtcacccagcctggagcgcagtggtgagatctcggctcactgcaagctccgcctcttgggttcaagcgattctcctgcctcagcctcgctagtagctggaactacaggcgcccgcccccacacccagctaattttttgtattttgagtagagacggggtttcactgtgttagccaggatggtctctatctcctgacctcgtgatctgcctgccctggcctcccaaagtgctgggattacaggcgtgagccaccacgcctggccctgatcatcagcggatcacaaggtcaggagatcgagaccatcctggctaacacagtgaaaccccgtctctactaaaaacacacaaaaaaattagccgggcgtggtggcaggcacctgtagtcccagctactcaggaggctgaggcaggagaatggtgtgaacccaggaggcggagcttgcagtgaggcaagatcgggccattgcattccagcctgggtgacaaagcaagactgtgtctcaaaaaaaaaaaaaaacaaaaaaaaaacgaaagaaagaaaaagaaaaagaaatgtttgaggcaggcacaagcagaaattttaatctccatttcacagatgagaaaactgaggattagagaaatgctgtgtgacttctcaagatctcacagctgataggagatgaaatggcaaggtaagaggtgaaattgtgataaaaagttaaggtctcctgctgtcccaggctagtacttttgaagccaggcagagagggctcagggtaaggctccaacaaagtaaagattcccaatggggagctgagcaacctatttggcactgaggtaagagacacagccagttgactagccccagactgagctcctttggcccattggggctccacaattggagagagccagaagttggcccagtgcctagctcatgtgtcactctttgatgatgatgatgaagagctggaagtgttcaaaggagagttctgaaattaatttcagagttagaaattaaagctaagaggaaaagttaaggaaacgaagattatttggcggagaaaagagaggctcaagatgaaacttgataacagccttcagacgaaataaaaaaaaaagcttgaactttccttctgagggctgagcaaagggaaacagtctggaagaatctaaataaaagggcaagttccttcctccttagtgaggattgttatagacacttaagagcctttagaaacaggataatatctgcttgagtttgaagtcaggaatttgccaaacatgggctctgatgacggatttcagcatgagggttacatgactcttgcacagtgtccttagaaatctttaggtggcctatgaacttgccttgtatcctagtacaattccagggggcttttgtctgtggccttctctactccttagtcttatcgtcttcacagggttcttctaatgctggagacaagcctgaccttagctcctgaaagcttaaccccaatgttttttgcccctgaagccagtggcttagaacctaaggctatagatctggcttagcatccctggaaaggcctgaaatattgactagtccaaatcttaccgcagtgatagaatcccctgttttatatctagtctcttcttgcaaaactctctgaacatcagggactagcaagctggcaatgcagaccaatgcaatgccccctgtgaaaggccagagaagaagagctgagataccagcagtaccaccaggcactacactaagctaaagtgtctttgcacttgttttctctgcagcatgggtcggagccctcgcgatgggtatgatcttcttctgttctcccattgtgagtatattcactgaccgtttgggctgccgaatcacagcaaccgcgggggctgccgttgctttcattggcctccataccagctccttcaccaggtaaggctaagagttggtggttatttccccaaggctgagggttggtttttttctgggctttagctagggttacttttctcactgcagaatcccctgtggccatggccctgtagggccctcaaagatcctgcaccctggattcagaatccagtgaattcatctgggtagggtccccaggacacattggtagggaatatccccagagaggacctaagagttccaaagtggtaggagtactctaagcctggtagttcgtagagctgggcccaagtccggttttggccactgaatggcaatggaacaattgatgagtaccattgttctctctgtgcctcaatttctatatctgtaacatgaggggatttgaccatatggtctttttacatctctttcaactctgctatttgattccccttcagtgtgccacacatctcacaacctcactttccatcccaagattgagcttctcgagtgagcccatgtgaacacctagcacaggattcccaaaggaatcttatgctgaaaaaagaggtcaactgagcccaaggatgtttagcatttctgactcttttccagatagctcaggctgctgacatatggatgatttgggacagataatgatttacatcatgggcatcagaaggatgattagcaatatcccttactgagatacaaacccagaacccagctacccagctaggcctgggctaaactgaaaccctagtcccactggttccactggcagaacttggcagtatcaggtgagaagcaggctctaggttcattttctgctttcttttctgccagccctgcagaagaatgtgtgtagggtaagggagaataaataccctaaccacagcctgaggaatatggaattcctaaagaactctgttgactttctgccaaagacactttggaagttatggtacctcctacttccaatctgcttgggccgatgtaggggaatgccagcctggaaacacagaaatgagaaatggccgtggtgacatgtctgggatgaggtcagagctaatttgtcagagacttgctttctgagcttagttacccagaaaagcgtcatggctctctaggcctaaggttccactcacagtagagaatgataattgtgttttgccttaactgggccctgtgaggtaagccagctttctttatgacttgagcatttccagctgcccagcctaccctacagcagagcttggatttggcctgcagtcatttcttggcttcgtcctgtccaactgggacagagaagggaaaaaccgtgtcctgcctggaaactactcagcactcccagggcagcagctccaaaccttttcagaacccctctggtggtcagcctcattcacccccagcaagctggtgcctggctccttgtggggaggagctaggcttcaaaagcagctccagtctcagcactatacagcaaaggtctgttttttaagaccgagcagagcaaagtgtaaacggattagcaacatatggattccatttcccttccaatccacatgggctcaattacaggaggggaaggagctcagatgtggtgttttcttctggcacgctactgtaggcacattggagtaggcgttctgttctctagcccctaaccttcttctctacccgctttgttctttctgtaagaggatcttcagagccaagaaactttctggatggcttcacatccagtggaaaaatggttcttctcatggctagagctccaaatcatccttcctgttgtctcaatcagggccctgagttcctccgaatgacatggaatggggcaggatgcaggcagggctggtggggctttggaaaacccaaacaatgggcatccatccctggggcccagctagaagtagatccaccacatggatctaaaccaaatcctatgtttttcccccactggccccttccctgaaggtctaacacaaggccccttggataaggcccccaagccaggccgatcccatagggtacctagaatctaatgggcacaggcccaaaggaacctgacagaagaggaaccgttggcttagctatgtgttccaagcagagacaaccctttcaaaaccaaatccttgctcacgtccagtgaataccagcagatggaaagcaatagtgatgacagctatcttagaatcatgcaccatatcttctctgcagcttaggcccagttctttagtatgaggactgggtctatctccagagaagaactgcctgaccaagaagagtattaggtaatttagtggccagataagaactattgcaaaatatattgaggcatcaaaaagaaaacaaaattctttactaggttgtgccaatattatctgggggcatatggctggccaagctgaccttcctattgcctttccccttctgaccctttatgttacagaggcttatgtccacagcagggcctatgagttttaagccaggacctgtcttacttggccaggcccacaaattctttgaggctccacttcctgtcaaggagccaggctactctagggaacaaatctataccatatccagaaacaaaggcaggactctaaaagttaaagagactccttacctaatgattcccgctgagatcgtccagggcctagtgtaaagggacttgggatatgtggaccttgggcagggtttgggagggcgtatgtctcagaagaacatcagccattctctgaaatattaatggccttagcatggagaaagacactgaagagtcccatggaaggtttcaatcttccaggattttgacttcttgcagacctttgttgctacctgggataaaagctttgccaccaccaatagtaaggtgaggctagtctctctaagacaatgactccctgtagcccctcatccagcttttacatgggctagttctggctttcctttgaacagtcctctttgatggggtgctatgagtcatgctagagtcacacagacctggattcaagtccaagttttgctgattcccagttatgttaccttgggctaattattttacctcgctgagcctctgcttccccatctgcaacacagggatcagaaggccctcttctttgtctgttctgagggtcagtggcaagtggggctgtgggttaagggcggaggaatggaagtctcaggaagctgacaggggagggcaggtagattgctggtcaggctgctgaggacagctcttggtatttctcccacagctccctaagcctgcgctacttcacctacgggattctctttggttgtggctgttccttcgcctttcagccatccctcgtcatcctgggccactactttcaacgccgcctgggtctggccaatggtgtggtgtctgctgggagtagcattttctccatgtccttccccttcctcatcagaatgctgggggataagatcaagctggcccaaaccttccaggtgctgagtaccttcatgtttgttcttatgctgctttcactcacctaccggcccctcctgcccagctcccaggacaccccaagcaagagaggtgtccgcaccctgcaccagcgctttctggctcagctcaggaagtacttcaacatgcgagtgttccgccaacgcacttaccgcatctgggccttcggaattgctgctgctgcccttggctactttgttccctatgtacacctggtgaggaataccagagtgggcccaccccacctggccccaagaagctaccctcaacctgcctagattccagagggtgggggtgggagacattgaaagggcagagctgggacctttgggaaaagaaacaaaatattggttggagagatccagagagggaaaaagagagaggttgagggaagaccttagtggaaaatgggggcaattccacagggggaagcccatggaccatggcttctcccacagtaaaaatttagatagattttgaagagatacgcattgccaggatgcaggagactggcccgggtgacccaagacaggattctgtggaatgctggtctttgtggtcaaatgattttgtttaggaagtaacatatactggatctctctagctttataatgtgtagtaatctcttaaagggactaaaaaaaattgtaggaaagaaacccattcagctttgtttaactcaccatccaccaaacttatgcaactacagaactgttggttgtagtccagctgttatcctccacaggcttcatgtttcctaaaacacactttggaagagttgcctggaagttgctggattcttctcccctggtgatttgatgttgccctaggctgtcagtttggggtaagggaatggggagattgtagagaaacccttggattttctcaatcatttaggctattttctgtcttgctggggcttagaaggggcgtggaggtacccaccctccttagctgttgctcagaagtccagaatccagacagccaagggataagcagccagagagcttgtcatggaggtagggctacaggagagggggtttctgtcctgctccaggaaagtaagcagtaggggattctggatatgcctacagttaaccagtcagctcctctttctcctcctgtttctggggatccttgtgctatgcttttcagatgaagtatgtggaggaggagttctcagaaatcaaggagacctgggtgctcttggtgtgtattggggctacctcaggccttgggcgtcttgtgtcaggccacatcagtgactccatccctggacttaagaagatctacttgcaggtgagtgtgaccacttgtccactgtggggagaaacagcctgccacaaatgcaaggttatccacagcctttgggatagaatggtagcttgttgtgtcgcatgggaaagtcaatcaaattctctgagcctccatttcacctgcttttaaacaaagaaaatcatccttgttctgcctcttttaccaagattgagtgaggattctgtgagagcagtgtatatggaacctattagaacacgtgtaaaggaagattttattaataatggctctccatgctccaagactattttctgtgtgaactaggctctggtctggtctgaatacaggccactgttcaggctgtcagtctttatctacctggcagcagtattgcctttcttacctgacttatgatcctgcaggtgggtttatgaagtggtacccaagtgcagagccctgtgaaggggcaaagatagcccccaaaatcaagtagtcacaagtaatccatcaggaaggtgattgagttctgactcatttatctcctgggaaagccctaaaagcacatgcaaggggccctagctacacttacagtggtgatttctctgtctctgatagccccaagtgccctcctaagtaccctcaaatatcttggatggaaatatgattaacttttccttaacttttttggtgttagattacaagagttggtaaatctgctttgtcagaggcagggttgcttttaaggtccatccaatccaacctcattacagtggtggagaaacagagggaaaggctcacacagacagtagtagcagagctgaactcctatgcaacacacttctcatattctaccttgccctaagtgatggcagagccaagtctcagagatgataagtgacttgaccaaggtcaaaccaagagataatcttgtgattgagataaaccaattgagattttgaattcctgtgcaaatatcagcaagtgctttatctgggtggctatttgcataggaatatgtgtggctttcccagcctcacccacatgacacccctgtgagtcttccctgccagtattagcagctccaagatgccaaagagttctggaaatcagggtaatctggcattgggccagggctttatcttgagaagaggcagcagcccctgcctagtcgtataactcatgtgattcttactacagtccctaggagaaaggtagagtctgagcagcttttgctttctgttatacagtgggagtccaagggacagggaggcattagccagttagaggccaagataggcttaggacccagtgcctctgctgaccacccacccactgctcctgccccttttccttactcttacttcaccgagttttacttagaataatataaaataatcttagaacattatagctgaaacatatcttcatcaactagtagttgaacttcctcattttacaaattgagtgtcttgggccaagagcacaagacaatggatgaacttctttctcttgagtttgttaagatactccatcacaggaatttgcccccctttctccctgcatgtaatgcaggagtacaggcctaggggaggaaacgagtgtacacaccttcaggttctgaagagctatccactagactctgtggctcttaatgttggtaaagacaagcacatatctctggcttcaagcccctggacagtctgctggaaaggaaatagcgacaggctgcaggacagcctcactttgtgccaattcttgaggcctgtttctcacgtccaagagggattttaaatttctgaatcttgaggcctgtttctcacgtccaagagagattttaaatttctgaaccttggcaaagcctcatggaggatgtttaacagacagctagatacaataggtaatacttagacctgattaaaatcagttaatagggtcctttgtgttatataatggtattaacttttaatttccataatgggctttgttgataggtgtgtctggttttatcccatagttgtgtgtgaatctcttagaggagaagctcaggtaccggggttcttattcctagcttctgcctagctacctcaaaactgcctgggcaaagttcaaagtctcccaacaaaaagatgtcctcagatggcattatcctctccaaaaatcaactgatcaacctaaaaaactcactgccagcaacaacatagaaaatctttagggcaccaaataaccttgacccccactccttccatgtgttcttggctaagttggcttgcttgtgtgaactactggaaaatccttgggcctattaaggccttgatagagagatcagatcttagccctgaccctgggatgacctggctctgacctggctctactggctgcagggggttggcagcagcgggatgggggcagggttcctttctctgcctgaagcccaggtcttcagtctagctggccaacacaggttgcaaatgaagaccagctgtgtttgcagcagcccttttctctgtggagaaggaaaaaaaaaacaacctctggaaaggcagtttcttcattttggagtcattttgcttagcccagagaaagcccagtggctagtcagtgttcctgggttggcttcattctccctagacatacaccttcccagtggcttggttcccctggaaggctcctctgttgccttctcagggtgtccagccaagcccagaggcccccagagccatgtgtctgagatgtctgagataggcagtgcagtccatgtcctaaagcataggaacctgggtgaatgtcccaatggtttcctttatgccaaggtattttataaaatcagcccccacaaaaatgggctctggctccttccccatttcaagaagctgtgccttccacttacaaccccatctgatcatcatgcaagccatcctcatgtcctcccttccctctttccatattttacttggatctgagaacaccggtatggcctgatcccagaccctgatccctggggaagccaaatacaggctcagaaagcagaaacaacaattccttttatcttagggtctagtgcaagacaaacttcttgaggccaggggccaagtatcccccaactttctttttttaatcccaacagaatcacagttaagtaggggctttcttggactttgaatccctcagtgcaagactttgaaagggcctaaccattcagcccaactgctctctctgttgacaccttccccctcccaccaccccattttatagatggtagaaatgaagacttgagaaaggagatgtgatgctatgtggtcttggctggccagcacaacctgacctcaggcccttgtttctccaggtcctttccttcctgctcctgggcctgatgtccatgatgattcccctgtgccgggacttcgggggccttatcgtcgtctgtcttttcctgggcctttgcgatggcttcttcatcaccatcatggcccccattgcatttgagctggtgggcccaatgcaggcctcacaggccattggctacctcctgggcatgatggccctgccaatgattgctgggccccccattgcaggtgaggctgatattccagggagggcatgaatcagggagtccttttttccctgggtactggcactcctgagcatctctccttgaggccccttttcctcttatcgtctatttaagcagctttgtcagagtgcgtgaaaccccttatcactactggtggaagagattaaacacagtacacacgcatggatccattctgcgggatggattttccatggtggtatatctgtttcaataggattttatttcagacagcagggatccttccagcggggtggagagaaaaatgagtttggctttctgacagttccactgatctagtatcctctcactctctccacaggcaagtgattatttgcaaggtagttgggtaggaagagaagagaaagcaggctctggttttattaaaacctagggacatcctcctcctcctctgctggcttctgaactgagcctgtagaagatatttgattaaagtaataccccagaattaagccagtgaggctcaccttcagcaggaaaagtgttgacttgccatctttcagcactcctggttttctccctccattttcccagaagggcactgttggtatcccagggaacgaggaacagaaaaccaatgacaagagaactccaatttcttttcttttctcttttttttttttttttttttgagacagagtcttgctctgtcaccaggctggagtgcagtggtgcaatcttggctatctcagctcattgcaacctctgcctgctgggttcaaacgattctcctgcctcagtctcccgagtagctgggagtacaggtgcgtgccaccacacccagctaattttttgtatttttagtagagacggggtttcactgtgttagtcaggatggtctcgatctcctgacttcgtgatccacctgcctcagcctcccaaagtgctgggattacaggcgtgagccaccacacccggcaactccatttcttttctgtaggatttattgtaaacattgattcacgcattagcttctcctaggctggtcaaatgagttaattcaacaaatattcttcgaacacaaattatgtgcaaggtgatatgagggcactgtgtgacagtggcaaaagctttcactcaggcttctgggcaacagccacactacccattgggggaagggggcctctactcaccccctgatccaaacagtgccccagaatccacatttctttccaatttgcttaactcctgagtaagcaaaaggccaagggcctttttgccttttctgaatactgtttctgggctctgaggtactacgaggtaccacatattagcttctggaagtgagtagggaaggccttgcatcccatgtcaaacatatccttggtttggcagcttggagaaacccagaggggacaaccatatatgtaactgaaaggaacacgtatagcctcttgctaggacaaatggaacttcagagaagggtcacttcagagaaaaggaaaataaaaactcatctgaaatgtaccacaggaaccatttgtgggggcagggggcgggggtaggaggctgggaaatatcactgtggaccaagacaacacttggccatcttctgtggatttcttttaaactaggtttcctcctaactccgtaactaggtgtgactagatcttagattgatgaaagtcataaatggagaaactttaagagaagcttcattagcttctttcataatgagcattcgctcaagggcctgcagccccaatgccttgaagttgagggagctcctgagttaaggcaatacacgccaagattatctggataggcactgtgatggcccctagaacgggctgagagtacctttggacagtagggcaaagctgagcttgacttgtctctcttgactgtttcaggcctactccgcaactgttttggggactaccatgtggccttctactttgccggtgtgccccccatcatcggggctgtaatcctcttcttcgtccctctgatgcatcaaaggatgttcaagaaagagcagagagattccagcaaggataagatgttggcccctgacccagaccccaatggggagctactgccgggctcccccaaccctgaggaaccaatctaatgcctttcttgccattgtgtgccctttcccagctcttccccttcatcccaccctgctcagcatttacatttttgccaccagcacacttgttcccagacctgcgcacacagcatttcagccacctgacaatctccttggagtcaaagctccaggtgttccaaactcattaactaaattctccccagaatgcttttaaattttccagggcctttctcctcccaggatctgggaaagcttgggaaccacccctggcctttggaacctctccatatactttctaagctctgggggaggaggaggatgggacctcctggacccagcttgttagtcacccactataatcaactgccaaaggtgctactgtgtccccaggagcctaatagggtaggcccaaatctctgtttgctgaggaggtcattgccatccatatttgggagccactgggtggaggggcagggaggcaaaatgagacaagtagccttggttagtcttagagttgctgatgactgtggcttcccaagaactgggtacaagcagtgcccttattgtatggttggttaacagtctgctcccctcttcccttccttctttttttcctctactgacttctctccatactctttcccctctatttctttgtatgactgtcatagacacatgggtgcttgaagaaaggagggacccggaacttgggccaatcagcctcaccttgtcccagtccactcctaacactagcatcagtcccactcatctcaggctgagccacatctcactttttcgctcaagctatataatcctagactggaagagtagaatatcatatagggaagaaaccttaaacaccacagtgttccatgttccagtcactgatttttacaaatcttacagtccaaggcattaacctcaaggccctcccagcaccccattcttgtatacacatggcaaaatgtgaagaaactcctttcatctcagcaggtagaggaggactgatgacacgagctgccatggcgggaggaggggcagtagttattgatatggtgagccccatctctcagttttcatgacaggtctatatttctacctgggccaggccaggaaagagactatttaagaaaaaaaaaatcaattcctagcctggatcccaaaaaggtacaggcagcagttgcacatagggttggaaaatttcttttgggaaggggaagccatcccagcctttaccacccaatgtgtctcccatgctgggcatcctaggccactttgcttagagggcattaaaggtgccatgaaaggtagactctgaaccactttgatccctctgaagtaggtgactgatgcctccttatgcccaggctctggcaacagtcttactgaagaacattcccagtgcccctggctaggggcagagggcactgccaggctgtgttcagttagcacagctcacctcattaggagctcagcctctctcctcactctgcctctttgtgtctctttttctcctctctgagcctttgtctattgtgttcctgtcacccaccctttcatcatctttttgccaggcattcctggctgtcacttggagccaacagtaacttgccaccttaaggcagggtcatccccgggccaggaggatgaggttgtcctgaggggctccaaagaagacaatagttcccactcatgattttccgttacaaacaggcagctggggcatggttggcctccaatgatttcattcaaggccaaagtcctgagccccctccgctggtcccagtccagctcttatcaactccccaaaggaaaacccactggttcttagctctgtgggtaggaaggggccctagaaagggcctagttactatcctgtcagttctaacagtagtggaacaggagaatctgggccctaggagccctgtaactcccaggagagaccactgaaaatactggagcaacaatgcccctgcttccatttctccccacctcactctcaccaagtcaccagagggtggttctgtaggacctcttttgttgcttaagatgcagatggctcttaagaatcaggcagtcgcccacttctctccagatgaagggaagacattcataggtcccaaatctgcccattcagatgtcacataatatggtgggatatcaatttacttcttccacacatgtggttgtgcacatgtgagcttgtgtgcttttggagagaatgttgattggcaaaagcagcacagtattaatatttagagtaggatgcagcctcttatgcaccacagttaaatctagaacgaacaaaatttcagagctcaagacatgggacatttaaatcctcaaggagtttggaacaaaataaacagatctaaaaattt

SEQ ID NO: 36612 - DNA, 63981 bp, Homo sapiens
ggacgctcttgcggtcccagagtggagtggaaggtctggagctttgggaggagacggggaggacagactggaggcgtgttcctccggagttttctttttcgtgcgagccctcgcgcgcgcgtacagtcatcccgctggtctgacgattgtggagaggcggtggagaggcttcatccatcccacccggtcgtcgccggggattggggtcccagcgagacctccccgggagaagcagtgcccaggaggttttctgaagccggggaagctgtgcagccgaagccgccgccgcgccggagcccgggacaccggccaccctccgcgccacccaccctcgccggctccggcttcctctggcccaggcgccgcgcggacccggcagctgtctgcgcacgccgagctccacggtcggtgcaagtctttcttatcggggactgggactggggcgggtgcggggatggcggagacgctgcctgggcccctcggtcgggagaagacgagagctgggaacgttctggcccgaccgccctgcagcttgggcgacccgtcgcagcaggggctggcacccacttgccccagggcgcgcggggaggcgggcgccttccgtgaggggtgcgctgcggacacgtgtagagttcggggaacttcacctctccacgttagggtttaggattcggagttttaggaagaggaagcccaatagttttccctgggtgaccccttttccccaggcatgcaagaactttgaggaacgccaagctctgtggcttgctccagcgccttcttgtgaagttggctccacagccttttcttactggcttgcttttcctcccccacatctgggtctgggtatgccaagggtagccaagggcactcggtgtgagggactgaggtgtttggggaaaccccctgtgtagctagttttggaaacctgcctgtggaggtctgggcgttttgttctgtgctcgcctttaaaggacacttgttgcttctcacgtgcagaaaacaagggctgcttctagataatcaccctctgtttacatcatcctaatggctttcccctgatagagttgggggtgggaggcatattaaactcaggcgttgtctctaaggagagttgctcatttcttaaccagagagcaaaacctcagaaaacttgtaaaaagttcctacttttacttgttttttcctccacctgtagttgtctatgtgttagctaattgagaaacaccttggcagtcatttcatgtaaattgaatgctctaaactcatgccattttgataaggtctgaatttccaaattaccaattacaggtgaactttgatcctgagagtctcatatgttaaatggttaaagtgtaagcgtaaggattcagtcctctttcttaataatagtttttgcactccccaaactctcagattccaaacaggaagaatgctgaatctatagaccatgtccttcaggtctgaacctgagatgcttcactagcgctatgactgattatgagtgatgattcaaagcacagcctgactcagattcctggaaatgagctacagacccaccttggaagaacctgcagttgaggggcttctttcatttggttttgtacttttcagccaatgataatatgacatccacaggcctttgccaagtatcccttagttttgcagcttaacatgtgtggagagctgatagagaagtcatcagaaatgatttctgtagtggtgtcattgttggaggaggaaggaagggggttttaatgatagctggctctcatgccttaagaacccacagcgttggccttacctcctggcataatcagctaaccaagcagaccagcatgctaacgttcaaagcaccacaggacctctgatgagtagagcagtacccaccgtagccaggtcagttcacaggtcagttcccagccgactgtaaccggcagagagccattccatttctgcaaaggccttctctctctcatttttaagaaagctgttattgaaggttccctttcatttgggaagctggaagacgttagtcacgaaacagcacaagatatgaaagtatttcttctcccccctgtatctgtgatccaaaaaggaggatgacaagaagcttttctcttggagtcctggtgttccctttggaatggaaatggtgtcatttcataggtctatcaatttttggccagatactcactccagattataagaagcaggaaaaaactgcaaactgtttataattaagtctagtcagagctgacaaatacatggcctgcctctagccttgaaaaattgatatttttcccatttaatcagagtgagtcaagtcctataagcaaaattatgtgtcctgccatttcttggctttgaaaccttgacctaaatacttcttcaagactctggtttccttataagtaaaatggagatattgctcctgcctacctagagtcgtaaagctcaaggcagataacagatacatatataataagttactatatgtaaatactattattatttcagagttcagggggaaatctctggggaaggcaaaagtatccaatactcgcactttatatataccctatactttctatgcaacttgaataaatcttattttatccacgtattggccaaacctaagctttactgatttcccaagataattgtcaaaattcctaaaagtggttaacatcaaccttgaatacactcagaaaaaggattcaattttattttttactttttatttatttaatttttttttttttgagacagggtctcactctgctgctcaggatggagtgcagtgactcgatcatagctccctgcagccttaacctcctggactcaagtgattctcccatctcagcctcccaagtagctgagactacaggcacacgccaccatgcctgtctaatcttttttatgttttgtaaagacagggtctcactaagttgcccaggctagtttcaaactcctgggctcaagtgatcctcctgctttggcctcccaaagtgctgagattatagacatgagccaccacacccaaccaggactcaatttttttaagattaaattatgacctgggtatatacatcacagacacgtacacacaccaccgcataaatcagattatgtcttcatttgaagattcataaaagcctacagaaaaggaaatatataaaatattgaaataggatgagctatttttaattatctttgattattccttattaaggtctcctagacttcctggacaggaaggaccacttgctctctgcaagtgacttaaaaataaataaataaataaataaaccacaccagatggtctttgaaaatgtctaaccaccctcctgagtctattgcttcatctaaactctggagacttctttaaaatattttacatacaaataaagcacaagaatgagagacaggatggtttagtggttaacagctccggctcagagttggactgacctgccttagaatcgcagtgttgccacccatcacctgtggccttgacaagctgcttcaccctcctgggcctctgtttccctatcttcaaaattgaaccgtggatctaccccacaggaccattgtatggattacagggcatcatgcacatatagtactgagtacagtgactggcataaaataaatgtagctatataggatggttaaaagatagcatggggacaggtgtcccttggaaaccaaaatactatgactagcctggaaaagttcattactcccatttcattcatcggcaaataccgtattgtgatgataatttctgagaaatgaaaaagcaaaaaaactcctgtaaaaaatttagattttacacattaatcatcaaggttttcaaaacaaatgtttttatcaattatttcattcttaattgaaactaaaattgttagatgtgttaatggtgttaaccagagttctcattaacatttcataacactttagatggctacctgtgctgcacttcatccctatgttcattatttatcatatgcaagacagcacacattttagaagattcaatttttacattcgataattttattttatgcctcaataccctgtaccctttactcagcatataatgccttttctctttcattaaaaaatatgtttgtatctcaactcttgaagatttttgtaattcaggttcttatcagcctgaatgtagagaaagaagtaactactacttaaaggaaaaactgacatagcctcatccatattatgatgtagatataagtatagctatgtatagagatgagtgagagagacaaagctagagagatagggagatggagatagagctagagatggaaatagagacagagatagatagctatagagacggaaatggagacagagacagagacggagatgacagagatgatggagatgatggagatggagatggagactgacatagaggagatagagcttgccctaatagagcttcagtttttttctggttttgctctgtcatagggtaacctgatatacatatatcttatctaatcaccaaatatatcctgcattttaattgaatcaataaataatcattgactatgatctttttggcaactgggttttggaacaaaaattatttttccttttgtttcaggtgaaaaaaaagtgaaggtgtaaaagcagcacaagtgcaataagagatatttcctcaaatttgcctcaagatggaaaccctttgcctcagggcatccttttggctggcactggttggatgtgtaatcagtgataatcctgagagatacagcacaaatctaagcaatcatgtggatgatttcaccacttttcgtggcacagagctcagcttcctggttaccactcatcaacccactaatttggtcctacccagcaatggctcaatgcacaactattgcccacagcagactaaaattacttcagctttcaaatacattaacactgtgatatcttgtactattttcatcgtgggaatggtggggaatgcaactctgctcaggatcatttaccagaacaaatgtatgaggaatggccccaacgcgctgatagccagtcttgcccttggagaccttatctatgtggtcattgatctccctatcaatgtatttaaggtaggaagtaaccacaaatgtatttgcaaatttaaacccatgctctgattccacgtggagagttgctgcagacttttctgacctttggaattttatctgtgtttttactgagagctatttctgctgtcttctaactactagttttaagatttacaaattttattatctgtcttatgttacacttagtttctaccttaattgtaacaaaatagtatttcagggatgatggttcaaaatcatggtgtttcatgacttggattctcatgccacccctgggcttgctggttggataggctgtcttggcaagatccctggatttttatgaaatgcaatttccagagtgagagctactaggcccagaaaatacttgaaacaaacatatccttgagtttagttaccgttgaatatgatgctgttcagaagccagatatctacagtccagcttgaaatgaattgtatttattttattttgactgtctagattaatgattaaagccaaagggcatcctggcttttctcagtgatatgggtgacttagagataatggggtccacatgatagcaggccactgttgaccttgctgagcagcattactaactaataccacttaaaatttgcctgctttactgtggtctccttcatttcttcagtctgcatttattgagcacccactgtgtgcccacccctgagctaggcagtaaggaaccaaaaagaaacacaacaaagtcagtgcctcagtgtgagaggaagataactaaccttgcttacagactgtattaggccatttctacattgctattaaaaaaaaaaaaaaaaggctgggtaatttataaagaaaagagatttgattggctcacagctctgtaggctgtacatgcatggctccagcatctgcttctggtgagggcctcaggaagcttccaaatatggcagagggagaaggggtgcaggcacgtaacatggcaagagcaggagcaagagagaagggggcaaggcaccacacttgcaaaccaccagatgtctcgagaatcactcactaatgcaaggacagcaccaagccattcatgggagatctgcccccatgagccagacacctcccaccagttcctacctccaacattggggattacatttcaacatgagatttggaggggacaaacatccaaactatatcagagactacttagacccaaaacaaactaaagccgaaggaattacatattccatatttggtctagttgttgggagggaaaaattgctgcaagaattcagatatactaaaattcaaatgaaatggcctgatctatgccagattttatgaaatgtgtttattctaaacccaagaagagtattttcctcagccttgttttttccttctatgtattatgcatagaaagcaactattctaagaggtaatattctgaaatattactttaaatggcaagttttgtcaattgaagatacaacacattttaagtaaaacagtaatctctcagtttccaataagtacacttaagctgtggttaaattatattaccctagcagaaaaatcagtggtctgataatatagatgaaaacaatggttacaattttgacattgcaaataaaaacttcccaaaattacaccagtacactgtttccaaaattgaagagattagagaacaaacaatcaaaaaattaccatctctttccacaggatagcataaatacatgtgttttctattagagcttaaaataggaatttagaactaaactatgatgcaaaattgaaaatgtgtaattgatttaaaatgtttagcatatgctacataactttaatcttttcttttaaaaagttttctctttatgatatactatgtgcacacaaccacttgactttctcctgacatttctccttaatgataaattggaaaattcaaattttgactcttcagccatcagagtgtggagtatcaaacattgattattcaaacttatgaactagtgaaccaacccatcatggctcaagaaaataattatccatctctgcatttataactccctgctgctgttcaccctgaagcacactatgtagacttgccatgtgcaaagcagcttcttagccaatcaatatccacaactgctgggaaggatacctgcttatctctttgcggtgctactgccaatcaccagactaaacatcatttctattccatggcaacgttttaagtcagaccatctggaatgtctccagatttggtaaaaatgcaaataaaactttgctttacattcacctagcaatgaataaaaattaacatattcttatttgaccatattgttctcccctcctgggaatccaatactttgtataccttactgtagttctaaataatgtggacagtttgactggtacttttacatcataggtaggagtacatttgtgtaattcctgtttttccaaaactcgtaatgagtcatttaactatcattaattttagaaagtaaacctttaggctaaaaaaacaaatactctttagttatttcaatctttttccagaggaaaagagaaaaaagcactggagtgtgctaaaaaggctcacagtatttaggagcaatcgccacatctttctgtcatcctcttctctaggtcatgagatcatacatgttgctattcttctgacttctaagcaggatactcaagagatccttccaagcaatgtgagtcacaggcccccatccctttcccccatagctgcctcccatagtaaaattctgtgggagtctgtcacatattaaacctatagattcctctaaccatatcaagttcactacctctgtattgcagggcaaggtagcagctgtccatctcactttaccattacatttatgtagctatgaaaataatgcatacaattggagaatattcagttaaagggatgtgtgagccttctttatttccctattagaaggattaggttgaaagaagaataaatagttgaaagtatctaatatgctcttcaaagaaagatgagttttgaatcacacctatttttgtgtttaacaattatattaattgcttttcttttttaatttgtataaatttatggggtgcaagtgtagttttgttacatgtatatattgcatagtggtgaagtcaaggcttttagggtatccatcacaaaaataatatacattgtacccactatgaaatttctcatcatccactcttagttgcttttatgctcagttctaaggtgtctccagacagacaacattgctttgagtcatatcagagtcagcataagtggaagtagactatttaaagattgtattaatatctgaggcaagctagaattactgataagactgtaataatgttacaagaagaagaagaaggcactataaagtattcttcctattaacgttttattccctttctctcactttgaaaaagattgtactgaaacggtttcatagagcaatgtaatataaaacacaactgaaaagtaacataacaggtatcaaacagctgggctgtttcggatgtcattaacctgtgtagctgatgcttggtggctctggatggcctgtggcatggaaggtgggatggggtcattccacccctaaattttcagaaatttcttaatttcttaattgatctccctatcttcagagcttcttccccataacatatccgggactttgcttccatctgtcaagtgccactgcttctaaaaaagcacccaggagctcccacctgtcccccttttcccccatgtttagcaatcaaggccctccacactttggccatacttcacctccttcctactaattcccaaaatgcatggctcagctctgtcaaaatgctatcactacccccaaggaacatactttgccctaaataacattctcagagagactgaatgtagtcaccgaattgctgctgctgaagcatttacagatcctagtttgaaaaatgagttaggcctagaattatatatgttgcatctaacagaaataacccaaaagatgaaaagaagttcctatagcccttgcttacatacactcacacacacacacacacacacacacacacacacacacacaacctgatgataaaagaaactcagcaatctaagaaagtaaaatgcaaggcagaaggaaccaaggcaagccaatgaatgccagttgccttcttggttttgaaacacaatggccttgcaaatgctaatgttgaagaaaaaactatttctaagattatcaaaggataactgatttttagttgttcaaaataaggataatattactaattgcagtagaagattgacaaaagcaggaaggaggaagggaaaggagttagcagattttttcatatacccaagcttataacccatactgctggtggattcattcttgtcaataaattacattatctgatatcctaaattttcaagaaaaacaaaaacttagccaagtaaattaatctgtacataggatatttacatttgttagaatggcaaaatagttaaaacattgtctccatgttgggagactgaaaataacccctgattactagatgacaaaatagataagtatagaatttaataattatattatttaatgattcatgagattacatgtatgccatagagtgttgtccatagggagatgggttataattttgaacagagtggaagccctaaaagtgatatttgtgcatgagccaaggcttggcaccatgtagcttcaggataacagctccgccattatgcacacacagacatttccatatatcactgtacctcgtctcttaagcagaaacaagaatgcagggagatgtatgtatgagagagatggagtaagggaaagaagtaagaggtacagtccaatggcttgccatagacgcttttgacgtgcatagcagggagttgatgccgtggataatatgccacgtaaatcacgtctccacttagcatgtggcacaaagcagatctgtgagaacaacagtgatagaagccggtaactctgttgattactaattttgtctaccctaagcaaccaccccttattgaggacaacaatgaaaaataaacacatcttatttctgcatgaagttaccacgaatattttgcaatgaaaagtcaagactctcaatatgttgctctggcagaggatctgaacaatgtggaaatgagagacatccacatagagccagttatctccatgttcacacagcctttgacatcttgtgcaactgggatccatccttctggggcagctttacaaaagctgcttcttgacatatcaaatcaccacagcaaattgtgtcttaaaaataaattgtcacaacttacagattagatacctcaagcatagtagatgttcagtaatgcttgttgttatgatttgatttgataagggccttcactcttaaattaacttcaaatcagattaatctgagatattcaaattaaaatgatgatgaaggtgggggtggtggtggtgatgatgatgatgatttgtcaaagggattcttcatttatagacaaggcagaagacattatcagtggtatgcatatactattccccaacttagtcaagttacccaccaaattccgtatgtgataagcatatttcccttttaccgcatcatcaagcaaataaaaacacacttttctcatgtactccaagaatcatgctatcatcataaaattagctatagaaactgcattctctaaattttaagagagaaaatgtgtcccttgaccaagatctctattcctcactggtgcattgtattccagctagatgttttcccatagggtagctctgatgctgcctcctctgtgagcacctctctttccatgcttttccgctacctctctatactccagctaacctggtctatctatctgagtccttctacctggaatatggtccttctacctggaatattttttcctcaggccttctctggcttcttccactttattccttggatctcagcttaatcatctctttggcaagtatccatgatccaaactgggttagtgccgctcccaagaccccctttattaaccctgtactggcacttaaaacatactctattgtatttgccagctccttggcctgtctgcaagttccttcaggcatgctgccatcattctcatttatcactgtatctcctgtgcccagctttaaaaatattaggtaaatgagtgaaaaaagaaaatgtactatagttgcctctgttagaatgtttttctcccatgcaattccagatctacaagcagacctgcttattgagtttattgaatttctacctttttttctgaaaatcagaatatctcagggtccataaatctgtgagaaactcgtgggaagcagagcagcacataacagcaagatgattttccccttccttttgtctttaggggtcaagaattcttgtctcatggttcaggcattgtgttaactatttctgtgcattctttaagcatagttgtaactgtagttttgattgaaatattaacctataagtgatttggaatatcaaaataaacattcatatcacagaagttttttttttttttgctcttgagagaatacgaagtaggttgatttttctgccattactatgatatatgtacattgcaaaacattatgctaactagctagcttaagaatatatgtacatataaaatgacagagtgacaaatttattagccaatttgctgtttgttataaggaagttgctgtctggaaaggcttcagaaccctgtccagctctacctccccttctgacttttcgtttcctgtgtctgggaacctcattgccttctctcatggtcatgttaagtaattattctcatgtgaggttactctgctaaccctcggcatttggctcacagcacagttattcccgcgtcagtgatgggggatggaaaccgtccatcactgcaagactgttcccatggctgaggagggagagatggtttcagtcctgttcttgttagtaacgtgttgagatgtaaatagattcatggctgatgatgttcccccatcaaagagttcatttagctcataggaagagtttgctatattctaaatttaacataaaataatgatgcaggaaagttttaggtttaagaaaataattttcacatgatacattgtgtatgcgtgtgtgtgcttgtgtgtgtgtgtaaatgttgctctggttccagcattctgatcaataaaagcagaagttcaggccattttatcctgaagtatttctatagggtagtcttatgagttgcttgattattatacaaagtatatacagttagtataaagagtgtgcaaactaaaatgaagggggctgaggaatcaagtgtgttgtcgctgaagttgattttgagactggagtggttaaataaaggctgttctaagaaattccatcaaaataaatttgatatactgccagaaattctacaactgccttctggatctaccacattctcttgggagttagaactactgctttctatagctacaattttattcttaactaggtctagtttttattggaaaaactgtcctaagattaaaagttaatagttgaaattaaatttaataataaaactgaatgtgtcattcagcattaatttttggtagccttatgtttcaatttgaacatcaaatattatgtaaaactgcatgctctgaagcatctatttaaatttggtacatttttgcagaagagcaacctggaaaaaaattaaataaataaatttggaaggtttgaagccttcaatgttctggggctcaggagcctaaaatcaaatgtgccctcagaaagacttaatattattttaggttgtgcacatttagaggtcgcttctcagaacttaaacacctctaagagttttattgacactctaacttttaaaacaacttccttggagactagtaccaagagaggaagcaagtcaaatcttgcatctcatacttgccctaaacatgagactcctgttattttagatcaaatttatactagaaggcaataaagatggcaactcattcaccacttgtttactcagtaatataaggtatttattctctagctgctcttcatttattcaataaagacattgggtaaatagcagcaaacaaaacagatagatatccttgcccttgtggattctggtagaagagcaagacaaaaagggaaataagtaagtaaatacatagtatgtaagataagtgctaagtagataagtacaatgggaaaagagagtggaaagaagagagatattgagtgggtgacctcaatacaaggtgacagttgagtaaaagaagggatgaaggagcaaacaatgccactatgtaaggtaagagcattccattagaggaaacatcaagtgcaaaggccctgtggcaggaatgtgcctggagggttaaaggaagagcaaggaggccatcgtggttgagtgggagagagagagtcgtggcaaatgagatcacaaggatatgagggtggagcaagagtaggggagaggtagagcacatagggcctgatagcatggtgactatatcatctattgtccaaacaggacaattttgagagtgaagggagacactattatgtcaggacaataggcataaaccaggactgtcctgggtaaacaaggaaaacctatacacctttaaaagtctttggcttttttctctgaatgagatgggaagtttttggaaagttatgtccagatgagtgacatgaacttgtttacattttaacaggaacattctggccaggcacagtggctcatgcttgtaatcccaacacctagggaggcagaggtgggaggatagcttgagcctaggcgttggctgctatgttgaaaagtatttcctaaatcaatgaagggaaaatatgcaatcttaaaatatgttatatatactaatatataacatgagaatattacctaaagtgtagcgtttactctatgccaagctaagtcgtatgaccctcccaacaaatctatgacatgctactgttgcctgaatgataatatgaaaaaagtgagtcccagactgttaagtaacttcctcaaagtcacacagctagaaatggcaggtccaggatttggatccagcctgatcccagaggctgtgctgttagccagcctgccgtactgttcttccacacacctcgtaagacaaaccttatcattaccaaaatgtcatccctaacacaaatagattttcaaagactgttcaaagaagaaaatcatttcctttatcttctccactaaatctaacagcttcattagttccttctttaagacagaagtaacacattgtaaagaaaatgtacaatagattgcactccaaaatagcatctatgttgtaagtcttgcagatggccttgggacatctggtgaacaggatttgtgtagcctatgttcattgtcatgtcagtgaggtcaactgacagaaggagagccagaaaataaaaaataaataaactgagaggaaagattgagttatttgatggactgattgcctcgacacctctgctcagagaaatgcattttgccaaacgaatggctcatctagttatcacttgaaaggctaggcaatttgtctgtggacaggatacagaagaatgaatgtctatggctagcccatagtttcagctgggttagaaacatcaggcttgactgataaagctagaggttgcttttctagacttttctccttgggggtttaccagatgcacaggagttaaaaggaggatgtggaagcataacagatgacatttgtggatatgtctaaactgatcattaaaaagatgccagcaatcctcaatttttaaagatttgcatataaaacgtaccttttgtgaaacctttccattaaatctaatgcataaggaacttcattattaattcctaattttaaaagcaacaaataaaggaaacattattgaacattttttcaatgtccaaaatattgcttatcaaaatatgaaaggtaatggatacacgtttcttaacaaaatattgaataacacattacactgcatcccacgtaagttttatgccacaaaagtaattctgcagaatgtctgtacaaaaaaaaatctctaactactgtgaacttttagtttgaaagaagatttaaatttcagttttcaccaaatagaaatatctagaatacagcaaagtttctcttttaaaatggtgtcattgatgtcataagtatgggtatttctctgcatattttcattgtttccacaaattttacttgcttaaagaagtgaaatctatgaaaattagggttatgttatatcatttaacagtcataatactttttaaacttttaaatatgttattgaaatgtagcatacacatagaataatgtgcctaagcattggctctgttaattttcacaaaatgaacacatgtgtaaccaggatcaacaaagagagcattatcagcaccctgaagtctcctagtcactatcctaacccctaagccactcactttcctgacttctaacagcatgaatttgcttgcctgtttttgtgtttctagcatatggaatcctatgatgcctgtaggtattgttttgtgtctggcttgtcttactcaacattatgtttgtgagagtcatccatattgttgcattcagttgtagttcagtcattctcattattgtatagcacttcactgtgtgaatatcgcactttctcaattctactaaagatgggcattattaagtagtttctagttttgggctattttgaatagtgcagctgtggacattctcctatgcatctttttggtgcatatatatgttgaatatgtaagtatatagatataaaaacctatagctgtgtacataatgatatctgtcatatttatgtatcaacatagatagctgcatactaagtatatctaaatatatacttcttatttaatttttcttgatcataaccttttatattttactattcagtaatgttggagaattacactaggttaaggtacagaattaagaactaggcaatagaattcttcttttttttttttttttttttttttttgtttagagatggggtcttgctttattgcccaggctggtttcaaactcctggcttcaagtaatcctctcatctcagcctcccaaattgctgggattacaggcatgagccaccatgcctggcccagaattcttttctaattctaaaagctttaagtcttgtgtggcctgtgtatgaatttggtccatgataattatttgcctttcaagaaaatctgttatctgccttcataatggataattcccagatcaactcacacattgactaagtacctgtagaaaacacagaggaatctaggctagccgtgccttcaagttgctgacgttctatttgaggatacaagcaaatagccaataaagttagcctggataccagcggagttttatactcaagtattttcttggactttttttttttgagatggagtctcgctctgtcgcccaggctggagtgcagtggcgcgatcttggctcactacaagctccgcctcccaggttcacaccattctcctgcctcagcctcccgagtagctgggactacaggtgcccgccaccaagcctggctaatttatttgtatttttagtagagacgaggtttcaccgtgttagccaggacggtctgcatctcctgacctcgtgatccgcccacctcggcctccaaagtgctgggattacaggcctgagccaccgcgcccagcctctctcggactttttgagaccaaagaacacaaagatactatttttaatgtgaaatacctctaaaaatgttcattgaaagtagaaagattggcatcttaatacaagattgccagggtagggatggttgtcatagaaatttaccaaattggaacacatgaagacagagctaaaagaaaaatttatcttaatatcatcagcaaaatttgcatttgcaacatcccaaaaagaaattttatttatgaaaacccactgaccacatatgaaatggaatcatcttacaatgtaaacactcccaggaagtcattcagaactctgtgaaatgtctgagcactgcatttttgcaatctcatgaataagagtttaaatgtgagtcattgacacttttcctgctttttgttctggggaaatagcttcacggtaatattttcattaattgtatggagtgacttcagaatcatctccagctcctgtaccatcataaaggaagtcaacccagagggagtggtatgcactaaggtgaccgtccagagcccactttcaagcactgctgcttgctcctgcttgattcgctcacccagggcccagcaaactacagctagtgagccaaatctggcccaccacctgtttttgtaaatgaagttttattggaacacagccatacctattgcttacgtattttctatggcagcttttgagtagtttcaacagacaccatatggcccagaaagcctaaaatatttactatctggccatttatggaaaaagtttgtcaagcctggtggcatctcaccaactgccctgccccttcctctcatccctggctctcatctacctccatttggacccacaggcagtcaaagcccaagatctgaacttcagaaatgtgaataaggcttcataacctttttctctttttaatagagatggggtttcactgtttcccaggcttatcttgaactcttaaactcaagcaattctcttacctcaaccttccaaaatactgggattacaggcatgagccactgcgaccagacacttcataacctttgatatttttaagtgcctaatgccttaaccccaagaagtaaatgggcataatctcaagaaatcaaaatatgttttattttttaaaatggtttgtcactgatcttgaataaatcacttgacctcccaagtcattctttttctttttcttcttttttcgagaaagggcctcactctaccacccagtctggagttcagcggcataaccacagctccctgctgccttaagctcctgagcccaagcaatcctcccacctaagcctcccaagtggctgggactacaggcacatgccaccatgcccatctaattttttgaatttttgtaaagatggggtctcattatgttgcccaggctggtctcaaatttttggactcaagtgatcctccttcctctgcttcacaaagtgctgggattgtaggtgtgagccaccatgcccagcctgaagtcattattttgtatttgaaaaaaataaataatgaagggaccatttcatggtatcccactaggcataatgacataaagtaggcttattcctaagctgacagccaaatcagttacaacaaccaagatctattgtctcttcgttgtctcgatttatgttagtaaacatcagaactttggtctcatgagaggtcttggcaaccacaattcacatgttttctaatcaaaattaaacaatttttaaactctttgtcacacacttagaaatattcaatacatcgtcctttgggtaattaaaagcagcactaagccaggtggctagatttttgggtagccatttatgtttcagttaagaaaaagaaaaaggaaaaggagatgatgaagatttttcatttattttagagaaatttcatatgaaaatatagttactctctaaaagtctttttttttttttttttttttttttgagacggagtctcactctgtcatccaggctggagtgcagtaatgcaatcttggcttgctgcaaactccgcctcccgagttcaagcgattctcctacctcagcctcctgagtagcagggattacaggtgcccaccaccacacccagctaatctttgtatttttagtagagatggggtttcaccgtgttggccaggctgatctcgaactcctgatctcaggtggtctgcccgcctcagcctcccaaagtgctgggattacgagtgtgagccaccacacctagcctctaaaagtcttaaagataaagctttacatacttgaagttactcagtcagaaaatcacaacactttatatttctttggaaggaccaattgaattacaagatcataactaaaaacagatgaattttcttacctctatgctgtaaaaatcagggactatttctttaataatggacagaaaggccatgtcttagacaaaggggaaagtgggggataagataagaaatatctcatgttccattttttaacattaggtgtatgtgtgtatgcatacatgttattttttgtgacacagatgttctctgtttacattagatttttccaaactgttagcagtcaggtgcggtgattcacacctgtaatcccagcacattgggaggccaaggccagaggctcatttgagcccataagttcgagactagccagagtaacatgatgaaaccccattgctacaaaaaatacaaaaattggctgagtgtggtggcacatgcctgcagtcccagctactggaaggctgaagtgggagaatcacttgagcccaggtcgaggcttctgagccatgattgctcccactgcactccagcttggaaggaaaaaaaaatgttgggaggaaaggacaggggagctacaggggatggaggtaaaaaaaaaaaaaaagcagagttgggtagtggagacccatccttagggctcaaccatgtcattctgccagcacccaggtgacatttcatatatttgaggaagaaagggagggagcatggactctcaaaatgtgaggagtcaaaatatgtagttccaactatgtgaaagcagcttgaagaaccagagcattgacctattcgtgatttttgcagaggcactcatttggattggccctccaaacaggctggtgtaagagcctctcagtatctacaccaaagcccatctctcttgtggttttgaaattctttacttgtttgcagtagctccagtgaaccctcatgaagtgataaacatttagtttatttgtggaaatggcccagaagaaaaagctggtattagaaccgaagatgtctaatgaagtatatttttcttagccagaaattttggataaatgaatgagtggagaaaagtaagtgcctgagggctcaatatttgtccttcaattactttttaggttgtgattcttggtacatgccatattctgttcagactacctcttctctactaaaaacatgcctgtgcaggggcagttcccacactagtaggaggtacagtctcacacatttatgcctttgtataaattagagaaaatcctaatgtttcatgttttgaatagggaatatattcaaatggatcaaaaatcaagaaagtagaaaaaggtacacattgagaagtcttcctcttagaccagtcctgatcaccaaatttccccactcccaccctctatagcgaatcacctttaaaagattcttctgtatctttccagtgtttcttcatgcaaatataagaaaatccaaatatatatttctgttctctcccctgtttattatacaatgttctgtacattgcttttttcaattgacagtacatcctggagatctctgaatatcaatatatgaaaagctgcctcattttttaaatagtttcatagtatcccattgtgggagagtgccataggttatataatcaattgttccaatcttttgtttttgcagactatgctacaattgtaaccatatgcatgtcatgtttatatctgtgggtacacctatatgacaaattcccacacataggattcctgtgccataggtcaagtgtctgtattactttgatataaattgccaaattgtcctccataataattgtgctgtcttgcactctcattagcaacgtaggagttcctatttccccattgcctaaacatatttttagattaggcatttctctttcctttggattatcttaaatagaaaatgtcagggaggaagtctttttttgttcctatatgctaagattgcctataaaaaaatggtgaaaaaataggaaactaattttggaaacgtattgggtcactgaatcaaatgcccagtgataatttaatgtgtcatttactcttgcaaaagtatacatttttacccataatgaagaggacactaattcaagaaagtatcatagaaaattagatattttttctactctgaagcaatcactgattgtcagtggattctatacactaaattatttcagaattcatacacctgaaaattgtcaaatatataaactctaattattaaattattgatatttagaagaaggatttgtgaagcatttgtgccagtttttccctgtcatttatatatcaaaaaagtactcataatggaaccaaattatttccatcttcaacttgaacagctttttgatatttcaggttgaaaccaagataagcctgtgcattgagtctgaagaattgtactttttccaaatattacagttttgaaaactaatttatgaattgaagtagctaagttccatccagtttccaactcccattttttgacacagatcagaatgaaaaacctagaagccaatatccaaactttactccagacctttccactgttcaggcagtagttgaggactgagacagacgttctgaatgacaactttacggtgacaactgactgttaatgtcatgtgataacatgtctgtagcttttttggaaataatctaggatgatagaatgggaggtatctcttcaaaaatatgtatttagcctaattgctgaaatactttatatttttaggactgatatgactgctttttttcatttatttagtttataacttcatgtagtatgaattcagcctgaaattgacatttaaattttgtacctaaattcgtaggtttagtttttttaagaaaacaatggctttccagtaaataaaataatatttttacattttcttttgttcagccttgagtttgttttgagagctttagtttggataaaaaagagaaatgtcattttaaaatttgggagaattgtaaaacaccattatattttttcagatacgttttaaaatttattttgtacaaaatatttatagatatgaggcttcactttgttgaattcatcatacacacacacttctttttagcagaaattaatagaaagccaattctaaattaatgtaggtaatacataatctactcaactggatgaataccttggttgcaagtcttgtcctgagcgagctaagtgacaacactctcaatctactgagcttccagcatctaggcagagctcccaggacaagcagaagtcacagggaacaggaagcaggaaagagcaggaaaagatcctttagttcccatgtgtagaaacaaatgctcagctgcctctgtattgaaccatactgatgcctgccactatattgttcattgtagatagaaatcattataagttgcagtcgattagaaattgcaaccacctctttcaaaaaagtgattaccaaaattttgaaaggaagagaaatacagattgtaattttttgctataccagcaaagaaaattaaatattaaaaatattataaagatgcttctgacaagctatgtgaccttcagagtttcgtcgtcaaaacacagtattaatctagatcagcgtttctccaaatttttgttctcagcacccctttatactcggaaaaatcattgaggacaccaaatttttcttcatgtatgttatattgatggatatttatgatgttacaagttaaaactgatcattttataaaaaatatttattaattttcatgaacataaccccattaaatgttaacataaatgatatatttttatgaaaaaaattatattttccaaaacaaaaaaattatttagtgcgaaaaaatggcattgttttacatttttacaaatctgtttatttaacgtctggcttaatagaagacagctaaaactcatatcagcttctgcaatctgttgtactatgttgttttggttgaagcatatgaaaaaactctagcctcacaaaaaaaaatgtcgtttaaaaaaggatgaggattttcatcgtcttttcagataattgcgaatattctttgatacgacatcaaaactctcccattggcagttctgtaaagattagttgcaatgtgtaaagtgaaaccatattaatgaacttttcagacactactacattaaaatatgttgtctctcttgtactttgcatagatcgtttacataagcatggttttgcaacatcagatattggccgttacgaattactagtttaccaattataaggatcttctcaatgttgccttatttaattacataatatcaaaaaactacattcgttaatatcaccaccaatcctttgtcacgtggaatattaaaaagacatgtacctaagctcaagatatattaaaaatttgtaatttctctgctgcttcaacagggatatcttaagggaaactcatgaaacatgatccataaggaaaaaaaattggaccttatcaaaatcaaaaacttttactctgcaaaagaccctgttaagaggatgaaaagacaacagccgggtgcggtggttcacgcctgtaatcccagcactttgggaggccaaggcaggcagattactttgagctcaggagttaaggaccagcctgggcaacatggcaaatctccatctctacaaaaaaaaatacaaaagttagccaggcatggtggcatgcacctgtggtcccagctactctggaggctgaggctgtagaatcacttaaacctgggaggcagaggttgcagtgagccgagattgcaccactgcataccagcctgggcaacaaagtgggaccctgtctcaaaaaaaaaaaaaaaaaaaaggattcatatctagaatatacagagaattctcaaaactcaatggtaaaaaaaatgaataatccaaatagaaaatggacaaaagacatgtacagaaattttactgaagggtatatgcagatgacagataggcacatgaaaagatgttcaatatcattagccattagggaaatgcaagtcaaaccgcagtgagatatcactacaccctatctgaatggctaaaatgtaaaaaaaaaaaaaagagagagagagagagagacaacatctaattctgtcatggatgaagagaaactgctggtggaaacggaatgtagagccactctgtaagagagtttggcagtttcttttttcattttttttttttttttttttttttttttggaggtggagttgcgctcttgttgcccaggctggagtgcaatggcatgatctaagctcactgcaacctccgcctcccaggttcaagcaagtctctcctgcctcagcctcctgagtaactaggattgcaggtgtgcaacaccatgcccagctaatttttgtatttttagtagagacggggtttcaccatgttggttaggctggtctcgaaccccaggcctcaggcgatccacccacctcagcctcccatagtgctgtgattacaggcgtaagccaccctgccccgccggcagtttttttttttttttttttttagacagagtctcagtctgttgcccagactggagtgcagtggcgccatctcggctcactgcaagctccgcctcctgggttcacgtcattctcctgcctcagcctcccgagtagctgggaccacaggtgcccgccaccatgcccagctaattttttgcattcttagtagagacggggtttcaccgtgtcagccaggatggtctcaatctcctgaccaggagatccgcccgccttggcctcccaaagtgctaggattacaggcgtgagtgaccgcgcccggccggcagtttcttataaaactaaatatgcaattaccataagacccagcagttgcactcttgagcatgtatcccagagaagtgaaaattttgttcatgcaaaaacctgtacattgctctttccctgggttcccagtatcctggcaggttcctgaatatttgtcacagcaatgagctaaagcccctggaagaggtgaagttgggaaactgtggattgccaagactcaaggaaggactgaggtgtcatttactttgaatgaagatcttgcaaatattcatgatattggccgaaaagcagcttcagtcagtgctcataaagaacatccatttgtcttgcaaaatattggaggccatatatgaacaatatttactgagagctcatcagataagctgtcttcggaaggaatagtggtacaaagaactgaatgccaacagactgccagtgaaaagtacatgagattaaaaagattgcaaatagaggaatcttccaaacctgtaaggctatcacaacaactggacaaagttgtaacagccagttttgaacctgttgctaatcaatacaatactgaatgtgaaaggaaagagaaaacagatggaaaataagctccagctaataaacaacacgtttcagacatgctattttcagcctttagaaatatcaatattatcatcttaaggacttggtggacatcacaaaacaacctgtggtatacctgagggaactcttaaattggtcttcagaatgtaaaagagatccacaaaaacacgtgggagctgaaaccagagtacagacatcaccaaggagaagaaatgagtgattaagatggctcctagccagcatgttagtgaaacaacagtgatgctaagcaaaacgcattgatactggaaggcttgaacaccgtatgttaatgggggctaagtggcaatactttcctttctctcggtaaattttctaaacctataactgttgtaaagtttcttcagtgttttttgaggagaaagaacaaatttatttatagacttaacttgtattaaaccaggctattcacaatgggaataagggttggaggattaagaggatttctcttaaatattagcttttagcatgtaaaattaggaaatggtttttaaatgaggactctctgcccttgctgtatctctgaggagctgaggtagtacagaatcaaagagaataatatagcaagaaaaaaacagtcaactacagaaattcttaaaaggaataaaaagccaaagttccttattttgaggggggaaaaaaaaaaaccctgtacattaacactcacagtagtttcacctgtaatagccaaaccctgaagacaactcagatgttcttcaatgtgagtggtcaaaccaaccatggtacatccataccagagactactactcagcatgaaaggaaacaagtcactgttacacacaaccatctgggtgaatctccggagaaccgtgctaagtgaaaaaaagtcaatctcaaaagattgcatactatattactccatttatataacattcttgaaatgatagagttatagagatggataacagattaatggttgccaggggttgggaatgggaaggggagagaagggaaatatgggtagaagaggacatcaaaagggatccttgcggtgataaacctgttctgtatcttgactggtgataaatacacaaacctacacatgttactcaattgcatagagctaaatgcacacaaattagtatatgtgaaactggggaaataaaataatattggtagattatatcaacatcaaaaaaattgtgccatttcacattcccaccagctttatatgaaggttttaatttctccacatcctcaccccaacacttattattgtcagtctttttcattacagccattctaatagtgtatagtggtatcccgtggtggttttaactagcatttccttaatggctaaggatgttgagcattttctatgtccttacctacttatgtatctgctttggtgaaatgttcacttaaatctttgcacatttttaattaagtatttattttattttagttataggagttctttatagattctagacagaagtccttcatcagatgtatgatttgcaaatatttttcccagttagcggatttgtttttattttcttcatgtcttttgaagagcaaaaattctttattttatttatttatttttttgtttgaaatggagtctcgctctgtcacccaggctgaagtgcagtggggcaatctccactcactgcaacctccacctcccgggttcaagcgattctcatgcctcagcttccagagtagctgggattacgggcatgcaccaccacgcctggctaatttttgtatttttagtagaaacggggtttcgccatgttgtccaggctggtctcaaacccctgacctcaggtgatccacccacttcggcctcccaaagctctgggattacaggcatgagccaccatgcccagcctgaagagcaaaaattcttattttgatcaaatccggtttatcaaatttttcttctatggatcatgccctagtgtcctatctgtgaaatttttgcctaacccaagatcacaaagaatttctcctatgttttctttgaacagttttagaggcttagctcttacattcagttctgtaatcttttctggctaaatttttgtgtatgatatgaggcaggcatctaagttatttttttgcatatggatactcagtttttcaacaccattctttgaagactattctcattgaattgccttggacctttattaaaactcaattgacaataaatataagagcttgtatctggactttctttctggtccagtgacctgtgttctattgttatgccaataccatcctgtcttaattactggagctttatattaatagtaagtttttaaataagtactataagttctcctactttgcattttgtcagaattgttttggctattctagatcccttatatttttatgtaaattttaagatgaatttgttagtttccttggatttggataggaattgcattgaccctttaggtgaatttggggagaattgccatcttaataatatcaattcttcttttgttatatgtattctcaactattttattcttttttggtacagttttgaatggaatttttctttaatttttttagatttttcatggctagtatgcagaaatgcagttgttttctgcatattgatcttggatcctatgactttgttcaagttctattccttttgcagcatcagctttcttcctgcgaatgtgtgatggtgaagagtacaatgacctttaggtagtttggtgccacggtcgtgattcatgcgaaagcaccagcagtttacctaccattgcttttgtactaacagtgcaaatgtcaaccagtgaaaaaaggcagtaatctctgagtgttattttgattttgcagacctcaaggaaggttcccagggttccccagtggtctgcatacaacactgagagaaccagtgatctagatcaggggtcctcaacccccaggctgcagactagtaccagttcatggcctgttaggaatcagccacacagcaggaggtgagtggcaggcaagcagtgaagcttcctctgtatttacagctgctccccatcactcgcattacctcatgagctttgcctcctgtcagatcagcagcagcatcagattctcaaaggagtatgaacccttttgtgaactgcacacacaagggatctagattgtgcattccttatgagaatctaacgcctaatgatctgtcactgtctcccattaaccctagatgggaccatctagttgcaggaaaacaagctgagggctcccactgattttacattatggtgagttgtataattattttattatatattgcaatgtaatcataatagaaataaagtgcacaataaatgtaatatgcttgagtcatcccaaaaccatcctgcccccgctgccaggtccatgtaaaaattgtcttccacaaaacgagtccctggtaccaaaaaggttggggaccgctgatctagatggtctctaagctcccatccaagtgtaaaatgctataatttttaaaacctaagatgaacagtgttgatcagatttgactttacaacatttacttaaatggctggttttcttggcagtcaatatttcttaggcaattgctgcatgtggaacaatgtatctagtcctttgagagagatggaaaggaaatagaacactggtcctaatctcaagaaaatggcaaaagaaggctctctgggtttgcaggtgtctaggaaaggaacccagtgtcactgtaggctgattgtattagacctcaaatttgtatattttttgttctactaaaaataaacaaaatgcttatagtagagatacaacatatatcaaacttcaagactagaagtaaaactaggttaaaatctatcattctaggctagtacaacctaatgttatctcatttccaaatgaccataagacataaagtaacatcaaactaatttttacaactttttcaagtagctttaattttacattattgtttataacagacccgtggttggaagcttaaaatctccacttaactgatattttttctacattttatatgtaattcaaattatgtatacaatatgatgcttacagctcactgggcaaatttactatacattttagcttttcctttgagagtaatgaaatagtgttcatatattcaaggcaaataaatagtctcaaggcttcaatatgtgggattctccaagttctgacatccttaatctttttaggtagaaaaaaagggactgaagcactctttcacgggaagaatgaaaagaaattgagaaagcaaaattaatcatatacagtacagggaagggtgcaggttagcttagagataaatggagttaataatagtttcagataaactagttacagactagagttctgatatgaaaataatgtacaatttcagagctggtagagaattcagagagtatctagttctagcctaacatttcttgtttggcagaggagggagctaaatcttctagatttttgacagagctagactggaagccagcatttctaacttctcctttagtatgttccatccttccatctctgcattcaatagaacttttgtggttttaatactctcgacaccacaaattgcatttccctagaagacagcctggcttctaaaactttatagtgaattattaaaatgtatgccattcttatctgaagtttcataatatgattagtaagccagccatcctgactttgtcttctattttgcttaatgcctcaattatgagtaattgtgaagttttattttctaatgaatttctgttgttaaatattcaaaatcacctcaatcttatttactatcaagtcagtgagagcatcaactttattctactttattctttttttcccgaaacacacatatggtattattttgctcatgctgcataccatatcttttttggctcattttttccatctacactcaggataattgtgaccacatgacacattttacaataaagaacttaagtttcttcagaacttatacattagatcattaaatcagctgcatactttcaaatatgccatttgttttccctttttcctattcatcatcacctacatcactgataagattttgggatccactacctaaatctgtatgtggggatctctgctattctgttttatcttgttttgttctgctttggttttgcctgcctgtttcttttaaataggcactagcatgtctgaccatagagactgatgattaaaatcaactataaaacttttccattaggttttgggacttattgtctgtccgggtcaaagcaccccatttctatgatgggagctctgacccagacacacaataaggcccaaaactgtgcttgtatgtttttatgacaagatgtagggctccactcacaacacatggaaaatcttttctccattccatgaaaaccagggtctttctttctagcatgaatctcctctccattatgaattaaaccttaaagtattgacacacacaatcagcacaaaccttgcaatttcaatattgaggctctctaatttttcttctctaaagttccattcttctctatccaatgatcctttggtcatatgcttacaaaataagtaaaagcctcaagtccctcacttttggattggtactcttacagcaaagagagttattaaaaagagatattcctcttgattcccaggcttcaggtgactgagattctcaggggtgataagcccatatcttgggtgaataatctatcctcaaaggaaaaaatcttcatggctctggaactctggctttaaaaagttctctttctccttgtttcctctcatccaccttgttgttattaacatctatgtatttcagattctaaaaagtgaagacctcaacagagactgaaacaccgaatattcagtagtgaaagatgtggttagtgagtagcaacaattccatctctttccatctaaatgcagtttagcaagaagcagttcctcagaatccatctcctacgggaactaacatttatgatttgctatagatcaggccctgctgtaagtgcttttcatgtatgaacccatttaatacatcaaccatatgcatgggcactctctttatctgcagttttccatgaggaacagttaacatgtctaagtcacgccaggggacaaagtcacccgagcctgttctctttactgttaggtcacaccaccctcttcttctgtggagctcccagggaagattgcttagagcttcttgagaagctgttatttctgcttatcttctggtggggtcttttgttcttgtgtggcctgccaccaccctgcacctggtgacctggaccatgggtgaccataaccatgaaccatcaatagttatggctcacacttccatattctgacttctgccaagcccttcctctggattctctcttcgctggcccacagtaatcctctgtggtagctaccagaacgatcttcattttatagaagagaaaactaacaggcacaaaggttaacgagcatgccaatgtcaaaagatcaggaagacagcagagcttggggtcagtctgcccccaaggaatccagcttcagggcccacgctctgagctactatgccaagccagctgccttgattacaaggagggcttctccatccccccagctcagggagggcacctaaggccagagtcaaaaccatttatggaatttctgctctactctgcatttgtcatacatcctgaattcttggactggtcaggaggcaagaaaagcctgttcaaaggaaaaagtgtatggataggggatagggagaggccatagcttttatgacatttgtatgaatgctctgtctcaatcctgaagcaattaatgcataacagaagaacaaaatctattcttggtcacacacagtgacttatttcgtagtatctgcagtggccagagagcacgttctcataaatggcctgtcctgggcatcacaatctttataatcatctcagtctgtgctgttggaagatgtttttgtttgctactgagtcaactatgtaccaacttttacatcccagtcccttccccagaaagaaagaaaaacctcagaacctcagtttttaaagcctgatacctggtcagtcatgtccaattctaagcgaccctataataattcatattgaagggaagagaaggttttccttgctttgaggtttgcagctattacagactgtatttgtaaatccctcattcctgtctaggacaaacaggagatgaaggagaggagaagaacccttcggcctcacaggatggggtgagaggaaaatcagcacaaagaaaaatatgccactagttttatttgtaccattttaagatgccatgacaacaacaaaaataatgtacaagtaataggattaagtagcaggggatattaacatctggaatggataaagaggcataagttcgtttatattttcatggttgtgcataaatggtacgtttcagtttacgattacaaattatagcaattcaaaataacgtttgtgtgttatatgttcagtttgcagaattctttcatatgcattaacccatttgagcaccccaaatgagcatcatatccttgtggcaggtatgagaactacccccatttaacaaatacagaaacacagacttacaacggggaactggcttacccaaggtcacacagttagcaacaggtcaatctcgtacttgaacctaaatcttataggttcacaacccatcctgaatataggggagaacagccttattttgtagtgctaagctggtgaggcctggggcagtagaacatctgttattgtactgtgactttatgtgctgatgtctttagggactattgtctttgggtgagagtgtaaggggatgcaggctacatggccccaacacgattttttctttttctttttcttttttgtttttttgagacggagtttcactctcgttgcccaggctggaatacaatggcatgatctcggctcactgcaaactttgcctcccaggttcaagtgattctcctgcctcagcctcccaagtagctgggattataggcgcgtgccaccacacctggctaattcttgtctttttagtagagacagggtttcaccacgttggccaggctggtctcgaactcctggcctcaagtgatcaatccacctcaccctcccaaagtgcagggattacaggtgtgagccactgcacccagcccaagattttttatttcttgtgactatattttatacctttttctgctcctcctgttccatttgactgtcagctgtcatttttgctgaccatggcacctctagagcagtgatcctcaaagtatggttggtgagccagcagcatcagcatcacctgagaacttgctagaaatgcaaattctcaggccctgccccagacctactgaatcaggaactctggggatggggcccagccatctgtgtttcaatgagccctccaggtgattctgcagctgctaagtcttgggagctgctgctccacagcaactattcacaaccttggctgtccttgggaatcccctgggacccttaaagactactaatgcttatgtcccaactccaaagattctaattttgttggtctaggacacagttttttaacctcagcaccagtgatatttgggtggggggatgattatttgttggggttgtctgtcctgtacattgcaaaatgtttagcagcatcccaagcctctacccctagatgcgagtagcacacccacccccagctgtaataactaaaaatatctcagacattgccaagtgttccctgtggtggtggggggaagggggatggcaaaattgtcccctggttgataagcactggcctagggtgatggccaaggcactgggatatggaagagctcccaaaatcattctaatatacaggcaacactgagaactatgcctctggagagtctctattaatgaacagctctggatgtgcaatgggccagagcacaataagagctaagctttacaccactgggtgtagagtgagaatcagtccccctgtggtggagactcaggcagtttgctgaggactaacacacatgagctttagggcataaatttcacaactttttggctccttacatttttgtttactttctggttgtcaggtatgttctagaaaactaatgtaaacagatatgttccccatacttaagaggtcccaaccaatgagatcttgcattgcactaaatatagtggtgaatgtacatcctccatctggctctatccattctacaaacagggtgcatatcagtgtatcatatggtacaagttcttccctaaatctgtttttaatgggttaaaacatgcagcttgtcaattctatgatgttgattttgatacaatccaaatcaaccacacaaatgcaaaattcctatattaatctctgctgtttagaagagctttcattttcaggtggggatcaggggctttaactatatttcaactatagaaaaattccctgagttagaacaaagacatgtaaaatcctggcccagcagattgccttctgtgtctccacgattctttctgtggtgttcttctgtgatctgcttgagaagaggagaacatgatgtacatttagaccatgggatgtgcctcacctccaagggcctgccctgcagctcttaggaaggtgggcagtctcatcacagcccaaagtgagatgtctccaagcaaagagtaaatggcagcctctcttcagcctagactcttaaatagcacagtattctcccacttcctcaaacaactcgatggtaggtttctttcaacataaagagtgggagcactactttgagacactgataaacaactttcaaatagaaaataaatttcaaagtgaatgtgttttcagggcaaaattggtactgtctcatttcaaactatgaaaatatgatctgatttaatgagttggagtcatccattcatccagcacctactatgtgctaggtactgtgtaatgtccttggaaattataaatatgagggtggcaaattataaatattagggtacatagactcttgtagcaaaaataagctatgactgatctgaggtgcctgattaaccctttgaaccaatacgactcgtcagcttgtcagactcttttgggttttgttttgtcttgttttgttttgtttttttcattgaattgacagttgcttgttaacattagtgaaatcagtgagttctttgccatggtctaggatgtattctcttaaacagttacttatttattcctctcctagtctatttcattaacatgcttttaaaaatcaaaactttttgattaagcaatagaattgctctccagaaaattactccaggaaaaaaagatcataatggagtactaaaagatattatttccatatgttcccacttgttttctttttgtaaaaaaaaaaagcatatgcttctatgtacataggatgttttctggaagaaaacacacttagcaattaacagtggttgcctttgggcagggagtttgggggccttgactggaagggagacttaactttgcattatataagcttttatacagcttaatttttaccatcttatgtattatatttttaattttaagtgctagtaaataacaggatgcattcccagtagtccttcagaagctccaagtgcttctgctaaataagagaaaaccagtgagccccactgtttgcctccatgaggactcctgctcctgctcttgctccagcagagcaagctgaaaggacactttgaatgtaggactgctccaacactggttccatggaagagattaacaagcgggttctacttgaggttagatagttaatgagggcctctttgaggaagccacatggaaccagagaggaaaaggaaaagagggggacgttgcctacaggcagggacctaatttcctcctagcagcattggacacttactacccatacatcctttcagaatgaaggacatacaagttagggaagtctacacagtgattacacctaataattttctccaatgatttctttccttcccctttatctataattcccaagaagaatcaatgctcactcctaggaaaaggaaaaagaacaccaccaccaacaccacacctatttgtctcaaagaaagacaattccatgatcttttttgcttcccactgattccatgatgtctttcctctctgtccttctttatgcctaaccctaacctaatcctagttaaaagtttaaggaagcatgtaaaaggaaaaaatgtaattgagattggaagaatctgagagaatccatgttcatttgtggtttttctggatcattttcttagcacttgccactgagaccttcacaggatttcagagtctcccttattaagcaagaacatctttttcttttctttcattgttagatgtgtgaattgggaaatccattcatgtggattatcagggtcctcttaatctccgggaatgaacaaacaaacaattcaactgttccagagtatatcccataaccgtgcctacactgttttaattacatatatctgtggtctttgaagaattataattctgagccagaattctaaattcttattctataaaaagtagttttcaggttttcttgtttttatagggtgattcatctcagaaatagtgttttatgtctttacttgcaccaagcattaataaccagcagtcagcaatggcataattatttgtcagcttcatgaaaaccataagaaatgaaggcagtgtttgtgcaaagagttttgtggttgtccttggacaaaagtttatgaggaaattttgagaagacaccaatcgagactgtttatagtgagatgaagaagaaaccagaggcactattggattaaagaaaaaggttattttcaaaaactatttagaagaaaggaagtaatcacgaaaactaaagagagaaaacctctataatgaagttttatagggtcttagccaaaaatcacagagtgagagactgccctgtgtaaccaagttctcattctttatctacggggtactggtttcccaaactctttcaaaggactcgtgttatggatcacactgaccatggaattaaacctcacatcatcttttggaaatagtagaaaagaaattcaaagcttagcttagagttactatggcaaaaagaacttttcaaaaaaaaaagaaaaaggagtttgtcaagttagtaggatactgtttcctagtgagttaagtttaaattgagtcactaagcaaaaaattagaaaggaaatcaataccattttcacacttgaaaaggcatcatatgttcagcaggaacttccttcccccttttaggtagctgagctattatttaagcccatgctcctagtataatacctaattagacaaatacagagtactggtagctattgttatgtgtctgctacccagcacagccactagagggtgtccactcttgccttgcaaacaaggttggaaattgtcaacatggaagaacagatttttctgcatgtgataccaacagatcaaggtaaccacatttttctgtatagtaaggggaagtttgagcctaaatagagaaaagccacttacatcacatctactgaagcagagtcagccccttaagcacagaggaaaatgtaagttcaaagtggctttaggtgttagctagctgccaaaattagtagcttctacaccactttgtttttttccagtattctccctaacctttcattcttaatttcagagacaatataatctgccaattccagtagttgaaattatttgctttactcatggtttagtaagcacagataaaaaaccactgtcggcttctcagttgagctgtctcccaaaatcccaaacttttactactgtttgaaaagtaggcagcgtgactagttgatgtgagatcaaaggcacatctcttctgttattaaattgtattatataactataatatatttaatatatatgtattatattaatacactatattgatttttatgtattaaatatatatcacaatatattcatgttactacatattaataataataaattatatctgtatatctttccagactaaaaattgctgaggctttaaaatacgaaagaaaaaaataacaattctaatactcttttgctacagtgctaactgaaaagcactgtgaataaaatttagaagttgggacgcataactaaaactgtaagtgcccacatgctccgtgccagctctaccatttcttaccactgtgtctccttctttcagctgctggctgggcgctggccttttgatcacaatgactttggcgtatttctttgcaagctgttcccctttttgcagaagtcctcggtggggatcaccgtcctcaacctctgcgctcttagtgttgacaggtaatgtggttctttccctttgctctttggctgggcttagaaaagcatttttctcaaaaagaagaaaagtcaagagaattcgtgcccaggacagctgttgattagcttcaagtgaattaaagcattaaccatcttgcctttgctgtttagaattgccttccacatttgctgattattagccatctttggctcagacaattatgtacctagagcattttatcaagaatacccatttgacgcccttttggcaataaagtgaaaattaacatattagatggaataaactttgtgaaaaggagattccaggatatgcaaatcctatatttcacctggtaaatttatcataaaaaaagatactgttcaattatatctgtaatgtttaattaattgagtgagaggtaagtgcaccatattgctatgttcttcaccctgcctttttgaaagactgaaatgtttcataagttttaaaaagagtgcaacaccagaagcatccctttatccaattctgaaaactccatcaaatgtcccgaagtctttccagaatccgcacgcatgattgttaagcgttctctaaagaagcccttctgaattctgtgaacttctagatggtattttctttaccttctggttttcatagcagcaattataagaatgaaattaggaactttataacacattctgtggcactcttttatatttactataatctcacacaagtggtgtataatggcctatttaattagcctacatacaatttagaagaggttttcattctaactcattccctgacaatcactttatcagggaacctgagtctcatcattatagaaataaaaggctcactcttctaaagaacattaaagagtttacagatattctgttattttacatttataattattgttaggacaaaaattgttactgttaaaacataaaaatgtgcattcaatcagcaattagaaaattagaatggtatccttgttataaatttatgtcagctgggcacggtggctcacacctgtaatcctagcactttaggaggccaagatgggctgacttcttgagcccaggagtttgaaactagtctgagtaacataggaaaaccccatctctaccaaaaatacaaaaaattagctggacatggtgatgcatgcctgtagtcccagctattcaggaggctaaggtgggagaatcacctgagcccaggaataaataaataaataaatggctataactgtgaaacacaaaataaaaatgttattaaaaataaaacacaaaaaataatttcattagtaatttaaaacacaatcataccattgacaaaaatgttcccattgcaatggtaaacacaaagatcagaaataaccttatcatctattaataatacccttcagtgatttgtaggaaagtctagggtctctttgggttacatctacattatattagatgttaaaggctgctgcataaaaacacttacataccataggtggccactatataatcttgagatcatggtaccttagaccataaaaagctgaataaacacttatgatgtggatttgattcactaataaattctcactctgatgttcccactcccagcatcccaatatcatttcttctttcattcaaaatgttatattatctaaaaattaaaagcattaaattgcacctattacattgctaatacaagtaaaatttttcctgtattcatcaagctgcatatcatcaagttacatttctttcagagatgtaaccatgtattttcattataatatctaattaaattttttagttataactctaaaattcatgtagagaaaagaaatgggaaaataatcatgacattttgaaaaaagaacaatgtgtcctacacacatgttcttcctatatgatttttctttttattaaaatacagggtcttgctctgtcacccggactagaatgcagtggcctatatggtcattttaaatgctataaagctacaatgttttaaacaatgtaatgcaaacccatgaacacactgacaaatcagtgggaaaactcgactcaggtgctggaatacacaagaatgtattaataatataggctgaaatcactttgaatataatcgggggaggaaagatttatcaataaattatgctatttagccatctgagggaaaaagcatgttaaagtcttctgtacatatcaataataatatttataattattaccatttattgaatattactaagtgttaggccctattgaaaatactttacaaaaattagtttagggctgggtgaggtggctcatgcctgtaatcccagcactttgtgaggccaaggtgggcagatcacttgaagccaggagttcaagaccaggctgcccaacaggtgaaaccccatctctacaaataatacaaaaattagccaggcatgctggtaggcatctatagtcccagctgcttgggaggctaaggcacaagaatcgcttgaacccgggaggtggaagttgcagtgagccgagattagacaacagcagctgcactccaggctgggggatggagtgagactctgtctcaaaaaaaaaaaaaaattagtttatgtaactgtgatagttggtgtgttatctccactttacagatagggaagctgaggttgaaagagattaaccaagtcagcatggctactaagtgctggagccactaatcaaatgttggtagtctgcattcttaaccactatactcaagcatgtaaaaactcaaaccattgttgatgaagaaagccaaactctgaataatagttgaagagatgtattctgaaccaaatgtgaagaccatgacccgtgacacagcctcaggaggtcccgagaacctgtgcccaaggttgttgagttacagtttaattttatacattttagggagacagaagttacaggcaaaaacataaatccatacacgtaaggtttacagtggtttggcctggaaacatgggacatcttgaagtggaggttgggtgaggagggcagggtggtgcttccacgtcacaggtggattcaaagatttcctgactggcatttagttgaaagagttaagttttgtctaaagatttgaagtcagcaaatgctgacaagaagtgcttggggttaggataagggggttgtggaagccaaggttctatgtagatgaagcctccaggtagtatgagaatagatagtaaatgcctcttatcagatcttaaaaggtgccagactcttagttaaatctctcctggatcaggaaaagacctggaaatggaagggaataatctacagaatgtaaattttctccacaagagatgcctatacagggccatttcaaaataggtcaaagaaatatattttggagtgaaatacttctatttctttcagggccttctctctgtcacgtgatgctatactagagtgtgcttgggatttggtatgtcactgctacagagagtctgttttgttgggtgtttgtttttttttgttgttgttgtttttttgttttttttgtttttttttttgagatggagtcttgctctgtggcccaggctagagtgcagtggcttgatctcggctcactgcaagctccgcctcccaggttcacgccattctcctgcctcagcttcccgagtagctgggactacaggtgcccaccaccacgcccggcttattttttgtatttttagtagagacggggtttcaccgtgttagccaggatggtttcgatctcctgatctcgtgatccacccgcctcagcctcccaaagtgctgggattacaggcatgagccaccgcgcccgtcctgttttgttagtcttaagatctgttctaacgttaatgctggcctgttgtgcctaaattccaaagagaggaaagtatgaagaggcaggtctgacatccccttcccatcatggcctgaactcgtattttaggtttctttgaaatccccttggccaagaggaggagtccattcagtcatttgaggggcttagaattttatttttgtttataccataaaggagtagaagaaaatagactatctttttgatctctggaaagggaaggaagacccttctgaactttaaaagaatggtagaaatgctggacaaaattataaatgtattttaagatatagtattttaaaacctttggattaaacattcataaaacttaaaaaaaaaaaaagtagtaagctaggaaaaattgtcactcctcccacaggcccagggtgcagagctggttcctcctcacttttttgttctgcctcctctttcttccttggggggatctaggagcatcatgcggagcttcagtcatgcccagtgttgagtcggggagatactgggaaagttaggtcatagattcctatatctagtgtcgggtcacctcacccaataccacctcctctcttcatctcatgcatgaagaaaaagaaataagatgttccatcacgataaatagttgtgtatcaaatgaaatgtgagtcattcttagttaaaaagaaaggaaggactgaaggaaggagggaaggaaaagaaagaaaagaaaaaaaagaaaagaaagtaagaaaaaatgatgccaagaatctatctcattaagatttgatctgagttgtagatcaaggaaatgaactattttaaaattccactctcacaaaaatcagccttaatccaaaaggtctttccttgaaaataaactaatcattctttgttccctagacacacactttactatttttacatttcatttggtattgaccctaagcttcaggacttgtatgtagggaatctatttgacatttctatttcaaaagctttcacacgagagaatgaatcattcacacttaattcctgaagataagattccatttgctttaactcttaatttggttgcattatattctactactacaaaaaaaaataaaaataaaaaataaaaaacactttttaaaatgaaacaaggaatgaaaagggagtttggaacctgttgcagtttgtgaatccctgctttcattttatgagctgaataaattatggcccaggacaaagagttcccatgatttttttacacagtattttaaaaacataattatctcacatttcagagttgtttgaaagaaaatgagagaaaccttacatccaagttctataggatttctttattacttcgtcaatcaatgattacagaatgatgtaagatcaaagaaaatatctagctttctcactatcagcttttaatctgaataagctaaacaggactgagagaaagcacatgatttctgccagaatggataggctttcattgctaatttcaactatggacttgtctcagtttaaccttttgaataattcctccgcaaatctagtttcacatccttggtcatttgagaaaaagacaaatcaggaactgaagaaattcagaaacaaattttgacccctatccagctttcttgttgaattatctttttaattctaaggcagtatacttctataatgaataaacttttcccaacaaaaatgaataaccagccattaccagctattaaaatagttatttttacatgctgaaagtgacaagttttatatattactttgagtttgtttggaggcaaaaaaaaaaaaagcagcagcaggagaggggtaggagggatcactgttgatctttgcaaaatcgtgttaaagtggaagatgatgatgatggggtcagaccagtaaaaaggtctgggtacagatccaacttgttaaaagttgcctggggaagaaggctataaaaagataaaactcttttaacaactattccagagtgatgtgttattagatacttggaaaagttgcaaagatccattaatgaggcagctttgttttatatggctgaaaagctgatgtcagttcttgaacccatcatttcaaataattgatcagtggtctctgtgatattctcaaaggtatatcctaactcaagaaacatgaaggtggttttcagaaaaacctctttgttagagttggacttggtttctccttattttcctggtgttatggttttctattgcaccatgacaatagtgaagacacagaggaagggtctgagccagaagacatgagcagggaactggacaaagtccaaggctggctagggcaataggatcttatttgggagtctgttcactatcgtactgagttatttgttcttttatcttattctattgtcaagatcaggcaactggttaattttgctaccccacttctctttgataactaccccaaaacttagcaattcagaacaacaaccgttttatcatatctcaccatgttgaaggtcaggaatttgggcaattcttctgctccttgtcacgtcacctggggttggtggacttcagctgactctgagcttgtgtcagaggtccaacactcacatgcctggcaccttggcagggacagctggatgtctgagctcagcagagcccatctccccctccatgtagtctcagggtcctctctgtttttgctccagcaggctcaaggctcctttcagaggccagacctggaactgcaaaacatcattctagccacactcaattgatcaaagtagtcacaggccagctcaatttaagaactcaactgaagaagtggtaaagcatttgcagctgtcttttaattcaccacacctgattctcttctaaattggaattggccaagcagttgcagtggctcagccttaggaggccgaagcaggaggatggcttgaagtcaggaattcaagactaccctgggcaacatagcgagatccttgtctctacaaaaaatatttttaaaaattagcctgtcatggtggtgggcaccaatagtcccagctactagggagcctgagataggaggatcccttaagggagtacaggttctggaggctacagctatgattgtgccactgcacttcagcctggatgacagagtaagaccctatctctaaaaaagaattcttcctgctagcatttagcttccaaacctccatatggtatgagagatataaatcattaacaaccattacaaatgatcaagtttgctgttaattaaagatgtgcagaggtaaagataggggcggcactgtaccttatggaagtggtaaataagaataaataataaattctaacacaggcaagcattcattaacaggcacttggtagaaacttctttcttaaggcacttcagccacctatttattccctgatccagtaatcccactcaagataattaatccagaaaaatcattcagaaagagaaaaaaaattatgtgtacaaacaagcttataggcgtcttattcacagctgtgaaacactagaaatgatgtgaacatagaaaaaaaattcaagtaaattatatcaaaatcttgttatactgtgtagccattaaattgataagggccacgcccgtgtagaaacataggagagtatttttaatgtaaataaagctaaaatttaaaaattgtgagtcatatgattatagtctattcaaactatgcctgtgagaatcaaaacaagaaaagaataaaaaaatagattttgttgaagtggtatctttttaatttgttttattttataatgttttaaagttctttcaagaataaacatttttaaacttaatgactatcccagaccacaccttcaagattcaataaacatgcattaaatgcctctggccttaataacatgtaaaaatctatttataggcacacgcactaacaaacatctttacatgaataaaatatatattttatacttttattttggcctatcacatgacagggtacaaggtgatataatgcaaaaaggctctaccgggagttggcagccctgagccatggtccagacgccccaggttcactggagaccaggcagaggatgcgacaagatgccagctctcaggttcccaactggaacatatggggcagaaagatcagcccatagatccctcctttaaattattgaatctggtcctctaaaagtattagcttttaatctgtggcctaattcatggctagcttgaaaaataggaaaatgatcagaatgtagtgtgctattagctttagccaattaaggtaaggtaaggttacacagtacatctgtgtaaacataactcttagaattatgctgactgattcttcaccagaattccctagagattaagaattccctagccaattaaggtgaggtaaggtacatgcatggtaacaggcatgaaaacgccaacaaaaagacacttcattcaacaggtatttatttggcacttgttgttctaggtattgtgaccaacatacaaaatgtcagcctttatgaagcttatatgctttttttcacttttttcttttcttgctttcttttttttttttttttttcagacagggtcttactctgtcacccaggctggagtgcagtgccatgatcagggatcgctgcaggctcaacctccctgggctcaggggatcctcccaccccagcctcccaagggaatataggcatgcaccaccatgcctggctaattgttgtatttttgtagagatggaatttcaccatgttgcccagggtgtcaagcgatcgcccccctcagccttccaaagtgctgggattgcaggcatgaaccatcgcacccggctgggaacttacattctaaaggagaggggagagcatagatgataaaccaaataaataaatagaacattgttggtcacattgtagtgctatggggaaaaatgaatcagggtgagagagacaattctggagggggagttggcaaacttaagtagggtctccagggaaggcttctgtgaaaactgcaattgagtaaaaaccggaaggaagtgaggaagcagctctgaggacacctgtaggcattctcacaggggtgggaagccactggggggtttggagcagagggtgctatggtctgacgtaacagcctcactccagttgctatgttctgacgtaacagcctcactccagttgctatgttcagacgaggctgtggcaaagcaaggtggacataggaagatcagttaggaagctatggcaatcatcaaggcactgcgataacaggtacgatggtgaaaagtggttgcatttggatatatcttgaaggaagttgttgcaagatttgctgaaggattggatgtgtggtggaagaggagtgaaatctaacccaatgtttggggccagagatgggaacaactgcagaaaggtttagccacaaggaagacaaggagtctgatttgggagtgtttagatgcctgttaggtgtcctagtggagctcgcaagtaggcagttggaggtacaagtctagagttaaaggtgaggcaccaggctagaggtataaatttaggaattaccgctagatggatagttaaatgacattaaagccacgagactagatgagatcaccaaaggagagcgcatagacagaaaaaacgtctgagcactaagccctcagacaaatccaatactaagaatttgtggagaaagcggggtccagccaggtaaatgagaaggaatggccagtaagtcagaaggaaaactgggagattgtggtggaaatcaagtgaagaaagcatttcagagaggagggattctttctggaacagcagttgtcagtggtggaatctacacttgcagattttccatgacaactgaagatgtcatggatatacagagagagatgtatatacatactgactagatggaaggctatttataatcgcacctcatgagaaaagcatatttgtgtgtcagtgtgttgtgccattatattcaaaatagaaatcagttttgaaacatccagtgtttcatggtttccatacatttccccacctccattatcacaaatgattgttcctaattgttcttatggctgttttccccttatctcatggagatgttatcgagatctgtgtgattataaatggaaaatattctaattttcagtgagtgggttaatgaaggagcagactgatcatgaattatttgctaaactagactctaaaaatgacttctacttatttgtgaatgttgaatttacattggattatggatgtgtaatattctgggaactcatggcgctttataaaaatgaagttggtctgtgaacatgttcatcataagaacatgttgaccacattttattccttaagccacttttcaccccaaatcctggcaaggaaatcaggttttcttactctctaatgaaacagggtgttttatttaaatcaccttccctggtaaacaacctgagagaagggaagaagaaatagatgtaactccgttgacagccttgggatatagacatcctgtctccattcctcttagctttactgggtatcaggctgccagtttaacaagggaacaaagaaaaataaacaatgatttttatcccactggacaatttatggaaataaccataaattttaaaattcaatcttgattatatcataaaaggattttcttggtctgtttgcatagctgtattttatcccattttgaaataatctggacttttttgagatttgtattgtacacaaatcttatttaccctaaaaatcttttataaaacatttctccagtaaattgtgctatataatatgccatgtggcatcatcgtaaaatacccaaatctgtacatgctcatctctagggaattctggtgaagaaacagtcaacataattctaagagttgtgttttcacagatgtactgtgtaaatgtactgagacagtacactaaatataactgatgggggcttgtcttggtggatatgggtagcttgtatgttgccttggctttattgattaatcttctacattactttgcatgtcctgcaaacccatgagcacctgtctccaatgcattcggtctgttttacagccttctggcactatctaatgaaaactataaaacgaaaatgtttcttttccattacggcagcaacaaaaatttcaggaatgaggccacaaaaataccataccacgtcacaggtctcttcttaatagtaagtctaaaagcagttagcattagaccttcacatcaggtcaaagaacatagaatttctaaaccaaaccttccttagacataacatttaaatgtgattattatcactaaaatagtgaagtaaaaaatagggtgagcataatttcttattatcagacagttttttgattgacataatcattcagtcacatttatgttatatactctgtttgaaccattcttttctgttagattgtaaaccctaaagattaggaaccaaagtatctttaaataagttttatctgctctagcacagggccataatgggagtgatataatccctctttgacatttaccacaaataggtatttactaaaactgccacctggtacaagcccactgtgctcacataagaagggaggaaacaatggaatatctgtggtggttattcactcaaggatatctagacccacttcatagataatgctttaaggtttctttttttattttataaagaggaataacatattactataacaagtaccagcagctttcatgatccctcccatccatccaatttctcccccagcttaaaaaacataggcacaactgtctgttaccgccacattctaaactctcctaagatttctctagaccaaataaagacctcagactcaggcctgccacgcagttgatttccaaatgggtggaactcttaaaagccccacttgtggccgggtgtggtggctcacgcctgtaatcccaacactttgggaggccaaggcggtcagatcacaagatcaggagatcgagaccatcctggctaacacggtgaaaccccatctctactaaaaatacaaaaacaaaattagccgggtgtggtggcgggtgcctgtagtcccagctactcgggaggctgaggcaggagaatggcgtgaacctgggaggcggagcttgcagtgagctgagatcctgccgctgaactccagcctggcagcctgggtgacagaacaagactcagtctcaaaaaaaaaaaaaggccaggtgcagtggctcactcctgtaatcccagcactttgggaggccgaggcagacggatcacgaggtcaggagatcgagaccatcctggctagcacggtgaaaccccgtctctactaaaaaaaaaaaaaaaaaaatacaaaaaattagccgggcgtggtggcaggcgcctgtagtcccagctactcgggaggctgaggcaggagaatggcgtgaacctgggaggcggagcttgcagtgagccgagatggtgccactgcactccagtctgagcaacagagcgagattttgcctcaaaaaaaaaaaaaaaaaaaaaaaaacccacttggttttcataccaagactcagaaaattcctaaaaagacaattactggtattggcaatgaggaggaacttcccagcacttacaatttttgtttaattgaaatacatttaaaatttcctaacaacttggttccattaccctttttttcaggtacagagcagttgcctcctggagtcgtgttcagggaattgggattcctttggtaactgccattgaaattgtctccatctggatcctgtcctttatcctggccattcctgaagcgattggcttcgtcatggtaccctttgaatataggggtgaacagcataaaacctgtatgctcaatgccacatcaaaattcatggaggtactaaacgtttaaaaggaattaactggggaagggaggaggtcctccgttagacttcaccatcttgagacttgatgacatcgccacaatgtcaagtgtggtttcttctgtcaaatattcctcagttgcatgaaaagtagatgttaaacctgtgtctagattcttgaatagaacagttatgctggctttcactcttgtattataccacaatggtagacatatctgttattctgcaccaaaccactaagaataccaaagcaaatttactaagagggactagatgtgtgtgtgtgtgtgtgtatgtgtgtgtgtgtgtgtgtgtatatatatatatacatatgctatttgtttttataataatgaatacaacacaacaatttccatctggaagacgtgctgatgtttatcttatgtcacttggggagaagcacatttctcacattctttaaagatggatttactaattcaaagtagagagtagtacttacatgtacttatattagtacggtttctatgtctaatatacaaataatataaaattgtagaacttcttaaaataatattttggtttaacaaattcagttgttggtttttttagtacacctgaccatattaatgtttttctgaaaagcttaatcacatgactgttttgggaaacctatttaaaatgcatcttttctttgcaaaactagttacatgtggactgaggaggaaaaccaaaaggataactatttctcttaaatcagtataatttagtgctttgatgtaagtttcatgtagctcacattccacatgtaattatttacagacatctcaaggtatgctttcccaacttggaaaattcacagaattcgtggttttacagttgaccagttatcctgcttggaaattcttgttttaaaattaaaagtgctcatgaaaactgccaaactaacaacttaaaattgaagtttcttactgggttagtcttcaaagtgaaaaacaaagtagacagtaggagattgtcagaatttgggctgtgtgaataagcaatctagatattccagatgcaaacattagagaaaagaggttcactataagaaggagcttactaatccttacagccagacaaaatgaaatgggctgtttcataaagactgtctcctatctagacgtgttcaagtaaagggtagctacccttcaggcatgggtgggctagacggttgcagtaaagggtatgagttgaacagataattttttagagttcattccaagtctgaagtcctgttctctttttctaaatttatttcccctattttttccattcttgctcttcaactttaccctagactgatggtaggcccctctctacccatgttgatgacatcagttccaaagagatgcattacccatttctctgtgggcctttgccatggagggggcaggggactccattcagccctctcaagggtcagcctctagaccctctgcagctgtttctgcatcatttatacccagccagcaaatgcacccggaaaaagaggatacaaaagaagggagaatgggtgctcaaaggagtgttcgtgttgcacttcaaaaaagagagagagagtgcttctgactttttttaagttcaggactgaaatctttctacagtgtgttgggaacagggaaatgtttgtgtaagcagtttagaataaaccaactcctttgggagtttgcacttaacctgaggatagaattcagggatctgtgaacttggttggaaaagaaacaacatgtttattttcactaacttctaactgaatttattatttccttctattatgaatgtacccaacaaatcaccatagtgtttaccagtatcatgactttttcagtaataaaaatagcagacattttcatacgatataacacttgtataatctcaaaatattatttatgctcttcagaacttcaacacttcaacagttcggtagttattagaaccatcactaggtttgttatttgtgaataaacacaatattactatatctaaatttaatttctaatattttgatagctgtgctttaatgtaattggtttccattgcaatcttatgtattttattttatgcatgtaaaagtattattctcagaagggattatagtctttaccagacttccaaaagggtctgtggcataaaaatagtcaagaactcctcccccaaattttttgtctttaggaaccatttttagattattttaatagccatgttataaatgcagccttcttagcctctttctatattcagaaactgtcccattttttacagagcaacatgattattttttactgtgggaactgcattgtccttagtaaattaacaatctgaagaagcactataaggaaagaaaaagcatttcgtcccaagttggtgattaattttgtgggaagaagaatttagatatcatttttcattttccatttttatagggtattaagttttcttctttaagcagaagtaaaaccgaataatctcggtatttataaatcctgcccagttagataataccagatatgcttcagttgagatatgctgcctcaatagtttccaggtggtaagtattaaaggagggagaagagtatagctattgaagttcaaagcggctggctttaaggtcacatagcaggcataccaggcagagggttaacccctattaaccaaagctacacagataagccattcgtaaccttcaccgtttcaggttaaatacactttcaccacaatagtcaaaagtaaagcaggcgctaacaaaattttgaggttcatccagaaataaagataaacatgtatattcttttgtctcaaaatcatgttttatgagctttagaaggacattatttttattgattagggctcttccgttgtgtagttgaaaccttcaatctatgaaaagtatcaagtatccttgtcaagataatttttgtaagtgcagtttctttatgtgctgtttaaagccaggataatttctgaagcttccaactgaattgagttttgagccccactcccaaacccatcactgcaaccagagagcatgattttacagatgtatctgcaagtttaaagaccttaaagctaccagaggcacagcatggttaattgacatgactctgctcctccttttctctttttttttttttcactttgaagttctaccaagatgtaaaggactggtggctcttcgggttctatttctgtatgcccttggtgtgcactgcgatcttctacaccctcatgacttgtgagatgttgaacagaaggaatggcagcttgagaattgccctcagtgaacatcttaagcaggtaaatcccataacatcatgaaaatctggccaggactggttagtccttgacagcagcaggcctgcaaataccatctttagtagaattagcctgatttcctaaaataaaaatactatcctgtaactgttttctttatagtaatagtgttagaaatttcttttgtaaaatgggaaacctgcttgtaaaacaagtggtcctgaaggctgggcccaaatagagaagaactatccctctattttgccaagagtgtactgagcatgtgtgtatgtgagttcgtgcattcaattgggcttgaaactgtaccaggacacaaaaaagcatgtaactttctccccatgcagatttacagtcttgttgtagaaataaaatatgcatgcaaaacaactggaatatagaaccacaggtgtggtaaaagtagcctgtgctatggaaagccaggaagggtatgagatagagtcatggggaagctgttcatggatgagggggattgaaccagaccttggaggataagtgggatttgatggggaagaagttgacagagagcatttcaggtggaagaacaggagtctagttagaacgtggaataggaaccatgcatttggggaatgggaaaaaggagatgaacctctctagagcaatgtctaatgtgagacttatgctaggaaatgggatcatgtacattagaagaggtaaagtgttggaggacccaaagttctagaaggaatttgaacatgtcaataggaggctaatgttggtccctcctgggtgaaattagaacagataaagctgtgggctttcaagggcaaaactagactcatacttggctctctgaccttgggcaaattgcttaatctctctgaacttctagtttctcataatatgtatgtaataatacatcatggggattacctgagacatataaggtgcctaatagtacccagctcctagtaggtattaagcaaatgttaatttacattaattctaagaggaaacctaggacttcaggtaagttccctgttgcaacagaaaagtatataatggtggccaactacaccaaaagttaatgtgagttgttgatggagtctgtaaatctgtcctatataattaccatgtgcaagcatagttcctcatcagcaactcttcaactactatactgatttttctgagcttcagcttttcatctgtaaattgggcataatatatgaatcaatagtattatgaggatcaaaaggatgaatgtgtatgcatgtactttataaaatctaacatgccatacaaatggtagctattatctttcattgacatttagcaagaagattacattgagaaaccttagtatgactttgttcaggcatgaaagtttcaaatactccaattgcttaatatgtttacaattatttcctctcattcttggaatggaggtagttagtatgggtttgtgaaaaacagtgttttaaaatatggatttttgcattcgcaccatgattgagcctgtttaagctatgagtggtatttgctgtggaaataattaaatagttaattatttaattttggaataatattaattatttaattgtggaaagaaataattgtcatatgctgcttcatgtttacacagcattttttaagtttttaaagtgcatttccatttccatgtctttttcttatttgattcctccaagcaccctctgagatcagtaggatatatattctttattatacaggtgatttagaggtttgctcaaccaaatggagattagaacccaagattttgtcctcatgcagttaacgttccttttggtgccactcaaatctgtagcaaatcctaagtacagaagagcaagtgtggctgaaagtcctgcagatgggactgcgggagaaacagcatagagcacaaaaccttgccatcttgactaatactctgtggggctcatagttttgcttcttgcttggttgtctctaatttctcctcatcataatgatgacagttttatcaagtaggggttgtgttcggatgctgggaacacaaaacccaaaataactgttagttgaccaagaaggagtttatctttctcccatagcaaaaagttcagacatcaagatttagtggtcaagccaagttagaggccaggtatctactgttttgctgatctttgcttcagtctcaggagactgtagcagcagctctacttttatatctgatttccaagcagcaagaggggaagaacagaaaacaacccgtcatgggtgtgcatcaaaagagtgtccctatacttctcagtagctcttccggaaacccatgcaatggtttctatttcatctaacgggtcaaaaccctgccaagtggccatgtagataattaggccaggttccccagctgccttaacaaatcaagaccagagtgatggtaaggaagacaggagaatggatattggttaagcaaatatcagactatcatggcagtgtactaatactgcttttaaaagcgttatcctctttgagtatgcactcaggaaaggtaacctctcccctaatacactgcttttctatttttctgggcacactgtctttctggacacacaaaatgacccttttaaaaagagcccccattcctgaagatttgaatattttatttcttccctcagtcattactccggagccatatcccagctagcccaataactatgagaggttaaagaactcccagttcctttagctagagtagcgagttatgaaaactgccccagaatattttgaatggctcagccaatcatgtgagtttattgtaggcttcccggacttaatgttatatgtttcaggttgagccagcattacccttccagaccctgtttttaatcagttttattttgacattaactgatcccagttacagacaagttgcattttgtgttcctagtcaggcttctaaatgcatgcaatataatactcaaataatgcacaccaatgaatggttgcagataattcctaatttatagattttctgatcctgagcagactgaaaggcatgcaaaccttccatgaagtccgtccaaggtcagcatgtttcagattttctagtcatcactgctgataatcctttaccctcatccttctgcttgcaaacaacatataatatttttatatgtcattaagaaactacatgtcattaagaaaagaatttaaagagcaaaaaatcccaataatagctatgttcaagatcaggaaaaggaaaaaacatagtgctatgacttttccttttctactccccactcctattttgttttctccaggtctttgttgatttgtccatgcaatatcatgtgatgttcagtctccttgccttccatgccatcattaatgctaattagttacctgttattaagagtcattagctaaccctttcccccatgcagtcacactccaccccactacacacacacacaggcagactcagccacctacacacacacagctgcagactcagctggctcacctccagccagtttccacctctctcctggcatataacctccgtcctggccctaataaccaacctgaggcccccatccttcctggaagctgcccagaagcatcattagcaattccttcgttagaacactgaccttagaatcttgaagaggtagaggcagtgtaagccaggctgttctcctggctcttctttgaattattctttctctggtgtctgctacttcttggtactgtagttcttgcatctagtataaaaacactaaatttgttgtcctatttttttctcactttcctttagcgtcgagaagtggcaaaaacagttttctgcttggttgtaatttttgctctttgctggttccctcttcatttaagccgtatattgaagaaaactgtgtataacgagatggacaagaaccgatgtgaattacttaggtatgatcctgtgtactcgctagaaaattggagtttctcagattttcatatttataatacttttacaaaaccagctactctacatgcccgttagccctgaaaattaaaactgcaaagttgatttttttctttagctgacatagcctataactgatcccaaaatgtgtgcaagccacatctgttatcttgcccctcccctcctgaggctgtgcataagggtttgagctaaccaactagtgatgtatctgtaactgtcctgcaaaactgaaactgccgtttaaacaagcactttttacaaaattctaactgccacccatacgaaatggcttctgggcaagaaaaatgcttattctaggaagaaatgctagtgagcagattttaaaacaatatattctaattattctacaccattttcttttgctctagtttcttactgctcatggattacatcggtattaacttggcaaccatgaattcatgtataaaccccatagctctgtattttgtgagcaagaaatttaaaaattgtttccaggtaagatgatttttcaagtattttttaaagacaacaaaatgagtatattaaacagtcaacagacacagccaattccagttgtaatattactttgatcagctatactactttttagcagtgaagtgaaaatcatgttttattacccagaaagagagtcagattgtcggcataacagaaaagcagttcctatttagacaaccacatacaaagaggttaaaatcaaaaggactaaatcacatgccagtttagaaccctcctttagagagaaatgtttcaatgtatgctccaggccacagagagtacataagacctattcataccttactttgtcttagacttgaaccaaagtcttgacaaaatataagctctattgttaagaaagcgctcactgatcgagaccatcctggccaacatggtgaaaccctgtctctactaaaaatacaaaaattagccaggcatggtggcgggcacctgcagtcccagctactcggagaatggcgtgaacccaagaggtggagcttgcagtgagccgagatagcgccactgcactccagcctgggcgacagagccagactcagtctcaaaaaaaaaaaaaaaaaaaaaaaaaaaagaaaggtctcactaaatgctgtttaattgtgtacttagtaatagaatcttcaaggaaagtaaatgcttattgctgtgggaatctgaacaaatataattttattcaaaatcagtttccttctgctttcaaacctccagccagctcagccacccatgtccttcagaagctctaagcctgtcttattgatgtgtaattttctggttcctgaaatcattttagcataggcttaatcctcactggattttgttatcttggaccaggctgtttaactttagcttatggtacatatgaggcagagtgcggtagaggtcaagaatgcaggctctggaagcaaagagcctcgatggacattacagccctgcacttgctaactatctaccccaggtagtgcctctcttgctttttcagtttcctcacctataaaattggatgatcacagtatctctctcataaggagggtaatatatgtaaaatgcttgaaataataagtgctcaatatgagttgattactattagggacagagtagagaggaaaaacacagtaacgacctgcatggaacttacagtctaaacagaggcagacatatattaaccaaggaatcacacaaacagatgaaactcggtatggaagtttggggccgtatttctgaggtcttcttggaaatgtttgccagtcacaaaacactcagcccaaaatggattgactaacatgcaggttaaaattagtacattatataaggtgaaattaattattacttactcattaatttacatattcattgggggagggaaaatcaaggtaaaaattatcagaaattaaccccactttttgatgaatcttcctaaaaaggcagtatatccaagagaaagagcccaaatctagagagtcctgggttctaattccagttctaactctcattatcctctctggacctcactgtcctcattcataaaatgggggaatagcataaaatgggagaacatccaaggctgttgtgaggatctgataaggtacctggtgcggagagccacacaggtggtgcacactgaagaaacgctaggacccccccaccagcccagccctacccgtgcctgccccaagctgtggagagcccttcctctcacctacagtgccttccctttctcttgcacttggtaataaaattaaaatgagaaacaagggttctatttctctgcactggaatggacagtgtaactcctgcctggtgataacaggctctccactctaggttactgtcaaggttcacttccctcgaatgcgaatggacatttgcccctcattagcatggcccagggccgctgtgtttggccgggaatgggctggtaggctcgccttacttcgagtctgttccttcccccagtcatgcctctgctgctgctgttaccagtccaaaagtctgatgacctcggtccccatgaacggaacaagcatccagtggaagaaccacgatcaaaacaaccacaacacagaccggagcagccataaggacagcatgaactgaccacccttagaagcactcctcggtactcccataatcctctcggagaaaaaaatcacaaggcaactgtgagtccgggaatctcttctctgatccttcttccttaattcactcccacacccaagaagaaatgctttccaaaaccgcaagggtagactggtttatccacccacaacatctacgaatcgtacttctttaattgatctaatttacatattctgcgtgttgtattcagcactaaaaaatggtgggagctgggggagaatgaagactgttaaatgaaaccagaaggatatttactacttttgcatgaaaatagagctttcaagtacatggctagcttttatggcagttctggtgaatgttcaatgggaactggtcaccatgaaactttagagattaacgacaagattttctactttttttaagtgatttttttgtccttcagccaaacacaatatgggctcaagtcacttttatttgaaatgtcatttggtgccagtattttttaactgcataatagcctaacatgattatttgaacttatttacacatagtttgaaaaaaaaaagacaaaaatagtattcaggtgagcaattagattagtattttccacgtcactgtttatttttttaaaacacaaattctaaagctacaacaaatactacaggcccttaaagcacagtctgatgacacatttggcagtttaatagatgttactcaaagaattttttaagaactgtattttattttttaaatggtgttttattacaagggaccttgaacatgttttgtatgttaaattcaaaagtaatgcttcaatcagatagttctttttcacaagttcaatctgtttttcatgtaaattttgtatgaaaaatcaatgtcaagtaccaaaatgttaatgtatgtgtcatttaactctgcctgagactttcagtgcactgtatatagaagtctaaaacacacctaagagaaaaagatcgaatttttcagatgattcagaaattttcattcaggtatttgtaatagtgacatatatatgtatatacatatcacctcctattctcttaatttttcttaaaatgttaactggcagtaagtcttttttgatcattcccttttccatataggaaacataattttgaagtggccagatgagtttatcatgtcagtgaaaaataattacccacaaatgccaccagaacttacgattcttcacttcttggggttttcagtatgaacctaactccccaccccaacatctccctcccacattgtcaccatttcaaagggcccacagtgacttttgctgggcattttcccagatgtttacagactgtgagtacagcagaaaatcttttactagtgtgtgtgtgtatatatataaacaattgtaaatttcttttagcccatttttctagactgtctctgtggaatatatttgtgtgtgtgatatatgcatgtgtgtgatggtatgtatggatttaatctaatctaataattgtgccccgcagttgtgccaaagtgcatagtctgagtaaaatctaggtgattgttcatcatgacaacctgcctcagtccattttaacctgtagcaaccttctgcattcataaatcttgtaatcatgttaccattacaaatgggatataagaggcagcgtgaaagcagatgagctgtggactagcaatatagggttttgtttggttggttggtttgataaagcagtatttggggtcatattgtttcctgtgctggagcaaaagtcattacactttgaagtattatattgttcttatcctcaattcaatgtggtgatgaaattgccaggttgtctgatatttctttcagacttcgccagacagattgctgataataaattaggtaagataatttgttgggccatattttaggacaggtaaaataacatcaggttccagttgcttgaattgcaaggctaagaagtactgcccttttgtgtgttagcagtcaaatctattattccactggcgcatcatatgcagtgatatatgcctataatataagccataggttcacaccattttgtttagacaattgtctttttttcaagatgctttgtttctttcatatgaaaaaaatgcattttataaattcagaaagtcatagatttctgaaggcgtcaacgtgcattttatttatggactggtaagtaactgtggtttactagcaggaatatttccaatttctacctttactacatcttttcaacaagtaactttgtagaaatgagccagaagccaaggccctgagttggcagtggcccataagtgtaaaataaaagtttacagaaacctt

SEQ ID NO: 36613 - DNA, 63981 bp, Homo sapiens; identical to SEQ ID NO: 36612

SEQ ID NO: 36614 - DNA, 13071 bp, Homo sapiens
cggcggctgcaggcggcgggcaaggacggcgggcacagcgcagcactccccgctcgttggcccgggtatcccagcgcggacccacgcgatacgctgacgccccgacgccgatccggccgagccaagtaagggggacggcccgagacggagaagggagagagtgggagtttcccagcccgcagaactttcgaagttgagaaaagaacccctggaacgtgcgctcagcactgggattttctggtaggggtcagagcttcaagtgcaaaggatgtcgcttctcatcagcaggttccttagttcaattcggtagaagggtcacctccctctacagatcgagtggtcagagagggcagcccttaatgatgctttatgtatttgttgtttgaatgtaagtctgccaactgaggtgctgcttttgagactaaaaaaccggctggtcgtcctggttagtggcgagatgttggggtacggagtgtgggggtgagggtgggagaggagtgtttgtgcatcttgctgattgcaacgtaagtacttatactttatcaccagtagccggaaaaacagacctcccggctaggggaggcagtctgcaaagggaaagttgtagagaagttgttgaatatcatttaggggagtcttcagccttctgatttgcttcaagaaggggatctgagaatggtggctcaggcctgtgatctcagcactttcggaagccgaggcaggaggatcacttgaccccaggagttcgagaccagcctgggcaacatagtgaggccactgtctctaccaaaaaataaaaataaaaataaaaaaactagtggacgtggtagtgcaggtctgtagtcccagctacttgggaggctgaagtggaggatctcttgagcctggcagttggaggctagctacagtgagctatgatcgtgccactgcactccagcctgggtgacagagcaagaccctgactcaaaaaaggaatctgagttgaattaaagaactcttgagaatggatgtggttttttaagaatgaggcactttctctgcaaatttcataggtctgaacatgagcaggtcatttctctgccagggtgtctaggtttggagccgggatgttttaaaagtggtatctgtgggtaagagggcacagctgaggcataaactttaaacagaaaatttcccccctacccccaataatggcaggtggatgctctccaggcagctggagagcatcaaggcaactttactaaacatggaagttccaataagtgcctgtccagtccagccagggttgcagtgggcaggggaggggagggtgatgtcattgccacgtgtttcccactgaggcacaaaacctgctggacactggtgcaattaagagccaagtttagacaagagcagctaacctgaccagctggtccccagcaacattaacttgttgcttttcaagccatctttggagtctgctggttctttccagctgcctttgtgccagctctgagtgcagctcttctttcatccaagtctgctttgaggaagggggaagcccatgggcagtgggtgatgttaaccgtatttgttttcccatgcaaatgatagtctgcctgaggagctggttactgacagtgtgggcagcatgtgtgtgtccagttgaaagcctgtcttgttggggtttgggggactgtttaattggtggtctttatgttagggatacttgcttctcatctcatctaataaaatattactgatgactgaccatgtatttgagcggagctctcactcatgcttactaatgctgccatcttggctgctttgctccccaggactcaacgatgactctgaataatgtcaccatgcgccagggcactgtgggcatgcagccacagcagcagcgctggagcatcccagctgatggcaggcatctgatggtccagaaagagccccaccagtacagccaccgcaaccgccattctgctacccctgaggaccactgccgccgaagctggtcctctgactccacagactcagtcatctcctctgagtcagggaacacctactaccgagtggtgctcataggggagcagggggtgggcaagtccactctggccaacatctttgcaggtgtgcatgacagcatggacagcgactgcgaggtgctgggaggtaggtgtcccagccccagtgggcttctttccaccaggggtggcccaggaagaaagagtgagggtgggtgacttatttacccacagagttgggagctgaagttaggcattttggacaattgatgggggagctgagtctctagaaaagcccaagcacaggctttcgggcaagaaaatgaaaatgcttgtagacaggaccaaaatctgttgatcctgggccagaaagggaattcttcagattccaattctaaatgggttggggaaggctgattagagagggcagagccagagggtcagcgccccacttgacttctgctgactctgacttgaacattcttcccggaactcagtatagacacagcctttttccatggttatacctaaaacaagccagttggaaaagctgttaggatggcttgatcagtttgcttccaccaatattagaaagttttgtgggtgttaaatagttcaaaatctgtatttgaaatagcataataattttttaaaatgtgaagtataacaatgaaactttctatagagtctgacagcttttcaagacaattttccctgtacaatttcatctatttattgattggagcctggcctatttccaaaactgttttgaggtgacattatctcaaaatgcatgtattcttcagctaggggtaaagcacagccctatgttctgctaagtaatatgaggatcctgatagccaatgccatccataaagtgtctttcagccacagcttcagtctgagcgtatgcgaccagggtagttatatgtccctatttgcagctacagaaataaaggaagcactgctcagtgtttccccaagtcacatggtctgtgttctgtcgcgactcacaactgaatcacagagtagggaggtgtcttagcgatgactcagttctcccctgcattgatgcatattaatgttattcctcactacccacagcccatctcatctggaggttttattcttcttgattgtctcagtgtcaaggagttcactgcctcatgaggcagctcaggaactgggctataaataatgactcattgttgtaacattgatttctctcctcactcctggaatctcagaagagtaaagggagaaatagggccagtgttgtacaattgattccctctttctttgtaaaggctgccaggtgacttgctaggaaagagaaacgggaggaaggggctagcatttagagtgaatgtttgcaacgggagaggcactttgttaggtgccttatatttgctgctgtttattttggtcttcacaaagttcttgtactcatgagtaaactaagtctcagggagatcaaaagccttatccagaatcacccaataaggaaggtggatttagaatttgggattttatcatcttagttcagttcattttaccatttctggggaacttgctatgtgccaggcactgtgttaaatacttcccacacatatttttgataatacttgaatcaatctggcattaatatacctatttgacaggtgaagaaatggaggcttacaaagtcaagtgactttcccagggtgaaaaaactagtacatggtatgaccaggattcaaatctagttgtgattgaacccaaatcctgtgtcttttcatagccccctgcagccccaggatttagcttccaaatactaagtatgacagcacattgggcatcagccacacacctggctctggcctaagctctgggatacaaggcgatggatgaggtataccatgccccctagtaatgagctaagtgttagttgctatgttgcagagcagggtcacattaactaatattttaagcagtaacgatacagtgctttgggcgttgacataaggaagagatggactgggagttgttttttgtttttaagagggaagaattgaaaaaagttagtggatagtagactttcaaaaatgtttgtccattagaatggagttgtatgtatccagagggtaatattcccataggcataaaatgttaagaagactgactcatacctggaatttggaaaggtagccttcccagatattttgggaacttctttgttgagagagagagagagagatgcccaatatgacagcacattgggcatcaggcatatggctgatcctggggccgcaggggaccatgaaaagacacaggatttgggttcaatcatgagagaaagggaatcctttccctagcttcttacacagagaatctgtaggacctgctggaatcactagttggttttgtttcccaagaggaaggttttctaaggcacacccctacatttttttttttttaaatcagcattcactgtaagaaaaaaaatcgacataatattctcataatgatttctcctaataaagatggatattgttacagttacactacagtaatcttatgactctctgtatacactgaatgccattcattcattcattcattcctaagaagttactgaatgtatagcacagagcttggtgaggcactctggggacatgcaaagagtcatggggcttcttctgcggagatgctcacagtatgcaatggagcataatgtatacaccaagtagaaattgagataggatgtggtaaatgtcttgaaagtggtgtaaggagagtgctgtgggaattccgaggcgaaaagattacctctgactgtggatttaagagcttcatggttggcccggcatggtggctcatgcctgtaatcccaacactttgggaggccgaggcaggtggatcacctgaggtcaggagtccaagaccagcctggccaacatggtaaaaccccatctctactaaaaatacaaaaaattagccgggcgtggtggcatgtgcctgtaatcccagctactgaggaggctgaggcaggcgagtcatttgaatctgggaggtggagattgcagtgagtcgagatctcaccattgcactccagcctgggcaacaaaagtgaaactccatctcaaaaatgaaataaaataaaataaaaataaaaataaaataaaataaataaaataaataaaagcttcatggaagagatggtctctgaactggaccctagggacaactaggatttggaagccctgagctaggtgggaaggcacaccacacatatatagcaaagtacggaagtctcattgggcttggggtttgatgatgggtttagacgcagctctgacactgacttggctgggtgctcttggacaagccacttagcctcctcaagctgcctcattagtgtaattggggtaatacctccttcatagggtgttacgaggattaaaggatataacatgttgagcatggagcatggtgcctggcacatagtaagtacgaaatgagcattagttagagctgattctgaatctaccatttccttttgatgtgcttatctttcaaaagtggtggtttccttgcttgtggcccctgtccactttggtcactgttggctggggcccgtggagctgtccagaggggaccggggccagtagagtagaggacagtatttgtagagcaggcatttcttctgaggttccttgggatcccctgagctatgaaagctggaagcagttgaaagttttcagggagagggatgctggagtctcagaactttagaggtgctgcaggagtcagttctggcagtgagagaacacttgggcgggtttcacacacacacagcacttgagccagtcttgggcagaaggggcctcacttccaagcacaaggagtgttaacgaaaaaattattaacatggtaaggaagactttattcagggccattgcagtaggcatcccaatagtggggagagatggggctcaattccaagtacaagaagaacaagtgggcacttagccaaggagcaggtgggagggggtcagaggatagaaaattactaagaggagacgtcaaggttagggggattcttgctgaagtcaggccaaggagcaggtgggagggggtcagaggatggaaaattactaagaggagacgtcaaggttagggggattcttgctgaagtcaggccaaggacttagactatcagaggtggtgggtgaggaatttgatcagatattgaaggtgggggattctcactaaactgacttagcaggattcttgctaaagctgaattctgccaggatggaaacggaagcccagggagaggccgggtagagaagaggattcagaggagcctgactaaagtttggtcagggagagagtctgtcagggggatcaaatgaggaaagacaaactggtctagagaaagtggctactgaccaccatcaccccttatagaacgtctgtctgtccccatcagcatgagttcttttgctacatagagtgtgcacagacaccccagctttcttccagtgcactggagaagtaggggtgtctccagacccagattacggaaaagcctcacagagactaatcagtatccaaacctttctccacacctttactggaagcagatttcaaagagctctcctagagtctggtattcttttccttcccttcttctcacctgattagcacttgaaaaggataaaagatgagctgagcaacttagatgaagagaaacctggagctctggttactcccaggcttgcacctggttaggggagagccttcagtcgggatgccatgtgtgctggaagggtcctggtgcacacagccagaggccgtatctaaactcatgtactggggtggggggtaaagtggggagcacacgtgctgagcagggaggagatggattgttttagcctcccaggcctccaacaccgtaattttcaggcaaaggtaagatcagacagaatgatcctgtcaggaagcttctagaacgggaaagcatgtttttactttcatggctgtgatccttagtccactttttctctagacttgttctgatatctcttaagccaggagaaagttgggttttccttttccgtcagcgattggaacacagtatgtttctatttgaatgactgggcactcaagcgagtcccctgtacctgagtggtgggctgagaaagttcctccatcattgaaggagttgtctgagtgcagggaggggttttagagaagagctaagaaccctgtggtgggaagcagcagtcaggccatccccgttctgtgctgctcaggctctgacagtctcccttgcgttgtctaatttacaggttgaggttgtgaggttctacccctggtaatccaaatagtcccactgtgatctcattccttctgcatattgtgagcaggcacacgatgggcgagacagagttttaattccccaagggcaaacacttactgattagaagaatgacgctgtgggaggtggggaaactcacagaaagacagggccatgcctggttaactctcttcttatttgtccaagttttccttctctaaggaagggaaacctctcctgattccaattcttagatgatgaagcattaaaccaggagcagtgtttttcgtaaactgctcgctattgtaaaacaagaagtgccctggttccaacgtagctctcttaagctaggatttatctgtagtgaggaagtgctgagtatggcaagaaccagcttccttcacctgaagaagtgataatggctaacactgactgagtttctactttgtgcccaggcttaatacaggtaattgtcacatagccctaaggtgtgagtactattatcaatcccattgcacagatgaagaaaactgaggctcagagagcctaagttgcgtagacccccagagttcataagggatggcacctggatttgaattcaggtttgcttgttttcacagccacaatgctatatttatcattcgttcactgtacaaactttattgtgcaccagcaatgtaccaatgtgctgggggacacagtaaacagcatagatgcaaatgtctgccctaacattacgagaggggcaggagggacagaaaataatagaataagtaagttaaatgtgttgtatgttaggtggcaataagtgagatggagaaacataaagcagagaaggaatattgtgggatagaagtgttgcaattttaaatggatggccaggaagcacctcccccagagggaggtaaggaaacaggccttgtgggtatttgagggaaaagattctagacaaaaagaacagaagaaaaatgataaatcattatgaaagtcataattttcaaaagatgaaattcaaaacaggaaacctcattgtgaaaatagagtggggatgggctcaatggtattgggatgagggaaatcccacttgcaaaaatcccactgtaccccttttctacgcctgccccccatggattttccaggctggaactgctttggcccattgtactgtactgtgttcacccttcacctacacaagatctgggctcaagtgcagggaggaaagtttccattaccaagtagagctggaggctgcatttctattatactcaagatggaaaaacaagcccacttattcctagggaacagcattttttttaaaaaaaggaagaaaactacagccaaaacagggagagtctcaagattcattcttgcacttgtccgaagaggagcaatgtctctgagcccaaagctcctgaaattgctagtgagtattcagtaactacccactgaaaggtacaatggacttatgaaaatgtggcttacagtttcactgggtggttaatgtttcctcatagcattaaccattgaatctgagtcaaaagctcttgagtaagtttatcctcacaaatgattttgccatacaaaaggtccaggaatgatgcaaacaaatgccttttactccatgtggtttagtgacacatgttcgagagagacgttctgctggataaggactggaggaattatatgtagaatgttgttgaaggtgacaaaaaatagtaatttgcctttgaaaatatctgtatacttacataattaattgcatatttagtaagtttatgttctagcacaattttctacctgaccctcttatggagaagtgttgcatattcgcctgactccaatatctttgttctttcttctctagaagatacatatgaacgaaccctgatggttgatggggaaagtgcaacgattatactcctggatatgtgggaaaataaggtatgcagagcctgtagctctctaaattcctttagggctttcctttcaacaagttgtttggtgcaagggtgaccttgtcctatatagtaggtgttccagatgaggtgggctcattttcttgattaaaagcatactgctgaagaatgagactgttctaaggaacaggtcgttcacagatgagttctgaataacaagcaagttgtagtgacttgcctttagttctattaaaaaacacacccaaaaagtttatttgttttagggaaaatacaaacaggcattgactgttattttaaataacatacatccatctcatatgaagttgagattctcaataccagtcttcaacattggctttttaaagattttaaaaagcttcagaacctatgtgctagacttctgttaattgaaaaccctcctagtcccacaaaagtgttcttaatctcatcacttggaaaaggcaaaagggagtttttgggaagtcagaaaaggctcatttttggtagattaaatagaaattggaaatgctgtttggcagagaagttgtgtaatttatcaaatcaagctgtagaagatactgaaaagtgaaaactttttggcataaatactggacaggctagcaatctttacagccaccagacatcttataggcatagaagaccaatgcttttagggagttggaagcgattttcttcctttttcctatttttcctatcagcaagtgtactttaggatacacatattgtttctttgcaaactgatgctttattccccaggcctaactgaactcacagaagatcttattgtttcattagggggaaaatgaatggctccatgaccactgcatgcaggtcggggacgcatacctgattgtctactcaatcacagaccgagcgagcttcgagaaggcatctgagctgcgaatccagctccgcagggcccggcagacagaggacattcccataattttggttggcaacaaaagtgacttagtgcggtgccgagaagtgtctgtatcaggtaagaggagcagagccaatactgtagaaacaatcgctggatcacatgtgttttccttcagacacgggttcttccctccttccacgaggctggatctaggaactcattaagatgctatatgaaattttaggtgtgtttctcagactcctacagtcccagtgggtctcctccacactagttgttctcccttgtccatctggtctacctgcaggatactaatcctcccgcttttaaggagtttcctggaattcccaagagtacagggaaatgaaagtagcatcttcatgcaaggaggatagggaactctgatttaggggaactgtgagaaagagtttcattgaggaaaaagaattctactctggctgactctggttcctgtgagccctagaaacactgtcctactctcctactccccatccctggcttctgaaatttcatttgaggcatcagtctgatggggtcacatattcttcttcatacttagctcagggaaaatctctatctgctgagtgggcagccaagtgcttttatagcccttgagattttactggcctaattcagatttgatcctggtacaattataaaactaaaatactacattgccgggccctgctcaggaggaaagacacctgataaagacaatgtacacactagtttgggaatgtcttcctactaggacacaactgtctacagtaatcattttttttccaaaccaaaacttgatgcatggtcattgaatgcaatgaaatacttgaaattgagactgtcccagaaaagcttgtataatttaactgtattacacatttgtaaaattctcaattttttcccaagatatctcattattgctttatttttatttttattttaaaagagaggaaagctaagcagtagaattcttatttccaattctggaaactgggtcaggagaaagagttgagtatgggcttgagaactgagcagacctggcttcactgccacttacaggctgtgtgaacttcacctgcagaggagactcccctcggtttcttcatgtatttgacagggataataatgtattttccaagattgttgtggacattgaaaacagtgtttataaagaacttagccttgttcttggcacattgtaagtcagcagtaaattaagggtatggcttttactgttataactaatatcactatatttgatgaaatgggaccttcagacagtgaatttatgggggatcagatctaaagcccatctcccttacttccagggaccctccagtgagacattttctattcatgccctgggagggcccatgccgcagcagcatcctctatccactgcatatacagctgacttagtgttacctcgaagaaccatccagcttgactgtgtgctatgtgggactgtgctctgcagtccctctgacctctttctttccttcccagaagggagagcctgtgcagtggtgtttgactgcaagttcatcgagacctctgcagctgtccagcacaacgtgaaggagctgtttgagggcattgtgcgacaggtgcgccttcggcgggacagcaaggagaagaatgaacggcggctggcctaccagaaaaggaaggagagcatgcccaggaaagccaggcgcttctggggcaagatcgtggccaaaaacaacaagaatatggccttcaagctcaagtccaaatcctgccatgacctctctgtactctaggaacccagggtcacccagatgtccctttgatggccgttgttgaaggccattgggaccaataatctatattagattgaatacttaagttagatgtggtttcccccattgtagcagggagctagcgtattagccttgtgggcaacatgatgcatgggaaatgaaagatttttgtaaaaagtcagtatttatttccaggaaaagcctgaccttgctatttgaacacccaagactctttagaggatgtgtttggtgttcacatgtgtttcttctattttggatagtagagaagtaaagcttacaaagaatgcctagaacaagaacttttcatcattaaaaatttttcccagtgttctgatatgtgactttgaggccaatgagtcataaacaaatataagaaagctgtcaatgagtttcttcaaaggagggaaaactttctacgaatctaagatccatggagctagaattgtagaactaggctcatcagaatcgtgactattattgctccatcaaactgtgaaaagaaatgatgtggaccttgctggaaacaaaggcttagcaaacaatttttgttcaatgcccaccaagacatatagaattgggaactgatacatgtgtcccttataggctcaaaaattatatcttacaatttcttatttagggggaaattatttgaatcagattctatttagtcaaaccaccttttatgttttattatttttgaattcatggagccatcataaaaatatttttaaaatcagaattattgataccctgtagtgcaaaatgtcaatttttaatgtataatcagaagtctgaatttttataaaacatatagcataaaaacttccagtactttggttgacccttgtatgtcacagctctgctctatttattattattttgcaaaataaccattttaacatttgataaagcatatttatgaacatatttcttaataagaaaaatatccattttattaccattttctatctttttcaaaatatgcaagtttttacctatatgtcttataataaaagaaataaaatatttg

SEQ ID NO: 36615 - DNA, 3571 bp, Homo sapiens
gacggtcgccgcgttccatcgtcgcgcggcccttcgggcgcccgagcccgcaatgtcgggccccaacggagacctggggatgccggtggaggcgggagcggaaggcgaggaggacggcttcggggaagcaggtgacccgagggggctgctggagcaaccttgcattttcagggctgccctcccgggaaggggaatcgagatggggtctcggaagggaacaaagagcccacccattccgccccgagcgggtccggagttgtaggtgctgtctcggatgcagggcgagcacccgcgagccggttcccagccccgtgagagctgcaggtcaccagtcccgttttacagatggggaaactaaggcagcttcggggacactcgcccttgtgggccttgctccaccacttccttcagtcctgggggagaccgaggcacctgagggaggcagggttgagcttagcggaggggccgggccgggacgtggagttggggacgcgggggcgtcgctctgccgattcagcatccccagccacccggctttgctggtgtagcctcacagccttgccaaatgtcagcagcttacagagcagccttttgcgtgcttacgagtgcaggggtggggtgtgaagagaaccatcggctcccttctcaccttcttcagcctcagtttccccctctataaaataggaataacgattagtgtctgctgcactgggatgtgtcagaattaaatgcaaaaaaaaggaaaatccttagcaggttctagcatgcaagagttcagtaaatggttatcgtcattattatctttggtatagtaaagattggcatgttaacatacactgaggatttagtaaatgtggtgtaagtatggtgcatgctctttgttttgtttggcgtaacagctttattgagctatacaacttacccatactgtacagttcagtaggcttttgtgtattcccagggttgtacatccatcacaatagtttcaggtagctctgcattgggcaatgctgttgggagcatcaggaagagcttcccaggaggtcacattaagtggatgttggcagacaggacttagaacagtggggaggagggtggtgtcccaggcagaagcaaaggcttggaactgggaagtacccttgacacagataaagcctggcctggaggggtgtggggcacctgcctccccaattcctcctcctagcctgtatcccaggacacagagttcgaaatattgataataatgaccatccactaagtacttgctgtggccagatcctgtctgagctttttttttttttttgagtcggagtcttgctctgttgcccaggctggagtacagtggcgtgatcttggctcactgcaacctccgccttctgggttcaagcgattctcatgcctcagcctcccgagtagctgggactacagacgcctgccaccacgcctggctaatttttatacatctttagtagagacaatgtttcaccacgtcggctaggctggtctcgaactcctgacctcaggtgatccacccgccttggcttcccaaagtactgggattacaggcgtgagccaccacaccggccactgtctgaactcttgatgtgtttgaatcctcacaaccttttttattttcccttttttccagaaaggtacaacttgctggggtaaagcagagctgaaattcaaacccaagtgaccctgacccccaagtccaatcctgagtttcggctgttaccaacctggaggaccctgggcaggttccttccttctgaggcctcggtttccctagctatataccatgagggggttggactttaagatgcagccgatttcccaggacgctgtcgtctgtgagggtggctggctctaggcaacgggtgccctttcctagaacacaggcacatatgcacccataacccagatacgctcctccagctcctccaccggctgcttcccccttggtctcaagctggcagctgagtgtatgtgagtcatgggctggctcagaactgggtcccgcagtgggcacaggcccagaccttgagtcctcagggacactgtgttgctgagcagggcagctctggagtggccgtggaggggagggagtgatggtttctagtggagaccagggaaggcttcttggaggaggcattttgagctggtccttgaagggctgttgtggttgaggcattctaggttgcagggatagttgagcaatggcggagaggctggaaagtcagaggcttcattcattcactcactcagtcattcaacaaatgcttattgcaaaactgtgagggcaccagggagccagcagcgaacacaggaccgttcatctttcatggggaaacataacagcactcagataagcacagcagtcaatcctggagagaaggtcgtggagggctgaggagggctaggggctcagcatagaggcctgatccagtctggggcattgggtgggctcccggtggtgacatccatactgagacttgaaggatgagtgggactcatccaggaggagagaagggaaggaagatgggaggacccagcaccttccaggcagagacagcagcatgttcaaagggcctgaggtaggtaaaggcaggtgtgagagaggaaaggaagaggcagggaggcagggctagctaggaggcaggggctggagactccgctgggtgttttatcctgagggagccacagaagggctggcgaacagggcccatctggggacagaggccttgaatgcccaactcaggaatgtgggctctggccactaagcagctgctgcaggaagtgcagagacttggcatctggcaggacttcccatgtaggacactggctcgccaccctatgaccaccctaaccctagaaaaaaggatgcagtactaaagtgtcattcattcaaagccactcctcttttggtattccacccattttccagacggtgacactgaggctcaggaagcagtagggacttgcacaaagccctttgggaagcaggctgggaaacagtggagggagggtgtccattagccccaaggagacacaggatctgggctctgtctttcgccttcctcccagaatacgctgccatcaactccatgctggaccagatcaactcctgtctggaccacctggaggagaagaatgaccacctccacgcccgcctccaggagctgctggagtccaaccggcagacacgcctggagttccagcagcagctcggggaggcccccagtgatgccagcccctaggctccaagagcccccaaccgggacccaaccctgcctccctgggctaggctctggcctgggcactcaccccctggcttagacaccttctcaagggctggccttcagggacccctggtgggtctgcctgcctgggccacccttcctgcctgggcctccccttggcctacctgggccagcccccaccacctggcatgccctcctggggccaagagtgggcctgcaacccacccacttgcctgcccacccaactcctgggcgctccccactctgcccaggccttgagtgtccacattaaatgggtctcccacacc

SEQ ID NO: 36616 - DNA, 67711 bp, Homo sapiens
aagaatcagaagacatttgtgctttggggagcagaggccctcagggtatagagaaggaagaagagagaggttcactgtagtcctgaagcagaaataagacctgtggctgaaggaagccttagcaattcactccttcctcttcctgagaactctctgtaggaagtctcacctagcagaggcttcacagtatttcagagaagccaaagattgtttgcctctttggaaactgttatccttccatcatgactgtgtcactcctgccactgttccaccatagaggtgggtgcctaatattagagagttgtttcacacacgtggctcattcctcaagcctcgctaagccaagcccaccaggaagaagcttgagtggaagcattctctccagccacatctttctctctttctctcatactagatggcgtcctttgcagcaaaccgtaagttataaggatgagggaagaagagtagagggccaaaaggattccattttgaggaaaaactacagtttgccttgccaggtagaagaatcaggtatgagttctttttgtctcaggtaataaactaagcaaagcccagatagtagtaatgatggagcccttcaactattgacgtctccctaagagccctcattttctgaaagcagagtgtttgtcccattcctgactcgccatgctgtgtgtctcccagagagtgaaagaaattgctgtgactgcgagcaccagtagagtggatttaattctcaccaagaaaagggaggtggtttgcaaatgggttgttttgggatcctgggagaggaacattgtagccagagatattagattttcactctagactttaaggaggcagatttttttttttttttaaattaaaagataggggccaggaatagtggcttatgctgtaatctcagcacttgggagactgacatgggatgatcacttgagccaaggagtttgagaccagcctgggcaacatagcaagaccttgtctctactaaaaataaaaataaaaacaattagggtgtgatggcgcacacttgtggtctcagctactcaggaggctgaagtgggaggatcttttgagcccaggagtttgaggctgcagtgagctataattgcaccactctgattgcatccaggtttcactgtagcctgggtgacagagtgagaccctgtctctgaaaataataataataataaagagcttgtacaattaacttgagaggagccaaaatttgagtctaggtcaggaaacctctagaacctgtgttccttctgtgctatgctgaaggggactgtgagaaaaaaaatgttcatgaggctcgagtcctgaatgagatggagcttccccaagagccagtaatgacacaagtggttcttaaagtcatttctggaagacaataggatcacaagggtttaagtctatcagatcatgttaaaaaggaactcattcatttattcattaatttgactaacatcttgattgtttactagtgactttaggtacttttaagtcattgagtgggggaaatatgggttgccttgtgaactcatcagtggggcctttttgatggtcagacttcttggaggaaattaagtgtttgcagagatctgaacaatgagtaggaattggggcaggatggggaatggagtgtggtgaatgaggtgaactgaaagcagtttaatctcgccagagccactgaaggagtttgcattttatcttttgggcattcattccaccattgtacattgaatgtgcactgacactcttctacgtgcacagcagtgaagaggacaggtaaaacccttgcctagtgcttggtgttctgagaaaacttagttcactcatagttcttagtccactaagagtagttcactaagaattaaaccaagctttttaatgttactgacaggaattctatactgatagatagggaattacttggagagattctctagttgaatgcaaggaaagtttgagaaggactctcatgataatcctatagattatacagggtagagacaaaaggtgggttaatgattggttgattgttcattcagcaaaaacatcttcagtgcctcttctcattcattcttacatttattcactcatttatcaaatgactggcagtgcaagttcggcagatggttaagagcacggctttggagccagattacttgggttcaaagcctggctccaccacttacaagctgtatgaccttggaaaagttatttaacttatctgtgcatcactttcctcatacgtaagatgagggaaataataataccagacaaaatttgttgtaaaatgaaatgagttaattaatgaactacttagagcagtgcctgatgcatgtaaatggtgactcaacagctcatggttcttgtaattattattcctcaatagcaggtttgtgctaaattctaggaatacaaccttgaattgagtgtggtccctgaccttgagggaaccacattgcacccccctcccacccaaaatgcaggtaaatggatgagtttcttcatggagtggggtaatcctataagctcaatatgaatcgattgtgataaggtgccccaagagttatatatatacagtcttaggcagcatttcccagcgtcttaatatatagtcttaggcagcatttcctagagattatagaaactagaactgtggtgtttattattttggagatctctaaacttaagaatctgataaatgctgtggggtgtctacttggaaaaatacattacaattttgccttcaaacagcctccaaacctctgatcctatgatgaggagctgttaactcttctcctctgggttggtcagaccacgctgagaacacagtattaacagttctgtactggagcatgtacttcgtgtaaaacattgtgctaagtatcctgggggagacaaagataaatacgaggtaatccatgcggtttaaaggcttagtggaaaagaatgttttgtatgtaatgagatgtttgtagatacatgttgaaatgataaaagtaagaatgttcatcttgagcaatggaacgagatttatctatacaaaaatttaaaaattagccagacatggtggtgtgcacctgtagtcctagctacttgagaggctgaggtgggaggatcacttgacctggggagtttgaggttacagtaagctatgattgcaccactgcactccagcctgggcaacagagtgaaaccctgtctctttaaaaaacaaacatagaggctgggcgcagtggctcacgcctgtaccagcactttgggaggctgagaagggtgaatcacctgaggtcaggagttcaagaccagcctggctaacataatgaaaccctgtctctactgaaaatacaaagattaactgggcctggtggcatgtgcctgtaatcccagctactctggaggctgaggcaggataattgcttgaatccaggaggtggagattgcagtgagcggagattgtgccactgaactccagcctgggcagcagagcgagactccatctcaaaaacaaacaaaaaaccaaacaaaaaatgaaggatgttacttaaaagttgtgttggtaactgtgttaataaataaataagaggtaatctttttttgagatggaatctccctcagtcgtccaggctggagtgcaatggcgcaatctcgggtcattgcaacctctgtcctccaggatcaggcgattctcccacctctgcctcccaagtagctgggattacaggcacctgccttcatgcccggctactttttgtatttttgtagagatgaggtttcaccatgttggccaggccagtcttgaactccctacctcaggtgatccatctgcctcagcctcccaaaatgctggaattacaggcatgagccaccgtgcccagccatctttattcgttttttttttgttgtgttttgttttctttttttttttttttttgagactgagtctcactctgtcacccaggctggagtgcagtggcactatcccagctcactgcaacctccacctcccgggttcaagtgattctcctgcctcagcctcctgagtagctgggattactggcgcgcatcaccatgcccagctaactttatatatttagtagagacagggtttcaccatgttagccaggctgatctggaattcccgacctctggtgatccgcccgcctcgacctcccaaagtgctgggattacaggcgtgagccaccatggccagcattattcttaagattagtgggctaatgtctataaaagtgctttgtagctataaatacctatacaaataaaagctattatttttattctagtcactagtagggataatccaaagcagaatgcacataaatgcagtagagcacattacaaattataaaaatattcaaaagagcaaagtcacttttattcatgggggatgtgcaggcactgctcttatattacagccatcgcacatcccccatgaataaaagggtgcagtggctcacggctgtaatcctagcactttgggaggccggggcaggcagatcgcttgagtttgcaatcagcctaggcaacgtggtgaaaccccatctctaccaaaaagacaaaaaattagccagttgtggtggcgaccacgtctgtagtcccagcttctcaggaggctaggatgggagaagatcgcttgggcctgggaggtggaagttgcagtgagccaagatcctgccactgcactgcagtctgggcgacagagcaagaccctgtctcaaaaaaaaaaaaaaaggaagaatgacatgatcagagctgccctgtaggaagattatcctggcagtggagagcagatactttagggggtcagcaaggagacagactagttagtggtctgtttcaatcattcatcattcaggtgagaaaaaggaataataatttttttggtgcctaataaaataatttttcaggtaaaagaataatcattcaggtagaagaaaggaataacaaattttttggtgcccaatatatgctttatataggttatttcacttaaagtcatcagaggtttggaaaggaatggaccaatttaagagagattagaacaggaaggctgggggatttcctttcctgaaggattctaagaacgggagagatagctgggtgcagtggcttacccctgtaattccagccacttgtgaaaccggggtgggaggattgcttgagactgggaggtcaaggctgcagtgatccgtgatcacaccacttcactccaacctggatggcagagtgagaccttgtctcttaaaattaaaaaaaaaaaaaaaaagactggaagactggttatagctcagcctgggaagagcactggagagggagtctaaggacctggactcccacttctggtctcacctctatcactgaccagctatatgacttcacacagtgccccttgctcattggttctcttgtctaccaaactgtggggtgtgtttgtttgctttgcttgtttgtttatttttatgtttatttttttgagtggcctgggagagtgaaatgttctgggatgggggtgtggagagcatggaggtgttctagaataatcaccaacatcagcttaaacacttttttttttttgagacggagtctcgctttgtcgcccaggctggagtgcagtggcacgatcttggcttactgcaacttccacctcccagtttcaagcgattctcctgcctcagcctcccaaatagctgggaccacagacatgcgccaccatgcccagctaatttttagtatttttagtagggacgggctttcactatgttggccaggatggtctcgatctcatgacctcgtgatccgcccaccttggcctcccaaagtgctggaattgagtgagccaccgcgcccggccatcagcttaaacacttaatcaaatgtgatgtgcctgggtttccacaacaggatgggaaaaagaccatgaagtttgggctcacacacatttcagtttaactcttgattttatcatttacaagttgtgtgacctttgggccaattattgcatccctttcctgttttctactttcctcttccataaaagaaggatgataacatccacatttaaggattgttgtgaggactaaataagacaatacctggcacaaaataccagaggggggaaaaaaaggtatatttccttccttctatttctgtgatgctcatatgcatgtagtcttccctcctgtctccccacttctctgccttccttctctttccctttcaccagcacaaagtgtaacaccctcactcccgttgctacagtgggctgtactagtttcacagaccttgaaatggcacatacacgggaaaggtgtttcgacacagttcctatggactgttggtgccggatgcttacacggtcacaccctggtcgctcatccagcttaagcagtcagtgaatccctgctgagaatgacctctgactgttgctaccctgggagacactgggcgagggtcacatgggcaaggggctggtggaatgtgagcatgctatactgtgccagtggttcaccctttgcttagtgtagacttaggttctgtcttaaggacatctgtctctcttgggaccttcctgtgcaaactggggggataagagatcggagaaaggcatcagggcatgtacaaagcaacatcaaaactaattgacatgattctttgctctatacccctccccctcgctaaagtcactttcttttttcaaaatcttcatgacccataaccattccatgcacagagatgcaaaaatggtcagttaatatccaaagcaaaagcgttgctcttgttccccaggcgacagggccaccatttttatcagtgtgaaacagagtatcagggtattaaggagacactgagaataaaagtgaggagatattggaaggcttaaccagggaaggcttctgaagatcgtttttttttttttttgagtcagggttctctgtcacccaggctggagtgcagtgtctcaatcatggctcagttgagcctcctatttcagcctcccaagtagctgggactacaggtacatgccaccacacccagctaatttttgtgttttttgtaaagatggagtctatgtttcccaggctggcctcaaacttctgggctcaagcgatcgtcctgctttggcctcccaaaatgctgggattgcagttgtgagccactgtgcctggcctttctgaggatcttgaattcggatggaagcaggagagagagaaagcaggaggaagagaaaggcacccccagtggtagccatggctttggggccctaagagtcaggtgcaaatggaaatagggatggggagtccataccacgctgtacgtgcaggtgagcagggctaaggggaaactgaaacctacggctgcaacatgtctaggggtgaccaggctgacatgggcagtccttctgggatcccctgtggtctggcaccatcaggaccactgccttcttcccattccccccatcgagatattcttcctgtggtttgaggattctgggacaccacaggcatcttggagaatatcttgtttctcagttcttttttttttttgagacagagtgcagtgcagtggcgcgatctcggctcactgcagcctctgcttcctgggttcaagagattcttctgcctcagcctcccaagtagctggtgttacaggcacccaccaccacaccagctaatttttgtatttttggtggagacggggtttcaccatgttgcccaggctggtctcgaactcctgacctcagtctgcccacctcggcctcccaaagtgctgggattacaggcatgagccactgcacccagccttcagttctctcttaaggcgttgcatcctgagtagggtttctcctttgacctggctaaagtagaatccttggtcttccggctgggttcagtgtccttgactgaccctggagcaggatatccttctggcctgctaccaggaagaatggaggctcccagcttgggaactgcatggctgtaggcagaggaccgtggccacctggatcaacctgggctaagaatagccaaggccagggtttggaggggtcagtgccttaaaggggcaggctgcccagtgggcagcattgtggggactgtactctagaggggcaagaggttcctacactcaggagcagagaccagggggaggccatggagctatggggcctaacattagagagcacccccccccccccccccgtcttttcatggctcattcctccctgggaaaatagaagtcttaccatttccagggcctgttgggttgggtgctcccctccttagattctgctttttaatgcaaatggccctgggagggactaacaccttgacctctcacacccctgtgtaagtgagtatcagatgtttaggggtgtttcatttttctgtttttctctggattgaaagactggaactgcttgaaaaccggtgtccctttcctttcctaccctggtctgtggggaccccacggcttctttacaccttcctgatttagggaatgaccggccaccctggggggcctgccagaaggcctgggggcatttgggagagggctcttgtgaagctcttctgcctgaggctccttctgtggcattctctttgcctgagtgccctcagcctgctggaacgcagagaacagcctgcttggggaagggccggagctgccccctggtgctgagagggcctgttttcctttttcttctgggtttaaccttttttctcagacttctttgccagtgacactaagaatgtgacctcggcgtggtggctcatgcctgtaatcccagcactttgggaggcccaggcaggtggatcatgaggtcaggagatcgagaccatcctggctaacatgatgaaaccccgtgtctactaaaaatacaaaaaattagctgggcatggtggcgggtgcctgtggttcaggaagctgaggcagagaattgcttcaacctgggaggtggaggttgcagtgagcggagatcacgccactgcactcagcctgggcgacagagcgagactatgtctcaaaaaaaaaaaaaaaaaagaatgtgaccttatgggtctaggccagcttcctctcttctcttctgggagagctggtgagggagtgagtgagcaggagggtgtgtgtcgggggagagtagggtgtgtatggggagggtgtgaggggtatgggataagcatgggaggtgtgtggtgtgtatgtagcggggagacatagatgtgtgtgtggggtgcagggggaaaagtatgtggaggggttgggggttacacatggtttgtgtgatccctatggcttcaggcccccaagagtgactgtaatctattagggattgccttgatatttgaggagttagcattaactgaagatatcctgctttatcattagactctgagtctagcttgctggttgaggaacaccacgatggcacagggacagtgggctgggctgtgggcacgtggtggagagccttcctatcccaagggaagaaagaagcatggcgcgggggctggtcggcgccttagccggttcccatgaatggctggctctgcctttttctgcttgacttcctttggcccttctcagagctgagcaggtggctgtcagctgccggcagcccaccacccacacagcctggccctgcccattggctcctgcacccaggcttacaggcagtcacccccatcctccccacagacagcaccaccacctgggagctgctggccctgcctcctctactcttatgtgtgtgatccttctgggtactggggctctggcatatctgtgctgagtgtatacttgcaggggagagcacagggctggggccaagagtgtttctgagtattcccaccatgccagcctcccttcatcgggtctacaatcttttcccaactctggaacagctccagtaggagagacagtacaaagtcacttagcctgagtggtcctccctctcatctgggacagaaaggaggaccctgtcttcaagaccagagagaaccttttggacatctgagaaaggtgctaccagaaagcaccctaacaatcattataattgaacaaattggagacgcttgctcaaaaagccagtgtcagcccagcaaggatgtcttccttctggaggatggtctcactggcattattcagtgctctctggtcagtccagtgcctctgcagttaccccgacgtacatcctcatccccttggaatggggctgggccctcgtttgaagtacgcctccacactgcctccttgctccttgcagacctggatgggttagcccggccccgccgagcccagtgcagaagacctgcggaggcagctcctctgccgtggcctctcctgtcctctctctgatgagccctccaggcagagcagagccttgttgttatgttgtttcctcactttggtgccctggctggatgggaacagctgggacttgctttatggactctgctgaacaggctggcatcctccagggagttttccccacccacacaggaatgaatcctgcagaactggattcccaagggcatgagctaaggaagctgaactgaggctggaggtgacagtggtgacaatctgggccttgcagaagacctcagtttataggaagcaaatgctgtatcgaggcaaagctgaggaggatggtagatgggggaggccaggcctaaagagagctactgtgtcttcgtctctaactccacccattttctgtgtcctctttcagaggacctttgtttatacttcacagcatctacagtattttcagagcgtttagggtttcctaggtgttgctttttggaaattctgtggttgtttttctgatacaggatgggctggtgtgaaagttgtgtgtaaagaagttccctcggtggtctcctcagctggaggccaaggttggtcaggggaggtcatcctgggaccttccctgtccccctacctttctctggaaggccaagaaagctggaggagtccctcataactaccatgcccttggaacctggggtgaactggatgagaaggattggttcttgggtgagggaagaggggaggaggaagcaggaagtaggaaccagacagagatgtggctgctctggctcctgggatgattcctgggttagaaatacacgtactgccaaagcttttcttccttctttgccaaatgttccattcagttgattgccagcttctggttcctgaccctgcaatcaaaattgccagctctagaggaaggaaagtttttagaggagccacaagctgcctcacctcttccatcctggtctcctcataacacagagcccacagtctacagggtatgtagcaggagctatgatctccaaggattctatgtgtgtgcatgagaccaaatggtttctgagctagaatcggggtctctgagttggagtcagcagtgcatgcagacctgactttatgtagctgtgtcccacaggctccaagcttctgtccctctgattgtctaggacccagaaagacttccactaaactcttgtgtgcactttggcttcaaattaatggagagtccagggtatggtatgcccagagagtagaataatggagagtaagtcctggtaggaaatgccagaccatgtgcggctgctttagtttagctatagaggtcactagagaggggatgtataagtgggaagaaaacacaagctgttattttgtcttctcacatttggaactagatgagaggcacccagagggcacgcacactagagaagagaaagaccttatggatgcatgtgattctgtaatagacctgccatcaaaaaagcttatagagctgtatacaacctgtgggttttccataaggaagcagggatcagatgcacatctgttggaggctgggggagccggcttgcttgaccttaatacacctccctgctgtaggagtcggattcctggcagtgtgttgatgttccctgttagagccgggctgtgggaggggcagttggagccagcggcatgtgtgtggagtgagatgcgaggcagggtccctggctgcaaaggaggtgggattgggggtatgggtgagtgtgggtgctgggggatggacagaagtggaggtcctctctgaagagaaaaacctggacaccaaagggtttaagtcctaatggcctctgactccctgaccctgcctgtccttaggggaagtgctgagggtcccttcctggggaagtcctagagctgagtctcttcccttagtaaaatctactgaaaatcaggatgcccaagactgggggcttgaaaccctgcatattcttcaccgccttgcttgagagctttccattttccctgcccactgaagatggtccaagacatgcagtaccttcttgcttcctgctttacaccccaagaggggattgaattctttatgtatgtgtctgccacctttgctagattgtaagctccctggaattgtgccatagtcatctgaatacttgtagtctttagatatgtatgtgcctggcctggcatgtagctggtactcaacaccctttgggatccaatctgtggctcagggtatggggaagagatgacccagacccctctagattctcccagtcccaaggagaacaattctgttagggtgccttccagcaagacagcaggaaccctcaccacccactggctccagtggtggcccctgggctcctccctctctggcacagggactaaacagagccagctccactggagggagtgccctctcctttctttccatcctttgactctgaaccattgtgtcactctgtcctgaccccatttcctccccggctagccctcagccatctgtgggcagctgtgagactgagtttggtgcctggtgcagctcagaccctggcaccgacctgcttggccataggcatgtcctcttgtttcttcagctgactggtgctttttggggtgcctctacccaggtcttcttgtcttcctgagagttctgaaaccctcttctgtggggtcaaacctggctgcacatttgaatcactttaggggctactgaagcatccagcatccagggactcaccctactgagtcagaacttccagaggagaggtcgggaatgtgtatatttttaaagcttcgcagatgacaattgcggtcactcaaatgtggagtgtgcattagataatattattgttgtcaatgttaagttttgtgggtgtgctcatggcattgtgttttacataggagaatgcccttgctcttagagattcaggctgaagtttttagaggcaaagtgtttcttacaaacactttgcaaagggcatcttacttttaaatggtaaagcagagcaagaaagagagcaaatgtggagaaatgttaacaattattgcaggcaggtggtgaaagaaaactggctgtaacagaccttctggacgatttccatctgttttctaagaggtggacattaggagagaacgcagcctgaaccaccaaggtgtataactccaggaggcaccattcacatggttttcatttttgtggtcgggggtatcattcacatagaatacaatgtgtggggtgccccctagagttgtgtgacatagtggcattggccccagccatctctccctggatgggctgcagagtagcagagacgcaggccctgatctacccttcctctttcaagggaccgacatggctatttgtttttatacagaatccctagtagcccttgaagactaagggaatggagcaatcttaatttaaattttaatttaatttaatttaatttgagacagggtctctgtcactcagactggagtgcaatggcacgatcacggctcactgtagcctcaaactcccaggtccaaacgatccatccacttaacccttcccagtagctgggactataggtccatgccaccacacccagctaattttttttccccccatagggatggtcttgaaccctgggctcaagcaatccccccgcctcggcttcccaaagtccttgggattacagacatgagccaccacgcctggccctagagcaatttctaatgtagagcctgacagagagagaactgaattggggaagtggggaggcaggaaacatgaaaccctgattcctaaaatactttctgcgtgtcctctagtcctggaaaatgaaatctagggcttgaatttttagaggaagccaggtcgctgtgtttcaaggtcgctgggactggttgctcctgtgtttccatctctggagttccctcgtgtctggctgctgctctctgaaccttcgcttcaccttgggggtggccttcttggtcctgtgggggatgctgtttgtcccatttcctcactgccacctctcagcatcatagtgagctgagtgctgagcctttgggaggagcattgccagtgtggccctgggcatgagatctgtcagaggggtgggcttccttccctgtgtggctgagacagtctagtggtggcctggcccagagccaggaggatggtggttagagaggggtagctcgcctttcctctgtctgaattccagtctgggaagagcttcaggaacagtgcctgcttggatcaccctgggacctttccttctctttcctgtgactttggagtcctctgagagatttgacctaaggaatcagtaggttggaatcaaggaatcccagagctggaagggactgtgtgtggttttcttgccatccttgcccctgccttacagatgccaatccaacctggttagttccaaaacccagtcctgtgtctgaaggatactaaggagcacaccacctacatcctgaccacccatctccatgtctgaaaattccccacctcccagaaggttctgccctgacattccagttcaagctcagtggaaatgatgggaatttggaacttgaggaacatagtaggggtgatggatccataaacatgtcaattttgaataaaatatcttaagcctgtgtttgagatatacactggttgctattgggagccaatagcaaatagcaaattggaacaatttgaaccaagtcacggaggtatcacatacgtggtcatgaatggttggaggtgagagggagagcagggcaggagagagtcttatagagaaatcagagagcctttgaaatatcttaggcaggaagcgaggtgatcagatttacattttaggaagagccctcaggatgttctgtgaaaaagccttgaagaggccaaggttagtagggggaaggactattaggaggccattgtaatagcccaaatgagagaagataagggcttgaattagggcaaccacagttaggatagaaggaaagattagctttgggaagtattaaggaggaaaaggtggcaggccttggcaattagagagaggggtgaaaggaagggggactctaggatgactgcaggatttttagcttgggggactgggtggtgccattcaccacaatggggaaccaggagcaaggagcagattgtggggaggaaagaagatgatagttgagttttggacatttggattttgagatatgagtgggcatgtaaacttgaaggagagatacatatttggaatcatcaacatgtgagtagtatggataggaaacaagaatagatgagattgcccaagcagagggggtagagttaacagtaagctgagaatagaatcctgagccaacaccaacatttcaggggtggacaaaggaagaggaagacaaagaaggaggagatggagaacaagaaaaaaatatcttcatgaaagccagcgggagagggtttaaggaagaagggaatggtttggagagccaaatacagcagcaatgtccaggcaggtggaaatggctacggaaatgggcagcccaggcattgttgctggagcagttttagtgggatgtggggggcagacaccagattacaatgagttaaagagtaaatgggaagggagaatttggaaacatcaggtgtagtccattctctggaagcttggctgagaatggaaggatgaacagagaggacaaaaagtcaaggggagccgggcacggtggctcacgcctgtaatcccagcactttggggggccgaggcgggcggatcacctgaggtcgggagttcgcgactagcctgaccaacatgatgaaactctgtctctactaaaaatacaaaattagctgcgcgtggtggcgcatgcctgcaatcccaactactcgggaggctgaggcaggagaatcgcttgaacccgggaggcggagcttgcggtgagccgagatcgcgccattgcactccagcttgggcagcaagagcgaaactccatctcaaaaaaaaaaaaaaaaaaagtcaaggggaggtgtttagggttcggagtttttcctttcttgttaagattaggtgaagcatgtttatgtgctgaagagaaaaaccatgttaaggagaagagattgaagatacaggagagggaagggaaatccatggagcattatcctagagatgaagtggatggggcaagagcagaagaggattgtgcctcagcaggaggcaggaatctgcttcccctgggccaaaaggaagaaagtgaagctgagtgcaagtatgcataagtgggtgttggaagagaggcttgaagttgaaaaagattatttccaatggcctgaattttccttctcacaatagtgcctgctaaggcaaatcttaatactctgcttgtcctagctcagcgctgaaaatacacagtcattctctggattaacatacttaagcccaatccaactttgagcatttatctggtatctcctatctataaggcactaggccctccttttcctgggactagtctcccagctccaggcagctaggttctggatatctccatctgcttatgctactcctttgaatttcaaatagcaagactccctcatacccactgtggataaaaagtgatctgtaaggagctgtggaaaggcagagaaattaagttaacagtgaactgctttagatactctgaggctgggcttgggccggtctgtccttggtgaactaattcctaagtgcaatagttgtcagattcactgagccagaacccttcagaccagggtcctgtgcctatacctgacagatgtaccagggtcctgggagggcaccccagggtaagggatacctttgtcctaacttattttgaatctaagcaacttgccacccaagagtctatctgagcctttttcctattgatgttttcaacattctaatcatgaggtgtaatttcatgtttgttacctgttgggtgaagcagtacaatagaatgaacattttctgataatttttatgaaactgtcaacctcttggctgctgatgctaagagtcagaagtgactacttcacactggtctcccccaacctaatcacaaacacacattcatagatccacagttctgaggttgggctacacattagaatctcctggggagtttttaaaaaataccattaccctaccacagagcaattaaatcagaatctcttgagagtattcaggcttcagtactttgttttttttagacagagttttggtcttgttgcccaagctggagtgaaatgatgcactctcagctcactgcaacctccgcctcccgggttcaagtgattctcctgcctcagcctcctgagtagctgggattatagacgtgtgccaccacgcctggctaattttttgtatttttagtagaaacgaggtttcaccatgttagccaggctggtctcgaactcctgacctcaggtgatccgtccacctcagcctcccaaagtgctgggattataggcgtgagccaccgtatccggccgggcttcggtactttttaaaacttcccccagtcgggccgggtgcggtggctcacgcctgtaatcccagaactttgggaggccgagctgggtggatcacgaggtcaggagatcaagaccatcctggctaacacggtgaaaccccatctctactaaaaatacaacaaattagccgggtgtggtggcgggtgcctgtagtcccagctactcgggaggctgaggcaggagaatggcatgaacctgggaggtggagcttgcagtgagccgagatcctgccactgcactccagcctgggcgacagagtgagactccgtctcaaaaaaaaaaaaaaagttcccccagtgttgctaatgttgcagctggggttgagaaccactgggccagactgaccttgtcgttaccaccatttgttgaatgcttctcaactctgttcacgtcatggcttctagagaaaaggataccaccgctgaagtaagtggaagcactggcctggagatccagtgtggcttcctgagggctgggggaaaaaaaaaaatcaatattttggcacacctgtaagacatcaggtagccgggtctcacctgttggcaagctttgttttattttatatattggtgtattttgggaggatcctagtgcaagctgagtaattacaaggtccgtttcacagggttctcttgtacttttcatttatagttttattgaggtgtaattgacatataataaaatatacagattgaaagtgtgtaatttgataagttttgacatgtgagaataccagtgaagccatcatgtgagaataccagtgaagccatcatgtgagaataccagtgaagccatcatgtgagaataccagtgaagccatcatgtgagaataccagtgaagccatcatgtgagaataccagtgaagccatcatgtgagaataccagtgaagccatcatgtgagaataccagtgaagccatcatgtgagaataccagtgaagccatcatgtgagaataccagtgaagccatcatgtgagaataccagtgaagccatcatgtgagaataccagtgaagccatcatgtgagaataccagtgaagccatcatgtgagaataccagtgaagccatcatgtgagaataccagtgaagccatcatgtgagaataccagtgaagccatcatgtgagaataccagtgaagccatcatgtgagaataccagtgaagccatcatgtgagaataccagtgaagccatcatgtgagaataccagtgaagccatcatgtgagaataccagtgaagccatcatgtgagaataccagtgaagccatcatgtgagaataccagtgaagccatcatgtgagaataccagtgaagccatcatgtgagaataccagtgaagccatcatgtgagaataccaatgaagccatcatgtgagaataccagtgaagccatgaccacaatcgagataatgaacatattcatcacctccaaaggttcccttgtgtcccgttgtaatccacccctctttccactctgtcccccagataccgctgatctgctttctgtcattatagatcagtttgcattttccagaattttatataaatggaatcatatgtactcatactgttttgtctggcatcttttactcagcaaagctattttaagattagccttgttattgcatttgtcaataattcattcctttttattgccaagtagtattcaattgtatagacatcacatttttaaaaatccattcactgttgatggacattttgggatattacaaataaagctgctgtggatattcatgaacaagtctttgtgtagacatatgcttttattttccttggataagtaggagtgatagttgaatcctgtgttaggtgtatgttgacctttttaagaacctgcctgttttccaaagtggttgtaccattttacattccccaccagtagtgtatgagagctgtcctcttcaaattgactggagaagctttgcttccatctcttcttcttggctaatagaaggtgcctcttggctgggcgtggtagctcacgcctgtaatcccaacactttgggaggcctaggcgggtggatcacctgaggtcaagagttcgaaaccagcctggccaacatgacaaaaccctgtctctactaaaaatacaaaaattagccgggcgcagtggtgggcgcctgtaatcccagctactagggaggctgaggcaggagaatcacttgaacctgggaggtggaggttgcagtgagccgagatcgcaccattgcattccagcctgggtgacacagcgagactccatctcaaaaaaaaaaaaaaaaaggtgcctctctctctttttggggcacaaatgacagaggtgagtatagggattagggcgcagagatgaggcatgtagagatgaatggatggatagttggatataataaataggtaaagttgtcttggtatcccttttttcctccatcttcctgtacattccattagttgtacacaacgaagaagcaggcactggcccagataatatcacctaaattggattattatggatgattagtaaatctctctttgtgactgattgatatttttacccctcacctgcaggcgcccagacaccatgtcacaaccctccagaactgacgttggcaggaagtagagactttgttgcctgtgtcccccatcctcaccatgtcttcgactcagggcaatggggaacactggaagtccctggagtcagtgggcatcagccgcaaagagctagcgatggccgaagccctgcagatggagtatgatgccctgtcccggctccggcatgacaaggaggagaacagagccaagcagaacgcagacccctctctcatcagctgggatgagcctggggtagacttttacagcaagccagcaggaaggcggaccgacctcaagctgttacgcggtctctctggctctgatcctacccttaactacaactcactctccccacaggaagggccgcccaaccactctacctcccaagggccacagcctggctcagatccctggcccaaaggctccctgtctggagactatctctacatttttgatggttcagatgggggagtctcttcgtccccaggaccaggggacatagagggctcttgcaagaaactatccccacctcctctgcctccccgagcttctatctgggatacccctcccctgcctcccagaaaggggtccccctcatcctccaagatctcccagcccagtgacatcaacactttctctttggtcgaacaattgccgggcaaactgctagagcatcggatcctagaagaggaagaggtgctgggaggtgggggtcaggggcgcctactggggtctgtggactatgatggtatcaatgatgcaattactaggctcaacttgaaatcgacctatgatgcggagatgttgcgggatgccaccaggggctggaaggagggccgagggccgctggacttcagcaaagacacctctggaaaacccgtggccaggagcaagactatgccccctcaggtgcccccccgcacctatgcctcccgctatggcaaccgaaagaatgcgacgcctggcaagaaccgccggatttctgcagccccggtgaggaccttcttgtgtttcttctgccttcctttctccatgtccttcagaaacagggactagtctctgctgttctacatccaactctgccaagtccttacccctttaggcctctcctaccctctttgggaccctggccctggtgggggaggtccaggggaggcttgattaggggtggacaccagtagagggagggctccttctcagggccaggtttcatgtatcttggccaaaacgggccttctggggcaggcatttgggaatcctggttcctagcgtgtgcctgcttcctgatgtaaggactgaattgggagttatgggattcattattgactggctgaatggccctctggaccggagcaagttgcttccgcttgctctgaggccctgctctgccaaaaacgctgcgtggcgatgaagatcattcacaatagtaaccacttgtttagtgcccactgaatgccagaccctggtccagatctccacaacaacccttcctgatagtccaaagccacacagcaagcaatagcagggccagcattcagccctggcctctctcgttcctaagccttctgtctcctcctctccttctccctttctctctctctctctccctgctctgttctttattgtgataaaatatacgtaacgtaaaattcgccaccgtaaccatttggaagtgtgcagtcagtggcactgacgacattcacattgtcgtgcaacccttgcattattcatctctactcattctcttctcacaatgaaaatatttagaaaaaatatgcagtatgacaaatagttttatttttatcagtacatagtgtaaaatagcgaactatctaggtcaaagcccccaggcaggtgccagggcagctctgatcttttttctggtttaggggagcttcagcagcatctcctgggtaggaccagaaggcctatttgtgtttcatccttggtccctggaaaccctggctgcaaggagtcaagagacaagtgacacccccatggctgatgccttctttttttttttttttttgagacagagtctcactctgtcaccaggctttagtgcagtggcgctatcttggctcactgcagcctctgcctcccgggttcaagagattctcctgcctcagcctcccaagtagctgggattacaggcacctgccaccatgcccagctaatttttgtatttttagtagagacggggtttcaccacattggccaggctggtcttgaactcctgacctcaggtgatctgtccactttggcctcccaaagttctgggattacaggtgtaagccaatgcccctggctgctgatgccttctgtgacagcttagcattctacttcattctgtcctggtttcctccttagccattgtttaaggggcactggggttttcccaccttgtgtctagcctttgggaaccttcccaactctgaagagctacacagttcttccttcctccgcttctcctaagagagtccccccaaaagcagaatcagctcctgggataagccacatccctagagctcagggatttttaaaggccctgctctgagaggtggggctgttcccgctatttatagggactgggagattcctgttcccagctctgagttcctcacacccagctgggcctgctcactgagtcagggcaccctggtaggtggtcacctctgtcactccttctctctcctgcctcccctactccctcacccttccccatcccctgcatgtcatcagagttctgagacagagctcagcccagaatctccttgaagaagcggacacaaagcaaaaagctcttgccagttctgagtggggaaatgcggccttggtcctccccggctcagcttgttgcaggggctcagcctgctgggaggggggaccccttgggccctcggcctataccaccgccccgctttcgtcgggcttccagccagagggaacctccttatcccaggccagcggagccagctctggaactggctggctccaaatgccagcctgatacccctgctgccagcctctgcccggcagactcccccagccagcatcgggtgatgccaccagggcctgccagctgggcaaacgtaagtggcttttgttttcttatggtgccagtgagtggtacagaaaggacatgagagtggccttcagtgaccactctgttctctccctctcttgccttctcttccctccccccactgtctctctctctttctctttttcttcctctctctctcctttctcttgtgggttaattgctgacagtggtgctattgttttgactgggacacaggcacgaacttggcagagccagggcctcacatgccaactgtccccactgctgccctcccctctgtgcacccccaccccccgccgcccatgcacacccaggggagcaagcctaacaagagagggtcaaccagaggaaacagtctggatattcaaatgaggagctcagttgctgtcatctgccccaagaggcagagaggacttgagagtagccaagaggttgggtgagagatgtgaggcgttgctatgtgcacaggccggagctagactcccgccagaaacagctgttggaaccacatgccggccttatctccatctgagctgaagcctcgtccctggtgtggcctcccaggctgccctgagcagacccctcaggcagaaacctgtcatgcaccagctctccctccccctcacttccttctccctagggctgggctacaggccttgctaggggcttctttaggaaccctcctgggtgactgaaagcagctctgggatgggagaccgtttgggaccttgtctgagaatcctaccaccacacacgtattttgagagaggaagtggggccaaggcaggctccctgacattccggccgttcagagccggctgactcggaagccagaggagccaagcttctaccaggtcctcccctgcccagaccactgctttgacgctttcttcctcaaatagcatttacccagaaggcacatgtgtctgagtcatctcctctatctaagggttctgggtctctctctgctttgggtccatggggcttgtggatattgaggctttagaccagggccaagcttccctgggcaccatttgggccgcccacctgctctagcctcagtagaggggctgggaaaaacagctgtctgctctgctccctgtcacgcctctgggagaatcccccggaaagcccgtgttgcaggagaggcccaacagcactggattgccttactggctgcctcacgcttatcagactgtcccctcctgaagtggctttggccacactcttgtccatctcagccagagcttcgcctccttcttcaacttggctcctggtctcctaggacagcagatacatgtattcccggatgtcccatatgttcttgtgcccctttcattggatgtcgagtgactagaaagtcttttcatctagagtttgagtttaggtctggagtacctcatagggaggggacaccacgaggaaaaaggcactgagtcgtctgctcttctcttaaaggtgggctcccggccccacactgttgccaatggccatgagttgtttgaggtctcagaagagagagatgaggaggttgctgcattttgccacatgctggatatgtaagagttaaagaatggggtgggatttgggagggctatgggggatggggaggggggccatccatttccaaactttctttaggagggaagaagcaccataataagtaaatctcagttcatagctatgaaaatgcttcctacaacaagtgtctgcagggtttttgaaatcttagaagtctcacatttttagcaaaattcatgaaacctccattgaatggtcaaagtatcctgatcactctagagtctgaccctcagttgcccttaagagcaaatgcaccccagctggcgataagagtgttatctggaactaaaagagaaaggaaatggattcataaaaaattttccattaaacttagcatggaaagctttgtcattttagaactatttgtactgttcaatggtgggaaacattttgcaattataagagaagtgtcaagaagggggtttctcagagctgctaccccactgcccccatcctggcctgcaaatttggagggctgggctgagtggggacagaggggctcttgagcctcagagcatgaggttcccaacagatgtcttcttgactactctcttctaaaggcacagtgagggttttttttcttcctgtacagccttcgatctggctctgacatccaagactacttcctcactggctatgtctggagtgctgtcacccctagcccagagcacctcggggatgaggtcaacctgaaggtgactgtgttgtgtgacaggcttcaagaggcactcactttcacctgcaactgtaagttagtgaggggggagaggatgtgagcatcccttgaagtggggtggggatgactgtgttttgactcgatttccacctcatcttgtggcccagatgaagggcagtgaggatgctcctttgggggtgaggggctggctatggggccagcattctagtacagtcactttcctcaactctgaactacttgcctgctttatctggttggtgatggtgctggagaatacttagctggaaagggggatcagggtggggaaactgagacccatctgccttgacatccatcatgattgctccccctaccttacccttcacaggttcctccactgtagacttgcttatctaccagaccctgtgctacacccatgatgacctgaggaatgtggacgtgggtgactttgtgctaaagccctgcgggctggaggagttcctgcagaagtgagtgaatgggtgggaggtagcccctgccttcctggtagtaagattgtgagggggcttcatgggattggtgctgggaccggcctggcagctccgccccaatcccacagtcaagactcctgctttctgggcacactctcggccacgtagcactttccccaggagctctgtcttccagcagggttggctgacgtcctgagccaagtctgctgtggaaagagcttggagctgggattaggcaaagactaggtcatatctgcttgcagattctgcttatggagagatgtgtgtatttgtggggaggggtgggcttggggagactatatgggtagtgctgtatctcctgctctagattatgtgtggtgtttttatggctggggcaaaatgaggactgggcagaagttcccttgtggagcccaggggagaaattacaattactgtctctccccattctcctgccaacaagtcttttccccagctggcccgtgcagctagttatcctcctcccaaaggcgtgcctccagctcctctccatccagtgccctctctggaaagcagcctccctggaaagtctgatgtggaccagctgaggcaaccccctttccactaccctgggctctggagggctgcagtggaagagaggcaggggcaaggttatcacttctcagatggtacagctgtgtgacagcagacagataagatctgctttcctctcttaggcttcagagccgctcctgcccccagtctctgtccacttggaggaagcacgttttgggaatagagaaaggagagacctgtgtctcacttcttaggagtgccctataagtgccactgcttgctttttctctctcttacattcaggtctagatgcaaggatggttgatctatgtctagagcataagatttggcagtcaggatggaagattcatttctggacttctttctttttttgagacagagtctcactctgtcgtgcaggctggagtgctgtggcgccatctcactcagctcactgcaacctccgtctcccaggctcaagcgattctcatgcctcagcctcctgagtagctgggattacaggcataagcaccaccacgcccggctaatttttgtattttttaatagagactgggtttcaccatgttggccaggctggtctcgaactcctgacctcgggtgatctgcccgccttggcctcccaaagtgctgggattacaggtgtgagccactgtgcccagctatctgggcttatttcaaatttaaggatattgtggggtcctttctggcctctgcctcctcatctcgaagctaagggaaaggaaagaggcagggttctgtatggtacaactccagggtacccttcaaatgtgccccacctttaaactcacttatgtacacacttttcccctagaggaacaggaggggtcctagactcagggttgcctggcagagagagtgccaggtggcctgccactgttagaagggaaaaaggggacatagtggataagttggagctcctgctgacgccattacacaggtttgaattcggacttgccacttactagttgtgaaggctgattgatgctcagggccctctgtaagctgcagtgagggtgaaatgtgagaatgacctgtgagcaatcagtaaataccagcagggaaggagcagcccacggagagaagtcctagggctctgggctgcacagatactgccatttcccttgcagcaccccaaatcctggagcccctgggtccggaggtagtgggagctgtcaagttctaccttcctgctaagactcaggtgaaatattcttagtgaggtgggacagggtcagcggtcctcagatcacacccctcatactctcacttgaatgcacagagaggaaggccttccacagagaagatcaagcaagtccccaggggacctgtgtgcatgactcctggcctaggagccccactcccacccaacagaaaagcacaatgctgtctcctggcccagcccccagacccccaacacatgacaactgcctgggatgggggtggaaaggacgctccgggggttccagaaatctgctagttcccaaggaagccctgagattttctacccctgcctggcaggaggggctgatactgagggggtgagtgggttcaggatgcaggctgctctcagataagaaccttgaggcagtcccgtgggagggttgggtttcctgccacctcccccagccccaccacactcttccttcctcccaggctctcccaccaggcccagccccacagcccagcctcaccacctccaggttttggctgcacttcagtcttagatctgagagggtctagatcggagatttggtcctctcaggatgtggagaacccctcactcgagccctcatgggacctagacgaccctgggccctgcacctccgccagcttttacatatactgccccccttatgctcctgtcctctcctctccatttctggcctagattcccagctctgctgaggaaggaagtccttttccggcttctgttacccagctgctgaggccaggcccaggcctgcagtgctggcctggaggtagttctccctctgcccctcctcttgggtttccttgctgttgaaggtgtgatttgggagagaggaagaggttggatcgccgagggctcctaggccttctctctgaaagggggagtctcacacatgggtgcttgagcaggtgggactggcatgcatttgggacttttcaagaagtcatagaaatttgtaaggttattcacaagcaggcagggccaacagatggaaggcagaaaaagaagttgggtggggacactgatctggaggcttggtaggcttgccccaagtttttttggcctcagcaccctagttggtagcattggaagaggggtctctcgctgagctcccaccctggagcctgagcacaggtggactccaacatgtctcttcctggttgtcccctatacagaggcccagaagatagggcttcagcaactgctccctgtgatgtgcctctgtttccccgctctctccaacagttcccagccctggagtgaaccagtgattaccacacgggtaataaatatctaagagagtcaatatttataccggccaaggattaagtatattaggtggcttttgtttagatagacctctgttccttctcctaagctctaccgtgtcattttctaggagccaaagtagggtacaacacgggtactacccccttacctaaaccttctttctgtatgtctctccccaaggctaaggtatgtatctcccttgccactgagtccccaggatgctaatggtcttgtccctctaccctaccagcaagcatgccttgggcagtcatgagtacatccaatactgccgcaagtttgacattgacattcggctacagctgatggagcagaaggttgtgcgcagtgacctggcccggacggttcgtgtgagggtggtggagggttgcccagggctggggaggtggaatgggaatacaatatagaacacatcaggtgggaggggggtaggagtgctgagctgagataagggcaccgcccctctctgaataggtcacttcttatacaggtgaatgatgaccagagcccctccaccttgaactacctcgtccatctccaagagaggcctgtcaagcagaccatcagcaggtgagtgtgggcaccatcttggatgtgctccaaacaagaactgtgcagggatcccatcagatgtgcctgcttgcctttctgtcagggctaagggattcttgcaggtgtcaggggttggggcccacacatcttatcagagaagatccccactccaggcatgtttcatttcttccctctggaactttgccatcattctctccaggcgagaagtggcagaatagaaagactctccctctatatgtcttcacaggacatatagaaagagtgggaactcctttaaatcagagtgtgagctgaggagagggagggagaaaatgggtttcccagggcactgggtctttcatgacctctcctgtggtttttccctgcccccaactcccaggcaggccctgagtcttctgttcgacacttaccacaatgaggtggatgccttcctgctggctgatgtgagtacgaatccaggggctggccctgctgcccgaaagctcctcctctccccttcctcagtcctcctgggatcacccagcactatgaggggtctgggtggagcctgaaaatctgttggcagagcacttctttttaacccctcgctcatgggcaaactaagactactagatgttgggcaacggcaagtgcgtagtcagggattctgctcctctatagaagaagcaggtcggaaactgcatgctggtcccattctctggaataggatgtctccagagctaaggaacctagagctgtcaccccccagctgctgcacttgatgtacactggagcatgcatcctatgagcaatgtcagaaacctccagtttgagaggttctgttttgctgttatcgcaggtaggaaaccatcaggaggtagaaggtttcacatgtagggagggccagagccctccccacttggattcatgcggagtctcaagcctcaaaaccatgagagtcaacatttgtcttaaatgtcacaacgccaaagaaaatctgacagtgatcttcaaaaataatcccttgctgagtgtgatggcccacgcctgtaatcctaaccctttgggaaactgaggtgggagaattgcttgaaccccaaagttcaaggccagcctgggcaacacagcaagaccccatctctacaaaaaatacaaaagttagccaggtatggtggcacacacctgtagccccagctactctggaggctgaggtgggaggatcgcttgagcccaggagtttggggctgtgtagtgagctatgatcacaccattgcactccagcctgcgtgacagagtgagaccctatctcaaaaaacaaaacaaaaaccaatccctgtctcattgatccagttaatagtagtcataaacgcttcctttttgaggggttcagcattatgtctagtcactgccagaatcccttctccagcagcctgtgcttgaacatttccagtgatgcgggggaagctctctgaacacctgtgctgtgctgttctggccctttgctagtggctacgatgggtagagaagtgtaagaatcgtcatagccttggccaggtgcggtggctcacgcctgtaatcccagcactttgggaggctgaggtgggcgggtcacctgaggtcaggagttcgagaccagcctggccaacatggtgaagccccatctctactaaaaatacaaaaattaactgggtgtggttgcaggcgcctgtaatcccagctattcaggaggctgaagcaagagaattgcttgaacccgggaggcagaggttgcagtgagccgagatcgcgccattgcactctagcctgggtgacagagcaagactccgtctcaaaaaaaaaaaaaaaaattgtcatagcctttggggagcttgtgttcttgttagaaaaattgaatagtaacacaaagctattagtagacagaacaggatggtaataaattaattaagggctcctggaggatgctagaggaaggggattggccagggagggctttatgcaggaggtagaattttagctgctctgtgatttaaatgtacataggtaatcagagctggacaggtgagggaattccaggagcataattccagaggggaggttatggctgtggcatgtctgtagaaatgagatgagatctgtctggaaattctacaggtctctgggagagaccctgtatatatgtgtatagtataagtagactaactatagagagaggctagagataggaggagcttcaaggggaacggctgaaagaattggggcatgtgggcatggcccattgaattcagtgggagagattatttgctgatgatgaatatttgaaaataaaatgtattgcacatttacccctgaggatcatgaatctctctactcttcccaaccctttcctttaaagactggggtggggaggggttggagaccaagagcatgagagcagagcctgccagcctcactgtgccacctcccacagggagacttcccactgaaggctgacagggtggtccagtccgtcaaggccatctgcaacgccctggccgccgtggaaacccctgagatcaccagtgctctcaaccagctgcccccctgcccctcccgcatgcagcctaaaattcagaaggtaaaggggcccagggtgctagcaggggaaaggaagagagggatactgtcaggtaactgagttgcctgttgctagagtgtgtaggtgttcactcactaaaaaggggcttctctccacctccatcttttatgtttaaggaattcaaccgcaagagctcttcagaaatggatgccaagtgtgtctcctcttcctgaggttgagggagagctacctgggactgcttgttgagagcccaggccagtaaaggctttattcacagtcaccaaggcattgcctgacagtctgcatatccatcagggtgcaaaaacaaaccaggaggaaaatctctctagagccaggggctccaggactccagcaggggctgtgtgctctgcagacagggccagcaccataggcactgtgatctgcagccgagtagcctgagggttgggatatctcagaagggtggacccgatgattgctatcctccgtcagctcactctgtccatcatacagatctggtacaaaccattactctctcctctctggggattctcagctactcacatttcagcccattctggtccagatgagcgcagctgtgaaaagcccttcttccagctgtgacgaaaaaggctatggccctgaagctcccctccctcttctttttcccaacaggatcccagtgtcttggctgtgagggaaaaccgaggtaagggaactgctctccatcttcatccagtcgggctgccgaaaactgcagtctctgccccgattcctttttctgcctgggccccttgatttatgtgtcggagttcggctggtgtgtgtgtgtgtgtgggtgtgtgtgtgtgtgtgtgtgtgtgtgtgtgtgttcctatatgaggtgtggatacagctggagagcacatttctttccacaaagtgttttcttattatttttcctagtcattcctcctggtgtccctgggagatgatgatgagggggtagaagtgtgggagtggggtggtggggcagcactagccctgtgatccagatgggaagcctcccacttgggtagattgtgattattctcccaacagctcacacttgctacctttccgatttagagtgggccttgggagaggatgagaaagaattttccctacgatttttctaggattcccctgttgtgcccttcaagctgaactttgccctaagactgacctatatccctgggattcctttgttttggttttgttttttgttttggcatccctgggattcttatggtgattcccagtcttttggatttcatagaccagtaaaatgtcccccaaagtatttgggggaccaagagagaattggcagccttttacttggccaaacttttttgacttttgcttttttgaagcaactgacaataattattaacactgtttcctaaaagaaaggacattttaatgctaagtagcaatacgtaaaaataaggattatgtttaacattgtataactgtcattttatgaaaagctcatgacatgcttctgcttttttctcattttaccgcagatgggtgaactttgtcacagctattagagactgactagcatttggggaccactgtcttaggccatcccattctagccaatgccatggcaacaaggtagggcttgtggaggcctcatgactttcccttctgaccccttcccttcccagagaaggtcgtggaagccctgaccgctgccatcttggacctggtggagctgtactgcaacacattcaacgcagacttccagacggcagtgcccgggagccgcaagcatgacctggtccaggaggcctgccatttcgccaggtccctggccttcactgtctatgccacccaccgcatccccatcatctgggctaccaggtgagcccagggctgagtagccgctagggagcaagctgagtttgacctccaccagggctttttcctatctgcatgtaataccactgtcctaagtcttaggatgtgtggcattgtgtgacattgtggtgcaatggggctgcgggggtgagccaagtgcctgaggaggacttgggctggggacatcctagaggagagaggaggtcccttaggagatgaagaagatcctgttattccctcttggtgctggctgcctctgcatccctgccccctccagatccaagaccagtggaaggagacatggcaacagatggccgattcccagatagagtgcacgctccctggccagtgggagggggtggggaggtgggattgaccctttgtctggggttctctaggcctgcaggggtgggtggaggaggatgttcttttggtaaaatcctcagcgcctctgttgggtccccagcatccaaggcctgagggaataggcactgggccctaccccgcccctgccggtcccctttccccaacccccttccccttctctctttgttccttacttaatgtattcctctgggcgattggcagagaacaaaggaggcagcctgggaaaccggggccttctctgacctcttctgtcaggcacctgtcatgagccacagggacccccgtgtgttggcattcatgtcggcatatgtcgtcttcctcccccacccttctcacttgcgcatgcacgtgcacgcgcacacacgcacgcacacacagacgctccatgggctggagctttctataaagaggctgggtggccagttcccattaaaggaagaaaaacaacaaggctcagaatggagcctaaaaccgagcagaggaatctagattgagttgctttggcctgagcacatttccttacatccagtttggctgtcctatccggagatcctgtgttacagccctcagagactgagagttttaccaggggaaatggattttggccttagagggacgcataggtttgggtgattggttttgggagctgggtgtcctgacctgctccctttcttttatagctatgaagatttctacctctcctgctccctcagccatggcggcaaggagctgtgcagccccctgcagacccgaagagctcacttctccaagtacctcttccacctcatcgtctgggaccagcagtaagcccttcccccaggcttcagtgcccaggccactgtagacctgctcagcctctgaaatatccctggggccagataactagtccaggactaatgataaaaccaggctccttgttaaccctaactggacaagtcattcaacctcttgagtctccacttccctgactctttttttttttttttttttgagaggcagcctcgctttgttgcccaagctggagtgcagtggtgcgatctcggctcactgcaagctctgcctcctgggttcacgccattcttctgtctcagcctcccgagtagctgggactacaggcgcccgccaccacgcccagctaattttttgtatttttagcagagatggggtttccatgtgttagctaggatagtctcgatctcctgacctcgtgatctgcccgcctcggcctcccagagtgctgggattacaggcgtgagccaccacgcctggcctccacttccctgactcttaaaggagccaagtataattaccacttctcaagttgtcatgaggatccaatgagaagtatctataaaggctctttgtaaaccataaaaaacatataaattttagttgttgaccaggcgcggtggcttacgcttgtaatcccagcgctttgggaggccgaggcgggcggatcacctgaggcagggagttcaagaccagcctgaccaacatggagaaacctcgtctctactaaaaaaaatacaaaatagccgggcatggtggcgcatgcctgtaatcccagctactagggaggctgaggcaggagaatcgcttgaacccgggaggtggaggttgtagtgagctgagatcgtgccattgcactccagcctgggcaacaagagcgaaattctgtctcaaaaaaaaaaaaattaaatgttagttgttaattttaataatactttattttttgatcttgtctcccttaaagagtttaactagttggagggcttctcatcctctcccttcttccctcagttcctgtagactatggagaggagactgtgcttttccctttatatatagagaagggagggttgtctagagaaagaatattgagcttggattcccaggagtgagcctctatttctagctctgtctcgaatactactttctctctattctttctgtgcctcattttttcaaactgagaaatggggacattggtttcactcagaggcagttatggcgtcgagatgagataggtgggttataaatataaatatgaaaccaaaagcacaaggtaatattaatcaccacatgtaaacaataatttggtgtcgggaaggtaggcgtcagccaagcaaagcaggaaggaaacggaggagagggtgccttgcttgaatgggggcaccgcaggggttttcctgccctgtgcttcatctgtgctatgctctaccttccttccagtcagtcagaaaatcccctgtttgctgcccccggctttgcttccccacactgactatattagagtcctcatttgcagagcagcactgcaagctaagtatttgtagcacagattaaagagactgaggagggtcctggggaggccgaggatgcaaaataggtagatgaagaatctggagatgctggaagaggtgggtccttttacagatggacaactgggaaaatggaccctttctcatgcccttcacacttaggtaattcttagagcaataaaggtgtatatggctgggcacgatggctcacacctgtagtctcaccgtactttgggaggacaaggcgggataatcacttgagatcaggaatttgagaccagcctgggcaacacaaagaggccttatctctactaaaaaattattttaaatgagctgagtgtggtggcgtgcatctgtagtcctagctacttaagaggctgaggtgggagagtcacttgagcctgggaggtcgaggctgcagtgagccatgatcacaccactgcactatagcctgggcaacagagtgagaccctatcttaaaaaaaaaaaaaaaaaaaaaggacatggggtgtgcattaaaggtcctcaagcaaacaactgccaggacaggagaaactccttgcaggcagaggatagctgcattaaatggcccttgagttccaccattcccttgggattttttggtcacaattactgctgctgtcaagagaaggggtgccagcctgggcaacaagggagacccaatctctacaaaaaatacaaaaaattagccaagtgtggtggcatacacctgtggttccagctacttaggaggctgaggtgggagaatcacttgagcctgggaggtcaaggctgcagtgagtatccagcctcggcaacagagcgagaccctgtctcaaaaaaaaaaaaaaaaaaaaaaaaagggtgctgcacagtgttctggcccaggaggaactttaaaaaattggccttaaaccctttactcatacagtatcagaggtagagaggcagcccagcctgccccatgagtttcattttgttccctgagatccccaccttgaattttaaaggggcagtcccctgcctagcgccttgtgaagggcactatcttgcactgtccatccagaagccccgaatgagacttcttggcccttcatggtcaagaccaggacatttgggggaaggcgtgccagcgttcagaggacagtctttgggccagtcattctctccttcctactgtagttgcagcctggggcaggtctttcaacctagaatggtagcgataatagggcctaccctacaggattgtttgaggagcagttaggacactgtaaataaagtacttggcacaggcttcttagctggggagccctcttggttttggtttctctgttccaagtgactgacagactggctgatacatggggatacgtgcgcatgaaaatactatctgtataagccagtgccagtgcagtaaccacagcatcacatagcaaaaagtacacagtctgcacacacatcatgcaagtgaagctatgttccccttttccctgatgagaaactgaggcacagagatgggaattaagttgcccaggattgtgagtggcagaaccgggactggagccaaccagcacattccaggaatccttcctggaggaggcagcctgtgtgatatgaggttgttgaatgggctgcaggaaggagaggggcttctcagggaggaaggtaagggctgcagccaacataatggttatcctgaccagccctgggtgaagatctgtgggagaggttgtggaataccagatatacccaaggactgaagggaagagggccttggctggctctggtttcactcataaagtcttctcactccccttttccttaagacacgaagctggaagcttcttccttgggtgaaaagaaagggctcaggaccagctccctctcccctttgctatggggtcagctgattctctgccccactgtagcggtccagggatcagctaactctcaaaataggctcagcagccgtgctttgtcacctccagccaagccctggcctggcatgtctgctggctgctggaggggccctaattatagctgtgggcccccagggtagaggcagctgggacagagcagggctctgccagtctgtggtgggctggagggagtgcctcacttaggtggagattcctctggaggacagcggtggaggcaggctgctttatcatgaaactgccaaccttgggggtggccgccctgcctctgcgccctctggcatagaagttgctgggccctgggctggccaggagggtgtgacagtatggactttggcccagggacagcttccccgaaaggtaacgtgggtcctccctgcctttccacagctcccctcccctgtgtacttcaccccacccagcagttccttatcctgagcttagagggagtggctaggtgtgattcagactgagggacctggagagaacttatgggcttgaatagtggtggggcttatgtgtctcagttctcttggccctgccattggctttctcaccactggggtacttggagaaacccctcctctttgtccctttggctttgaagctgtttgggggtgggggtgagaaaaacccagtgtgtgtccctggggctaggtgaaggggactcctatgaggacaagtgagagggctgtgggggagggtgaaccgagggcagagaacatggtgcttcttcctggtggctctcagcagcaagaagtgggggagggatggagactgtcaaatggaaaaggaggacaaaaggagtagctttgcggaccctctgcggaaatcctaaaacaaggaaaggagcaaggctgacaacatgggacgtgtcatcacctgaactccgaggtggctctgctaagcaagttctgtccaggcaccacgggtagcttcaaaatcgggatgttcgcctcactctactgcaaagctccaaggacaccacattgtgcttctgggaacatccagtgggggttttgcctagtttgggacctctcctggttctgcaggaggagggcttcctcagggagtatgtctgaaccctgagagggaggctgtatcctcagcctcagcctcagcctgacttcctgggccacctgttgcttgaagccacaggagtggcccctcctaatttgacttcctgtcctccataggatctgcttcccagtgcaggtgaaccggctgcctcgggagacactgctgtgtgccactctctatgctctgcccatccccccaccggggagctcctcagaggccaataagcagcggcgggtgcctgaagccctgggctgggtcactaccccactcttcaacttcaggcagtatgtgagccccagggtacagcttcttggccttggaaggggaggagggggacagagaaaggggcctggctgctgcactggccagtgcgccttgggagagttggccatgtggggctcactggtgaagtccagaggatccccaagcacagaactggtgaccaggactattgatgtaaccaagagccactgagcggttctggtggcacaggaccatgttaaggatacatggaaaagcaatgcttgggtaatagatcatctggtcttgtcattggaagaaccttagaggtcatctagcccagcctccccacctcatgaaggcatccctgccaccaggtcatccagaccagggtgtggttagctcacaagtcctcttggagggcgtaagcttttacaggacttgggagaaggaagaggctatggtccacggtgagaatgagaggggagttggatgatggcttcaaacagaaaaggcagatttttggattgggggagcagtagaaatattctctgcttagccactttagcagctcttcccactctccctccttcttagggtcctgacctgtggccggaagcttctgggtttgtggccagcaacacaggaaaatcccagcgcccgttggagtgcacctaatttccaccagccagacagtgtcatcctgcaggtgaggctttagcccttccctcccagtcaccagcaagaccattccagtcaactctacatttttctcctggagatttgggctgggacagcaggagagagtgctagaacttcaagcatgggaggatgatgtgactgaagcaactgagggaatatggttagatgtggattgtgaggtgagctctggggtatccatctcccatctcctggaggttaaattgatttcgtggagcctgaagatggggtctgagaccctctgcattcagggctcagcttctgagtcccttgtattgaatcttcatacgtctaagtctgatcaaacctgacctgggtcctcttggggcctgaggggacacctttgcccctgccagtgactcagtgctttggcaggatggacctattctccagggagaagaggaggagctggtcacgcccaaggtgcacttctcagttcccagcttccccttcttgtggttatgagatactttggtatggagtatgaatgttgacatagaatgaaagctccctgaggcaggtttttttttttttttttttgagacaggatctctgtcacccaggctggaatgcaatggcacaatcttggctcactgcaacctctgcctcccaggcacaaatcatcctcccacttcagcctcccgagtagatgagactacaggcgcacaccaccacgcccggctaatttttgtctgtcttatttgctgctttatgcccagactctagaaaatgcctggcacatgttaggattcaatagatatttgttgaatgaggctgggtgtggtggctcatgcctgcaatcccagcactttgggaggctgaggcagggggatcacttgaggtcaggagtggccaacatggtgataccctgtctctactagaaatacaaaaattagctgggtgtggtggcgggtgcctgtaaatcccaggtactcaggaagctgaggcatgagaaccacttgaaccggggaggcagaggttgcactgagccgagatcacacccctgcactccagcctgggtgacagagcaagactctgtctcaaaataaataaataaatgaataaataaataagttttttgaatgaaagaaagtagacctcctttggagacttggctcactcagctctgatactttagtaggatgaacatctggtggcatagagtagggaccgagtgtcccagggccttctcccagtgtgtggtcttgcctcccctctggcagcagtgtcctctggcaccccatggaagtcaccccggactcagcctggatgcaccccgtgtttcagctgggtgacacctctgttcagagttctggctggggcttgtcccctcacccctcaccaaggtgcatctccaccgaacctcttcctcacatgtccattctttttctctttttgtttccctctcattttttgctgagagttatagctggaaaggactttagagatcaccaagtctaacagggctattttacaaagaacctgagggaaagtgagggagggacaaggccggaatgctggggtgagagaaagaagctgggagtccacacacgctgcctgttttctctcctcacatccctgatctcatcccccagattgacttccccacctcggcctttgacatcaagttcaccagcccccctggagacaagttcagcccccgctatgagtttggcagcctccgggaagaagaccagcgcaagcttaaagacatcatgcagaaagagtccttgtactggtgagacccgggcccccactgaatctgtcatgtttcatctgacctcccagcactgagtctccgtcctcctgctttgggagtggaggtgggaaggggtgggcattgccatctcagcaggaagtggaggcagcccccaggcctttctccatcagctgacactaggaaaagtggagaggtcaaggtcaggaaattagatctgagaatacccaagtccccaccccagggacttggtccagactcagctacccaggaggaccagagctctgccccacatcccagatgtgctatctactaccttctgtccactggggcagctggccccaccaccctgcccccacctcttgctctcacctcctgccccttccacaccaacagcctttgaatttttctggccctgtcactttccaaaaaggatcaggtgtcaaggcaagctggcagctctcaggggtacgtgagtccaggctgatctcatccttggggctgctgctttcacaggattggagaaggaggggtgagaacagaactggaggagctggagggacctggttccgctgtctgctctctgtttacctctctggctcctgcgcagccctgtgcgtgtgttgtgtgtgtgggggcatgagagagatggggctcatctctgtccctgatgtccaccccaagtagctggagtagctgagcgaccgcagacctcccttcccccactctgccgactacacttcattagaccctcagctcccttctcccattagacacctgatctcaggcaaggcccaattagctgcaggtccttgaaagccgacagctggtccctggaggccccaggaggcctctcagcagcacagaccctggtgttgggggaccactgccctctggtggttctattgagcgtggtgccctcagggcatccgcaggaggggtagcagattcggtgcccttggcccatgcattctccatccaagatgtccctgagttgggatcaaagataggatttgggctctggttcccaaactttgattcatattggaatcacctggtgatctgtggcatagactgatgcctggcttccccagccatttggacttaactggtatcaggtgtgacccaggcatggcgagggggttcactcagcccctcaagtgggtgtcatatgcagcaaagcttgggaaccgctgaattgcagtgtgtgcagcactcccttgagggtaagggctgcaccccctggctgatgctgttctctctcactgccccctaccctcccaccaccttctcctttccgtgtgcccaccaggctcactgatgctgacaagaagcgcctgtgggagaagcgatattactgccactcggaggtgagctcgctccccctggtgctcgccagcgcccccagctgggagtgggcttgcctgcctgacatctatgttctcctgaagcagtggacccacatgaaccaccaggatgccctggggctcctgcatgccacgtgagttgtaacatctgccttttctgactatgtgttcttgtagaagccagggcacgacactgcccatcagtgatctgagccagccctggggaaaatggtaaagtgggtgtggatattcagggattttccatttctcctttttgctttttctttctcattttcccttcaatgttatattgtcatttttcaaacatacaacaaaattgaaaattgtacagtgaatacccatgtgcctaccacctagattctattgttagcatttgctctgtgtgctggattgtgtacatttcatttatccatcactgtatccatccatctatccatcttattttttatgcttttttttttttttttgagacagggtcttgctctgtcacccaggctggagtgcagtggcatgcatatggctcactgcagcctcgacctcctgggctcaagcactcctcctgccccagcctccaagtagctggaacaacaagtgcacagtgcacaccaccacacctgactaatttttaaaatttttttgtagagataaagtctcactatgttgcccaggctggtttcaaactcctgggttcaagcaatgctccctccttggcctcccaaaaatgctgggattataggtgtgagctaccatgcccagcctttttatacattttgaagtaaattacagacaccattaaactccctgctttggcatgcacatcattaactagagctcgatgtttgttctgtttttttttttttttcttttggggcaacatttatacataagcaaatacccaaagtttacctgtacattggctgagttttgacaaatgcatacgcctgtgtaactgaaatccttattacttagttttattttaatcattgcccattccctctttctcttgaagggttctcttgggacccaaggcttccagtcttagatctgttagggctgccttttctagatggtacccaggatttcctgcttatttctcgccactctcagtaatcaaaatgtacctatccatgtgacctgccttaaggagtttttgagccaatggttttgttaatctctgctaaactaattctgccaaggtttattggcttatataaaatactgtgattttctgttatttgcgtggtacattttgcattaaaggatgttaacaagacaaaataatgcttttacccacatcagggccctccaatggcaggaatttctggcacagtgggagtcaagggagaaatctctggagtaaggttgaggactttgtcccattttctttaaatcctccaaggagtgagagtggctacctagttgttcccccatggctcaaggcagactctgaccgtgaggaaggctcattcccaagggttgctatccagggaagttgctaaggattcttctagtgactttagcagaatctagggccattgcattttctttctccatgcctctgaagcccaggtgtgagggtgctgggctcacagctgtgcctcaacttgcagctaggttgtcagggcactgggctctgttttgcagcttcccggaccaggaggtgcgtcgtatggctgtgcagtggattggctcactctcagatgctgagctgctagactacctgccccagctggtacaggtgggtggattggtcctccctccagttttgctggtcccatccccagtatcccaagtgagtctgcattctgccccttagaaaccagagatcccagtgcaataataataagtgtaggttacaggcagttaatgaagcttcatattctctttctccctttctccgaaacaggccctgaagtatgaatgctacctggacagcccgttggtgcgcttcctcctgaaacgagctgtgtctgacttgagagtgactcactacttcttctggtaaaactgcatgtagaaaagtgggaggtagacacgtgtctttcacgtaggagtatttcactcttaggcacgcaagggcaaggaactgagttgtccgggcttcagtatgtgctgacttaccctgtggccttggaccagcatcttttcctcaggggtctcagctcaccccatgtaacatagtgaggattatgttatcctgtctctcctctacccacacatggcagaaatagaaaggagaaacaagatgcagaggggctgtgaactctacttaaagacagagtgagggcacagactggggtatgggcacaggtgagcatctccatatgagccgtacatacagaatgtattttccctcccaagttcggggtgggttttgcagtgagttggagctgggcctgactctgtctccccctgtacccttgcctttgatccctggagtgccctgactcctgactccctctgccttgcaggttactgaaggacggcctcaaggactctcagttcagcatccgctaccagtatctgctggcagccttactgtgctgctgtggcaaggggctgagagaagagtttaaccgccagtgctggcttgtcaatgccctggccaaactggcccagcaggtccgggaggcagccccatctgcaaggcaggttagtggggtgaggctgcccctacccatttctcatccagggctttggcagccagtttcttcttaggaatcctgaacaacaagattccacgtgacgatttttgattttggagcggggagcagctgactctggaaactaggccgtaaacaggcagtccacaagctggatacagcccgtggatgtgttttgtttgtcctgtaaaatattgaaatttatttagctgtttgttttaaaggctaagcacagttgtgtaagttgttcattgcacaagagcactcagccagaaggggcaagtgagggctgaaatccagccatattttgttcaccatgctgtgacccatggctcaggcctgatgccacccagagaggacacctttatctgtttgtacgaagacattgtaaccagccagcagtgttcctggttaacgacatttaaaaattgagagattttgtatcaacgtccagattgttagcttttcttggcagaagcctaaatagctcttcccccttgagagacagcctgccctctctgtgcactgtggcctgcttcatgctgttctgccatctgctcccctctagagctatttggtcttgctgttagcgtacagtcccaggctggggtgtagggggtcctcctccttaaggatcttctggagggtgtccacacttctcagggggtggttttcataccgactactacggagaacccacccctgggagaggtctggttctcagtatggaccctccatttcacccctgctgtactcctccccttctttccagggaatcctccgcacgggcctggaggaggtgaagcagttctttgccctcaatggctcgtgccgcttgccactcagccccagtctgctggttaagggaattgtgcccagggtgagtgactggtaggtttggggctctcagagtgggagggctcagtggaggtgaggtcttcactaaccaggcatgcaaggtcgaggagctgagttgtctgggcgtcagtatgttgctaacttaccatgtggtcttggcctagcatcttttcctcaggggtctcagctcacccccatgcaacatggtgaggattatgttatcctgtctctcctctacccacacatggcagaaatagaaaggagaaacgaggcagaggggctgtgaactctgcttaaagacagaatgagggcacagacgggggtatgggcacaggtgagcatctccatataagccataaaataagagagagattaggaagaaaggcatatctgtggcctcttcccattcctaatgtgtatggacttttagaagcctgacagcttgcagggtagaggaattgggttggaggttgggcggctaggcaggtgtctttctctgatgatgttggggatgaagtcggaggtggtggtggtgatagcagctgtcatctgtcatttattgagcactctctgtgcccggccctgttctgagtgcttaatgttggttatggcatttcatcttcacaactcttaggatgttggtactattgggagtccccttttacagaggagtaaactgaggtgtagatgggacatgtgacttaccagaggtcacacaactagtaagttgtgcgcagaatgaactaacaggatgggaggttaagtgctggagctgaggtcataacaaactgaattgggatgatgactatttaacaagagaaggaaggaaattgggtttctgggaaatccggaagaaacaatgagcaggtcttgggtggaccggcagcagcggggaggcagcatcttggtctgaagtggagaggtcgttttcctttcctggcatgggccactctgaccctcgtcactatcttttcaccatggcaggactgttcctacttcaactccaatgctgtccccctcaaactctccttccaaaatgtggatcccctgggtgagaacatccgtgtcatcttcaaggtgagaatactttactcaagcctggtggaccagggtgggagagagaaggaggcagcctagagtggcattaagtagcccctgggtggttctcttcccactgttccatgctgtcttaatgtaggaaagatgatcaggtgaaaaaggatttagatgaattctgcatggccccagaggcctaacaacagagtgttaggtatagggaggcaactggcagctcagtatcccgaagtgctttctaggaggcagagctccctcaacaatgggttgggtaaggtggtgatccgcttgtcccttgggtattcaggcagaggctgaatgccatgtggcagggctgctgaagaggaaattaatatatcaggtgcaggtccaactagatgaaccctaaggtcccttctaactctgatgtatccacaattctgagaagtaaatgatagtctcagagcatataatctaatgggggagacaaaatacatgcatgtgacttagtaacttatatatttgctatgcgcaagttccaaatccaaagtctaaacgttcaagtttaaaaaaggcctgatggcctgggtgtggtgcctcatgcctataatcccagcactttgggaggctgaggcatgcagatcatttgaggtcaggagtttgagaccagcctggccaagatggtgagaccccatctctactaaaaatatatatatatatatatatataaattagctgggcgtggtggcaggcacctgtaattccagctacttgggaggctgaggcatgagaatcacttgaacctgggaggcggaggttgcggtgagctgagatcgtgccactgcactccagcctgggtgacaaagtgagacactgtctcaaaaaaaaaaaaaaaaaggcctgatggtcagaggggctgcatgcagaagcagaccgtgaatttaattcagatggggccatgggattgcaggacaagctggaacaacacatgggcaaactgggaagcttcctgggccatctttgacctggtgtgagctgagtgagcaggtcaggggtgtgaggctggggaactccctgtcactgttagtttagggccaaggttgagcacttgggagacctgagagctggggaggtagtggagattagatctggtcactttctccctccatccagtgtggggacgaccttcgccaggacatgctaacgctgcagatgattcgcatcatgagcaagatctgggtccaggaggggctggacatgcgcatggtcatcttccgctgcttctccaccggccggggcagaggtcagttgggagtaggggtgagggtggaggaggggaccgctttgcttattgtccttctgcccattgccaacacaaactgtgtcctcctccaggaaagtgaaaagggcaagattatttcatgagaagctgtgggatagccttaaaagggaggcatgggagaagactgttataaagtaaaacagacttggtgccgtgacagccaagcatattgtgtagactttggatcctgattaaaacaaaccaattgtaaggaaatattttttgggccagacatgctagctcatgcctgtaatcccagcactttgtgaagctgagatgggagaattgcttgagctcaggaatgtttgggaccaacctagacacctcatctctaataaaaattataaaaaattagccaggcctaatggcatgtgcctgcagtcccacctcctcgggaggctgaggcagatggatcgcttgagtccaggaatttgaggctgcagtaagccatgatggtgccactgtacttcagaccaggcgacagaatgagaccctgtgtgaaaatatatatatagagagagagagagaaggagagagacagttgggggaagtttgaatatagattgagttagattaaagagtgattgttaattttttggatgtgacaatggcatggtgtctttgttaattacacttgaaatatttatgagtgaaataaagtatctgggatttgctttaaaatactccaaccaaggtggcagggagtggagaaatagggttgtgtgattagcaaacaagattagcaaaatgttgacaatttttgaagctgggtgatagttacatgtgaagtcatgataccattctttttattcttatatatattttcaaattcccatagtaaaagctaaaaacaaagggagcagcagctatgaactggagagaccaaaaagtcacagtatggaataggaaatgtgggaatgaccttcctttctatggttattctcttcctgttattatcagacttagtccaaatgccttacagcttaatttatagggaagcatgagcacagtccttgtagtcctctccctgcagtccccttcattctggtctggaacgtgacccccatttctcccctcacagggatggtggagatgatccctaatgctgagaccctgcgtaagatccaggtggagcatggggtgaccggctcgttcaaggaccggcccctggcagactggctgcagaaacacaaccctggggaggacgagtatgagaaggtagggttgtgggtggggagtgcgtctggtgtgtgtgtgtgcctgatgccggcacacagctctttaaccacaagacctgcacttgctcagagaggacagctcagctttgttggcagaaggacctaccctttcttggttgactggtgcctccaaatatctgggggtgactcactcaaatgcctcttgtaagctggctgagaaaatcccctgatgctggactgagaaactttcactgagttctcctggcagattaagtcttggaggaggcgccagcttttgagagcctatctgtatccctcccagttgtggatcctcttcaggttcccttatgttctcagagggttcagtggtactttctagaaaaagagttggttggaagagactttagagatcattttatgccagccccttcttttcatagctgtgaattaagattcactcattcattcctagttatggagctgatatgtggcaaggctgtaactcaaagctaggattgaggttagatatgagacagagacgagtgaaaacagggctggctggttcctgatgaaagaagattagattagaagtggagctttcctgggtggtagggccctggtagcctgctagggtccgtggcctgttcccagcatcacaactctagtctctgggttaattaggttgaggaaagtagggacactgggaaggaacaaatcacaataaccaaactcacaagagactggctataggccagaatgctaattcgtataattttaacttcaagggacccaaatactgatttatattgatcaatgtactttatcctggagggaaaaccagcatgggcagccaaggtataatcagaacattgtttagtgaatgtgtaattagatgatcttaaatggctttcagtgtttgtgttccccggggcttaattcctggcctgctgggccctctttgcactcttcttgtgccagctcatcctcttattacttcaactaccacctgtatcttgatgacctccgaagccattcctctagccctcttcccttcctccaggtggttctatagccaccttcttgctggacttttccacctacgtttcacccacgtctcaaactcggtgtaggcaaaactgagcctgctgtctctcctttgcctcttgaaacctgctttttgtgtttgctatcagtcaatggtgtgactctttctgtgcatttacccaagccaaagccacggtcttcctgatgcttccctctatctcacttctgtaccatgctctgtttattcttcttcccagctatctctcaaatctgtcctcttcttcctattttgttaccattgattttgttcagctctttgctgtcggtcccctgaaccactggaatgcctctcctccatctagagccagcctctgcttgatttcagaggtgttttgttgttgttgttgttgttttgagacagagttttgctcttgttgcccaggccggagtgcaatggcacgagcttggctcactgcaacctccacctcctggattcaagcgattctcctgcctcagcctcccaagtagctgggattataggcgtgcaccaccatgcccagcgaattttcatatttttagtagagaaggggtttcaccatgttggccaggctggtcgcgaactcctgacctcaggtgatccacccacctcagcctcccatagtgctgggattacaggcatgagccacagtgcccagctgttgtttttttttttaagtgtggataagttcttcaaagcctctgtgtatcctaacagatagcattgcacacagagccttttataatccagccctgctgactcctgtaatcccatccactgcaacctaccatcttatgctaacctatgctccagctaggttactagctagatcatgcggtgggggcagggggggctactactttcatttctgcagtactgtaggcagtaatatttcctttgcctggaaagtcatttcttcccttctcattcctcaaaactctgccactctatgctatacatttcaaggccctctacccttggagaggagtaatgatttttttcctttctactaccaacctcccatatacttactctttatgctaatatgcatttttcaggtattaaacacccatatgcagaggcactgtactaggtgctggagttgtgattactccctgccaatgtaatagtcatatatgtgtaaatgtatggaaataatactaaataataataaatgtacagatgaatgtataagaatataataaaaataaatgtacagaagaatgtacgagaatacacacagagagaaactaactctgcatgttcatgtttaatctcagtctttcaaagatagcttctctgcccttctagcctttctccaagaataatgctggtagtttctttttttttgaggcagggtctcactctgtcacccaggctggaatacagtggcacaatcactgcaacctccacctcctgggttcatgtgatcctcctgactcagccttccaagtagctgggactacaggcatgtgccaccatgcccagctaatttttctatttttcgtggagatggggttttgccatgttgcccaggctggacttgaacccctgggttcaagagattcacccacctcagcctcccaaagtgctgggattacaggcatgagccaccacccccagcaatgctggtagtttcatttgatgacttccagaagaaagaaactagaggtattttctcttggccacctactcagcaagagagtatcccacaccctacacatgaaacccctgaaatcagaggcagagtgtccctttatagagtgagacttcttgccagtaagtggctaacaccctgcataacttagggaggtgaaaagagtttagtcatttacccacaggcacacagctattttctcagccaaaataggattcatttaaggtagaaagagcatctgtgacagggagaggatttgatagagatccaggtcacgactgggagttacgcgttatgctccttattaagtgcttttattcatttattttactttctaagaaatagtctttttcttccagaagatgaatgctgtgatttctttataacctttccattcttagtttctggtggatccatcatcaggttgtaattcgacaagtagctgggtgggtgcattctgtgtggagctagttttgcaataggcattgtgaaataggcaagaagctgttaggagaacagatctgtaaaccccatgggactgaaagggcaaagtcagtgctgtatgaatggaggtgacagtgcatctgtaggggttcagaggaggagaagtcagtatgagcttggaaggtctggaaagttatgggactcaaggtcattgaaggatgatgggtggaaatttatggaaggaggcaaggagggcgggcattccatatctagtaagctttccctcattcctaatttcatgcattcctacctggctatgacgatcattgctctctgctgatgtctttcctgagttcttaggaattctataaacctcacgaagaggattttgaaggcaggagtggtctatttcctcattccatgtagtttttctttctggaaagacagataaggggatggatgttgaccagacaaaataagatggagtcaacccctcaccactcctctcctgctttaaactcagaaatatctctaacatattttaccaactaaagatgtcccattttcaagtgtaaaacactctctagacgtgttaagctgcctcagctcttctttggagtgcagtgactttaattagattagcatttagctgttaccaagaactctggaaatgggaattttatttggggcaggaagaaggatgatagaattctgagcagggtcaggaagagattcttaagttggcttcctcagtggctgtacttaagatcatcacggccagttggggaagttgtaaatgtcagtcttcccatctcttaaggtcccctcagtctgggctgatcaagactgggctcttggatcagtccactgtctttccaaccgatctccctaggagaaagaaaggagaagatggtattcagatgaagtggtgaagatatacatataaatctccatcttttccataagacatgggagatgtttctgtgtgtgtaagtgtgtaagttagtacatgatgaaggatgaacaggcagatgtgagacactattggggttcacagaagagagagaggccagggctggctgagttctgtctggctgtggcccctggagtccttccaagccagctttatgtcctctcctcccatctgccttgacccctcccaggctgtggagaactttatctactcctgcgctggctgctgcgtggccacgtacgtcttgggcatctgtgaccgacataatgacaacatcatgctgaagaccactggtcacatgttccacattgattttggccgcttcctgggccatgcccagatgtttggcaacatcaagcggtaagtgatctcctgaagccagattgtgagtgaagggcaaggaggtgagcaacagtggttcagagctgggacacaagcccatgatggaagcagctgggcctcagatcatggtcccagggctgagcagcattggaggagagaagacggataaagaggtcaagtccttgcagggccttgcagaagaatgcggggaccagctgttcttccctaccaaggactgaacaaagggaaatgaaccaaactgtagcaaaaaggaatgcaatcagatatccagaaaaaaatattgccagctcacagataaggaaccaatgaaggatatagagatcttttaagattaaggtaggaaaggaacaaagaaaaaagttagagccccttctatccagtgtgtccacgtgatgagggatgagggaaactgacccctgatgcagcccatatggtgggcttcctcctccatgttgaccttctacctgtatgttccccttggctcagggaccgtgccccctttgtcttcacctcggacatggcgtatgtcatcaacgggggtgacaagccttccagccgcttccatgattttgttgacctttgctgccaagcctacaacctcattcgcaagcacacccacctcttcctcaaccttctgggcctggtgaggagctccatccctttccgaataccttcttcttattatctggcatcatctttaagacttccctgtcttgccgcagaggatttctagagatttacctctctgagccccaactgaatacctgcctgccctagataaaggcagggacccagactacctgaggacaatgatgtctgtgtaggtgcctgactccctgctccagcccttcagttcctgtggccctccagccactgcccacagcatctgtctaccaccctctagaagggttagggagcctagctgtagaaaaccttgcctaagggtagagaagcagcaagaattctctgttgttacaggcaccctctcttcttctttctgctccttctagatgttgtcctgtgggatccctgaactctcagacctggaggacctcaagtatgtgtacgatgccctgaggcctcaggatacagaggccaatgccactacctacttcactaggtaaaatgattccctgagcgaatcagcactgcccaccctgagtaattcccagcctgccggattggcaggaggaggactggggaaaggtgaaaagcttagctcagatgctagagcctagagctgaccacgtggatacattgtcccaactttgcccgtgatttaggtaaatcattttgcttctctcagccttggtttcccatctgtgttttggtgctaacctttgcacacaagggtattgccatcactcttatctacattctcactaggtcccatcaaatactttgtctatggggcaatgtataatgtggcttttgtaataacttttaactttcttggtcagacgcttcccccttgccagaacatggagttccatgattcagtctcctcatatttgacaatgtttttaggtacactgtgtgtgaaagcaaggatgtgtttatctatgaatgcctgcaaaatgtggtccctgtagataatgttctccactctttttggaattcagagaattaaactttctctgttaggtctcctaacacaggacctctcccgctgaattgaaatctgagattgaacagtgcttggtgaggttctattgtaatgaaccttgaaattttttgatatttagacatttacacagagagagtgagttcctagttcctttctaccttggtttgatggtttttggctcaggtgggcagccaggggaggagataagaccctggggttcacatgagcaaattgcatgagattattgtgtgccagtcatttgctttatgaggatatgacacaggaaaatggtttgatctgagctgattgttagtctcaggagtcaggaatattccttggaacacccctgtcgaggcagcaggaatttgggttcatggttatatcctcttttcttatcctcctgccaggttgattgagtccagcctgggcagtgtagccacaaagctcaattttttcatccataatctggctcagatgaagttcacgggctcagatgaccggctgaccctctcctttgcctcccgaacacacactctcaagagctctggccgaatcagtgatgttttcctctgccgccatgagaagatcttccaccccaacaaaggctatgtaagtgttttctccaatctgaccccctttcctgctctctgctgaccctggcttgctgggatcctgactttttccacacttgcacagtgggcacaggagttgaccgagcgtcctgtgctgggagcagtcctggaccacttccctctcctttgctcacgtgatctgcctagaattgggtagctgaattggatggttattccctctgagtcaaggatcctggcaacatatgtgggaagtctgcttttagattcctgtgtatgtgctatcatctgtctccactcttgctctcttccttctggaatgtgcccctcccctcagcacatacatacacttccggacctttcctacacccttcactgggtgcagagggctcggcaggtacaccctaagatctggacctttgcagatatatgtggtaaaggtgatgcgagagaacactcacgaggccacctacatccagcggacctttgaggagttccaggaattacacaataagttgcggctgctcttcccttcttcccacttgcccaggtagctgccccctttactatctgcacagagggatgtcggggagggggaaaggatacgggatgggaggtggtcagggctgcaggggcagaaaatacccttttggactaaacatctgcctgctttgcttggcctggtatggagtttgatgacaagtgctccccctgctggccaagctctccttgcacgcaagagctctcactccaggcccactggccagaaaggaaggcatggttgaatctgatgtttcaaaatttctaattttttaaagagttacaccatttttcaaatggataagcaaaatgtcatatgtacatacagtgggatattattcagcatttaaaatggagggagatttcgacacgggtaacaacgtggatggaccttgaggacattctgctaagtgaaataagccagtcacaaaaaaacaaaaacggcacgattccacttatctgagttacctggagtagtcagactcctagaggcagaaagtagaaagctagttgcccaggtctgaggggaggtaggtgtggttgtttaatgggtacagagcttcagttttgcaagatgaaaagagctatgaagttggatagtggcgatggttgcatgacagtgtgaatatggttaattccacagaactgtacacttaaaaatggttaagatggcaaattttatgttacacatattttactgcaatttttttaaaaactacttttcaggccgggcgcagtggttcacgcctgtaatcccagcactttgggaggcctaggtgggcagattgcctgaggtcaggagttcgagagcagcctggccaacatggtgaaaccccatctctactaaaaatacaaaaattagtgtggtggcatgcttttataatcccagctactcaggaggctgaggcaggagaatcgcttgaacccgggaggcagaggttgcagtgagctgagatcacgtgactgcgctccagcctgggcggcaaagcgagactcagtctcaaaacaaacaaacaactttttaaatgaattttttggccgggtgcggtggctcatgcctgtaatcccagcactttggcaggctgaggcaggcagatcatgagctaaggagtttgagaccagcctggccaacatggtgaaacccccctctactaaaaatacaaaaattagctgggtgcggtggtgtgtgcctgtaatcccagctactggggaggctgaggcaggagaatcgcttgaacccgggtggtggaggttgcagtgagccgagattgcgccactgtactcccgcctgggtgacagagcgagactccatctcaaaaaaaaaaaaaggatttttacatcgatgggagaaactgagggctcccgagccatttctggggagccacaggactctggcctgctgtttggttttcttgtctggggcccttggaaatgtagtcatgagatgctgagcaggtgtcagacctgggcacagatgtgcagcacaggaggaattgtgagggtccctagaaatggaggctgctgggaaatgggtgctaggggactggaaacgcaaatgaaatgtgaaaaaagcccattgtgtccattttctttccccatcttcacctcctgcatccccgctgcctacgctgccacgccagcttccctagtcgcttcgtgatcggccgctcccggggagaggcggtggccgagcggcggagggaggagctaaacggttacatctggcacttgatccacgcaccccctgaggtggccgaggtgggtgggcttgcctctcctcctggctgtccaggctggtggggatggttggggaggcagaggtggaagcatccggaggcactaggagtcaggaacaggacttggcacttcggggtctgtgggctgaatgaccaatgctccagtctgcagaagacaggaggagggtgggtccagcctcacagggttatacacagaaatgcaattaaacagaaaggtgaatgcatcgaggcacatgggctgagaatgatgagaatgagcggagcctcagaaaggaaggctcctctttgaggaaaaagttttttgagcaggttgagtatgtattatcaacctagatttttttttaaacaaatagtagtataatggccctaacaaagtcatgaggaatcctattattaaatactttaacaaatcatctgcccctattgtccatgttcccttcctatttgtccatatgcaagcatgatttttacagttttatagtggttatagcttaagtataactctggattctgagcttttttcccttagcatttatagtatacatatgctataactttaaatatctgttccttcagacaccaacttgcagtaccataatcttaaccattttatttttgaaagatatttagagtatgtgttttttttccccattaatgttcaagtgagtattttcacacagtttgtttgttttttgagacaggatcttgccctgtcattcagtctggagtgcagtggcacaatcacagctcactgcagcctccacttcccaggctcaagcgatcctcccacctcagtctcctgagtagctgggactgtaggcatgggccaccacacccggctaatttttgtatttttttttttgtaaagacagggttttactatgtcaccaggctggtctcagactcctgagctcaagcgatcctctggcctcagcctcccaaagtgctggaattataggcatgaaccactgcgctcggcctgttttttctttttaaactttttagggttaaaactttcaagcatgcagaaaagtagagaaacaatataattagcacctatatatccatcacctaaacacttaacattttgctatatttgcttcttctattttttatgaagtattttaaaataaataacatgccaggtgcagtggctcatgcctgtaatcttagcactttgggaggccgaggcaggtggatcacctgaggttaggaatttgagaccagcctggccaacatgtctctaccaaaaatacaaaaattagctgggcgtggtggcgcaggcctgtaatctcatctacttgggagcctgaggttgcagtgagctgagatcgccccactgcactccagcctaggtgtcagagcgagactccatctcaaacaaacaaacaaagtaaattacagacatcataatactgtaccccctaaatactcactatgcatctctaaacaataaagtcttgtttttaaagtaactacagtattattatattatccagtccatagtccatattcaaaatttccctatcatcccccaaattccttttactgttggcttgttagagctataatccacataagaactgcatgttgttggttgttatatttcctaagtctttttacatctggaacagtccccttcctttttgtattgggccattgtcttattgaagaatggccctgtttctgattctgttccagtgtgatttggtgtacaccttcttccacccactgccccgggatgagaaggctatgggcaccagcccagctcctaagtcctcaggtacagtatcttctctgagaccttactgccaactcctctgaactaccccaagggtaactgcttctgccccaacctcttctcagttctctctccttgacttgcctcctgttccttttcttactctctgggaaatctagtttcccactcaggccgtggggtccatagttccttacctgggttccccacagggtggatattcagtcgattatatccttagacccatcccaacccaattaactctaatcacattcagactacacttatgtagatgcctcatgagtatcagaaatctgacatggagaggctggggcaagggggttcaggaagaaaacagaaacacctgcctggcctcttgacccttcatggtttcatttgtccctacagatggcacatgggcccggcccgtcggaaaggtgggaggggaggtgaagctgtccatctcctacaaaaacaataaactcttcatcatggtgatgcatattcggggcttggtaagtgcctgcacagccgtgattttttttcttttttaatgtttctttagctacttttttgggcagaccttctctgccgcgtgtcatatgggtaaccaccacagtctactgagcatccaccatggacctataaccatagcaagcctatggtatgactaggcaatacatgagacagctttttgtagctgtggtctttgacaagtaacctaatcattctgagcctcattagaatgaggaaaatgttagcacctacctcatagagtcattatggggattaaatgagataatgcttgtggaatacttaacaccatgcctggttttattagaataatgatttttatagtaattataagggagaggcccaaggggctcattacctggctataatgattgagcagccacgtgacatcctttgaatatgatcaaggcagtagtagataattactaaatttttggtacgagttctaagaacattgtgactagaagaggaagggaacttttttttttttttgaaatggagttttgctctgtcacccaggctggagtgcagtggcgcaatcttggcttactgcaacctccgcctcctgggttcaagcgattttcctgcctcagcctgagtagctgggactacaggcacatgccaccacacctggctaatttttgtattttttaaaattagagaccgggtttcactatgttggctagactggtcttgaatgcctgacttcaggtgatccgtctgtctcagcctcccaaagtgctgggattataggtgtgagccaccacgcccagccaggaagggaacttgaatacttgcattgtgctgcatcctatgttaggcattttatgtaggttggggcagtgggatatggcaggaggaacataaacattcatccatttactcttcattcaataaatgtttgagtgcctgctatatactgatacattagctctgggtatgggggaaaacaaaacaaaatccctgccctcagggggcttacattctagttgggaacggcacacaggcagataagtaaaatatatggcatagaagatggtagtaagagctatggcaagaaataaagcagagaaggaatgctaggatggaatgaagggagtggactttgcaaagagtgctcagggaaggcctcattgttgaggaggtgtcttagcaagatggagaaggtgagggagggagccatgtttatgcatctgagggcagactttcccaggcaaagggagcagttagatctgacagcccagagccaggagcctgccaggggtgcgtcagaaacagcaaggggccagcggctgaagccgatggagcaaagtcgagaggagtggatgatgaggttggagagggtatgatggaccagcacctcaccctgatagtaagaaccgtggctttttccctgaatgagatgggttttaagcagaggcatgacatgatctgacttaggttttaaaaggatcaggctgggtgaatcactagttggctgcccttgagcaagcagctcaatctctgtgactcatgtctctacctcttaggggttaagtggaccaaatgacaaaatagataaggatagtagatatggcaggaagatacctgggaacatgatggttcactcaaaacagagcacattatgggatgtcctgaggatttggataaaagtatagacttgatatcataggcaaaccaattgatgttttaataggacacaatgttatcatggtagatatttttatcagaatagagtgagcttggaagcagacaaataaattagttgtgcattgcaagatgccagatggcagatgagagtctggatcagagtgtgatcacaggaatggtggtgaagagacagatgttaaaaatcttaacatttttttggttctcattctattgtagcaactgctccaggatggaaatgaccctgacccctatgtgaaaatttacctccttcctgaccctcagaaaaccactaagaggaaaaccaaagtggcccggaaaacctgcaatcctacctacaatgagatggtgggtggggaaaatggtggggtagggcaggggttggcaacctgcgcctgttctcctagataaagtcgtattgaagaacgtattaagatgttgtattaagaacatggctgtacttgctgatttaggtgttacctgtagctgctttcatgttgcaatggcaggatcgagtagttgtaacatagaccatatggcttatcaagcctaaaaatatttactatctgtccctttacataaaaagtttgccagcccttttgggctgggatttcatggctggggtctggccctatcctgtgggaaggagaagcctgctggtcctgtgctgaaaatgagcagtggccccaatacaaagccctcacctgcttgaactctgagcaaagaacagagttcattaatgcttcccttggagtctgtgtaccttgtgtgccttctgtattacctgggactctgcagggtgagtgctagcctcagctggatcagcccccaacagactttaccatctccctctcgggttccctctggattcttcttgttccttctctcaccacttccctcacccatctctatgtttgcagttggtatatgatgggatccccaagggtgacctgcagcagcgggagctccagctgagcgtgctgagtgagcagggattctgggagaacgtcctcctcggtgaggtgaacatccgcctgcgagagctggacctggctcaggagaagaccggctggttcgccctgggatctcgaagtcatggcaccttgtgagcccagcagagccaccacccagcatcccaggctggtggcaggagctgggggagaggactctcccctgtgagactcctccttgtgaagggccagggccctgggcaggcctccagctcggtccaggtgattctggcctctgtggtaggaggcagggagagtaagacatgctctgctgtctcttcctctggagactgaacttgggttggttgtgatgagcagccccttggaggctgtgaggttgcagcaaagttttaagtttaccttgtgtcaagggagcaatgcttggtttggggagtgtgtggggtgggctgtatgaagtagcattttgggggtgggtgggtggatatcttaatttttatttttaaaaaatgaaatagtgatgttgtcctaactgggacaggaagccttgcgagaagggacgtacctatgccccagaaggcaagagaggaagactatttggactttttgtatgattaaggttcttattggacttttccctaggttttttttttttgttattgttgttgttgtttcgttttctagctataggaactatctggggaggggcccagtgggtcctcggccagagccctctctaaggacaggttggggagggttggggagggctgcctgtgctggactgaggcttgtgccactgggcctttctgattttgcctccaaaggagagcgctgtgatacctacatgtgtaaggaagggccttccgtattggggttctgccaaggacccgtattcagggacccatgctcttttggggggacttttcctcttgtcttccctactttattaggacttgccctgaataccattttctaccccttgcccctccattctcctggcccttctgggggtcagctggtctctatgaatatgctgggggtgcttccccataggtctctcccttcatttgtctctggtgggacaaaatactgactcagtccttagatgtagtttcacccaagagcatcttggccctgggaagaggtccctaggctgcagatgctactgactgcttgctaggtagcctctggaaagcattccccatccatcactccccacttctttctgctgtgctgcttccctcccaaactccatttctgtcaccctttttataagacttttcctcattctgtggggccataaacctatttagtctggagccaaagggatgccctatctgaaggaaaggggcatggggtgggggattccatcaaaactgttgttttttgccccatgatttttctttggtcagtaggaggctggattggagtggtgattattcccctggagctaagctcaggagcccgaagggagagactgagactgactcccttatctcttcatattctttattccctaccagatggatttttttttttttttttggagacggagtctcgccctgtcgccaggctggagtgtagtggcatgatctcgactcactgcaaaatctgcctcccgggttcaagcgattctcctacctcagcctcccgagtagctgggattacaggcatgtgccaccacgccaagctaatttttgtatttttagtagagacggggtttcaccatgttggccaggatggtctcgatctcttgacctcgtgatctgcctgccttggcctcccaaagtgctgggattacaggcgtgagccaccatgccccgccccagatggattttacatttgctcttttgtgtttcgctccaaagggttgtcttcctcgccaaaaggagggagggactttgaatttgatatgaatctttaaaaccagaattggctggatatttcccatgattgggaaaagagtgaaatgaggacattctgtaaactgtccctccctaattccaaggatcagaaactccccgttttgctgactcattccataactggagaaagaagctccattgaccgaagccacagggcagcatggaagtttaaattttctctaaaattaaaatgccaaggataaagctggctgcttccaggagggggaagaggagtggggagtgggcggtgaaacttttccagatgaacggaccataaatgtgttactggctttgtgcctgtagctcattttattatgacctatatgctcctgatttaaagagatctgtgtactgtttacttcccacttcccagaatcccttgtatctcctttctcgggaattgtattttctaataaatgacatttgagaaaa

SEQ ID NO: 36617 - DNA, 922739 bp, Homo sapiens
atggaggcagagggcagcagcgcgccggcccgggcgggcagcggagagggcagcgacagcgccggcggggccacgctcaaagcccccaagcatctctggaggcacgagcagcaccaccagtacccgctccggcagccccagttccgcctcctgcatccccatcaccacctgcccccgccgccgccaccctcgccccagccccagccccagtgtccgctacagccgccgccgccgccccccctgccgccgcccccgccgccgcccggggctgcccgcggccgctacgcctcgagcggggccaccggccgcgtccggcatcgcggctactcggacaccgagcgctacctgtactgtcgcgccatggaccgcacctcctacgcggtggagaccggccaccggcccggcctgaagaaatccaggatgtcctggccctcctcgttccagggactcaggcggtgagtggagagcgccccctcccccattcaggcaaagggtcacctccccttttctcaaatactccatctaagtcggcttatcaccaccaattctagacccagggtaaaatgctagtctggaaattgggggaggacaaacaggggtgtgcctatcctttattgagagtatgctattcaggtgtgtgtaagagaccccccaaaagtactgcataaatgttaactggggccgtgtgtgtgtgtgtgtgtgtgtgtgtgtgtgtgtgtgtgtgtggtgcgcgcgcttcccagttatctgtgccacgcaccagccctctccccacccacttccataccaccctggctagtgagactaaacaggcaaaatcagtttgctctgggtggagaagaagagaaggtgaaggttttgcgggatttgaccagcgaaagcacccagcatctgtccactcaccctattgggaagagggtcggtggggctgctctgactggggaggaggggggagtgagaaagcctggtcccaggattgcagctaaaagcctaagaacaactcgcatttctcttcgtcaggtggagaagtaaattgaatagcaaaaggggagaacacgtgggtgacttggagagtttggagcaaaatgttcagcaatccttgagagagacaagggggtgagggagggagaaggagcgaggacgctgtgggagttacactgtgtcggtgtgtgcgagcttgtgtgtagggagaccgtgtgtgtatcagtcgtccctgcaaaatcccaggaagaaagcgccttgttttagcagcaggcaagacgtagagatttgattatagtgatttccccttaacgtaagtgctccggaagacagggcagggaagccgcctatcaaccgggagttttagtagaagttgaccgctgcttctccaaggaaatgagtaaaggaccaattacagccattctgaggagtcagctccagattcttaactcaggcgtggaggtggatgtggggcccacgtttggtccctttcctgataacccagggacagctcctttcttccctgtcccaggccttccacgccgtgaatcccctcccccacacaggcacaggaaaaagatttcaggagctgctgatccttggcacatctaatagtaaagtagaggggtcgtcatctaaccttagatgtggacaggcatcgatgtactgcacctccaagccacaagtctgaacaatgggcagttataaattgtaaatcaggtctgggtgtggaaacaggaaaatctagggctgggattgtttgtccaactctgattgacagtaggttggactgatcagaaaatcataatggtgttcaaatgtgtgtttgagttttgtgtgtgtgtgtgtgtgtgagcatgtctctctgttgtatacactatgtacaagggaatccagccaaactatcataaccctgatgtgtacacatcatttcagcttgcatatatgctcttagccctttgcctggctcacacccttaggtaccttgttggagatgttcttgtacctgttggatgggaagaataagaattgtaattaataacctcaattcagatcaaagactgcagacttccataaattaatataaaagtttcatttttcagccaagactgctaagaccctttgtttgaagaggtggatgtccttctctctcccctttggttgagcacgacactatgtaggaccccaatgatagaatgaaggcaagcctgatactttgtatatttgacctattaatagaaaaataccgtgtgatgatgagcccttaataaacattaaataagaacaagagttctagcttgatctgtgggctgattgattttgtagagtttcttaattgacttcattttttaataaaatagaatatgcctgagagagtggaagaaagaaaaataagctaattggaatagaggtattgcatcattgatttgaatttattttttgctatgctttctacattgattaattgttctatttgaaatttttagttgaatggttcacaggcaaactaagatgtataatatttatatgtagctgccactgtggctcacctgatatatcattgtcattctatttaaggatccttagacttaaaattctttacaatacttgcatattccccacatgctcacacattgcatgtcatgtttttccttaatagagttgcttttgcaaataaatacatctttaaggaggacatggatattagtttcattctttaaagagaacagcaacaatacttttttattttaaagagaacagcaacaatgcttttaaattatcaaagaaattttacatttattaacttatttgaatcctacaacaacactgagatgagatggtattatctctatttgatagacaagaatgctgagccccagaagatgcgagcaatttgttcagtatcacatagactgtgagtgctagagctaagactgaaacccaagtctcctgcctcatcaaaggtggtgagcccaccttaaataaatgtgtgcagaacctgggcctgttgacagcatcaagaaatacatgaaaccaacgtgaagtttatatcgactgatactacaggacataaagcctgaatgaactaaaaatgagatatggtttaaatccatttttaacaaaatgacatatatcacaagcttctagaagtaattagagattttaactttagaaactctgggcagtataaactggtgttaatgatcacaacagaggcaaatcagtgtatttgttgactttgtaaaatgcatataaatacttatgaaagagtgttcagataaattaaagctagtgagaacatctaacgtctttttcaataattttctaaaagcaaacaagaaaaggtgtgtgtgtgtgtgtgtgtgtgtgtgtgtgtgtgtgtgtgtacgtgcgcaccaccatcttaccatcatccaaatggggggtttaaatagtctatcaagttaatgtctctgaaaaagcctcatgggtggatggatgaatgattccctatggattatcaagaaaggtatatcttttataaagctatttctagcatgcactgtagcatttccagatattatcttggctgaaattttgagaatttgtaacagtttgtgaagcaatgggaaagaggaatcttgtttaatgaaaaaatgtatataagcagtaaggagacaacccttagatattttgtggtcaattcttttaagtccatgggaaatttggatatgttaaataaattttttatataaagtgtgtctgtcaaacaaggtagattcatgtcttaatctcaacatgcaagaaatttcaaacaataaaattaccagagaaatgagtctctaagttaccaagagaacaaaatgaaatatgaaaaatgtttaaaacactctttaaaaatgtacatatcagattaatcatttcaaccaatagtcttcaaaatgtgacaactatttaactgaactgataaataattttattgtttctttgactttacacaacaaaatattattttcaataatataatacactaaggttgaaaatacaagcagcatggatgattccttgatattataaaatattctggattatagtgatacaaatatccagaaggggacatttgatttagatactttgtttgattcatttatttttatctatttatatttattgtttttttagagactgggtctcgctctgtcacccaggttggagtacagtggcacaatcatagctcactgtagccttgaacacatgtgctcaagtgatcctcctgcctcagactcccaaagtgctgggattactgtcatgaaccaccatgcctgactcaatttaggtagaaggaaaagagctaaaacctataatcacacaaaatataaattctgcgcatattatatttacttgacattagctttttttttttttttttttttagacagagtctcgctctgtcacccaggctggagtgtgcagtggcacaatcttggctcactgcaaactccacctcccaggttcaagggattctcctgccttggcctcccaagtagctgggactacgggcacgagccgccacgcctgactaattttttgtatttttagtagagatggagcttcaccatgttggccaagctggtctcaaactcctggcctcaagttatccacccgcctcggcctcccaaagtgctgggatacagacgtaagccaccgtgcctggcaacattagttttttaaatatgttaacatcatatattaaataaagaaaacatattgtaatatttaaataataaaagaaattaggttttcatttttctatgctaggttataaaagctatttctttattgttttattgatttttcaggttattagtgtaattttttcttcattaaaggatgtaacggtaatctaggttcatgatgtaaaatttagatttcacattaccaaaataattaattgaaaaattggccgttcagattgtctacatcagtgaatttgaatttaggaaacagtatctttaaaaaaaagcatattggaaaactgacataaggttgacatctttaaattttaatatgtaaggacactaaggatatttaaatagcaaaaaatgcaaggaaaatgtatattttttacatttcctacatattgtcaacacagtaacacagtattagactttttaattttttcaaaattagtttgaaccttttattcttgatttgcctccaatagaatattgtcttggtaacttcatttaatactttatcagctagtgtgttctaagcctttgattaatcagaaaaacataatgaatccatcacctttttacattttgattctaaaatgatgtaccttctgtgtttcatggaaatgggaggtggtgggcagaggaggtagaagggaaaggataggaacaaatccccaagcagggaatgttcctaagtccttgtcttattctaattggatcatctgggttcagttgcccacatgtggagcagtagcatgaaaataggtaattgaccacatcaacaagacatatttctctaagattatggaatgtcgagaagagaagggactgaggcttaaactaacctagtccaccactgtccatcttttacatttgaagaaacatgtgtcatgaggggttaaattacttaacacaactagtttactgcccaaactataactacaaactatatcctccatatctgctgacaattactttacattttacacattgtggccatcttttaaccatcagtagccccaacttccaggttatagccttgaaccaaaagtttggaaattacatttaaaaaacatttgtgaataagtggaatattcaaatattggcacaagagagatgacttcagaaaacaaacattctttcactttcaatttggatacatttacacacacacacacacacaaacacacacacacacacactgatggcttgctcactgatttctatctctaaactttaatgtgggtttggaggcatgtcttgggaagagttcttaaagatcaaatagaataataatctaaaaagacttagttctgtttatgattttgctaattatttaaatgtctgaagtctatcatggacaaacttatgtccctctcacagcttattatccatctacaggtttaaaaatatgcaatatgtgagtctataacttgaatgctgctagtactggctcataacagcaacgttgctaagggattacaccaaatagcactgtattatatttcaaaagatgtggctatttttatcctgaggaacattttatctacgtttaaaaataagaaaactgatttttcccgaagaataagccactttaccttattgtttaaaacttatcagctaaattggttggaccctatattcacacataccaccattgccccaaacctcaccataccactttggagattgagaactctataaaatttgctttgtcatctaaatgagcatttataattcttgctccgtctcaacgtggggcatcacatccatccagttgtctctggtctgtggcattcttagactcttcctctcccctaactttggatctcaaagaccaccaagatcttttgaatcgtcctcagaaataactcttgtgttttttccttgccacttccctagttccagcacttatcctctattcactaaactatcgcaatagcctctaagtgatctctagctccaacctctcctcattcctgttgttcctttttttttttcaccccaggctaccagtttcaccaccatcttctaaatcttaaggtaatttctctttgccttcaagataaagtctaaatttcttagtttgactcttcagaatgttggcccagtcggtctttcttgcagaaagtctaacttttgtccccttttgtaaaccccatgaaataatcacacttaaattctggccgtggtctgagttctctgtgccttttcacacctctctttcttgctgaggctgcttcttccttctagattgctttccctatgctctgcaacaccccttccttacctgttcagaaaactcatgaatatcttttcaaactcagttcatgttaccctcttgcggatattcctacacaaagaaggaatatttttcttttctttatttttttatttttttatttttattttttatttttatttatcgtccgagctggagtggaatggcgcgatctcggctcactgcaagctccgcctaccgggttcaagcgattctcctgcctcagcctcccgagtagctgggactacaggcgcctgccaccatgtccggctaatttttcgtatttttagtagagacggggtttcactgtgttggccaggctggtctgaaacgcttgacctcgtcatccatctgcctcgatctcccaaagtgggaatatttttcttttctgggctttcccatagctttcgtatattatttgtactctagcagttatcaattgcagtttaattatttgttttatgtgtttcccccattaggtatgttaggaccttgcacagtgaatggttttatatagatttttaataagtggtgagcttttaaatgtggaaataataatgaaaccttgtctttttagtttgtgctctctcagacaggatatatttgattttcttaataatctctttgaaacacacagagttagtgattattttacccattttatagatgatggaagggaatattgaatctcagaaaaatagacacatattcatgttcaaagatagaacttggacttgagccaaaaaggtctagtgatcttttttattgtaatgtaatgaaacaagagatactgtgagtataggttggtatgaggagaagcagcctataatttgagttaagattatgaagacagagtgaaattataatattatgaagagaaataacagttttgatctaacttatgaaaaaaaaacaacatgtaagagtgaaaataactctgatgggataaagccccctttgtaaatttagagaagtgcctctacagagtaaattcttaaccttgggttatgtggctctacaagattcattacatttggaggtaggcacacatttcttagagaatgtttatccaattctcaatgagtcttttatccacaaaatttaaggcactgtgttctaaagctaagttattgactgcttcactaagggaaaaattatgagaacatagtatactaatggagtaagattatcgttggggtggctgaaagtaagcagtttgaaatgggattttagaaaaatgcaacacttcagacagataaggtcagaggcttatttaaaaatgacaatccccagtgggattttaggggattacttgacttaaaatttaatttaaatataaggatagtaaagaacattttgaaaaaataaaaagactgtttttccttataagatagcagaacatatcatataggctattaattcaaacagcatgataataatttagaaataaaccaattattcaaccaactggataaatggtcaagaataaggcccatgcatatattgaaaatttagggtttagtaaaggtagcagtccaaatcagtgagaaaaggataaattatttaatataggataaattgtttaatggtttatggaaataaaaaatgatcattacttcattcatactataataaagagcactggataaaaaagattaaaaactcaagagaaaaacagataaaggccatgaacagaaaattcaaaaaggaagaaaaatgtatgacaaatatacatttgaaaagtttttctacctgacagacaaagaaataaaaactgaaacaatttttcatctatcattttggaaaaagatgaaaaatttaaaagaatttgagatggtatacagacatagccactttcttatgtacattttcagtgaacaatatatcaggaaatcaggaagtataaatcaggaaaacattggtgggtgatcaaataatatatatcaatattttaatgtgcatacttttgtcccattaattctatgtttagaaacttagcctaagaatataattgaataagtgagcaaagaaatactatattgcaatattacatataatagtatacatctggaaaccacccaaatatctttcaggacagaaattgtaaaataaatgatgatatatctgtattgagatctgtatgtattgaaattattgaaatgttattttaaactctacaagttgttatgtggaaaaagcaatttagagaatagatgacagaatatggtatcatttaccagtgtgttttcatgcatgcttatatttacatatatgagattatgtctatgtacatgtgtgcctatagttatgtatgtaggtgtatgtgtggtatgtgtgtgtatatatatatgtgtgtgtgtatttatatctatatacatatatatgtagagtgagagagagacagagacagagacagtactacatatatatgtagagagagagagacaaagacagagagagagaatacatatatattctgtctaagcaggaaaaaccaccaaactgttacaggtgtgtgaagagaggatattttgagaggtctttgattttgttttatgttctcttctcttactcaatttcctttaaaatgagcatgtgttgtttttataataagcaaaaatcatgtattttctccttttgtaaaacaatattttcaacttatttcgtttaatatatttcacttgtatttcacttgtttcttacccccccaaaaaaagcaaaggattgcgtttcataaaaaaatttagtaaaagataaacatgaggacatcaaagagaagagaaaatggcatgaaaatagtatgaactatgaaagcaaaaattcatttcattaattcctgagtaattgctagaaacgagtcacagactggttctgatcttcctatcaactaatccaaggaagggaacactgttgctttaagattcatatatcggtaagttaaaaaatgagttgcttggtaaaatatattgctattaactctgagaattaaaagaaatatttctctgtggtgttttataaaaaagatgctatgtgatatggtgtgtgcagtttcaacattttttctatacttcataaagtttgaaatagatataaatgtttcttataactgtgactgattcttataaaactacacattgatggcctgttgtctaagttccattcattgaaaatctatcagcactggagccccagttagcattcttaacagggcattctctttaagactgaacactaagtgtgcaccattaaaagaagctgcattcttcaacttggaaaattcttctagactcactctcctgtatcccacgttcagcctcttgttctcacctgaatacccgaatttgatttggatgctgtatgtgttctctggtccttaagattaaaaactaaggtcttattttagtttcttgctcaaatattgcttttttgacctgctctgttcctgtaactgtagccctcaagcaagcccaacctaattctcaagtgtggctcagaattctgggacaccagcccaaattgggtcttccttatttgtgatagaatggaaccaaaggaataagagaggctgggcatcttggctcacgcctgtaatcccaacactttgggaggccaagacgggcagatcacttgaggccaggaattcaagattagcctggccaacatggcgaaaccctgtctctaccaaaaaatacaaaatttatccaggcatggtgacacgtgcctgtaatcccagctactcaagaggctgagacacgagaattgcttgaccctgggaggcagagattgcagtgagccaagatcgcgccactgaactccatcatgagcaacagagtgatcctctggtattttttcttaaaaaaaaaaaaaaaaagaaggaaaggagaattcagtgttggtatccagctttctgattttctgacatgaacaccccattgtctcgatatttataacatatccacttccagttgaatgcaccaagataatctagttgcaaaatgtagccccattaaatacatggattgacacatttaaatataagccagttaaatgttagaagttacttaccaaaaatgaggttgatgttttagaataatttactcacagcccttctctctgaaagcaattagagtaatacatttttagtctatcgagattgtccaaattcatgataacaatattacctagtatgcaggtgtgcttccagctcacttggaagcatttttaaatcattaaaacataaagtaaaagtttggactcttctatacacacatttttattttactaccactcaatcattcccaccacctgggttttcagttttattgaggaccagtttcttgtctaatgatcagtaggcaggggtctctactgtccagaaatcatgtggttactcatcacggcagctgctactacagacactgaagaaagatcatccaacatggataaataccctgttcttatcagatgtttgagaagtaatagagtataatgatgcccctcatgtagaatatggttctaagaaacccatacttatattaactcagaaactgccataaatagctgaaatatccaaataaatcaacagacccacagtttgtgagaaacagaaggatgttcatggcttcaatgggataggccaaactttgtgttgaattatgtgcttctttatgtcttgtttcctctgcctgaaatgccttttcctccacacccattagtgttttataacacctactcatacttcagatcttgattcaagcatcacttcttttggtgaagtattttcagatctcccaaacctgtcataataccatatagtgctcctttatattgtttattatattttcaattacatgtttaattgtataattattgataaggccaatttctttcaccaaactataaactcctatgaaaataatgactctgtcaatttttctcacattcaaacacagtatttgtacattgcttgaactgaaagaattattaataaataattgaactccagggttaccaattttatgaagttaggaatatactgttaaaagtaagtagaaaacaactccaaattcagacaacctttaccatgtgctttattttattaaagagttaaaaaataactatacaatttattttatgtaaaagacacttcagtttacaaatgcaaatatcacctctggaaataaacctaaaggacaggaagtcattgaagaagtggcaccatggattgccaggatgatgatgttgcaggagagttatatttaaggagacggcaaataaaaaaatgataataaggacattagatactaatttcaatgttattttgtgttttgtcttatgattattttagtgtttatgcattatttaacatttattaataaattataaatactctggctcaattcattctgttagcttggtttaaacatatataaaatgcccacagctactcctgttattggcatctggtagttctgcatgacattaagacccaaaagtaaaaataaataaatttcttgactgagaaaataattgccaattcaaaatggtctactaaccttaacattcataagaagaagagtatgtatcatcatcctggcaaaatggcacttataatttcataaatgctcctttttaactttatgtattatttttattttgggggtagtaagatgtggaagctgttagatagtcattacttctgttgacatggaatattttataaacatgaaatatttcacaaaaaataaaaaaccagtaataacaggtcacatacacactcaataatctcactatagcaatatttcagaaaaaaatgtatttagggaaaacaatttatgtctgtttgtttttagtggcagtcatgacatgaggaccccagactcaagtgcattgccatttactccctggtagaatgtgatttcatttccaatgagctcaaacataatgattatatgtcttactaattatacaaaacatggtgaagaggtagtgtgctttgtgatgtcacatatcaaaaatgctttcttttaaacatttctatctccttagctaggtttaagagataacaagatgggccactgaagtaactttgtcaagcatgttcaatgtaatatttccccagagattgttttaactgattcgaccaaattagattattgacttgacaataatgaacaagatacccctttgaatttttgtcactacatctttttgtaactcatgaaaaatttcaggccaggcacagtggctcacacctgtaatcgccgtactttaggaggccgaggcgggattattacttgagctcaggatctccagaccagcctggacaacagaccaaaaccctgtctctacaaaaaatacaataattagctgggtgtggtggcgtgcacctctgattggtcccacctactcaggaggctggggtaggaggatcgcttgagcccaggggttcaaggttacagtgagctatgctcctgctgtgctgcgcaatccagcctgggcaaaagagtgagacctgtctcaaagaaaaaaaaaatcagaaatgtttgaacccataaagtagataatgaggacatagtgggagtatgtagaaaagcaataacaggccaggagcagtggctcacgcttgcaatgccagcactttgggaggccaaagctggtggatcacaaggttaggagtttgagaccagcctgaccaacatggtgaaaccctgtctctactaaaaatacaaaaattagctggacgtggtggtgtgcacctgtaatcccagctactcaggagactgaggcaggagaatcgcttaaacccggggagcggaggttgcagtgggcagagattgcgccactgcactccagcctgggtgacagagcgagactttcgtctcaaaaaacaacaaaaaaacccaaaaacaataacatatagcagtgttggccctcaagcagtctggcagcctttttattgctttggatgccgtttgtgtctaagcatttgctttaaatatttgatgtagttaattaatgagtattttggatcttctattatacaaatctgcctatgaaaaataaatgcaaacaaattacaaatttcaaatgatagaagaccaaacggaaatacaacgataatgtcctcaaatgtgcactagtagtttaacagaatataactgccatctgattattaaacagtagaaattgtttaagtagatagttaaaaactgtagtatctaatggttagtattttccaagacagtagcctaagagagtagttcaatatatacggagttccggctgtggaggatggggctggtaaggaaaagcaagaagaggaaataaggctttgctaaagattccttaacttccctataagatgttacagaggcactgattggttttaagcagggaaattatgtggatagttttgaattttttaaaacttactttggtagggccgggcgcggtggctcacgcctgtaatcccagcactttgggaggccgaggagagcggatcacgaggtcaggagatcgagaccatcctggctaacatggtgaaaccccgtctctactaaaaacacacacaaaattagccgggcgtggtggcaggcacctgtaatcccagctatttgggaggctgaggcaggagaatggcgtgaacccaggaggcggagcttgcagtgagccgagatcgcgtcactgcattccagcctgggcgacagagcgagactctgtctcaaaaaaaaaaaaaaaaaaaaaaaaaaaaacttacttcggtagatatgtagaccatggagtgggaagaaattaaaggtgtgatttaggtgtttattgcagtaaaccagatgagaaataaatggtgatagtctgaaactgatgctgtggcagtaaaggatggacatggcagtaaagagatgaatttaagagaggttttttttaaaagtggaaatgatagatcctgtcgactgactgacttaatgctattagataaaataatttttaaattacatgtatttccaaaaagtacaattaatgaatccatggccaggcatggttgctcatacctgtaatctcagcactttgggaggccgaggtgggcgaattgcttgagcccaggagttcaagactagcctgggcaatatagcaacatcccacctgtatttgaaaaaatagtaagtaagtaaataaataaaaatccataagtatttggacacctaaggtaaatttaaaatcttgcagttttgttttcctttgttctttgtaatttttagcttgtttgagtgggggaaagtttgaaatattgggtaaggcaaacatttgaaaacgctcatctgcagaggaaatttgcagtgttgtggatagatcacttgtgtcaatatgtgaagcataacaaatgctttttgattgtgaaagcataggtagatatattgcatttcaggtcaccactaattaattgcattaatttagttaaattggttttctcaactcatctgaaaaagatgaaaactaacacttcaaactacttcctacttggtaacatcataaagacaaatgaactttctttttcagtcatttccctccttcccctgttctgccctctctctctaactaggaagctactacaccagcctttccagctttggttttctaatcttaattatttctgtacccatctatcactggaaattcttcaaacactgatgtgtggatgtttgtgtgtcgggggttgaggggtgagtttggggagtggtgctgtgtgttattgcaaaattatcctttttttgctttatctttaaaaccttttggaaacttgtctaaacttttctttctcttttttttggcagaatcttgctttgtcactcaggctggagtgcagtggcgcgatcttggctcactgcaacctccttgtcccgggcttagctgatcctcccacctcagcctcccaagtagctaggaccagagttgtgtgccaccaatgcccagctaatttttgtatttttttgtggagatgaagtttccggagatgaggtttcacgtgttgcccaggctgctcttgaactcctgggctcaagctccgcctcccaaagtgctgggattacaggagtgacccaccatgccctgcaaacttatctaagctttttttttgttcttcttctttttttttttttttttttttaggttctggcatacatgtgctgaatgtgtaggtttgttacatagatatacatgtgccatggtggattgctgcacttatgaacatgtatgtttattgtttaagcttttttatcctttttatcaattgtatgtttttaaaaatctctgccatgtgcttttgcctctggctaattctatctgcatagacaccataataatctgttaatcacacttaacaagcctttgcatttgatatacctcttacaaacaaccaaacgaacatgcaggcaaaacaaaacagcaacaacaataaacacttcatagtctttcttttgcttgtttctctaggatgactattcttaagacccacacctgacaagaataattctttaatttttcattttcttagaatcaaggtattgtgttttcatgtagagttgtaaatatggtataagcaaagatacttgctctcaaaccaggattttatatatattttcatattttgtggttctatgtatgcatttttggctctaaatatttgttttcataataccattaatgtgtaggacaattactatgtatttttgttgttgttgtcctatccttttcctttcccttcatcttagtattaggataagtatgcaacagtaattttccctttctatgagataaaaacttctacatcttcctaagataatattactgagatagccatttatagatcattatttaaaaagactttttcatagtgcattgacatacactatcccaattgttcctcatatagaagagttttaagttgaagagaaacataatcaatgtcctctagaaagattcctcttgtagtagcatagaaggggaataaaaataaagcaagacagaaggtggggggagtccagttgagacattatgataaaaatccagtatagcagatagagtcataacttagagcagtggaataaataggttgatattattaggctaggtttgtccattcttagcaatcaattagaaaaaggcaggtggataaagaataaagagatggaaatcttaaggtatgtactcagccaactgggtgagtgatggtagcacttaccaggtcaggggaggaaagctgaagagtttgctagtgaacacacaaatagaaatgttcagtagattattgtcatcatcatcatcaccatcactatcatcatcattatcatatttcctcagcactatcatttattaatttgtgaggcttggtactcctagaagctttgcacagatcacagttcacttaatcttttcaacagaccgtggaaaatatacccttttctctagatgcagacctggaaaatggaacttagaaaagttatagaatatatatgttgttgttgtccttttaagctcagtgtacatgtgcaggatatgcaggtttgttacataggcaaacatgtgtcatgggggcttgttgtagcgattatttcatcacccaggtattaagcctagcatctattagttatttttcttgatcctctccctcctcccaccctccagcctccaataggccccagtgtgtgccattcccctctatgtgcccatgtgttctcatcatttagctcccacctctaagtgagaacatgtggtatctgtttttctgtttctgtattaatttgctaaggataatggcctccagctccattcatgtccctgcataagacatgatcttgttctttttttatggctaatgctagaatttttatgactccaaagttcaggttctttcaatatatcagattttaggaactcagaagaattgagagaatagtgtggattggttggaagttactaggaaaatatgatgagcatcagaaagaacacctaaataagggatgccagtggggaaaagctcaaggatggaagccagaggtgcaccatttaaagtgcaaggaggaaaagaggagtcagtgatgggacctaaggaggaattctcactctgtcctttttcaagcaggatacagattccttcttttttttttttttttttttttttttttttgagacggaggtctcacttggtcacgaggctggagtgcagtggcgcaatctcggctcactgcaacctctgtctcctgggttcaagagattctcctgcctcagcctcccgagtagctgggactacaggcgagtgccatcacgtccagctaatttttgttatttctagtagagatgggatttcaccatgttggccaggatggtatcaatctcttgacctcgtgatccgcccgcctcggcctcccaaagtgctgggattacaggcatgagccaccatgcccagccacagattccttcttgtgttcatttgaaatgtgaactctgaacaaaggacagtttatcttggatagtcttattccatgatttatatatcactaaaagagcagagaatctgtagatattataagtgggatccttaataattaatatatggaaagagaagcttaccagataccaggatttttctgcattgcctggaaaaggaggatatctgcaaacttttgtaccctgtgcacttatcagattggacctcagatgggacctctgccccacagaatttctctttaatgactcattgcttactggtctaagaagaaaaataattatagcctcaggttagaaaaattgaaattgaatcatttcacagtcagattaatgctccattagtcccatctatatgaaagggaggagggagtcaccaagtcaggttggaaattccttgggatgattgaatgtaagggagaaaaactgtgataattgacatagtcaaggcaagaacccagttccgaagcaaatattttctttgtgtgaggaaagggtacagtattgctggttcttttttacatataatattactttgtattctcccaatactttatttttttttaaaatggataagaaatcataaccagtagagagagtaaagaaacacaggtctattttctttaatgaatatcatcactcttgagttataactctattatctacagtcttgttaagtgaaaattgtttcctcaataagaacacttttttatagaagttgaagttctcttctggcacacattagaattctccagtattcatatttcagttttattcatggtgtcaaaaggaattgatgtgataaaatttccaataatgcaatgagaatattcacgtttgtgcaaataccatggagatgttgagaagtagagtgaagggacattatgtgaaaagtaacatctcactggactcaccaactctaaatcttacttttttcttcagagatgaggtctcactctgtcactcaggctggggtgcagtggcatgattatggctcactgctactttgaattccagggctcaaaggatcctactgcctcagcctcctgcgtagggagccatcatactcggccatttttttaaaaaaaaatttttctgtagagacaaggtatcaccatgttacccagactgatcttgaacccctggctcaagcagtcctcccacctcagtctctcacagtgctgagattacaggtgtgagccaccatgcctagcttaaatcttgcttcttatatatgcaattattaacaatagaaagctgttttgtattactagattacttggtttttcaaaatttcaacaactctttttgatttttaagaatattggttagaatggaagtattggcataagtcactagttttcaaaaacatacccagcagagttgaaagcgaatgtaaaacgccatggcctgttgattctatcatcgtatagagtatttttctgcttatgtacttttattgttttggtttagagacatgtatgatttattacaccagtattttaaagcacattctccctcttcatttctgcaatgtactgtgtcgaaccaacttcataggtaaaagttgtaaaatattgctaatttcacatggttcagcctaatagaatctcatgcccttttaagccttggagaaggaaagcctctcatattgtctccttccagattcttggctcaatccaagcttctgcatagttggagtggcaaatcccactcctgcatctggtgagctgtgcagttagcagctctgacacttttctacgctgttcaaacaattacagccccaaaatgtgagtgtggccttaaaaaaggctgattccatgtgactaccagattgcttcaagatctgcccagtcatccccctgactgtgtcatcccttaaaaatctgtgtcatctgggtacagaaaattagaagaatgttctcttgatctctgcttaaattttcagaatttttcctttgaaaccacgaactagagaattggaattagacttaatgacttgactctatgtagtatatatttcttttctccaaacactgttttgtatacatgaggagggacaagaaatgaaggaaggggaaaagtatagcgtttcagccccagaaaggtacctttcacaatgtaaatgcagagtatctggttagacatagccattttgcgcacaagcacattcagagatgaagacatgcagtctctaattgtttcgttgtatctaagagggtgaaaatagaggtggcatatgaaaaaaaccttccattttcattgagcgtacccatattctatggcatttcttaccagtcagtaggagttttttttcctactgatcagtactactgaattacccaaaggcaaaaatattccctattgtttctttgttttctaactttgttctctagcttctaggtagatgttaactttttggtatttaaatgtgcacactccctgagaccaaactgcctcagcaagttttacttcaatattaatgggcaagatgaatattgtttgatgtttcactgttagcaaaagggaggagaaagaactagaactaagttcaattgaaccattactatgcagggtctatacagtcatgattattatctcagattccaaattctgtttaccaaaaattatgattatcaaattgttaagatagtaaattttatgtgtatttttaccacaataaaaagttggaaaaaatgatttgactatatccaagtttgcagagttggtaagtagctttttattgcaaaaaacttgctgatttgtgaaagaaccttcatttccaaattaggaataatttcctgcaaggaaagactatgctgtgtgtgtgcctgtgtgctcttgtgtgtgtgtgtgtgtgtgtgtgtgtgtgtgtgtgtgtaactcttctgttgtgaatccatcagtggttttgcattgtttacaggataatgctcagaatccataacaaggtcagtaaactcatctatcatttcctaggcatgtctgttatctgatctctagcctttcttctcccatcgtcgccaagtttagttctacttgacttccttcacttccttcccattgacctagggagcacctctaagactgaaagggaagtcgtgggcttggtggagttgaggtggggaatctatgaacagataaatcagatagaagcattgtttggtagaaagaagagctcatgagtggcagtagagattgagttaaagagtgggatgaaaaagaatcaaaaggaagtagtacgatttggtgaccaatttgttagaagggatgaggggcagtaagtagtcagtgatgaccccgaggtttctagctggacctagaattgtccaactagtccaaaaatgaaaaaatttgcctttaactaagatgagtttgacaaaagatgaagtaaatttgagggtgtaggtaatgaaaacaagttggctttttctcccttgatggcaaatttcagtgtgtatggatgtatacatttgtgtatttgtgtgtttgtcaatacccattgatttttcttaggttatattcaaatactgaagttgtactaattaagcaaccgaagtgtatgctttcagcatggtacctttcacacagcaccaaacatcattatattattttctattgtagcataacaaatcacaacaaaattagcatcttaaaacaatacacatttgttactttacagtttccatgggtcaggagactgcacttgacttagctgggttttctgttcagggtctcaaaaggctttaagaaaggtgttggccaggattggggtctcatttgaggttctggctcctttttccatatcaggtggctgttggcagaatcaatttcttaaccactgtaaaattccttgaagcttgtttcttcaaggtcagcaggagaaagaaactctgacttctgacttctaggccattttttggagagctaatcacttgcttagaccagaccaaccctgaataacctttgattaacttaaagtcaactgattaaggatgctaattacatttgaacaatcctttaactttgccatattccactggttaaaagaaaattacagatgttgaccatctgggaggagatagtgtaagggcctgagctattggagatcatcttagaattctgcccaccacaatcgtgttctatgtttatgcaggtatatgtgtgagtgtgtatttatgtgtgtagttaataacttaaaaaatgaattacatgtatcccaaaacaagcggcaactgcacatcccatgccttcttacttggattagtttttcctgaagttactccagggtcctgtcttcccattgttaggtttcctttctgctgtcctggcttcacctttcgtagccaagaaagcactaaatttggctctgaaatgtacatttcagtacaatctccctgtcttggcagcagtggtgaggctttagcaaatcgtttgtgatcccaaatgagcttcagcagtttggagtgaggccatggcccacatgtttgatgccaccagcctgatttttgtaatgaaaactatatcaataaggtaagtagtcccttcttaggcatgcattcttttccaattttatgtagtggtcagtcattcttacagtgatacaaataaatatttatgctttcatgtcttttaagcttttagcaacgttaaaagaaaaggagtctgtaatgaatgaaattgtcccattgaacttattttttcagcttttgaggatatatcgagtgtacttcttaaaactgaacatgtgcatttgttacatttatatatgtttccacatatcactttgtaaaagaattagagagagcttatgaaatagaatttaagttgatttggtatgagcaaaatatattgttggaatgaagcaaaggaaagaaagcataagagccatcatagttaattctgtttaacttgttttaactctatcaaggttgggccaatgtggcaatttattaaataatttgctctcattaatgcaaaagaagaaatgttccttagggaaaaacatgttgtcttgggtacaaaattccagcaatgttttttaccacatgagactttatggaaaattccagataacagaccttgccctaatggtatgtgggcaacaaatccagaagtatctatcatagcattctttcttataacaaattttattagaagccaaggctagaatgttgaagctggactccgggcaggtgattcaaatgccatactattactttcctagcatggacagttctggttattaactcactcttacataaaacttttagaaccagaggattggagggatgctgacattccttagatatcttaggtaataatcctgaaaattcacttttcctgaagtttttgatagcagatagtaagaaaatttcactttaaaactcactttgaggacctgaaatgttatattccactttgctgattgaggtcaaggactattgtttgaacctcaaacaagcaggtggtgaggttcactttcaactggtaattacgagaaaacgaaccattatgctagatgcaaggccacctcatcttgcatccggtaaacatgccaacaaaaacacaaacaagtgtctgtaatacctttcaacagctccctgttgctctcattataaatatggaaatccttaccatggcattcaggaatctgcatgatctgatgcatgtgtatattgacagcacatcttgtatcattcgtgacatcactctctattatttggctgattttgacctaattcagcacttggaaaccaccatactcactcctgccttggagtttttatgcatactgtttcctctacactgaataatacctccaaaccctaccgtcactgcctattaaccccctacttctcctgtttctcagttcaaatctccctttttctgattatgtgtctctgattctccaaatcttgccagttggccctgttagggactctcagagcttactgtagttttatttcatccatagcagcttatgagatttttttcattaatgtctattagccagatcgtcagctccatgaaggcaggttgcaggcttgtttttctgaccactctatcatcaacccagagcacaataaatgaacataaagtgaattcaataaaaatgtgctgaaaggataaactactgttatttactacattaattacaacttttgttagccccttacaaaagatgctttcttagatgctgcatttcccattctacagaggttgaataatatgactatgatagttttagaggagatgggaaatagtttggtatttcttaaattaaaatatgaatctgttagagctagaattttattttctgaaagataatcttgtttagccagtgtgagaaactacattacacaaagaacattttgctagtattatttcgcaggagaactaaacttggtaaactgtcgttcctagaagattgtttttatcaggcaccgttgccttctttgagctttatgaactcatgttttaggacagttagacattactgatggagttagagaatactagaaagtgaacttcagctaaagaaagtgatcttttttctctaatggcaattcagttgcaaagttctatttttattctaaggggctcatagagggtggtccccaggattctcttaggggtctgtgagaccatacatattttcataataacaccaacatgtcatttgtaattttcactgtacattttctcagcagagttctccagaagctatacaatgtgatgcatattatttcataacagattgaatacggaagcagacatgagaacctagatgtcttccattaggtggcacaaataaaaaacattgtcactcttctcacagttttttggaaaatagttatttttaccgaaaataaatttattatattttttgaaaatgaattagtaaataaatatttataattgtctcagttttaagatggcaaatattccacataaacaagaaatctgtgagtcttcaataatttttaagactataaagagattctgatacccagatatttgagaatcacttctccgagccattttattgacacaattttacttgactttgcaacctgaccgttttagataccttttctttccagtcttttctaaaagatcaattgattaattgggttgactcgatgatacaagcacacgatcttcagtatcaaaagatactcatgaccagtaaacccctctttagttctcaattatccaattccctttcctggaggcaactgctactcttgtatttcctaatggagatcttttatgtgtttactcaaatgctaagacataatatatcatattctgcttcctgcttatcttccctaatgatatagcaaggagattgattcctaactctgcatgcaaatctgccatagtgcttttagcaattgcagtatcgtccatgatctggatgagacataatttcaccagactcctgttggagtctgttggattgtttcccatcctttgtcactacctacagtgtagtgatgactattcttttacttatttgttcatgtaaagtaaatatatctctagaattaatatttggaggtggaattcccaagtcaaaggaaggaaatacatattttttaaaaggattttagtagattgttctgaaaaaaattacaccaaacttaccctcacatgactatttttgctttttctcagtatactttttaatagattgcattataaaattttaatatttaccatttaaataagtgaaagcaatgtctaattgcagttttaattttatttttattaaggaagttaatcttttttttttagctgaagtcgaaaaatatgttcatctctttttcattgaagctcattagtttccaaaaatgtgtcctcatttcatacaaagtatctttgaaccattgccaggtcatagaagtgactcttgaagatcttcttctctgggatcaagggtcacatctcgttctcctggcttcatacccttctctctctacacatctcaattaagtaagcttcctttcttatcctctgaaattataatcatctttaggctcccagatataggtgacctgtgccatctagtctgacttccagtttgcaaattatcttcaaaaagtggaaacagcttttactttctactttataaattcatacgtgctcaggaggacttttattaagattgggacatattgcttagttagtctctagggtggaatcataattaatgaaagaactctgtctgatggaaggcttagtctaacaaatcatcctaaaacttcattagacattgtgtaatccccatggacactgttgaagagacacttgattaggcagatcgtgacaacttcagctttgcccatcatacatcctccagagactcctcaaactcaagacagactttctacaggaaggaatggctgtttctatttcagaatattactgataccagagctttgctgcatcttcatgtactttcctttatttttatttttatttttttacagacaaaatcttgctctgttgcccaggctggagtgcagtggcatcatcatagttcactgtcacctcaaactcctgggctcaagtgatcctcctgccccagccttccggagtgctaggattacaggagtgagccaccacacccagtcttcatgtactttcttatgtaaatttattttgtttgagattttctttgtgatggaataagcaattccttccttaactcatttcccgagacatttttggaatttgcaatatatatgaaaaagcacttattctcagtgatggaaacaccattatttcttttactagaatgtgatcttctggttttaatatttatgtctctgtgccaaggtgaaaatattgtagaaatgaaagtataatgagagagaatccagataataagattttcaataaacaaaaaaagaagtatgtataggagtcctgtctgctgcaaattttaagaatggttttctgtcaacatacagttgtcattgcttactgaaaacttctataaaaaacaagacacaaatgattgagaagatagtagagactgaaactagaactgttgatttaataagctttcttactcatatacttaatccacagtaaattattagcaaattacattttcatagtatttcagaattaaaagatcatagtcagggcttaaaggaatccagttgttttaacagtgctggaggcaaagcgttctagcagcaatcacctgtcagaatgacttaggttggattgtttgcaccacacactttactatagttacatgtctttcatgtccctttgtatctctgactcagtttcctcatcagtggtaatagcagaacttacattttagtgggaggattaaaataatgtacatgaaatcaaatatataagtcagcactcaataaataatagtttgtcatcattattactatagtaaatgaccactatctgaaatgggatataaaaaggaaagtgaaattactaaataaatatgagcgtacaaagacctgacaatttagatacaatatactcactctgtctcaaaatagtgtcttctgaagctttagtcagaatattatggtgacatttctgctagatttgtcattgagttgctgggtttggggaagaacctaggctacacatttctcttggctctacaaaaggctgtggcagtgggtccctgagtaaaccaccagaagaaacctaaggggcacctctgtttttcagttaatcagttttagctcaactgggatttaatcctgaaaatctaaattacatttacagactttaagttattgtgaatatttacactacatgggagaattaccaaaatatattcgttactcatacagttttcgaaaaacaggtgagacatcttccagttaaattcatcttccttttatgtttaatctattgaagaattctaaacattgttttgcaccaaattgctcccttaagttttaagagccacctagtttgggcatcagatgttctcctttatttctgtaaaaatcttgcaaattcactcccagaaagaaatgtagagaatactaggctatttcacagaaaaggcttgctgccctttcctgataacaaggtagttattattcttggctgagcctgtcccagaaagagtcttaggtgacctggtgtgggaattgctaaatctcaggctactcactgagactgtctgctgctgtgctgggcactgcagtcctccagagcaggcctgtcagcatcctaccgtgctctgagtaggtccactggggaacctggtggagtgacatcatgtatcagcctctagcagcaactcctctctgtagccccatgtctttcctgtggtacaaaggaacaagtgctacagggcatgtctgtaatcgttatcccaagggcacgctccacaggcatctaagggtgaaaggtactgccagtctgttgggtttgttatttccatagagctacacaggaaataacaccaccaaaaataacacattcaaactcagagggcaatcttccctaactattcataggcacacgtcaggcattctatacatatacccagctctttgctaagcatagtgaaatgcccttttacattgcaattaattattagccaacattgaataattattggtgagagggtaaagggcaagtgaaataaaaatagagctggtttatttttaggaagacactattttaatgtgttgattaatcagacaggtgtttaaaagcatttgttagagtcaattcacagaaaatctcttttacatgcaggttacagccaaagaaagaaataatagccaacacatttacgatttcaattgcaaaaattgtcatatttttgaacttgtgtgggtatttgaaaatattagctcctactaggtccagttaaagcttttaattctataaggtttcagactaccagctgaccactgctcagcatcccctggactccaagggtttcatctaagacatctaaggagaatgtctacccgcacatcgcactaatgcccatgactgcactgcttgaaccatgaggttattgaacagaaagcaaatccttttctgaagagcctccaagatgtggatatttcagttaatttcagctccctgccagctcagaagaatgatgctgtgctgtgtgctgttcccatgaatactacacgcagggcactgctcagtgactcagccttccagggagccagtcagggttttgaagctgcatcgtccctttcatccttgaagttcttttggatttcatcaatggcatggagggatatttttaaaacaatggagatttttcaggactggcaaaagggctcccctcgtcacagtgccaaaaccatcacaaacataagttatgttaaaaaaaatcctaaactaaaaatatctggtacttagggaactaaaagacatctcatgtttgctatcatttccatcagagctcaggtcaatggacagagatcaataccaaaacaaacatgcatacttagagcataaattcagataaatgctggagaattaacatgtagatagaagtaccatcatgcctaaaacaaaaactcagtccaatggttgtttcagtgaactgactagccttcatagagaaaagtttattcttttcaaactgaagttaaaagatattcggtgcttcattcgaaattttctatttcatgatttttgaagtagtgatttagaactctttaggactatagaaaatcatttttcttctaaaatgttgtcttagtcctaaattagaaaaaaaaatagtaagaaattaacaaaacaaaaagttaatagtattattcacatatataaataatgggccatcatggtatctgattttgataaaaggaaaatatactctgggattatttttccaaattctggcactctatttatgagtacctagacagacactagagtctcatggaatttagtattagaaatgctactttggagtacatttgatgtcattcaagttaaaaaattaaggaagtagattttcaaaataggtagcataaaatgtaaaattattgaatgttggagcaagaagatcatctaatgccctagcagttcttaatgttgcttgggtcatggatcccttaagaacacgataagagtttaccttcttcctccctagaaaatatactgctttttcttttataattaaaacaataatatgaaagttaatcttagtccagaagtcctaatagcccaagaatagaaatgtcaaattcatctcatatcattagtttgtaattttccgttgcccttttaattccaataacacagaagctgtaaaactgcttgtcatctgactttttatttgtcattacccaattgagcttcttatattacagataaggaaattgaggcacagagatattaagaaacttttccgcaggaaaaaaaatctgctagttattgagctgggattcaaattcaggtagctgattctagtgtgcatgtgctaaccacagcacatactgtggctaaccatgcctacactcatgctcaaaactacgctgtgataggtcttattagcatccccattttacagacgtggagattgaggtgtagagtggttaagtgacctggcaaaggtggcaaaactagcatcacagtcagccagtctggttccagaggtaggaactaaaccaacacactgcccttcacatgcctgtgtgtgagttcgcacacccacacaatacatgaatttgtacatatgtatcttagaggtcagggtaagctgaggatacgcatgacaaatgggattagatatgactttttccttctttctttcttagttttctaattattttgttttaagcaagcattattttggaataaaaattataaatattatttttaaaaagcaaacaggttgataacttaaaatgtgttagctggtgaaacgtccagccttatggagtaggcccctgaggtatagaaatggttttgatggcataggatgtagccttgggaatgtcctggaagagtaggagcggccagttaggcattaacactcaggagtaaggagactgcatttgggatgctcagctgattggagggtggtgttgagtggtcccctgggcagtgagaagagaggccaatagcactggcacaggaggacaagcaagttgttctaagtaaactctcaaatgaactgagagataaaaactctaaatttggactgcttcacaatttgcctaaggctggccctactcaggcctttgccagctgttgttttcttttaagcctctgatctgcaggaaaacagtcctgatttcacaaagctttaacagaatttttataaacgcagatttggggctccatatccacaaagttttccatcctttattttgagaatctgcatatttaacaatgatcctccccaaggaactgcaatgcaaatgtccaaatacagtccttggtaatatgtgttttcacagggtgaagtttttgtccaacactgtgagatgagagctgggggaaaaaaaatgaacattaaccatagaacaggaatgcaaattttctgaaaagtagagcgctactcctctcctctctttttctccatataattgaagagacactcaaattgattgttttcccattgtttcgaatggttgctccatgtaattactgaactgaactggtagtttggggggaataggggaaattcagagaatgttgtgtagaagtagaagtctacctatgtcaatgacctattttagcatttttctctattaactggctaacaattcgcttggaaactcctccagctgaggctttgttaggctttgctgaaaataaattaggtgactcattaaattgttgctggagttaaaaaaaattaggcttattgattcttaaatttctgctaaaaatgttgctaaattaaatataggttattgtctttatcaaaacaaataacccacagcttctgtattgctttatctgtattcaaaagtttgggccgggcgcagtggctcatgcctgtaatcccagcactttgggaggctgaggcgggtggatcaccagaggtcaggagttcgaaaccagcctggccaacatggcgaaactccatctctagtaaaaatacaaaaaaaaaaaaaaaattatctaggtgtggtgttcgggtgcctgtaatcccagccacttgggaggctgagtcaggagaatcgcttgaacccgggaggcagaggttgcagtgagccaaggtcgtaccattgcactccagcctgggcaacagagcgagactccatctaaaaaaataaaaaataaaaataattaaaaaaaaaaagttcgaacaacaaggttatgttagcatttatcagaaactaatgataatttatgtggtattaagtagggtagtatcttgaatgagaaagaatactgtagtttggattctttggaggaccttcggtttatattttatttgcaattatgtttatgcttattatttctgcttactttgtgactaaaagccagttaaatgtgattctcagatttcattttcagtgtttttattagaatgtggtcttttaggatttaaacctattttcatcttgcaagtatatattttaaaagtgattcatttaaatattctgctcagcaattagcacaaatgttgtcactaaattattacaatagtagctattaacttcaataagtaaaataacagttccctattgtataatatatttagaaaaaaatcacttagtggggtgcatgtatgtggaacaaggtgaagactacctatctcatcacagaattcctcaattaagaagaaagtgctcttaattacatccaatggcatcattttcatgaagataatcaataacaagtgacttatttcagtgtctcaaattttcaagtttatgcatccatctacttcacagcatccatctccatgggccccaggctgattcttgttatccttgctcaacctatccattctcacagtaaaaagccatgagagccattattttttaggaaatgtgacccattatccccaaatcactgggaaaatcaccttactcgacgggtccttatagctatccctaatatcttgttgatttctcctttaacctttttactatgccaatgaaaatggagcaatgtataactcaataaactccaattcaactgtcaaatatccctttcttcccaaattctgtttaagagtctgtgggcctcttccaactacaatccctgcacacccatccttagcattagccattgtacttttagaggaccaatttgtaaacttgatcatatcaatcttgaaatctaggaacaaagaaccaaactgataagctcttatatccacactcaggagctcatcttccctgattaccttgggctccaagtaccactttcatgagtgcctcacttgtgtagaatctcaccatggtacagctcatcacaccattttattatccagcagtggaaatgtaaattcatatccttttaacactcacaaaaggagtcaatttcagtcaatttttaggaaatttggtgaaaatttagttggttattatcctgttcttcaaaaagcacatcattagacatacttttaaaaaaccagagaataatcttaccttataaagacaaatgacacatgttgctatgagtttaggggagggttactaaccttattatcatgtgaactgtttggaattacctttgaaccctctatacatggatttctgtcggaggcctaagaactccttgtcaggagaaggaaatggtagaaatcagatgaatggtgaagtatgaccattagaaaccaccctctatacacctacactgcctatttttacatcaaacatagcgaactgtcctttaggaagcagaaaaggcagagctgaggaaatgagaggcacctctcatgtctttaagaaaacaactaagtggcaatttctggaaaataggttattgtttgtcaggtattagcctgaaattttgcttgaattgtttctccctaggaaatgaaagatgttcacttcttagttgttttggaaaaacaaatacttactaaagattataatggctatcaatttaaacaaacagatgcttttagtgtctttgtgaataacactagtgaatttgcaagaattattgctttaccaacaaagcataaattcccatgttgcttcagtacttgtgcagtgtttgttctggagcctctattcaatatcaaccagcgtatagtagttcctccgtgagagtctcttgtaaaaacttacattcattcttgttattattttatctgagtgaatatttgacaaagaccaaagaaatccccttgagactggtacccattttctctaatttgaaagatattgactaattttgttagatcccaccatgaaggcaaaaggaaaatatattagctatcactgtggcttaaaacaagaaattatttattatttttaacaaatctgaggggcaactggtgtttggttgatctatgttgaacttatggatagttatgtgagtgtcagatagaatcagacatctatgtgagctggcgcatctccattccacattctctctcatctttcttctgggactgatgagcttgcctgggtgtgttcttctcgtggagatggaagaggtggaagaaaacaagcccaacacaaaagcacattttcaagtctctgtcatgacagttactgacatcccgtgaatgagggcaaagacaagcagtggggcaggtcctcccacccttgatgggagggctcagaatgaatacatagatgcaaggagtagggatttggggccagatgatacatcctaccacagagaggtaggatacagggaaattctaggccctccagtccctttgctccaaataatcaccatagttgagacttgaactatgagagcatcaagtaggaatgccaggtgagcttcagctgctgcccaagtgtctaagaacactcattcacctctcagatactcacatacctatgaaatgcaccaattttatatcatgagccaaagtaaaactcagaatcattgaaatatttgtctttgcatagaaagagtcccatatggaaacaacccagcctacctgcttgacttcctgcctgcctgcatgcctccctactccctccctccctcgctacttccttccttccttccttccttcatctctccttccttccttccattctccctacttcctgactgcctatgtgctttcctccctccccccttccctccccccttccttctttccttccttccttccttcccaccttccttccttctgctctccctcctttcctccatttctccctctctcccttatatttcttcaattcttatcatttgagtatctagttaatgagttctcatttgatgttatagatttttttagctcttcctcacctgtattccttggagtaaattttatgaatcttagaaacagagtctggctgataaatttattggtgcatcaaactcattgagaaatgtcttccagtttcatcttccaaaatgttactagttctaaaggtagtggttgatagttcacacaaaaaaatcaatactgattcagaaataacttgctcatcagggaaataaacctggaaggttttagtcataatttatttataatccctccctttgtgatattcagagatgaaatttgaggtgaaaaaattcaagtattctttttcatatattttgaaaatataagagtctttgatgtattctgggagctagcatcttgaaaagaggaataaaaaatgacttatctggagttaggaaggtgctagtccatcacccataaaccagttaaagagataaaggtgatttatcagaaagtacaacaaaagtgataacaatagaatattattctccataccaagcaagttacaggtatcccctgctctggacaaatgcgtgatgtgtaaacccagattgaccaagggcataagggagatgtagatctgtagctttagcacacatgaccaaggtggtgcacttggtgtaggctctcggctgattgctgactttgcacacttgcggggcatttcatgaatctaaattcgggaataagatttagaagctggcagatgacgaagagattgtttgggcaaccaggactcttgtatgtgacataatcaatgctgaagttagttcatcatcccattccttgtatttccaaatctgtgatgcttagggccttatctagtgccttttaccaagtgggtgggttgtagaaaaaaaaggactaatactcattttctttgaaatataagcttttgaaagaatattttaaaaagaggactaacattttagctttcatgtaaaagtttgaaaaaatgcaatttcagtacttggaaatgagcattttaagactccttgttgacttcccttgtattttaatgcatttctagagagatgtctgcttctgcattgcttccccatgatttacttcagttgaaagttcagccagatccattattttctttctttgacacattatgcaaattaaatgcaaaattcagtgatgagaggaaaaggtctcagagcattgagcagatgccgtgtcggtaatagagtaaggcaattacaaaattacttgcagccactgtgactgtgtattttcccgtattctgaaaagaaatctgtcatgtgctcatcactacgagatttatttttccattgatgtgtgggagatttatgcatttaactgtcgtacacattgatgagagaaacatgcacctacagaaataattttttatagattagtgagatatttaattctgactttcttttccactaaaatgatcctttgtaatagtcttctcttcgcctgtattgtaagtatgaacatcagaatggctcagtaagctggaagagcaaaaccatgtctgtgtgtagaattccaatgccaaaagagaaataccacttatcttccacttctataaataaaggcaatagcaaagtcattaacaagagcaaggggtgaattcaatgatctctaagatttttttccagctaaaaatgatatgattcttatctattactaggaaatagtggtattgaagtagaattatgagctctacattcagtctacttttcacatcggattgtcatctcatttttggagggtaattctctttagattctctagtcctaagctgtaatatgtcttatagttgtcatattttagtgaacaaaccagaaaaaaagattgcctgcatcatatgtaatttttgttcaatccaagggcaatatcgtagaatacttgactcatagtttaaaatgatcatttttattgagttcaaattaagtcttctgtagatataataattatgtgaatcaaaaatatgtatttgtgtgaagaaatgctctttcttttcaggcttgccttcaaaaaaagttagtctcatactgaatggcaataatttcttcttcctgcctcctaagaatacattgaggatataaaattatgagactagaatgctcttatttcaaaaacattcacagtaggcattggcctgagcaataattgtgaatgtttcatatttagagaatgggtagattattaaatatgaactatgaaaatttctacccttctggtttttctgtgggatataatcctctggtcttaaaaattaattttagtaatggattttcacaagttcccttggagagcatgcttggaacatttttgtgacatacactcttgaggttttccttctaaatttcttttcatcactcattttgactttcagatttcttaaatatttgttattacgtgtatctttgtaaataaaagtgaggcttaagaagtttgactttgttttaggatggaaccttgttaaaagtacaagcacacatgtgttgacagcagctagaggaagcgtgatagtgtggaaagaaacagaagtccaaagacctaggggtacatcaagttccattatttaattgtcatctttgtctttgctactgaaagtatggtccacagaccatttgcatcagcattgccagggagctggttagaagggagaatctcaggccccttctagacttactggatcagagcccgcattttggcaacattaccaggaactcatatacacactcaaatttgccaggctctgaactctataatctccagcattctgatttctccaagtccctcctttctcatctttgaaacagagtaatttctacctcacaagtctagtcgagaattaaatacaaacatgtaaagctgctgtgttcggtgcctggcatacatggctgtcccccattcctgccaacacacaccttcaagcaagacaacttgagagaggctgagtgggagagagggtgaataaatgttaataactcacattagagttggcattttttttctttttacttgtctctattatatagggtgactgtattaattgtgcaatacctttgcttttaaataatactactgggataaaagtgagattctaatctcacatattatttcaagataaggttcagatacagagttttaaagaaccacctataaaaatcaaatccacataaattcagaggaaaatatcctcaatgcttatataatattggatgtttagggtgataccctctaagcacaacttcaaaggaagaaatcattagggaaaatactgacatatttgagtacatatatgttttaaaatttaatttacttgaaaaggaatgaagataattaaaaaggaagtcacaaattgaaaaaaattatatgcatagacaaagagttgataaatttaacatagaaacaggttttacaagacaataaaaggataaatgtaatgattttcaatagatataagacattaataggtgggcatgtaaaaaatgtcaagataacatgaaaaaattagttttactactcataaaagacatgcaagtgaaaacaaccaagatgccatctccagtctatcagatttctctaaaaatgagaaagcgctcataaccagtgaaggagaaaaggatctgctttcatcttggttaagatatacattgcaacaatatttatgggaaattctttggctatatctatcactatgaatttatgcatacatttttcacccaataattatacttttgagaagttatcctaaggaattaatctaaaactgaaatgatacatgttcaaaattttcattaaagaaaaccaccaaactgtaccataatgggaactattcataaatatgtaaattatgtccatatgatagaatactaggcacccattaaatcatgttgtaaacaatatttttattgaattttttaattgaaaccaaaaaagagcaagataaactcagtatacatagcatgtcatttttgcaaatgtgtatgcaaatgtgtaacatgtatatttttaagattggaagctggtacactaaaagtgaatgttaattctgggttatgtttttcccaaatttttgcctgtttctgccctgcctctttgattttaacattgagcatacatttatagtttaaagactgttaaaagtggcacttagatatagcttaaaaataattttaatagcacagggaaattattttattaatgctagttaaattagacgaaaatataaaattttaatggcagaaatatttcaatttataacatatgcataggaaactgaaaagagtagttagctctaaatatggggattatggataaattttatattcttcacttttttatttcaaaatttttataattagctttaggatttttataaccagaacaaattacatttaagactcccttctaaacttatttgcttattttcaatctcaaattgtgaatttgtatggcctctatatttccaatctaattttacagacattaaatttctcttgaaattcagtgaaaaattagcagagtcgaagttacacttctgtatggcatttaaattcctcctcccagaatacagccactgttctacagtacagaggagtccttcatatcacgattttcattgtgtctaagaggcatgtgtttccactttgtcattatttggtctaaaaggatttttcttctattttgctgctgtttttgtacaagacatataaagaaaggtgttaagggagtgttaaatataatcaaggtgttaaggagaagagcccagagagagaactcttaatcttttcatctggtccagttgtcaaagtcttttgtctttagccatcacttttttaatcagagacatataatctattaactatgggaacaagaaccacagatttagcctgtgcttatctggaaacctcccctaaaatactactgaacgactctttttttttttattcctgtctctttttctgttgcaaactgattgtccactataacctggagaggggactcaatttttagaaactgtcttatacacctcttaattagttacctattgctgcatatacccaaaatttagcagcttaaaacaataatgaaattttattatgcccacagtttctttaggtctgtagtaatttaagagaaacttagctgggtgattatagctgactctctcatgatattacagtcatatacatcaggactgcattcttctgaatacttgactagagctggaagattcacttccaagatggctccctcacatggctggcacattagtgcctgctgttggggggagacttcaattctttgttgggtggtcttctccatggggcagcttaaggatcttcatggtttgtgggctgtttcacaaagtgtgcgtgatccataggagattaaggtggaagctgcaatgtcttttatgatagagcctcaaaagtcacacaatgtcattcccaacgtatcctttttttcacataggtcagccctacgcaatgtgagagtgaggaagggactacagaaaagaatgaattcccagagatgagtaggatcatattgggtgccatcttggaggctggctaccagtgaagaagactgctttctggccctcagtgatttacttccatctcacatgcaaaacatactccctttattgtggttcccaagagtctcattctattatggcatcagctcgaagtccaagatcttatcatctaagccaggtgtactagttttctttgctgtctaacaaataatttaaaaaatgtagcagcttaagataacacccatttacatgtcacacctctgtaggtcagaagtgtgggcaaagggtagctgggttcttagctcgaggttgaaaccaaggtgttagccatggctgcggtccttatgtggagctgagggttctctttcaagctcatccaggttgttggcagaattcagtcacttgtgactgacagactggtgttcctagagaccacctgccattctgtactgcgtaaccctcttcacaatatggcagtttactccttcaaggccaacagaagaatcttcctactgcttgggttctctgacttcatttgaccctgacctctaaacccagatttaaaggttttatatgattatatctggcccaccagcaaaatagtcctttttattaactcaaagccagctgtttagtaaccttaattatatctgaaaaaaacagaatcaaaggagtggtatctcgtagtattcacagattctatccacacttcagaagtggaaattacacaaggcctgaacatgaggagatgggaatcttagaatctgtctaacataccaggtctatgtgcaaataagatcaatctctgttagtttactcttatggggtaattaattaccccaaaacttagtggcttaaaacaatagcataactaacttctcagtttctatgggtcaagaattcagaagcatctttcttcagtggttatggctttggcactcatatgaagttgcagttaagaagtcagtcagggtgatagaaatataaaggcttgactggggctggaggatgtgcttctaaggtgatttactcacatgatcaagttggtattggctgttgcaggcaggtctcatttcttccgcaaatgaaatgctctccaggctgcatgagtgtcttcataacatggttgctgatttacattggatggagagatcaaagaggatgagaggaaagcagcaatgtgttataggacccaacttcaaaagttacacatcattgcttctgccctattctgttgggcaatcctgatgcaatataggaggcaccatgaatagcaggaggcaaatatcatctgggctttcttgttaacctcagttaacaacaacaaaacaaatatttaaaaaactaaaggaaagagatttctggaatatttccattctctgtcatgcccactgccatagtctactcaagttctcatctcctattggacctctgcggtagctttataagtcctgtccttgtttccaatgtcatccctttcaaaacgcttcaaatagcctccttaaagccatgactcctcccacggttataaccctgcaggtaaaggcacttgaggacataatctgtaccatctctggcgtcatccctttcattccccttcacctcccccaactatttttgtatttcagtcatgctggacctcttaatgtttccccaaaacatcctaagcaatttcacgtctctatgccttttcttttcctgttctctttgcctgaaataagaacgacagataatagtgactatgcaagtcctaaaatcgaggcagccacagtgctaaatcacacattggatagttcaattttattcttataacaaccctttgtggtaaatcttattaccatgctcattttacaaatgggcactcctaacccgatgtgcataatgattaaaaacatagactcaagaaaagtttggaggttctggcgtaaccctctttgttattctctatgcaactagcttaaaaataacaactttgattattctaatctattaaccagttttcagtgtgtctgaccaaatcagttgaattttatttttttaaatatgtgtgtgtgtgcatgtgtcagtatgtacgtgttaaagagtagagggaggaagttgaaaatctgacatttgatttatttctcctgggacaaaggaagtttggatatgtcaaactgctggctaatcaacacgttaatcaatgcaaatctctagtatggatatagttatattttgcccccctcttcctttccaaacttctttccagtctcatgaccagcttattggcttcatattaccaagtaaatatatcaactgcccatatgtatagtacccagacaatgagaacactgcctaaatattgtgttttcaatactacttgcttttagcaacaaatcatagcacccagcctaactttaaaaattccatgtcatccaacttcaaactataacaaaaattgagttttacagaagagtttcaaaacatttttatgcattagacacttcagaaattatctcttaaaaacaaaacaaaataaataagggacaaaaacaatagaaaacgtcaggcaccaaactgtgaactctcttttgtccatgtatgatttaaaaaaaaaaaactcactgatggtaatttaagaaatttgacctttaggaaaatcaggctgaggctcatctttgtactttttaaaacaagtcaataaaacatataaataatagagatgagtgcagctcacaggggacactcatattttctaggagcctgtggatataaacaatgaatttcatgaacacagagcacatttctacatgatctccttttctttacaagttatttatgttttactggaaatattaaaacttcatgtctctttgttgctcttgtttctttaaatttttatttttatcatcagtcattgttcaataactcaaaatcatataaaataaaacagtttcaacatcattccgtactcaagatgatctctattaaataatgatttttttcttgaaaaagcattctataattttttttagttttccagatgactatttaaaccaaatgtttaaatgaatgattaatgagtcttttatcttatttatcccacctgcctactgcaaaaagacatgaatttaatacattttagattttaaacagttgtatatctgtaaaaaaacaatttttacaggtttcatattctggacactagaaaacacttcctcctcacagcgccgagttgtatgaaaaggcagctcaattgtctttccttgagcagccttgtgtgcctgggtattcccttccatctctcacccatggagttcatattcctgttgtcatgtcaccacctcagtcaacgaaataggttctgccatttctcaaattttatggagaattatcctgatgagttaaggcagaggttgaaaacttgcagcccttaccccggttacggattttatttttaaaacccagtgtttttgaacactttacagctgatatttctattctaatggatgcattatcttcttttaaaaatacttcctatattagccctcttaaggggtatgaagtggtgtctcattgtagttttgatgtgctttactcactcttaataccgttattataggttatttattgttaaaactgtgatatattttcctttattttctacatatacatagatacatgcagtttgataatctgcatttaatcgcattagaaaggtattttgctatgtcattaaaatttttttgtgaacatcatttttagtggctgcaaaaacttacataaagacagacatgtcctaatatatgtgtgtgtatattttaactaaatattggcacaccaaaaataatggatttaatgcaactagcaatgataatgctcaaacaacaggagtgctatgaagacaatgaaacaggtgagttgtcagaacaccttctgtcattacattaacttttttaagcactaaattcacttgaaattacaataaacaagataagtacaagcattagataatttgacctatcagatatcccaaaggcataaactatcactagagggtcttttctttatgcaattaggtgaccagtgactcttattttttaaagcttttaaaataaaaaaatagctttagggataaaaccagccagatttttatcgtcaaaaacatgttcacagttcagctaagccttgctttcttttgaagaattgctctttataatgctcaccaatggatttagaaatatcccattgtaatcatgaagatctcaattatatgttatgaaataagaaacataatgaaatacttgaaccttcctgccccgcatagcagatatatttttgtatttatgatattcacagtaaaaaagctgtgctgagaagctcaaaatagtatttgatcttagtggttttggagcagaggaattggcattgccatgatttttctataacttggcgcaggccaatggtttcaggcaggactttcagagcagacttctgtcaaatttgccatatggagttactgggctcagattatagaggttttcctggttgtttgcctaatttgggaattatcagtgctctccaggattttctccaaaaacaaagaacatgttcagaagaaactgacacttcaggaagaaaagtagtttgatatttgagaggtttagatggtttctaatatttctaaaaggtaccatgactcgtgaagaatttgactggtaaaaaagaaaggttcctgttatccctggaacacagctaacagtctggcatgtagccttacctgaactggtaccctccccgtacacctcacacttagcattctgcacagccaaagaccctgtcagttattggccagcctgaagaatgaggttgaattcaactcagggactgaaatctactttatagcattttaaaatattgtagatccaaccttgagttgacctactccgcaggttcatgggtgattaggtgtgagatacaatgggaatgaatatctgaaaaccctttgcagaagagaaggaggaggaggaagaataaatccaatttttacaggtttcatattctggacactagaaaacacttcctcctcacagcgccgagttgtatgaaaaggcagctcaattgtctttccttgagcagccttgtgtgcctgggtattcccttccatctctcacccatggagttcatattcctgttctcatgtcaccacctctgtcaacgaaataggctctgccatttctcaaattttatggagaattatcctgatgagttaaggcagaggttgaaaactcgcagcccttgctccaattacagattttatttttaaaacccagtgttttttaaaaaatcgagggagtttacacaaaaattcatgttttctgtttctctagaaaacagcaaatctggcaacaccctgctcacattcccacctaccaagaatgctgcacattaaatggtggcttttctttaggtgactctaattcactggggtctccatgtgacgtttcagcctttgcaccctacttgtccgctgcaggcccaggagctctctactcctcatatgcattacaggaccccatgcacattgaagatgttttctcaggcagagcagacaccaggcaaatatcttctggtcttaggagcaagtcttctgagaatcaatgatgacaaatatcttaaatggtctactcgatggttctgaaaatgtaagagctaaactacctgtatcaaaatcatcttgggggcttatttaaaacatatatgataaggccccacctcaaacctaaggagtcagaatttctacggaaaggcttgggaataggaacattaacacaagcatcccgggtggtttttatgaaacaaagcttgagaattattgaattcttctccgatctgacagctcttctcctgggcagacccaattagagggaactgatgagttttaggaaatactgtaattctaactcatcagtccagcagtgctgaaaatgcagaattttgtccttatcaaaagccaattaatgctaaccttttcagtgtgtgtccagtaccaccatcggtaaggtaaataaacaggcagttttgcatataatctagtgatttttaatttagttttttcccttactcatcctaaaaaaagcagggagtcattgggcttttgtatctattttagctgagttattattttaacccctatctttagtgcagaattaaaatatcacccttctatttgcttttattcctaatatctgaatggtttcagcttgacgcaattagcatgtagagcatgctcacctactgtaatctcccagatgagtcactcagctccagcacataactgcttctgggatcctgttggctaaccaggctttgaaacccagggaaaagaactgtgtgttttcttcagaagtaatccataaatgagaaattaccataaataggcagttttattcactctaagtgatttttacataaaaactgacaaggccgtaaattgtatatagaatcaggttccatatccacacagctaatgcacacatgaattattcgatgaaatttgcttcagtagtattatctgaaattggtttcagacaatacattaaatgttacacattatggtaaatttactgtatttttgttccagccacgtcttgtgttggcaaatctgctaaatttaagtttgcattgtattcacatgtgttgctatttcctgagatgtcccaatatattttagccatcaaacaaatagaacttcacctctctgaggctcagtatccacacttgtttatcatgcaagagacatgcaggtgagaaaataggcaactgccattctatctgtgattgctgttcatggaagaagtaaaaatgagctgggacaatatataggtggcgccagggatggctccttgaaggaagtgatctcacagctcagacctgaaagctgagtggaagttaccagaggaaaagagaaagggaatgcattggttttctattgctgggtcagaaactaccactaactcagtggcttaaagcaccattcattatctcatgttttccctgggtcaggagtcaggtgcgtatcagagtctcaagaggctgacatcaggtgtttgcagatggcattcatgtctggggctcagggtcctctttcaagctccttcaagttgttggcagaatttagttgctgtggttttaggaccgaagttcccactttcttgctgatcaccagcctggggcagctctcagccccttgaggccacctgcagttcctcatcctttggcagatcctctcacaacgtggccacttacttcaagaccagcaagagaatgttcctcttcaggaagggcccaactcctccttatggatgttcttctgattcagtcaggcccacccaaaataattgccatttttggttaactcaaaaatcaactgatttgagatccttaattacatcagcaaaatccctccaccttctccatacataataacctaatcatgggagtgactgttcatcctgttcgtgattaggctcacatataagagaaggagatcatataggacatgcatgtagaggatagaatcttgggggccatcttaaaattgtgcctaccacaaggaaggattttccaggcaggaagaaccagatatatgaaggaggcctaaatgacaggatagcaatttccagtgtctgaggctaaggctggaatgctgacctggccagatcatgcactgctaggtttaatggcctatgcatactctattatgcaattattaaaatacctgtttacaaagaatatttgaaatattaaaaaatggaaaactgcataccgtaaaatattaaatgggaaaatcaggatatgtgtttatataacatagtatcagttttggaaatatatatgcatatcttaaaagactagaagtaaatacatccatctgttagccatggatatctctgggtgagaaagtatggatgagttagagattctttgtcccttttcttagttctaaaatttgccacaataaatatgtattctcttataataataattaattaaaaaactattcatggtacttgcaaaaacaaatgaatttgagcagtctctttgaaggaatcaaattttgtactccaggtgtttgagaggttgaaaaacaagctcaggaattagctgcgcatgatctgtacaaacaaggggatcagtcagtggaaatgaagtccagcttcagccaagggtggtgagtataacagacctactctgatatgtttcatcactaaacattgagcaagaaatctagtgtttaaattatggaggcattaaagcaattaacctccctctacctcaattttcttatatctaaaaattgaggggagcaaaattccattcttgtcacaggtctcaattgcaagtagcatgcaagcaagtaggctgaactcttgtctgtcaatctagctccttcctggatggggtatttaatcagctctccttcccaagcacccagtggacttgaagctcacagttagacagagatggctagaggtgccaagtgctgtttatcataggtgacatcacctgtgtgctcagagttataaacataggcagcttgcctactgccaaatccattacaactttcagaggtgttcacttaggaagaggaggaaagagttttttgagaaccagatgggaacttagaaataagtaacattgacaaccaaatccttcagacacatcttcaagtttcaagagagcagttaacaaaaaagaaaaatgtatttttagaaattgtttgggaggtgaaaggatttttctgggggggagtagggtagggaatggatagagatgatttttttttggctctgcaatatctcagagatctttgagttgaaatataacaaaatgtatttcctctctcttgctccaaaaactgaaaagcaagtgcactagaaaatgtcagagttggccactgaacagaccatatttctaattcatggcaagatggctaaaataaaaattcttgaaatacgtattttaaaattagattttgacctttgatagggcttatcatgctatttatattgtagcagaaggaactgattttttagtagttgcctcatcaaagacatgactcacatttccttaagcatttacaccatatgtttcctgaggtaaaaaaataaataaataaattttatattttttatacaattagtgaaatgtgagcaaaaaatataagaaatcatttaaaaaatattttggggaggatgtggtctagaaatgttgttttctagaaattgaaattatgttagctatttggccagtgtagccattaggtacatttatgaatatagatgagaagtaatcattgtgatgctagttttatcattaaggaaaaaagcagaattcaaaagtttagcaatgaaacacaggtactactgaaactcactttatatttgaaaatgtgaatgtgagtttaaaaaagcttttgttagactaactgaaaagaatcattttaacatttaaaaagaaaaatattattttaagtgacatttggtgacattattatatgtgtacaagctgtgactataagataatgagacaaattattatgtggccagtggaaattaaatttatctttatgattactagcaacagggactattttattcaactatctttacataatacaaaattattgtaaaatttctaggaaattcatattccacttaaaatatgaggaagtacatttggaaaaaatattaacatatgaaaatcagcatcccagttaaggaatccccagtttcccacttggtgctcaaatcacttcacgttttatttcattggtactttttctagggcagtagatttaggaatagaaaacagactctacacatggaatacactaaagtcttgaggaggtgtgatatttccctaagtttggataggtggtatcatcctttcagtcactcttgactctgcattagactctctacctaatgatccccaagtcatttcacttctgccttcttaacattttgaagatgtcctctaaaatttcaagtcccaccatctctgcctccgaactcacctccctgactttcagtcttgaagcaccttaacaacccctcccctcctgtgcatgttccacctggaaaccagggtgatcactctgaaatgccaatctgatcagtcatttccctacttttgaaccttcaataacttcctagcacctattcctagaaaccattccaacatatcacctaggcaaaggaaacccttttcttacctggctcctacttatccctccagattcaccttttgacacctcccacttcatctctctgcagcccccttcctgcacacacacggagtttcagtcttgccaaactcttcgcagcttcttgagtggaccttgctctctgcactacaatctctttctgcctagagagtcctttacctcccccaatctggttaacttctactgtttatttaagtcttaactctaagtagatgtcatttttgaggatgctctctctgttcccactttggaacttgggcttctctgttgtcctggtgtcccgtgtattcctctgtcatagccctcatctcattgaattgtaatcatgtcttcactagtgtttcctttctagcatgatagatttttgtattgccagtgaccccaacaaattccccaggtcctagccctgtgactggaacacagtaggcatttaataatagttgacaaatgagttagtatatgtaatgaaaaatctacctgcctgagcattaggaaatataaaattaatctaaactttgccactttctgtaatatctgtgtgtcagtcaggaatgcttttggctgcaagaaaaccccactgacagtcttttaaaacaaataaggaagtctaaaaggagtcagatgctggccttggttcaatacaatgttagaggcagcatctcagtgcttctctaatggtcacaaaatgactacagtaactccttccctcacatccacttccagttcaagaagcagaatgagagacagcaatagccaccctgtttcttcatcaagaaagcaaagatatcttagaagtccccactgtccttcatttacttctcatgggctagaattatctcagtggccaccccaagtgcaagagaaactagggaaattagtttttagcattcccacactctatgttgaaaatgagtaagagacaataatttggggaataggtgtgggattagtcagccaacagtgtttgctacaccttgggacaaaacattttacctctcttactctttgattctttcattgagtgaagaattagaataagtaatctttcttcaagaatcaattttctctcatctataactcccatatattcttatttccaaaatggaattaccttctacaccagacagttacttcaagcttttcccctgaatatttcacatttccagaaagcactatattacaaagaagcccttccttttcaagaactctatttgccataatgttctccctaacaagggctgaacagtacgtgcccagattccctgcctctgacctcaccacaccctcttctgtgtggcggtctctcaaattgtttaggacaattatcatgacttctctaaatctccctttttccaggctcaaattccctatgcttcagtagtttttcagataagccccttctgtcccttcacaaccctggtcagccaacaccagacatactctcttcatttacttatgattcattgaacagataatcactgagttcctgccatgtgtcagcactgctctaggagctggtgatatggtgagaaacaaggaagggaaggcccctcctctcatgaggcttacagaggagcaaaggaatcagatgataagataagcgttacacacacacacacacacagaggatcatttcagagagtgattcgtgccaagatgaaaatgacaaagggagataggagagtgacaagggatgtgtgtgtgtgtgtgtgtgtgtgtgtgtgtggcagtgcacgtgtgaaactagaagacaagccttcagatgatcagggaggtttctctaagacctgaatggggataattaactagcatggaagaggaagaggttttgaagcaggaggactttgtaagtgaaaggccctgggtagaatgagctagacctgagccaggaaaaaaaagatgctcagagggggaaagtgttggaagatggcctgataatgcacatggggagccccccaccacaagctcatgtaggacaggacaagaactcagattgtattctaaatgacagtatttcaatacccatcttaaaatgtgtctggacaaaacttaacacttagctacacatatagcctgactggagcagtccagtttataacctctccttgtagtgggcactgtatttctatggatgcaagctacagttatatgacttttgtggaagccatgctatccccacagttccactgtgatttcctatatgctctttgatgcacactgctcacatgcatgaatattacttgcacaaagagagagagtaggtggatgtgatgccaggagctattagaatgattcacattacacttccaccatatgaaaaataatgtacagtctaaagcaacactgcatcatatcatcgagcagcttgggaaagcctaaattacatatttgaagttcagtcagtcattgaaattagataatctggatggtcctgaaagtgtctttcttgagagctttcctccaaaagcaaaattgaatggtaaggaaaaaaatgaagtacaacaaaaatgacagcaaaaaacctgaaaaacaaaaaacaaaaaacaaacaaacaaaaaaccccaaaaactgagtaatatcaaccaggcaggagttgaaggagagaagcccaactgttggtagataacttgggatgagccaattaaatattggtcttctctctctcagaggccctaattgcattccctccagcagccacaggcctggggttttccccaggcctgtggcattcagacatcagagctgagaactccagtgaccaccaggctgcattttaatgctaagctgggagcactgatactctccaagacagccttgcaagctccatcttccactgactcaacgttcagtggaacgttcagtgtgtttcatctgctgttcagtcatgcaggcagcagggatcctgagggctctcctccccaatatggtaccaagttttgattcatccttttcctcttccctatcagcaggtattctagaagacagttttatgatgacattcacagctagcattaaaaccagataaaaataaaacaggatgtcaataaagaactaatgatgtgtgtctgtgtaaatgtataataataataaaaagaatagacatctgtttgtcaaggtaccatttaaggccttggggctttaaatgaaactgctttataaatgcaccaacatatgtgactgtttgcctacgtctttcatccatgaaaattgccctgtagacagttgcctttgaggtgaaaagcattctataggcactaaatattatgctagaacacctctaagtgctaatctaactaccttcatgacggaagtttcaggagaacaatttaagggtcatggaaaaaaagtgttaaacgagttggtaatctgacatttcctaaaaactagattcaaaaccgaagggaaagtagagagaggaatcaaaactagcctagtaggatggaagtaggcctccctccttggaggtgtgaaaatgcctggaataatttaggcaagaatgccaactgtcagtgatgaccttggtttaggggcagttatagcatggtggaaacacccctggactggagatccggcatcccttatggggatatgaaagaaatttggcaggtctcttaacctctttgacattcctttcttctttgttaggtaagaagctggtgctggttcagtgtaatttgaactgtgttctgcatgactgtagggttctgcttagtgccacgtggaggtggggatgccttgggtgaagatgaaggaggtgtagtaagcaggtggggctctgcactctttttactctccttcttccagtatcatcagaacaactccacttttttgtctttatacactgagttatttataaaatcctagtttttttaagtgtcaaacaatgcttgattatgaaatgatagcattattctagcattctaactaaagtgtgtaaattataaacaactatctttaatggtcaacaaattgtcatcattactgagcagtgttgttagtaacaccaagtaatacaattaatgaaatccttgaaagtagaacctatcagtgagccatgcatacaactgataagctgtggataatgtatagaagaatgagttcatttggtaattatttgtacttttcaaaatattggtgaactttcatctttaaggagcaatggtgtcctagttattcttgccacaactgcatggaaactctcgaatctgttagtatgtccttgggcacaaaaacagtattttttggaactgctcaaaaattatgtagttttgtagacatttagggaaaaatctcataatttatgttaaacactcagttgtcttggtgttgattgaaagcaaataatacgtgcttaacatcctgctagttgctgagggagattcattcatcattttagaaaatgtttctgggcatcagtcatataataaacactttcccagcacttggcttcacaaaggaacaaaacagacaatgcacattcctgccctagtggagcatatattctagatgacagactgaacacctagacatatatgacaagctctttcttgcaaggagagtccagttaggaaaatgtcaacacctaaaacagttaaaggctaagatagcttctgtggacactaagtgctacatagtagttccagaggaggcagagagttagacctggctagacactggacagggggtagaattagacagatagttcctggcttggtgcctggtacatagtagttgctcaataaatatgtgttgaataaatgaaaaaccaggactgactgaatagacagtttacacatttacataataagtgtgtaatttagggaagtggggttagaatgagcctgggtgaaggaagccttgaatgagagatggagaactgtaaacgataaaggttttgaagttggggaaaggtgagggggaagtgaagtgtaacatggagaagcaaaagtgtgaatattttccaagatgcctcgacgttatgatagatgaacctctgagacagaatgtagggggaagatagaggaaagagccaaagagcctctgagggtgcaaagaagtaaagaaaaaccaggatgtatgatgagaattttattatggagctatccagtgtggatgtgacttctcttccccatatcgacacaaaacacttagcaaaacatttctctttctctctctcatgctctcctgttctttctccctctatctctatctccttttgctctatctctagatatctattagacagatgatagatagacagatacatagatagataggtagatagatagataggtagatagatgatagatagatagatagatagatagatagatagatagatacatcttggaagtggtaagacagaaaaagtagtgagtatagcctcaaaatggctgcagggcaaggtaagaagctgagctcagccttcaatccaatccctgtttacactctgcctatttatttgtttataatatactctgactccccatcgacatatttacattcttggtagaagagattatttttgatatctctttgtatttatttcttagcaccaagataattttaaccactattttattattgtaaattctattgtttttactccaaagaaatacatatttgttgaagaaaaattagagatacagataagttaggaaaataataatatcagaaaacagggccatcatttaaaacatggttacataaataataaagtactgtgctaagtattgtaatgatgctgatgcttttgtaataatgatactgatggtgaagatggtgatggtgatgatgatgacaatgatgaacacatacctcccactgattatgtgtaaggcactgttctaaacctttgtctaaattaatgcatgaagtcttcacaacagcctcaatagatgttattcttcctccctcctatttattttattttagcatattttatagatgaggtatctgaaacagagataagcaacctggcctgagtcatacaacacaaagtgatggaggtaggaaatgacccagacggtcaggctccagttttttgggcactaccaaattatattaataatacaactctgtagcagcctgctttcgagttatggaatagtttctagaataagtcacacacatagatttcgagcccaggaccatctactctgagcagaagctcctacctaaccttgactataaactgactctaccagataatcacacttggcctttctgtaagtgataagcaacttgcctctgtgggcacctaccctgagaaaggtagtcaccctgctccatgctctgtttcaagtacatttattattatttatgaattacttattaacataaatttattattatttacgtattatccaacttattaagtgatgtatatgtatgcaggtgtgtatgattatgaaatacaagatgaaagaactgtaagaaaatagctttgaaaaaattagtaatgactgggccatagcccagtgataaggcatgttcacatataccatttcctttcatgatggtaacagcccagcaaggtaactgtcatcagggctgtcatgtattctagtactgtttgtgtactgaataaaggcatttgcctgagggatgatagggctcaaatccaggctgcactcctcttgatgatctatgaacccaagaagatgagtctacctggagggaaaggcttttccaatatgcacaaagttccacagaagctagagttgtcttgggaatgattatctccattttgtaaataaggaaattaaagatcagaaagattgagtaatttctcaagaatatgtatccagcaaataacaaatcaaggactcaaacctaggccaatatggctctcacttcctttctccaaaatcactgctatgtctttcaactaaattgcattgctctgttcactggtacaaagcttgttgcaccatttaaaattcaaggactatctgattgtgtattatatttttagatcctttcctgaaagcaggttttaatggggagggagaaagtagcaactggaagagagttttgagatggtagatggtaaaatgtgcaagcaaattcccaaaaaatctggggacacagacttcactgccttcagaataattgaaaggagaacccttcaagtatgaagcttcagctgaaatttcaacgtggtttatttacctaatatgctgttcattaattacaagctattagtgactattagcctatgaaattgtatttacagttcagaaatgtatttgattttcacaagccttactggggaacaatgctcagtcaacactttcttcgcctaaagagtacgatcaaagagcatgaagcgtagtaaatgtttagcctttgaatttggagtttacaaaggataattatccacgggttggtgaattcatgttcctctctactccacacagcctctggtttgcatttacagttttgcacaatcagatgtaaaattaaaatataatcattccattttaaatggttccctgtacaattatctcattttaaatcttttgctaatgtggttattctaatgcaactatgatcattattttatgtatgtaaagatgtcaatactgtccagctgatgatattatctaatagtatgtagcaaagcatgttcccttcctacagtgcctcactctttcgatgggtaagatgggaggtgggagtggggggagcatggcattagctgtggataataaagcaaagtaagtacaataggtgttcaataaagtcatcatttttggtacttacgatgtagttttcttgttcctttggttccttttgcagtgggtgtatttgcttagacagagagaagtggcagagggagactgcatttgtatttggttatttcagagaaatgcaacttggtattatgagcctttaattctgtagggcagtctccagatcattttgatgctgaactttgtcataaaaaactattgatttttttcttccaattataaacatttgctggtttcttgtcagttaataactgacataacattatttcagacctttcacttagggctctgttgtgtgtttctcttgatcaaaattattgccttagcatatcaactgaatacacaagagaaaaatcaagttatctatgtttatcatatgcatttttgaatacctatatgtgatgcttgagcatagtggtttttataatcctgtaagcgatttttcaggagaccagatctgacctcctctctcacacccctttcacactgcctgcaacacaccacacataccacacacatcaccaccctgaccgaccaatggaatctgagccaactataaatctcaaacttgttgatattggataatgcctggaggagaaacacggctaccgttcagtaattccagaaagaatttcttctttaaactcagtaaacccaatggcttctcagaaagttctttctgagttttcttatttgaaatttgaaaattatttgaaattgacttaactgacatcacctgttcccctctggatctcccagtgatttactgttgactctttcaaatccactcatctcagggctgggggactgagtcacagtctgctttttcctccattgtcatttccaaatttttcttccctctccttgctgggggctggtgctaagttgaccccatttttccctccttgtgctgtcactcactgcctttccagaatcttctgcatcaggtcagtcactctttccaacttaattccatatgtcaacccattcatcaccggagccacgtggtttccttcacacaaattgtcttctctgcaccacagatgccagtacactctggcccttgccatctgtccttaagatgcaacaccggtctgcttccaaaatccctagttcagacagcctgccttccagttgccacatcctgtttgtttcccagtttaactatgtcactgccactgctgcttctacttgtcagaccttcactgacctctccatttcccccatccctccatttcatccttacgttccttccggcccccatctctgcttcaacgaatgaacccgttttcatctgtttttccatgttgggattctagtcagatttccttgaaattaaagctttttctagtataaacactcagcctgtctctctcactttaaaagtgaagacatagacacacagagaagtgagatgatctttgtccaatattgattagtggtggaagtcccttgatagccaatccatatttctttcacagtaatagaaagtaccaaactttaaaaatgagattagaagttgcctttacataaatgtttaggcttttgagatctcagggctattttgtaatactctaattttaggaatcattgttacaatgtttcaaatctactgacttacacatatatatcctacatatattgtctaaacatattctgtagaagcaatggggattcatgattatgaaaaaagtggccattgctggtttaggcagtgtgtaaatgttgctactgacatcctaatgtgattttaattcttgcagtctggtgtcataaaatagctttcaaaaaagagcattttgatcacgactcattttccaatttctctcctccatgatcccaacatcttcctaagaaatccactctgtacctgagtttccacatggaacttaggacaatgatgttagtgaattagaggtctggcagaatcaaacgaaagtaatcctcaccaagtcactaaaccacactactttgagtctatgcaagttcaggaatttctatttgagcaaaagccacaaatggccagagcggacctcaggctttgtgcttgaactgcctaatgccatttgatttttcgatcccgcacttttccttgccagaccaatggtcttttctagcagtaaaatttcagaataggtaggctaccatcactctttgggttaccccagtgtttacttaagttgaaattcaaatagatatgtatttctatatgaatggctgccattctgctatgcccatgtttctgtttctcactcatctctggcttgtctcgtagagccctttctggtgctgacttatgttgctgagtcaaaggctttcatagtcaaagctcttctttttatctgatatgttttgcagtttgctgtactgcgtcaactctactgggatcatatttctcttgagactaactactaggcaacctgtgccttcttcctgcactgcattttgcaagtgcttcttaggatttcactttcatttaaaggcagtagatagctcagagaatgtggaacagtaactagaacagatccaagagctgtagaatcaaagaagagttaactactgtctctgaaacttagaatgtaaccaaagtcaagctatgcaacctcactaagcctgttttcccatatttaaaagtggattgtaatgtttatgagtctaccactacatcagattggtgcagtgattacaggagacagcgcatgtaaaactcctggcatggagcctgatgcatttgaaacatttactacaaactaccattgttgttatcattattaaaaataacccattctttcaaagaatcttgttcttggccaccaagcttggaagtcagtgatattgttcatcttatttgcccggtttttttttttttttttttttgagaataatttatgacctctgtggcagcaagtctggcctcatcttgaccattctatctgcatgtactaacttttcaattttaatggccctgtgagctttcctcccataagccaaaaagtgctgtttttctattctagtgttttcttgtcaggcaacaataatttctaaataacatgcctcttctaaaccaatctcttaaaaaatagattgtttttgtttctgaccctttctcattccatttcagaaactattttttctccttctttaagcaggttacaaacccttatatttttaatatgctgaggcttgtagtcaaaccattactgtcccaaaagaaaagcccttttagcacatttacagcttcttgctatctgtgccctaactaaattgtgctacagggatagtttcttaaccattaaaatgataggtgaacacaattttattttgaaggattactaagctatttttaaaatttctatagttagaaaagaaaaactgtttaactgaaacttgaacccaattaaaataacaattctcatggctctccgttttgcaatactttcctattcataaaataagaatgtgcactttacctttttgacccatatatttgatgtttttcaattctctacacgttctttatctctctgtcagtgtggaatattctgatttgttaattaatacccaaagcagcagttggctattaatgaaatgtacagaaaggtatttggtaaaggctacatgaagatgatgatgacaataacaaagatatctgattgaaagtaatctttacctgttaatcttcccttaatgtctccgactacaatggcagacgttgctttcttggatgatgactgaaagattagtttggaatgaataaatttatttttccatggttgattcatagatttttttagaaattactaattttgaaaattaaaccttctttttcagccttttgagttttatgtttctatagtttaggcttaaaaataatgtagacattagaaaaaaactcaagcggtattaatccttatatccctaatggtaaagagcgaggcagctaacaaatgaggtgctggaacactagcaagggagcctgtctctcttctggtccttttgttgtccaattacaggtgaaaagatgctatctgtcagcttgtcattaactcaaatacacaaaggcctgtcagttctcttatgcacttgccaatgtgagcacatcccatattgatgtttctactaaggcttgctgtacttgtaaacagtgtacttgtctggtaactaaatagggacaagcatgcagtaacagtgtgacactgagcatttcagttatatgtcttcttacctcagaattttaagaagaaacaatgctaaaggagattttttttaaaattaaaaacaaaaactacctttccagggtattttaaagaaagaaggtgaattccaattgcacatacatccggtatgtgtgacgccaggtttatccatggcctctctcgccctactgctttttaagtaatatgggaaatgcaaataacaaataaaaacctacttaaatagactagtaaaaaattgagcaataagggatcattgtataattagattagaatagtgattttgcaaagggttttaaaatgccttaacataggcactgacaaaatgtttgtaggtcttactaatgaatttttatgttttttcaatggaatgtgcattagaatgaggccattagttctttgtggttaaccaaaatctcaagatttcttgtaatgagagtaacttttctttctgggatccctgacaaaccggaagagagtgctgctgaaatgtgggaaaaacagctgtgttataacaggagctgccagccccccacacagctggctgcagagataattaattgtgaagagagtaaggaagtaattcacataattgtgtaaatgttaagtaatttacataattgggtatatatacaaatggatttcttccctaagctatttttttaaatacagaaaaatctaatctacaagcagttgattattaaggaaccaatttttaaataaaccaaaaaaagtatctattctaatgtgtgctatttttcacaaaaaaagtgttttcctgtgactgtatcctgcatcccttgttacaagtgtgtgtgcatgtgtttgtgtgtgtgtgtgtgtgtagataagtatatgatgtctttctgggactatatgcttaatctcactacaattacttttgggttattccatcagcaacacaagtaaatctctctagatactatttatctcaggagtgacaaatatgtgttaagaatgacttctattacccctgcattataagtttattttttccagtatttttttccctttgatttgagacttagcctaggcatcattcccaaagaagtgctccagacagccgccatgaatgaatcagaactggcccttggaaggaggcctacctgccggtcctctaatggacataacttacttttacctcacagtgttactcagtgctttatctactagggctcatgagatgcagtgttcatactgttttgtttccagaatccctgggtgtgttttattccctcagttgtatataacaggacgcacaatggggtcaggccaatattttttggctcttaaaaggactcttgctgaggtttgccagtacctgctgatctgcagctcccccagcttcataagcagtgataggagtactgagtcagccccaaattaaagaaccatgcatagaacaatgccctgcagcagactcgtaggacaaatctgaaagagcatccccagactcttgaggcatagatacctcctgaaaataagggtctgccttctataggtcattactttggaacatttaataaagcattaccaaaaagaaaaaatacatgtattttataccctcacatttctttttagtcatctttagttttgcttacagtctgattaccccctcactcccaaatccttagctccttacaaaaaggaaaaaaatattttctataacatatatctggaagttttaattttagatttatagtttcacattttcaagccagtatttttctagttccattttgctctatttctagatcattttttctctctcttttctcttaggttttgaaattgctttagatctttaaaaagccattcaccagatttttttttaacttggcctcaaatcatttttactaagtattttatttgagccatcttttttcttttttccatttgttttgttacttttctctccaccgaccctctgctatcaggcaagcatttatattttctattaagtatatagtttctcctaatctctataaacaattatgtgaaaataataagttaacaaatacaatatgacctcaattaactgtcttaatacaagtggaaatggcagagataattccaagagccaattttttattttaatgtgtttttcatatgtacattttaatgggagcttttatgatattatttttcagccacactatttcaaagaaaacaatggagggcattttgtggagatcaaattctggttgagctgtttggacacccagctgcccatcctttctctaatgctcctcccgagcacccagcatcatctctcagaattagacctgaactagccctgacctgaactgattcttctgtccctggtcttctctttctaaattatattttcttgatgagtattttctgtttctaaattagcatcctccttctgggcagtaaaattgagtgagtattagacaaaattgtgaaacgtgtaaacagacattgaatggtttaattaatcagcaagatgtgcagttgaacttgaaagtaaagcatgtgcataataatcctgaagatgattgaagattaattttagtatctgtgatcagataaagacacatttcaatgatgcaacaatgtttaacacttgcaggctactgcaacagaatacttctttagggtcctgaaatcattcttgctttccacaaacttagttgagtgcattaagagattctggctcatagactacttctgcttgttgactcatgccttatccttttcacaggatcactatctagctttaattaattaagtcaggctaatatttaaccagtcttaactactattgctcaccttgcttttctatctcgtgttcattgggcctgtcttagcaaaaaatgactatagaggcaatcaaaattttttatctgatcataagttcaaagttcaagtcagataatttaccttaaatctggattgaaaattaatcatatccccaaagttttggcttgagtaacagtctagatgtttttgtgtatttccttagattcaattctatcaatcctctcctgtgacacctgtaacattcctatagacgattcctgttcaatggtaactcttcacagtgtgtcaggaagagctcttagagatactattagtcagattattcaaataatttctttattgtatattcctatttggcaccaatttgatagtagcatttccttgtgtggatagtttccctttatctattaaaaaagcagtcttttctgactattttctattttcccagcctctactcccttgcttggaattgactgctgtgttaagagctatacaggtttacagaaactgatctttatgattcccaaaacacttggcttttgtgtgaaattgcaaaaattgaaatagcctctttggtacttggtacttattcaaaatgttctcatgtgtcttttggctgcattgcatgttgtgcacaggtaccctagaacttaaagtataataaaaaaaaaaagttctcgattttccaacactgatgatagttccgactttgcagattagcaagaacatgaataagattaattttgcataaatgtttttcatgtgcacaacttggagatcttcagaagaaagaagcaacgcgaatctcatacatataatctttccgtagcttctactgtaaattttggtgaagtgaaacaataaaatttgtataatgtagaaattaagggctgatgactgaatggtcattcactttaaattcatgtatttattgaaattattactcgagttcttggctagggatatagaggtgaacaaggcccaaacttgaaggagtgagtattgcactggagagagaatcatgcttacaaaatattagcaggcccatgttccttagtctctgaatttgtaacagaaaaacacaaattctttccaccctgagtcactcctatccatgaggaattgattgatttaactggcaagtggcaagaatttgacatcccttggttcaagccttccagtggggtaaaggtgtgcttagaagccatgagcacaggggatcttgttctctcatttcttattcccatcaccagctttccccagtagactggatgggtgagaaggaaggctcaattaattgcagaacaattgagtaagtgtcctccatgagcagtttcctcccagctgctgattctcaggaccaagatgaggggaataattagaaagcctgatcctggctgcaggtctctgccctgatgcagtggttgttaaagtaccagttaagtacagctcaagttgttcaactcagaaggcacaataagctttagcctaatactacagttctatagctttatggatggatacagggcaacggacacagcaggtgaagcatcttaatgtcatcagatgagacagaacccacccaggtacacagcttccattgcttcctcacagagtgtgtgcggccaccatggacaagaactaaacacctgggggtcactttaccacagagactctgtcctcagtttccaactagtctttcaaaactgttctggtttagatgcccaggtctctatgctaccctgcagctccccacccatgtgcagtgccaccaccaacaaggcagacatggcatgctgtattcttcttaactctgtagcttctaaactatgagtgctatgagaaggcaactctgagatggttcttcagcgtaggcctgggttagctcagacctgatgctaaccctttacttacaatgtccaatccagatttttcaacaataaagatattttttatttttattggatgcttttgtatgcttaacattttatctccaatgtatcacatgtgaaaggctctgtggagtcagttacactcctttctctctggggtaaggacagttgagatacattgattgcacccaattgacacgcagagaccagtagacatcagacttttttcatcttactaatgaggtaaattaattatgtcttcccgtgaagaggtctaaagtgatgctctagtgctattaccaatccaagagtggtatcagaagtctcctttcagaaattgagacaaagaaagaggacacctctattttaagaaaacaggtataatgctgtaatatatcactatccacagtgcagtgggatcccaagtgaaggtgtgtccaagtgtgcctggaggagatctgcttctcattgtagtgagaatttgagctgggatgataaggctctagtgaggtgagcagagagagggcattgcatgtaagggctcagtggatgccagaggggagctgggcaatatccaggagattgtgaagcatacaaaagactgggactttcccgccaaattcatacttacattattaaataagtacttgtcgtcatccaagttaattaattgatttatttagatttttgaaagcctttgaaattgtatataaagatagatactcaatctttacttaagaattccattgtgatctcaaaattctttgaactattctcttactcaacaaatatttattgaatggccactgtgtgtcaggcactagtctttctataaacataagggatgctgcagtgaacaagaccggaaaggtccctgctcacagaagggttacattctagagcttcactagcagtacagtggtacagtaaccaccagcatgtgtcgtgatggagcacttgaaacgtggccagttccagtggacatgtactagaagagcgacgttcacattggatttcaaggactttgtataaaagagaagaatgtaaaatatctcattaataaaatttttaatattgattacacatcaaagtgatagttgttgattgtattaggtaaaataaaatacacaactaaaatgtgttttgtttcttttacttgtggctactagaaaaattacataggtggcttgcctttctgctggacagtgctgctcttgaaagaagagtcaaaaaatgaactacttgacaaataaatgaacaagatgttttcccacagtgagaactgctatgaagacagtaaaactgggtgatgcaatggagagcgacagagactacgttaaatcaaccagccaaaggaggcttttctgaaatgcaattttgctgacatgaggatgataggcaggagccagccagatgaatttctgtgggaagagcagcattctagatagaaaaatagcaaaggtcccaaagaatggcttgttatcttaaaaaaaaaatggaagggttaagtagtaataagtctgaaggagagttgtatgagaggaaatcagaaaagtaggcagggctcaaggaacttgcagacttggaggtaagatgggatgtttttgaagtgcagccagaaactacagaagagttcctagcagaatgacaaaactgatttacatttttagaaagacctctctatctgtttcatgaggtaggagcagaaaaatgtgtaaagactgttctagtgttgaatcgcagacaagggttccagaggctgcttaaggctttcaaatggagcctctgggggaaaggagaggctgccaagctggtcgactcctctcttggctaaagctttgctgggcaagctctgtccttccctccattcttgcattctgcaggcagttggagataaactaaaagcatcactgttaatgttgtttttcaaagaatggaaaaaaaaagaatgcattataagcaggaaatcatgaaatgtgggggaaattgctttattggcccttggctggagtctacaaattggagcattatacaggaaggcattaaacagggggcgaaagggacatgagtttgattttattagccttaggtgagagatgaaactctttttaaagctccaagaacccctaggacctgagttgagaagagacacagcacaaagcagtacaaatctgctgaagcttcagataatcttgaaaagagtagaagacactgcagctctatagctagagaaaatcaagcctgctttgttaaaaacactgatttgtaaggatggctgtccattctgtaaaccagggtataactcttttacgtgacaagaccattaggaaaaatggcaattagatgagccaggatttcagcagtcagtctagctgaggaaagcgttttccatccctactgcttaccggccattttgggggaccatgatgactgtatgagacagccttagtttgagacagttgctggaacttgactgtcatatttgaagctgccaagcagtcaattgacaatgagttatcaggggctgcattgttttaggccacgtataaagctggattggacaggtatgcagagtggcttctactcacagctgggcagctgtggtttcagcagtccttgtaaaatgccttacttgggagaagagtcttcaaattagagtggtaaagatctatttagtagcaacattttaaacatcacatttgaacaagtattaaatatgccaaagttcagcatttcattcatggtctactctttccctctctactcactttttctaaaagctaagatattacattggtttaaaaaaggggaagttacataaaatataaataaaatgaaatataacaaattctagtataataaaaattctccttaaaaatcattacctccaatacaaagtgagattaatctatctaccttcactgtgaaaagtatatagaaaacaaaatttaaaaattacaatagttctactcatccaagatcataaaagcatgtttgtttcaatgaagagaattgtctgcatttacttggatgttcataaaactgggtttccctatctctaattctttgagtataaagtttaattatatatgccctttctaataacatataaataacaaaaagaaagtaaaatccatattatatcatatataaatagaccaatttttcgtcagtatcagattaaataaacagtagcctgtcattccaaaacacatgcacacacaaatcattatatacaatttgtgggaaacatttaaaatttatttataacgattgggaataaagaaatatgcaaagacatagggcaaatccaaaccaaaacaattcagcagtaacaatattaagattagacaaggggaaatgtcaagtttaaacaccaaaaaaaggtaaaatcagtggtgttagggcgttagctggtaccagcttgtaagagcctatggttaacatatcttcctaactccatgttcaataacatcatattgaaattggccacagtgtgattatttacaccgtagaaattggaaatgatacaaatcagggctttcttcctcccctcctctagagccaattgctaaccatttactagaacaccatgggatagaaatgatgaagttaaaattatttgaaatgcacatgtgctcaacaatatagcaactaaaactataagacaaaaactattagaaatgtaaggaaactttatttaaaacacatgattatactggcatattttagtttatttcttcagaattgtacacatccaaaaactattaagtaacaatataaataaattagatgtaatccataaacttagtaaatgaaatagacagtctttattcattcaatgtaagtgtgtaaatggatgtctccaccttaaaaatgagatattttaaataagccataattgattcaaaatggagttaccttttttggcatcactaacttagcgagtaatcttgtaatcttcctcttaaaatttgtttttgtgaaatcctaattttctatttctttttcttttgttgttgttgttgttgttgttgttgttgttgttgttgctgttgagacagaatcttgctctgtcactgaggctggagtgcagtggcacgatcaatgctcactgcaatctccgcctcctgggttcaagtgattctcctgcctcagcctcccaagtagctgggactacaggtgcccgccaccactcccagctagtttttgttatttttagtggagatggggtttcaccatgttggccaggattgtctcaaactcctgatctcaagtgatctgcccacctcggcctcccaaagtgctgggattacaggtgtgagccaatgtgcctggccctaattttcatttattatacttcccttactatagattcaatacaagggaatgaaagcttagacgttcttggcatattttatgaactcctataaaccccaaccaggttgtgagtagttatcgcttactgagaccttaaacacaaacaatattttaatgttcatttattatcctgaataagatacatagatatatattgggagttgagcgctaccatgtcaagaggagcaagcccatagaatgatttttctttcatttttttgcaaaacaactgcaatgtcccattaagacttttcctgcatgttcgtgtcagatgaaggaaagtattttccactgataccccaggttgttagctagtcccacgactgctcttcaagaaacacaagagacctatctgaatgtgggtaaaaggatttcatgttgctttttacttagaaacccagattgtttgtaataagctctgtctgattccttcaacacttagcatccaggcagttttcttcctctaaacttcaaaaaataggagagaattgtaaggaaaatgataaaagcatctgaagttcagcaaaagtgagcctcatctgagctgacttgtcctgatttggggatagcctgaggagagtgtgttcacgcaccttgcagagtagcccttagcagccacttgaataaaaacgaatgaaaagataaacaacaggagtgggcagaagttcgaaatggaggatgtgtgtgaagaaataataacattgtcttgaagattttagaaaatgggagaggcaagaaaaagaaacatagagatgaatcctggaaaaggtatttaaatcttggttgattgttcataaagcccccacccatagcatcttcatcatccctgtgggatgcaaatattgttgttttcatcttacacacacggacattgtgtttctgacaggccaaggggctgttcaaggtcaaatgactgttgaaggcaaaaccactagtatgcagcagtagcagaaaatgaatgcatggcttctgatgataaatcctatggtcttttcaaaacgcctctgttgtctctagggaaattgcctcaaattagaaatcaacacattctactgcagttctaatttgcacacgcttgcctgaaaactttctaatttctggttcttttttaccacctcctctcccacttaatttcatagctacagaggggaaagatagctactgtccaaatagtcttgctaaaggacctcattttcaaaattctttttcccccttcaagtcttcatttgactcacggtgtaatcacattagtgaggaagattttgtacagtcatacctagtgccaaatatcaagttttcctccaaaaagcaaaataaaatgatgggcagaccacctgctttccataaaattgtaccaaaatcaaggaggacaactctacgttatcacgtagaaataacatcagcatttatgagtaataggtctgtttgatgggcaatgctgtggtgtgtaaaattctgatgacaacatgttgaaaaaaaagtctggaagaatgggagaaaaaaagtgaaagtctatggaaagtagtagatttggagtccttttgaagaaaacatgcaagaagctgccagataactgctagataagcagctattgaccatttatgaactcagttttaccaggcgttgagaaggcgagaatactcaaaataaaacctgcatagattccacccttaggaaacttacagtctggcagattcaaaacaatttcacttcactttaagtaattgtaaaattgcctccataaaagcatagcctggatgaaaacatttttcaatattatttactcattttaatgcactcaaataaactttataccaagtaacttctttaaagatctaccaatataaggcacgtatagatcaaagtagacaatgtcagcccatataatccccttctccaggtccattttgattgcttgtgtcaacattggggaccacagtaaattactaatggtccttaaaattccccccctatttatctctttcttttcaatttttctccttcactcctgctactctatttcttgtgtttttttttttatctactttttttttttgctcttccccagggaaactagaggaaaattcttcatcctgataagagtttttggcaccagaaaggatattttacctgtagtctgacctacatggagtgagggagcctgaacatgtttccatgagtgttctagttcaatgggcagaaagatccatcaggagaaagcctttgtcactgatggctttgaaattgttcaaatgactttgcagttcacaacacgtgagcttaatcattggtttggctcttctgaggagctgagggagacaaagaagcaaagttattttcccagaggtagtgaggcccaagatgctcagaaaagatttaattgaaagatgccattgctgaaatttcttttataatgttctgcctgtggctttccaatagtaatagtagtagcagttgttgtaataatagagatagtagttgtattgatagcaataataatagctactatttattgagcactgactgtgtttcaggcatgggtccatgcactttacatatattaactcatttaaacctcccaacaacctaacaaggtaaagatgattattatcccatttcacaactgagcaaactgggacatgagatttaaggaacgtgcccaagctcacacagctaggcgatcaccaattatacatttcctctctgcaagagaacagtctatttttcaaaaacatgctgataaaacagcaatcccatttgcttctaaggacaaaccctgccatgcctgagtgttgccattcttaaactccaggccagggcttgcctttggatacatgtgagcttcactgggctctctgctcaatgtccctcctcagagtgtctccctaaccacctctcttgatctctctccacccctttattccacttgggttttcttcagcacacttagggctacctgacagtgttagcaaggctacaaagcaaaacaccagatggggtggcttaaataacaatcatttattttctcacagttctggaggctggaagcttgagatcagtgtgccagcttggttcagtgctggttatgggtctcttcttggcctgcagacacagacaccttttcactatgtcctcacatggcctttctgtgtgtgtgtgggggggggtgtgggtgtgtgcgcgcgcgcgcgtgcctgcatgcctgtgtagggagaaagagaaagctctttgcctcttcttataaggtcagattaggaccctacccttatgaccacatttaaacttatttactgactaaaagccctatcttcagatatagtgacattgagagttcaacatatgaacatatgagctgataggaatatatgaattgatgggaacatatcaacacttcaacatatgaattggggtgagggacgcaatacagtccatagtggtgacccagcatatatttaataggtcattaatgtgtttactatgtgtctttcccactcctcccggtattagtaatctaaataccagtaaggatttgaggttcttctttgttgtattcctaatacctaagacactgtcccacacatggtagatgttcaatacatatttgttggataaataaaaaatacagagctccctcttctcccctacatgttggaaaatgtgtgtgatctaaatgagggagagggagaaccatctcatctaatcttccaaacttcctgagccacctttagctactgagcacattcacgtttccgtcagctgggaatttaggtgccctgcctatcatcctctggagcccatcccaggagggggcagaaggaggtggagcagcacactagtgttcccagagtggggagagcagatggagaggagttcatgggaacgatgatttacccctgctcacttacccctgtgagaggacactgccctccacgaatcaatgctggctcctcctccaggaaccaggcttctgcatctcacttgccatgctgtggatctaggaacaaatttgcatttggaaattcattttaaagtgtgcatgctgaggttctggtgacatgcagggtaacttctcccacccacgatatctcttgactcaggccttcatgtaggaggggaggagtgtttggcagcaaaactgggtatttcttaggaaggaaatccttctaagctttatggaaatcctagggtgttgtccctacctttctgagtgtggagcagactatctgtgtacatagcggtagtgaggggtgtaatattggagaatggcttaggtaacagccaaaatatacattgtatatccccaaaaagacgaccaaagactcacaggccatgctgctatcattagatataataggcatagcctttcattgatatgtaaatgttagtatttttggtaagtgccttattttatcttctggataatataagatacaagtaccatgagggcaggatccttctctcattcattttttttcccaagagcatagcacaaagtaggaagtacttgttgagcgaatgaatgatcctaaatatgaaaggatggcattttatcgccattttccagatgagaaaaaaacgagggagcttatcaggtttatatatagtgagtgacaaacttcagaattaaaccaaaatctagtaattcctataacttacaggttattaaggagtccacctgaatgtaagtccaacaagacaggtgtttattttgtttacatacattccaagtacctaagacaatgcctaacatatataaaatacttcataaacatcttcatgtgtgaatagaattttcaaagttcatctcaatatatgcctcatgtgacacttccaacccttcactgccaggtctttcagtctttatttgaataggttcagtaagaaagaattcactcgtgctttagatatgtatggcttttccacattgttgtcagttctaaatcccgaaagttatttttgtatgcttggaatacttcacaatattcacaatttttacaataaaataatttcaggtcttcttgatgaaaaatgtcgatcaggacagggctgaggataatcacaaggcttgaaattaaagaagtctccttaggctgaaatgaatttctagttgtaaaaccaaatatgaatctatgtatttgtgttcctcagaccacttttccagcaggtccttggctgtattttgtatgcatttgtgaaatgctttgttgaaattcagtttcagccaggtctgtagcattctcctggcccctggtctgatagttgtaccaggaacactagctaacaattgcatggcactagtctcagctggatttgttctaactcttttatatgtattaactcaatccctacaaccaccccatttcattactatgcccacttgagaactaaaaacactgaggaagagcgaagttaagtaacttgcagaggtctcagagctaggaagtaagacagccaactcggaacccagcagactagctctggagcctacccacctaccctccacaccgtacctgtggtccatcctcaccaaccaggcctgctgccctgagcataacttcaccctcttgcgttctaaaactatctgctgattaagtgagttctgaaatgttttcagggaccaatactaaaatcaactatgaaatagtttcagagattgacctttcctccttttggaatggataagattttcccaaccgaggtctcccatcagctctcctgttcccctggactgtggcacataggagggccagggacttgcgcctattatttcatttcttttgttatccttcatttctagatctcttctctaccacaattatctctcatgttgacagtttccccacagatgggatgtctatttccttgataatacagcattattatgctaaaatctctcatttgtgttattagccagactctgtgcaaaaacgtgtgtatatctgagactctgtgctgttcttagccaccttcttggtcccttctcatgtaaattactagggcacttcttcaatattattattatcatgcccccttaccaccaccacaaaatcttccatcataacccatttttttttcctcctccttaccacattttcagctttgaactcttataatcagatcaggaattacatttctgaacaaatgcaggctttgcagcattgtgaagtgcagctggtccccagcagagagccctaagcccctgcctgaagccaaacccccttttgtggcgagaggtctggattttatttgttgtttttatctttggtgaactgtcaactggaagcagagatgcgaacaccagttatgtcctcccctgcaaggttcatgaccaatactttatagtttctggatatgcttcctaggtttcttctgttggtgtcatttgcctgcatgtgactcactggcaggtggtgatttcatcatattctagacatgtgtcttaggaagctggcccctatcctggctggctggacacatatcgaagttccttagatctaccattgtcactttcatatccattgttaaatactatagatagcatgcaggggtcagccaaattgttctgtaaaaggctcaagcataaatattttaagttttgtgggacagacagtctctgtcgcaactacttgactgatgcagcatgcaagcagccacagacaataagtaaacaaatgggaatggttgtgtcccaataaagctttatttataaaaactgtctttttttataaataaaggagcccatcgtttgccgccccctagtgccaggaaggaacaaggggaaaataaggaagagacccagaggaaaaaaagtgtcaccaaccatatctctaactcatatttatttacttatttttctaagcgcaatcgctaaattatctcgtcttcctaaggcgtatgaatctcttacattaacttagggacagaatatagagttttatgttatcttctgtgagttctttttccattctgtcatgtttcagactttcagaggtaatttttaagtatttcagctgtgccttagatacattaagggacctatagtgcctccctgaggccaagatgatggttgcaatcataaataggttatttctgagttgagactggtaagaacagattatcctgcccagacagtgatgtgccaagcattggcaactttgaaaaatttgcaatttgattttataggagagtttccttaacaggcctgagtttttttcccattgcttttgtgaatacagtattttcccctgctagactcttagtcaaatgttcttgccattataagaaaaaaggaaaactgaaaaacttgaaaataattttattggcttaggaattattttcatgtttgtctgctaatggcaaataaatctaccttattgaatcatacggattttaattccccgggggaaaggtaaccaatgacaggcatatgtgtgtgtgtgtgtgtgtgtgtgtgtgtgtgtgtgtacaagtgtatgcttgtgaaaattgaacagcaaaaagaaattaggtggagaggaaaacattaaagctggtactggtgggtaatcattatatatagtatatatacacatatgccttctccagttttatggaggcagtcagtgcctcaaagacgtgtaataaagagacagcaacaattattggtggcattcatgtaggagaggcttgagccaatgtaaacttgacttggttagtaatctttgccaaaactccctgattgttgtaagggagttgtgaaccattaggtttgcttaaccagaacagcaagtaagcatccaaacagattgtccttggaccataagcaaatgcccagaaaatagccccctgcataggatattaagtacttagaaacaaatgagaaaaaatattacagcaagtcttccaggtatagaagggataaacaaccctattggtatcagaatttaggaatattattatgtctcccactttaaatgaaatacagcagcctgacttggcaaaatttggggaacggttccccttctttgcagccaggttcggtgcttgccctctggcatcccttcaattgtgtatattactggcagagacagctgtttgagctgctaataagattgcaaaataatatcagcttgtgcttcaggttgaagataagagataacattgcattggctgtaggaatggctttcttataaactggatttagttttatctcacttgtctcacttgttacttttttatttatttacttttttttttttgagatggagtctcactttgtcacctgggctggagtacagtgacacgatcttggctcactgcaacgtccgcctcccaggttcaagccattctcctgcctcagcctcccaagtagctgggattacaggcatgcgccaccacgcctggctaatttctgtatttttagtagagacagggtttcaccatgttggccaggctggtctcaaactcctgacctcaggtgatccgtctgcctcggcctcccaaagtgctgggatttcagattacaggtgccatgacgcctggccccacttgatacatttgagggtctcataaggtcttgaaattgagcctgtgaatttataaacagggctacaaccatcctgcagatgcaactttttggcatgccagaatcagtggcacctgaagagcatctccttgaaagcggtagtagataaaaggagatgcctttcaggtttcagacgtggacctcagattcacctccaagactagagttatcacagtgcacaggatcatccaagaacagacatgcagagggaggaaaggccattgtaaggctcaggagaacatagtagagcctaaaaatgagaacaaaatggtactatcagaaaagatggcagtggttgggacataagagagggtaggttcacaggtttgtgggaccaggactcagtcactttcctcgcgctaggctcaaccctcacgatggggaaagtaatgtacttctgggcttaaaattcttcacagtcaactggtagagatatgagggaatttattgctaagtagtagggaaagtgttttcacaaataacatacaggaaattcccatatcatacaaaggaggttgtattatcaccacgtttttacatatgagaaaatagagtcttagaaaagttatgtaccttgcctaggagcatgtgcctagatagtggcagctccaagattcaaacctaaaactccagagtctgaaactcacacagtttcttctctgttctgaggcttcatgcagctggacaggaggttagcctgagacaagaggaggatcattctcgaaggcagagaggctggggacatgactgctttctggaaacctgagctcatggagagaggctgagagtcaggaaagtaggacatgaaatcatttaatgagagtgaagaccagccaggtcagggagtttgaaaagagagttttgaaatatccattgtagctaatatgggagagcattctttgagagtgattaaaatggcgactgaggacacagctaaagtgagaaagaataaatctgtggcagacttgcatatttttggtatgtgcatctctttccgaaatcaattgaacagaggtgggaaaagtagcttggtggataatgaggtagagtggaaagttgaaaagacagagcttaggagtctttctgattggtctaaaattccccagggaaaatcatgtttctttttatgaatatagtccaggtcttaggtctgtcccacggcacaaagttttcaggacattctggacaaattcacacatttccctggatgtcagtcaattccctttgcctctgtgctatcactttccttctctctgctttctccttgagttacctgtcccagctcttcactccacattctgcagcctccgtttagctcctttatacctttgtccagattcttcctaacttattatactgcctcctcatgtcaacttccatcccatctgcatttgggaaaagaagcccacatgataagtgagtccatctgctaaatgtatgcatcttagagcatttgttcaagatcaataaagatacaaattattttgatttttcagctgttgcccaaatccacaagagtacacaaatgaaaatgcactgatttttaaaaagtacaaatagccattaaagtttgtattgttttattctttaaataagccggaaaaatgggaatacgtaggaacgagggagctagcaaaataggcggggcttctgcgtttcaggtggtctgagactgcagtgaccctgaggctggtggacctggaaggagccagggagagatggtggatcccaggggtgggagcaaatgcatggtccaaggttctgaatggcagagctagaccaaaggactaacctgctaaccttgaccaaggagatggcccagaggttttctatttctactgctccatcttttcattataagttcccagtagaaacgagtcatcatttaaaatatcggtgcagcacttaacacataaggaaaaatcaataacattcatttacttacagtacccagagaagaaataaattcaaatacgtaaaaatgggcatgaaccatcctgttccatatcccactttaggactgtcagcaactgtatacattgctgaacgtcattgctcttgtacataatgaataattttctgtaaccctgtgaaggccgactgatttttacggaaagacagctttgtgttaggcggcccgccttccccacggaatcgggttttcccacgccacgttttgatgtttctgagaagtgtgcgccatctgctggccgctgagaggattgacgagcagccataaggagcaccgtgtttcttgagcatgacttaaccaggcaatggaattacaattatctttgggtttctaaaacataatagacatttcaggattcacgtgacttatgagaagtcgcttaattgcctttcaagcagtatacattttttattcaatatgtgtattattctttgtaataataaacgatgcaataaagcaatcgaggggttcccacatgctctctaggcagagatggaccccgggccctagatgaaaggttaatagtttggagtgagcactaactctggtcctctgactctgaatctaagtcaggagtagaatagagctgtacaaagaagactgcttgatggaattgaattttgtcccttcttcaatgggggaaaataaagtacagttttcatcaatagattaatgactaaacttggaccttgatgccaaatccaacttgagctccgcctgcacagtctggagatgtacataagagacacatgctcagcctcttagcacatcgttataatccaggcaggcaatactatatcctaaaattactcctctttgctgaaattgagaaaataggaattacccagggtaaatttggtacataaatgtaccaaatggtatgatttattctagtactgtcttctttttcttgattttcttctttattgggaaatttgtattttgtagttccttcgacactttaaaaattaaactagagggtaagatttaagttttctcacaactaacaaatgattttgattttattgcccaaagccctttatatctcactttcgatgggtctagtccctttggcttaatttagatgtgatttttccttaataattttgaaaatggtggtgctctataccaactagctagaataggaatcacattgacagtatttaatggatagaagcatctcaaagatctttgcttaatgagggcaaatcattagcaatgtccaactccctatgttagaggcgccaactaaggcacggtacttaaatttaaagcacaactcttcgacttccataaagtacatatattacattatatttttaaattacggggtagtgactcgatatgtcactggaatgttttgaatagtgcccccggcccccctgccaaaaaaaagaatgcaagaacactgtcctaaccaagaaggcctgggagttttaactaattcagcctttcagcctccacttaaaattctggaagacagtagtgttggtgctagctgtccttggctgcaagttgtctttacagaagaacttggggtacattttggtgtgaggccactcttgcaagcagcatttgcaggcattaagagaatgcacacagttcaataagctggggttatattcataatcagtctttgtttaatgctgtaaaaatactaaaggaatggccaaaatctctcggtatctggggaaaagggttctttgaaacttttgatgtgtgagcagaataatggaaacttatctgttccccatgcttttaacacacacacaaacacacacacacacacacaaacgtcatagatcaagatgtaacaggttggaatggggcctaggcttgggaattttgtgactccccaggtgatctcaatgtactgctggtttattagcaggctttgcccaaacaaatactctttctcacctaccaggagaaatcaaagagctctgggttaaacacttgtatgttaaaaccaaaatggtgggcattgcagagtagaggaattaggagaagaaaatagatattgggtcaaaaattggcctcaggaaccaggaagtaagaatggccaatcttaaaagagaaagttctgttgaagagggagcattatctgaagttggaatgactatggaggacaatgacagctgtcccacaggatgtcactgggctgaggaaaatcagactggaagccacaagcccatgggggctcaggaagcctgtttcctgagcagaacagagctgggtttggcacatgcctagtgttccagtgaaatctgtcatttttctgcttccactttttacaaatgagttattcaacgctactttgttgacacatggactcagcatttaaaaaatgacagtggagataagggtctaaggtagtgataggcaaatgaatgatgggcatccatcatctgaagagcttcttaaaattcagatttcccaaccccaccacagacgtctgtctccgtaggtcttgggtagggctcagagcaggctgcttctgaaattttgaggttgtgaggtaagaatacaggtgggagcctgcataccacttgtctaaatatttaaaagttgtaaatcagcctaatgaactgtgaaggaagctctggcctacttccttgacaacttaagcctatacagagacctggaagatcaagttcaaatgcagaacctgaatgtttcggttctatctgctccctcagtgttaaaggtctgtcctttttccttgacaaatatgctttcataattgtctggaaggccggattccaattcagcaattccaatccctcagtgttgagggaaagggccacccgctctgctcttctcttcccatctggctctgtctggaaccacgaagcacctctgtgtgtgtgtggggacaagccagcccaggtgcctgcgttttggcccagtacctcctaccctcatactacatatgtagccacccccaggcatagggttgtgcacactggtgacatgtctgccctctagaagaagcatgggggaaatgggaccccacaggccctgttagctgatacgggccatgagctcccaggtcacggtctaaaagtacattggtttggggctctgcgtgaccatattccaaggatcctgcaaaggaagaggcaggactggagaagggaaagagtgggccttctaaggctcccagggcaggacctctttttgtctggtctaagaggggtattgaacccaagtggcttagatgctgaatccctgggcttagaacccaatgccctggagcattgatctcacagtgctggccagaaaggggctcgttggttgctactaggtcattatcactcccagggcacctgggcagtcaatgaaactgagctcagaaaagtcctgcctttatgatgtcccttccacttccataactttctccataaaataaaaccaagaaaaataatttttctcttgatttcaaatcgtatttaaaggaaaatagaaattttatttttaaagaaattgcatgttttcattgtctatatattgttttgaaatatgtacacgttgtgtaatggctaaattgagctaattaaatgtataacctcacatgcttatcatttttgtggtgaaaacacttaaaatccactctcttaacaattttcaaaaatatttgaaaaaatatagttattaactgtagtcctgtaactatttcctattaattatagggaagtagaaattttaatagtcatctttctcatgcttttcttgacttttagattcaagaaataataaacttgaataaaagagattaatttcacagtaatgcaatatttctgtaaaatttcacaccttgttgactgtcaatcagctgagaactttacacctcattaaaaatccattagaacaatggctgttccattagcccttcagtttatgccttaaaacatacttgtctaaaaacaacattgtttttggcaggctgctccttttgataagtggggacttgctctggtattaactgtttccaggtctccagaaaaaggctcagggtatgtctagggacatcagtgacaacagtgaggtagagcaagtcaatactgtgccacctctgcgctagccagagaacctctgctccaaggtgagttggttccccctttcattaaggtcctcaggccccagtaaaatccagatatggctttggagaggaacgctgtctgagtgaagctccctcagtttcataaccagcttagagcttctcagctctgacctgcctgttagcatggctggggagcccagtggtttattgaactggctaataacaaagattctgagataacgaaacagaaaacaggtaggttttgatgaaaaggaaggagataaggaggataagaggggtagtagggaggaatagtgggagaggggcaaagaagcattaaatcaagatttggagaatggctggaaacagtggcagagactcaataggagagtgaccctgacagacggggaggtggcaaaagtgcttgcaggcacaggccacccaacagttatttcggggactgttcacaatctcatctacttcacagttttgccttgtcctaactcaggtcttattagagccagaataaattgccttgcatcgtcagaaactgaccattcattcctgtggtcttctttgagatttttagaatcccaaggactaaatatccctatccacttgcctttgttcactgtattggatgatgtgccattgcctgtctccagcattcactgagagcagtaccccaacatccaacacatctttaaatgccaaagggaagtgaaaatgtcctgacttcttaaactctaacatagcattcatcctattcttatattttttgaactttgcatcaaaacatacataaatgcaggtgcacaaattgtaagtgtaaaagtcaatgaattttcactaagtgaacacacttggctcaccagaagctaaagaaagggtgaactagaaggggactttgtagattacacttcctgacaccatcattatttaagaaagaactgtttcctaggtatattttaggaccttttatctggtgatatctatctactaactttaggggtggggtggaattgattctttttacaagattagtgaagctagaaacaactagcttttaattcattaaatgtaacctactttcaagtagcttcatgtgactgaaatcaatctgttttattttccaaaccagtggaatacacacagggtcattacatacattttgaaagtcttctgtttcaaatgtattgtagattaagaaacagaatgtggcagggcacggtggctcatgcctgtaatctcagcactttgggagaccgaggcgggtggatcacttgaggtcaggaatttgagatcagcctggccaacatggtgaaaccccgtctctactaaaaatacaaaaaattagccaggcatggtggtgtgcgcctgtagtcccagctacttgggaagctgaggtgggagaatcgcttgaacctgggaggcagaggttgcagtgagctgagatcatgtcattgcactccagcctgggtgacagagcgagattttgtctcaaaagaaaaaacaaaaaatagaaaaagaaacaacgctattggcacacccagaataatcactattggacttctgataccaaaaacaagggggatttcctcgtttttaagttttatgaaatgaagtaatattctgtatactcttccgagtttagcttctttgagtaggtttgtgagatttatccaagtgtggaatggagttataatttattcatttttggttttgggtgattgtatttttaaaattaaggtaaacattaaaagttagggtttaacccactactgggtattcacccaaagggaaagaagtcattctacgagaaagaccacatgcacaggcctgtccaattcacagttgcaaaaataggcaaccaaacttgttgcccatcgaccaacgagtggataaagaaaatgtggtatatatgccctatggattactactcagtcataaaaagaaaccaaataatgtctctggcagcaacttggctggaagtggaggccatttattctaagagacgtaactcaggaatggaaaaccaaatatcatgttttcacttacaagtgggagctaagcgctgaggatacaaaggcataagaatgaataatggactttggggatgggggagagattgggagaagttgagaaataaaagactacatattgggtacagtgtacactgctccggtgatggatgcaccaaaatatcagaaatcaccactaatgaatgtgtccaagtaaacaaaacccactgtaccccaaaaactatagaaatagaaaatgaataaataaaagttagggattaaaaagaaagtgggacatggtcattccagaagtctaaaatattataagctatatataaaatacaagtttgtaactattttttgagtacctgcaatcagcaagtttgcattaatattactgtttactccctcactttttaaaacaactaattttctatttcctattttaagaccttacctaagattgctgtcctgtggaatggttcctagcccacgtgaccttgtctgtgttgaagcatgagtgaatacatactaccatctactttagtgaatgttgatgataaaatggccaatttcatgtatttgtttattttcaagaaaaccttagagcactcgttctcaaactttaggatgcatcagaattacctggagtgccagaatcccctgaagtggttgtaagaactcattgctggggccaggtgcggtggctcacacctgtaatcccagcactttcggaggccaaggcaggcggatcacttgaggtcaggaattcgagaccagcctggccaccatggtgaaaccccttctctactaaaaatacaaagattagctgtgcgtgatggcgggcacctgtaatcccagccacttgggaggctgaggcaggagaatcgcttgaacccggggggcggaggttgcagtgagccaagatggcgccactgcactccagcctgggtggcagagacaaattgaaaaaaaaaaaaaaaaggagtttctaggccccatccccagaatttttgattttgtaggtctgcggtgggatccaattatgtaccgtctaatgagctcccaggtgatagtgacgctgcagacctggctccacattctgagaaccactgccttagagcctgcacatcaagtcacgtttatattcctgtgccgtactcccctggtgaggattcctctggtcattcatgcatttacgtttttaaactccttggaatcaaccaggtagagattgtactcttgttgtcgtatttaccatcctaaatcattagcatctattatcttcctctgccctacaccacaactctgcttgtaacccatttggagcgtgttttctatgttcttgctttgtttacatattggtggccccaactatttatcagcttattaaagacatcaggccactatttgtctatatccctgcactgcctagcagggagcactgcagggactattgaattcatgcactgtattctctgctggcccattgatttcatccttatagcccctgcttctcacctgcatgtgtttttttcacaatttacatactgataaaatgaattcttgcttcttgctcatgtaagaatatggaggctgggcacagtggctcacacctgtgatcccaacactttgggaggccgaggcaggcagatcatgaggtcaggagatcgagaccatcctggctaacatggtgaaaccccctctctactaaaaatacaaaaattagctgagcgtggtggtttgcacctgtaatcccagctatttgggaggctgaggcaggagaatcgcttgaacctgggaggtagaggttgcagtgagctgagatcacgccactgcacttcagcctgggcaacagagtgagactctgtctcaaaaaaaaaaaaaaaaaaaagaatatggaagttataaaaataatctgtgatcatataatgactgttttccccaaaaagggcattactttcctgcttcaaagtatgtatttcttaactaaagtgtttgtgggatatggctgcgtgttggcatcacctagagaactttaaaaaaaaaatgaaaacaaaaacaaaacaaaacaaaaaactgatcttcatgtcccagaggttctcttctaattgatgtgggctgtgatctgggcatagagattgccaaaattaccccggtgattctaacacataaaaatgttttagagtttcttaagtactttttttcctgatgagtttcaagagggccactttttttttctggaagattattttcagaaacacctagcccttctttatttgtatctcctgtagatgttttccttctgagtttttctctgtgaaacaagaaaatataatgaactgtcatttgcacgttgcacaaagcatgaactttatttggagtcttagataaacttgttctgatctagaaatgaaaaataatgaactctgctgagttctgcatttcctgtctgaagttagctttaccataaggatctggtgggtaagtgtttgttgttcttgtcattaattattggaacagagttgtttggagtagatgattcattgtggaacaaatcgtctgattttgagggacattttccattataaaataattatacataaaaacagaagtattgctttaatactaagatttgtaacaatgccatgtcattctggttgtaatgactctgtgtctattccactggtttggaaaataaaacagattgatttcagtcatatgaagatacttgaaaataggttacatttaatcaattagaaactagttgtttctaacttcactaatcttgtaaaaagaattaattccaccccactcctaaagttagtagatagatagatatcaccagataagttcctaaaatatacctaggaaatagctctttctcaaataatgatggtgtcagtaagtctaatgtaagtccattttattttaccctttctttaggttctgcccttgtatcttagaataatgaaatatgaagtgaaatttggtgtcatggtttacctgtagccattttataatttagattcatgggtttacattacttactgaaactactggggaaacattaacaacacaataggattcctagattgataaacttcaacactcaagctatgacagttgttctcagtctcgtctttgattcaatgtaaaaatttggacaagttaattagctttcttttgctgcgtgtataggggcaggataaacttgagaattcccacaattattcaacccagatcaaagatatttgtctcaggaaatcaacaatattaagaaaaatggctttttgaaaaaaaattaaaaaaatgtttagcaccttcaaatatcagattcacatcctcatcatcctcacttagagattttaaaactaatagcaattttgtatggcacatttgcatttacaatgcatttttgtacacattctattttcccctaaacccagggagactggaagagcaacaatttacatatttgcgtatttttagaaagtgagtcttagaaaggttaagtgactaacctaggctcaaacagccagaagtgtgtggaacaaaggcaccacacagctttgctgactgtgagctcactctttctactcctccagctatgccagctatacaatagcaacttgtgagaggtgttaggtgtgagggatagtaggggggtaggggtggggaggggaagaggaagcaaagtcctcatactgattgtatttttatcacttttctaaaggattttatgttttacagcctatttgtcattggtggaaatatctctacactggtgctataaacagcaaaacatgcacttgagactccctgcaagcccatctaagttttaagggtaattgagaatagcagcacttgatacacatatcttcatttactatatagtgtgatcaattattttccctgatactaagggaaaattaaacatcttttcattggttgttgcatttctttcacggtgtttttaatgcactttgcgagcttttgtagttctcaaaactggccactagatggtagtgtttagttagtattgtcgcacatgttccattgtgggaactttgattctaataggaaacatttcatatataatactgcactgaaactgtttccccagtggctgaggcacacgataaaaactctgtggcttgagccttctttttcttttttaatgactagacctcccttcattcaacacagacctttcttccacatactacttattcagcaattcatttttctccccataatagtctttttaaacaccccacagtgagggagtgttaaaagtcctgcctttcgtagaattttgctctaaacttctgagaggtaaagcagatctggtgccaagatgatgtgttctagggaagtacaaggacaatagacttaaagacctgtgctgccagcttgtgaataattgaagatttgtatctcgaagtaaatttcagagtacccctgtacttccttgggtatctaaaccaaataagacagaagttgtagttgcctggtatagataccacattgccaaaattttacagtattttggacaatccaatagatgtcttctctctgctttgtttaagccttctaatttccccagcaagacaaagcaaaacaaaattaattcacacagcctgtttgcatgatatggtccgatggtttactatgctatgtttgtcattagtcacccaagcacagaatctaaaagtcacttataaccatttcctgcccccccatgactgctgattcttccaaaaccataaatctcctttactaattcacttgaataaccaaacctgcatttcaggttctcattctttacacacccaataaaaaatgagatgccatctgttattttattcattaagtcaagttctgtttctcatgttctgcgggaattcttcccatgtggttttactgtttgtttcactttcttcaatttccctcatcattacacataagcatttataaaatacctcttcataaaatccactccagtcattctctgcagttaactccaagatctccaagatcaaaacagaccccaaagttgtcaatgaaactgttcacttgcacagtgcaggggctgggggtgtggttacttgggtgtgtgaatatgaactttcggttgtctgaggacaacaggaagccttgtttctggttgctatcatattaaactttagttaagatttttattgtttatgagatagggaattttttcccctgggggtcaactggggtcaccctatttcctgagggctaaataaaattggctgcaatccccatcgtacagattgtgaaaagttctgctttctctccaaagcttttatgaatccttgatcacaccaggccccacatctctgcttcagccaaattggttgcgtttaggagttctctcacagtagctgtcatcatctcttttttccataccacagaggctcaaggtagaactgagccccttccttagttttcccaaccaccagccttccctctgccccaacaaaacaaaacttgttcacacatgggatttctgcattgtaccacactttactgatggtttgaagaaatggaagcaatgttcaccataatgtgagaagtgactgtgtttagactttcatattcttaaaaagtcagttacccagtgatttctatatggaaggtgttagccttttgctaggtttgcttgggttttttctttcattcctacccttccgtacctctcctacttcaaaaattgcttataggaactccagatttttcttacttaatggcatttagtgctttacgtctctcctgctccatccaccttttaactcccagaactacgcaagtgctcagcagaacaaaatgggctttcatgtaatattaccacaacttgatagaagatatttttggttataaatagcttttaaaaaaaattttttggtgattacatgtgggtacgatgactaaattgaattttgctcttcgtctcatacacacaaacacacacacacacacacacacacacacacacacacacacacaggcatttatatatagagagagagagatggagacttgttctgtcatcccagctggagtgtagtggtgcaatcacagctcactgcagcctcaacctcccaggtgcaagtgatcctcctgcttcagcctcccatgtagctgggattacaggtgcgggccaccacacctggctattttttattattttttgtagatgcggaatctccctatgttgcccaggctagtaactcctaggtgtaagtgatcctccagactcggactcccaaagtgctgggattacaagtgcaagcccccatacccccagccttctgctcctatttgacctagaaattccatatagtagccatagcattcattcattcaacaaataattattgaacacctacttgcaaaaaggaattcagttcctattctgttggggtgataatctagtaaataataataataataatgaaaagtgtccatgcactcttctaggctccaataatccctatgaagagagggtatgcttaaacaacagatgcttattttctcacggttgtggaggctggcagtgtgagatcggggtgcctgcatagtggagttctagtgagggctggcttcccctatgccttcacccaaagtttatgtgttattaatatcagcagccctctatctctggatgtctctggtgccttagaagacatattctctacagttaaagagtgatcctcaagaacggacagggtaaatatattttatattgctaaatgcccccatttgaagggctatataccatttcatgtagcaaggagcacttaatggctccagcagaacaaaataactctacagaaaatttttatttgcccaaagcatctaacgagctggtccttccatgcatgtggtggcactcttgtgaactgcttcctgagatcctcttagtgcaaagccaacaacattcagtacatttccttcacttgccttttggcatgtccatgacaatatttccagctgatctaacttctagaaaatctatttcccacaagcaacaggtcttctattttcctgcttaagagtgtttatttttgcttttttcagcagcttcacaacttctgacttggttgacttttttttttttttttttagagagaatgtctctcctccatctgcgaagtgctgcattttaggtttgatctgacaatttgatgcaacggctcaggtatatatgacaaggaaatggaatttctatcctcgaaatcaattctgaacaataaaagctgagaggataagtttattcaaaggtgatttggtattgcgacaggctgctccaaatcagaactcagcaacctgattttgaaaaatttccaagttcatgaaaagaatcactttgtacataagggctttctacttgtttgggtttgagcataactagatagcttagtgggatatccatattcttgcatttgatgatcacatttggcatctaaatattatgctgttttcaaatgaaagaaatactgctgaataagagagctagaatgaattacatacaaagaaaacttaaaataagtgtcatctaagaagatgaaaaagcaaacaagtacatatgttcttaacttttgggggcttgcctttaatttttttaataaggcaattatctgctattagtaattataataggagctaaaatccagttaatagtcactgtgtgtgaaaccctgtgctgagcaccccagggtatggcctccaagaggacacacaacactctttttggagaaagctgaagacagtgggggcagtgactgaaggtcacggagttggtaaaaggcagagccaagctcaaacccacacagccacatacctgcaactgtgttgttagcactgcactccccagttaccaaagccttgtttattttccagtcctaaactctgcttaaatgtgcatgaagagtaatttcattttttttccttttctagactgtaaatttgtataattggatttctacaggcttttgtgtttctggtgagattcaaaatggatttttcaaagttacgatattcagtgactcctataatctagaaatttctcccaagacaccagacttcctccctgatcttttgactaaaagcctggtccccagctgtattcatttcctagggctgctgtaaggaagtatcacaacctaggtggcttacaacagccaaaatgcattgtctcacagttctggaggccagaaatccaaaagtaatgtgttgtcaaggttgtttccttctgagaaccgtgaggcaaggatttgttccaggcctctctccttggatagccgtcttctctctttgtttcttcatagtgccttcctcctgcatatgtgtgtgtctgcatttccccattttataagaattcccctcacatcagataaggcccactctaatgaccttattttaactcgattacctctctaaagaccctatttccaagcaaagtccctttctgaggtactggggttggaacttcagcctatttttgcagggacacaattcaacccatagcaccagctctgaaccagggtagtgcatggaggtggagacctagtaccgtgctaaggaccccagccgacagtgtggtccgaggcaagtttcccttctgcccaataggggattggattgactgatttctactgtaatatagtacaagtatatatagtagaagtatatatatagaagtaacatagaattctatttttatagaatggctgtaatttatttaataggttttctcactgaagtaatttcataaaagtttttggaaagttggcttcatccttctactttcatgcatttgccgcagagattaagtgtctgccaggtattctttcagcgtgatccaccggggaacccacagacccagcctcctcccactttccttttccttctgagatctctttattcttcctgttctgtgtccaaaaagaggaaccaactgccccctaagtctatcctcacatatagagcctcttacatgacaggtgtcaggagaaactaaaaacgattagacttagaaggagctaactattaaatggtgaatgctcaatcaatattcattaatcaggaaggttgaccattgactttaccctctgtgacttcactggctctttcacagcaacgattcttgagaaaatacatggccaagccttacattagctgatctagttttcagagccccgctaggatatgagtcctggtattgcagatgaggaaacagggtctcacagatacacagaagctcctctgggtgcacacagtgagtactgggataggcaaaggctgaactcaggcagcttctctccaggatccaccctgagtgatgagctgtgtcccaggctggagaagagccatgctgcccactgtctgggcctatctacaagctctttcattcattcttggatttttccagctgaaaaaaagtgttatatgaaggatcagagatggcatcttaaacttttttttgcacaattcatcattaattcactgttttttaaactgttgtcacaaagagttgttttgaatgccttgatgaactatgttttgtttgttttattatattttcacttgagatttttactgtgaagcatgctattttgaagacaaaatttttaaaaatagagaagggcaagaagaatggtggacaatgcaggaggtgacaattggtataattacagtaaacatttataggtcagtggaacataagccctgagggaaggctctgaaagcggacctgcaagcaggagggagggagggaaggagggaggcagccctcgcaggctgccgggaagcaccagggatgtcgtgcctcactgtgccagcctcacagatggcatctcagcgacatggctgttcttttgtcttttcttcatgagcatcttagagaagcgcatttatgcacatttctacctacaaagttttgcctcagtgtgactcatcttctttctgtctcagataggattactcttcaaaggaaagataaaaaaacaagttctgaatataaagatgaagccaactgcagggcttgttgaattacctcagagatagctagagttgtctgtgtgtgtgtgtgtgtgtgtgtgtgtgtgtgtgtgtgtgtgtgcgcctctgtgtgtgtgtctgtgtatctgtccatgtctgtgtgtatgtctgtgtccatgtctgtatgtgcatctgtgtgtgtgcatgtgcctgtgcatgtgtgtctgtgcatgtgtgtgtatacacatgagtgcaatgtcccatattggcaaataccacatggtaacgtcctgcacgccacaggagctgtatatatgagctgtattttcatgatggcccactgggatagggattaaatcagatgatcaccatttatacctaagtagtaacacttaaaaatgcaattgctctctgtcaccacggcttaatctatgagcccctaaggggaaaaaattcttacattaaaaaagccatttcatatatagataaatgttgaataggcaggtgttgatcagaaggtctaatccccatccacgtgaaatgaacaagtcaagcagataattgttttactagagctttcctttgcattaaatgtgcctggaaaacatttctaaaaccattcttttctttttggttgaaccattatgaatgaatcttcatcctttaaaaggctagatgttcatgttcaactgttttggcaactgacctaaaccaatattattatgaacacattttggttgttttggttggacattggtaactgccagtgaagttggaggtgagaggagttaactacttccttataatgtcaccacctaattagaataaaagcatcttagattaaattctgatttacataaggacatttattaactaaacaattattcagcaggcatgaaataaacaaatcatatgactagttctctctctaggtgcttggccaccgtttgcaagcttcccttaaggcacaaaatccaaaattccagagtcaatatttcatcatcactatagacaaaagtttgtggtattcacagctggacgctggacatctcccaggacgtggttcctgagtcattctgcctctgagtgtgttgctcccatggaaatcatgcacctccacggaactcactcaggctcctcggggactcctgagtctgcagtcagattgctagtcttgctctgatttcctacctatcggacattccatttgactgtcttgccactgaactcaatgggtgtaagctgactcttcttccctgcatatcagcatcctcctgacttccccacttctgtgaatgtcatgatcattctttctgccacctaagcttgaagcctacagtcattttttaacacagccaccttcagctccaattccaattccaatcagtcactcttttctcaaatctcccttcataccagttcctgtccttctgtctcttctaccctaagccagagccatatctctgcagatcaagggcctttttgttctgtttcttccccagtcaattagtttacatgatgccaaacccatcttcttaaaaccacctggattagatcactcctctgtttgaagatttccaaagaggccttattttgtagtggaaaatgtccaaactcctttgcatattcacttattctcagcatgcttttaccaccttgcgttcttctccttcacggcacaaacctctatgccagctggattttccatccataatcccccaaatacatcacatgcattgttgcattggccacccttgttagtgctttttccatgtggtgttcttactttcctccttcactccatgcccacttcctcaaaacacacacacacacacacacacacacacacacacacagcttcttggagcctcaaagttggttgctagtattttaagtgcccggaatttgaaatgaaaaaaaataaaagtaaactggttttaaatgtaggcgttgccacgtattggttctactgtggcctcagacttgttatgaaatatttccaagccttagcttccacatgagtacaatgggaataatgcctaccatcctattgcccatccttaattaatcttagttccgtttctgtgccacgtttcctccccagggaagccctttatacccttactactcatggatttatctcttctctgagcccatagaactgagttctgttgtcactgctttagtaaagtcaccatttgcttgtttaaggtccctcttctattttcacttattgtgtttcggagccacacattgtatcctatactagactttgaaaatactttagttgcagtgcattatttttgtgtagtcagagtacccagggcagtttctcacacattctctcgttttgtctcataacatcccaggagctggatataatctgtgatttatgaggagagaaagtgagagacagaggtgtaagtgagttgcctaaggtcactcagagagtgagtggcagaagcagcacttgaatcaagtcttaggattctaagcccggggctgtctgctccctcctagacctgtaactttagaagcaggaatttatttcatattgcttatatttcagtatttatttttaacccttacagggcccggtcttgtgactgactgtaattgagaaggtactctacaaatatttttgaaagaataaataaaatgaatactacagaccatgttaataatgtcaaataactctgggagtttgagggataattctgtcaatacgagttgagggtgtgcttggcctctccatcatttaccctgcttttatgagggttagcagcacaatgtcttcattctaaaacacagaatcatgaggttaaagaaagcatgcaatgccatcagctgagaagaaccagaattcacagtgcaggttctctaaagtggttttgtgttgctctcagcgccgtgaactcccaccattatattcatagctttttagcctttggctaagatcaagtagagtgtttgttctcctggcttttaataagtaatgtgttctccatccaaggacaacatatttaggctgtacatgcattacgaagtattaagctcctgtaacagtaaatttctcaacaggagatttatgtgaattctcttggatgttattctgttgacattaggaacaattaggaatataaaatgccatggcagatttttctgtgatgctggacgtactgtcaggactctgagtctgtgtactcggaagtcttcctcagacagggacaaggcgcattctctttcttaggaagagaattaacagtgcactcccacctccctgtgctcaccacatgggcacacatcccagggcgagggtggagtgagctcagaagaacccacgctgagcacaatgaaagcaaaattattatcagagaaagaaacagattgcagcaacctgggtttaacaggacacatagtagtagacaggaagtttttcgtgatctataacacattttcatattagggtcatgttaatttcacaatgaattgcatattaggctcaattagagaaacaataaagaaggaagacgggatgacagaaagcattgaagaggaggaagcagaatggaggcagagggtggaatcaaaaataaggacaaagagaggaaggggaaagagaaagaaaatgagaagtaacgtcagcagctccgtaggttctgaggtgagttagctggtcgtaggtcaacagctttagtcacacatcctgttattcactttgggcatcagagcacattttcactaccctttgaaatttccatacagtctacagcgattttgtagcaatctttctttaccgggaaattgcttatctgcttttcttttcaatctttgaggtcaacttattaaaggctttagtttcacatgaagcccgaaatattttgaaggtaagaaaaaaatgtgcctttggtcttaaatatttccacttaaatcttgattctgggctactttaataattccaaaataagagtgagtggcttcttttttcaataactgaaatacaacatttaaaaacactcatgtaattattttgctgtgttcagttgtttgaaagtagacaaggtttgatttgacagagctgtgttttaacctgggctctacatgtcactaaactactgtcccctgtaagctcctgtttcctcgtctacagatagaggtactccagtagctctccaggctctgtgtgtctctgtcacaggtttggcataaagtagacaggaatggtgtcagttcctccctccccaaactctctccaatgacactcccaccaagtgcagaaacgtacagaaagaactcttcctgcttttcaacttccattgatcacactgaaagaaatatcacattagcttataaggctcaaaattatcttcagtgctatagctctgtgtactctaaaatcagagcaacataactttggttctggatgaaatcgaatcaggacctgactctactcctagaagaacgctgaccccaaactcctgttttgcagaaccctgaaggagcaagtaaagatgccagccattaaatatgaagaccttcagagacctagaactaatggaactaaatcaaggatttctattttatcttagattaaaatgccatttatatgcattcagggcatagttttcactcccatgaggaatagattcatacctgtataaagctgggaatataatgactaattaaatatactgtatgacttcaatatagccaagaaaattacaatcattccaagtaatactgtttttccccagacacaaatctgaggatcttgaatcttagcactggaaggaatgtagacatcacgcaggctcatcacttctctggcacagaacttgacttgccttgagcacatgtctggtagcttcttcctgggaacatagatgacataacgcatattgcctttccaggcagcttgatctgtcatgagacagctctggccttttagaaaccagcctttatactgagctgtgagcctgcttctctgtattgcacattttttgttcttaattctgaacaaaaagtttttgtgaattttcttcctggaaatggtcttcaccacttgaaacaactgtcatgcccatctgagcatatttcttaggtgaggcttcccagtttgggagacgcttctctcataaaatatttctgaattcatcagtatctctgttcctataaaacgcgtggctgtctacttcaggcaaatcctaaccaagctcaggtaacagtgaagtgattgtttgctgtgaaacagtattgtactgttgaagttaaagaggtctatgattacattgtgtttattttggattttgcattattgagtattttttactttattttctttttgtaaagcccatatcactacctataacaagcttttgataagtgaactttctaatttttcctattctatagctatgtaagggaatctttaaattttgccaggactttctagcctaatgcaacaagggaggttacattaactataataatttaaatttcattagttttttcccacatttgctgaagcaattcttctacacaatctatttcattatttctgggagttctaaatgtgtcccacaggaacacatcccccttcttggaaccactgctcttccaccagaaccagcagctctctggactccccaaggcttattaggtctcattgttacccagggagtcaagcagctatcacaaggccatgctttggctttgtagctgctccaatggatgttaaaatttctcactttgttcctgatactgtacggaattatatgcaacatctctttacttaaaagctctctgcttctcccaggatccagagattcatccctggaaaagcattcaagtgcagctgccatattccatttagaatgcctccttccttcagacagccaaggttttgttattgggctcagctctatgtgcccagctccttcttcagtacaaggagctctctccaaagaggtcactaaatcccctgcaaatagtctttaactagaccttttcaaaccttgtctcttttttttctttgaaatgacactgtaccatgaacatttttatgaaatcattaaacatgttaaacttcatcaaagccatcattttaaagtcttccatgatgtctatcttatagagatacaccatactagaatgcatttttttcatttttctattgctgagaatgttgggttttatacatagcttgttattttaagtaaatgttgtgctttaccttgttcctattatacttttaattcagcctactgttagcatctgtggatgattttctatgcttatatgtcactcaatatattagcatcattcccagcttttggctttacatatgcatttttaagatgtgtctcttaccttttaaccatcaaatcagattttagttgcttgatagacccagcttttatatttcagtttatgccacctctaaggtcgttgtagtgagatgcctatataaaagacatacaaattcaaggagtgaattaaaatctcacttgaaattttaaatgtcactgaatattaattgtggtcgctaattggtatattttctagtaatcacttcaaaagctcctcattaaaaataaatcataaaaatatagaattataagagcttttaggtatagttcaatgatctaattccatccatttatctgtccatctatccttcagcaagtcatttatcaccttccttctgtatattacagatgataataaagacatctgggacaaaaaggtaagtcacagacctacccatgtgtatgggtgatagagtagtgaatacaagtgacaaagggtgtgattccttctgtttgagaggtgaagaaagtattcccaaagcaagtgacattgaatcagcaccttaagataaaacgaagaactcagcagaaagaaagtgaatgggaagatgtggtaataggtttaaatggacatggcatgtcggcaactaaatttctgtagctccagaatattctccccagtcccctgagacgaagttacagagctgtgaatccggtagtgaaagccttggtataaggcgcataagaaatgtgcagattatctaccatgaaatagaggaagaaatcaaggttattcaagtagaggaatgacacgttttagaaagacttttgttataacgttatgggaaatggattataggctggaggcaagagataagacattgtcagtgtgacagaatattttattaataaagcacataatttatactcagatctatgtgagatgagaccaattcatgtcaacatgtccaatgtttttgaaaaaatgctaagtttttattatcgcttttgtttatttccctgtgaaatatagtaggctagccctctatttctcctggcgaaatctttagataggtggaaaaaaaaatgttgaaaaagggcatcaatgacctcttttatcttggttttatctgccttttggaagatacttgattcaaagctatgaaaaagcatctcaccaatcccgtatttcacttggttggacgatgtgtcaagagaacgcctgaggcttcctctgtccgttaacaggccagtcatgagtcacagtctgaacatgaggaaatgttcatgtactttttcatagtcatggcaatgagacttttttgtgcccaaagtactatcctcgcctaaagtccctgttaaaaaggttattttctgccacaggcaggtagcagaatgtcaagatccaattccaagtgcttcatcatcactcggatagcctcaggaagctgaggttttacagctgcctggaacccacatgcttcatgtgatgtagagcagccctgttaattagctgtttcaggattcttaatgccctatggctttggaaacacttgttagcccacagagggaggggaagagctggaagcaattggactacagcctgaatttattttaattcaattcagtaaccaccttatctttctaaatccctgtttagaatctgttgaaaattatagttgatttaagtttttctcagtgatgcatcctgagagaagagggagattacaattcaaggttttctgaagccacagaaatgtggagtgctgcagaaagagctgatcgatggaactttccagacacatgtatgcaattttctaaaggctagaaaatagatgccggggatggggagaggggaggccagttgatgtggaaaggcttgtgtagagtgcccacgagtctgcatttctgttcacctaccagaagaaacactgccagttccccccaccctcaccccccaaccattctcactgcagagagctggcactcaacaaactcataatttttctcaatacaattctcatgacataacctgaccaaccatatgaaacctaatgaagaaaacaaccattgccattggcaacaaatgcaggagttgcatcacaagtaaaccacatactttacttcacaaatttgaacattagagtaccaccggcaaaaacatggtaccatccttcggtatggatgagatatcagtttacaaaaccttcactggaaagtccataccaaaatttttaaaatgcatgcaaaagctaattgtgttgacatctttcttatcagagctattgcaaattattttgtctagaggtggttcttaaaacagccacctgtctgtccactaatcatgtacatagcatcctcttcctcatattcatcctctgaaataccaagaggtgaaagagtgtttcagtagctcaccattcttggctgttacataatgggtcagattcctttctgagtagtaggagaggtcagtgatccagatctatatatctttgtgctttttccactaatacattcttagaacctagtaggtgctcaataaacgttagctgtatgaatgagttagtgaatcaatgaatgaagtgttaatttttagaaatattatggtcagaattttactaggaaaaacatttcttataatcacaaatgaaagctaggtttactcaaaattgggaatagtaagtagtctttccatttcccataccacaggtatgcttgtattcttcttatatgcttatgaaagaagagaatgtggattaagttataaactatttgtacatgatattgtatatgtaaaaatcatgtcagttttgaggccaggatttctttgtattgagtaaaattttcctaaatatttgcccattgtattagttcattctcacattgctgataaagacatactcaagactgggtaatttataaagaaaaacaggtttaagggacttacagttccacgtgactggggaggcctcacaatcatggtggaaggcaaaaggcatgtcttacatggtggcagacatgagagaaaatgagagaaaaaccatgaaaaaggggtttccccttataaagccatcagatcttgtgagacttattcactaccatgagaacagtatggggaaaattgcccccatgattcaattatctcccaccaggtccctcccacaacacatgggaatcatgagagctacagttcaagatgagatttgggtggggacacagccaaaccacatcacccattttaaaacaggcttgatatcaatttattgctagaaaactataatttgtattttcttttacatttttaatgactgattgtacatttgttccctcaaaagaggctctccaaaatactgcctaattcctatgttaatagcaacccaaacatgttttcaatactaatattaaaacaaattagcttaacaaatacaaaaggtaatgcctggtttatacaatacggatttgagaaatgcaggtttcaacctgttccacaccatgcccttcattatattcttctgccagagattttattctttacttttcattcaatcagaaagaattgagaggaatttgaacccattctgcctatttagaatatcatttgtactgactttaatcttttgctcctaatccatgaattcctgaggtcttttatttacatccataaatttgaaaagcacaatcccctttttttttttaaaaaaaaaaaaaggaagttacttttgggaatcagagacatgtacctctttgttctcttggagagctgtgggttatgggagggaactcctcatcctgtttcctgatatgcagtgacttctctcttacacagatgagtcctaaaacctttgtgagctcagacaagttggctggttttatttttatttttttatttttgagattgtctcactctgtcactcaggatggagtgcagtggcccaattaccaactcactgcagccttgaccttccaggctgaaaccatcttcccacctcagcctcccaaatagctaagaccacaggtgcacaccaccatacccactaattttttgtagagatagggtttcgccatattgcccaggctggtcttgaactcctggtctcaaccaattcacctgccttggcctcccaaagtgctggggttacaggtgtgagccaccatgcctggccaagttgcctggttctttacatggaatgttctttacatggaatgttccaggatcaattaaacacagataaataacaacttatgttttgtaaataaacacatctgaatggaatcttactccaatttagatagaaattgatatttttcctttcaaatgaaataaatgttttagactaggacatcccaagtgaattgaagattggtacaggagcctgaggaaggaagtttaagagagtgaaagcatgagagaagagccaagattatgtagcccagagaaggaaagaattattacctaccattactttaagggactgtgcttcctcacagtagtggaagacagatgctcattttttattcaagactgtgtaaaataaatggccttaatttatagatgtggatgctggtttatatcaatacacctcaacctgggatggctccaaatcttgactacacatgggaataacttgaggagttttacaaaaaaactgatgcctgggtcacaccctgagagattcttatttatctggtctggggtggtgtggcccaggcactgaaatttataaaattctccgggtgattctaatatgcagccaaggttaagaatgcagctgtacagctgtagatggaagaataccaaaaccaggccttctgctagtgcctgagcttctcctcattttagtttctgtgatgtgttcagacattgtttctagaatctcctgggtaatatgagttatagtcctttggatggagtaatacattaacacatccatactcacatagtttggaaggggccaggatgcaaagggaagttggaggaggaagagaaggaaatggtaaagtccaaagcatgggtgaaggggggccaatataaacccacagagcaaaaaggagatgttgggtcatcatattctattacataaattggatttacatttccttgtctttcattgctggtctttattcccacaagtctccaaatacagtcataaaattctcatgagttgttatagcaaaattgcttatcatttactatttcttaaatgaatgcataaactgtattactttggcagaaaggatgctgctgggtatcatatgtaatgtatactagtaaggtggacaggaccattaggactttaaattcctttataatctcaaaagtctgtgattctgatcttcctggtcttgcaactccagaaaaggtggtaatcactggagtaggctatttatgggcctgtgagatagtgaaacatgctattaagacaaaatgagagacttccttctctgaaatggttccatataaaagtaatatatggcttaagtatccaggggctcatgtaatctctccatgtcagtatcttttacggggaattatttaaccaaacatgtattgaacacttacgtgctacactaaaatcccagatttgtcaagttcccgtttaaaaagtgggtactaagcctaagatattagcaatacttgtatctgaaaaggcctcacatctagaaactataaagaacttctaaaaatcaatcaaaacaacatagttcttagaaaatcacaaaggaacaggtttttcagactcgaggatgtctatatggtgaaaaagcagcagtattttagagttggtctgaactgactcacaggaacctatttttaaatgtccagaaatttgctaagcaaattgttaatgcatcaattatctaaagtttaattatgtaaacttcaagttatctgaaaaacataacacatactcaaaactctcatcccttcctaagtgttttactacattctgttatttctgtttgtgaggtcatttgtttattgcatctgtatgatggaaacactgtataaaatgacatgttattcccaactccacataggctgatataacgttggtagcttaaaatcagctttagtccaggtatttatacaatggaaatggaaatcagcatacgccacaaatcaggagttgatttttttttttttttttttttttttttttttgagatggagtgtcgctctgtcgcccaggctggagtgcagtggtgcgatctcggctcactgcaacctccgcctcctggattcaagcgattctctgcctcggcctcctgagtagctgggattacagttgcccgccaccatgcctggctaatatttgcatttttagtagagatgaggtttcatcatcttggccaggctggttttgaattcctgacctcgtaatccacctgccttggcctcccaaagtgctgggattacaagcatgagccactgcgctcggcccaggaattgattttttgtttaatggtgttgactgtctacaaactgattaagaaaatgttattaaagttgtacatcatgtctgcaaccattaaattgtaagtagcacaaaaaatctgggggaaacagtcttctagactttccagatgcagcaaagaaattgccttgttccaacatacatttttattgtttcacttttgtcttacttaaccactaagtaagacatagttcctacataaaccaatcatgtaggaattacactcctttttcaattacaactttggtttgattacctttgtggtcttctgttctatcaccgtctttttttttttttttttttttgagaaggagtttaactcttgtcacccaggctggagtgcagtggtgtgacctccgctcaccataacctctgcctcccaggttcaagcgattctcctgcctcagcatcctgagtagctgggattacaggcacctgccagcacatgtggctaattttgcatttttagtagagacagggtttcaccacgttagtcaggctggtctcgaactcctgacctcaggtgatccaccctcctcagcctcccaaagtgctgggattacaggcatgagccactgcgctcagctcaccatcgcttttagataaggaaactgagccctagagagtggttggctcgcctcaggctccaggacaaatatgacttaatcaaaactatactcctgttctttcattcacataaaactacttatctaaggatgctgcagcaacactgctgtcaggccagaattcagtaagtttacagctgaggccttatctatagaccattgattttgctcaaggaaaaagttacacaaactagcaatagagtcctgaccaggcattacaaattctacactgatgtgtaaaagagggactaggcacaaagaatacatgcttagcacaatctatctttattataggaaaagcaatttaaaacatattttactgagtagtgccagaaaattaccgaaaaagaaagttaatgctttttccttctcaaaacccttctataatgtgtaggcattgtcatattagagagactcctgggaaatgcttggtcaactaaaattgttaaagagctaaaattgaacattgactcagaagcaatgtgaaatacatcttcccatttccaggatggagtgcagtggtgagatctcagctcactgcaacttctgcctcctgggttcaagcaattctcctgcctcagcctcctgagtagctaggattacaggtgcctgccaccatgcccagctaattttttaatatttttagtagagacggggtttcgccatgttggccaggctggtcttgaactcctgacctcaggtaatcgacctgccttggcctcccaaagtgctgggattacaggcgtgagccaccgcgcccggctcactgacgctcttcttaatttcttctgcctaagaaatagaaggtattctcgagggaaaaaaggcattgacaactagtacagggaaattgatgacaacataaggctgtttgaggaaaaaacgtgggatctcaaagactgttggtgggagtgtaaattgaataatctactttggagaacaatttggcagtttctattaaaatttaaaaatgctgatatcttatcagttaatcctacttctaagtatctattattaaaaaaaatacttggcatgtattcccaatgcgttttgcaagaatgttctttgtaattgtcaaaaggtggaaatctgaatgccctccagtagggaaatggctaaatgaaatatgaaataaccatactattgaatactatgcatcagctaaaaatagcaagagatctttgttgagtgaaaaaataaattgctgattgatcattaaatataacactatgtttttaagaagcctcagaaaacagtaatatatgatcctataggcataaaattatttatgatatcacacggaggtctatagaatttattgtcctctatggtagccactagccacatgatgctatttaagtttaaattaataaaattaaataaaaataaaaatttcatgtctcatttctacgagcctcatttcacgtcctaatagcaacatttgaatggtggccagtgtaatggagagtgcagatctagaagaacaaacacaactggtaacagagttacctgggggaaggttgagtttggggatggagggctacagaaactttagagttctgcagaacttttaacatttttacaatgagaatacatcatatattatctagctaatttaaaacaaatacattgttaaaatgaaaagcatgcctagccaaaggatttctttcttttttttttttccgagacagagtcttgctctgttgcccaggctggagtgcagcggtgcaatctcggctcactgcaacctccgcctcctaggtccaagagattctcatgcctcagcctcccaaatagctgggattacagcatgtgccaccatgcccagctaatttttgtattttaatagaaacggttttcattgtgttggccagtttggtctcaaattcctgacctcaggtgattggcccaacttggcctcccaaagtgctgggattacaagtgtgagccactgcactggcctagcaaaaggatttctaaaacaatgtagaattttagtagatagatcagtataaattgatttgaacaccctacctttttagcctgttaactatctaaaagcataaaaaatagtaaaacaaacggcaaaatcatttcctccttccttttctacctgtgtctagtgtctattgaacacttactatattcccagcatttaaagtacaagaatcatgaggcaactgctgtttagactgaagtgttttcaccaggggtgtatcaagaggatttctttgtcataggttgatttcccttataactgattgattaaataattactagttggcttatgcaatgtttatataattacaggatataaatggtggttattagcctaactagaatatatgcctttataatattggtgtaatattcatatgtattttactacagcttaaaataataatttcagaaagaaattcaaattgattttcataatttagcaaccatttgagctcttccaggtcagaataacttcttgggaagccccagaaagaaaagcatatacctgcttttacagttatccatagattgactataaggctaggtattgagttggcggatgcatactttcttaattctttagataataggtcaatagtgtggtagtgaatcttgatggtaagtgtccttcgcatgtttcatactgcacagtagactagactgaaagtcccaggagactgtgagtgtagcaaagaatgaatcttgtatccccagatacacaaagaccatgtcttcactggacccacagaacctagcacatggtgtgtcttattaaatgcttgtagaataattaaataaattacattcagaaaacagtctataagtcttaaagtttacctttcaattatgtaattattacttttaatttataatttattaacagacatagatattcacaacacctgcaaaagagtttatttcaacttcttttttttgtctcatctaaaaagtgtggatttaatatagcaaagtttgcttctagaatggaatcttttagagtgtatatgcgcttttgaaaaaaatggtttatgattttgttatgtaatactgttatataagttattttagaaattgcatgatttattataatatcagcagtgaatttaaacattacacaaatgcctgaatataaagaaataggatcacctgtgtccaagttaattgccttcttttgctgtattcattagccatcaatacctacataatctaaggccaagatacatatggagcaatctatggacaggcaatagcatcccatgggagctttggaaattcaggagctcgagcctcaccccagatgtactgaatcagaatctttatgttagcatggtctccaggtgatttgtaggtccatcaatgtttgaagagcacctgtctggccttcagttgcctttatacatcttcttaccaacagtaccatctagtccaatatttttctgtcctgttagtttgtccatagtctcccaacaggcttctgtccacaaagctgttatttagaggcatggccccatccctctcatagtctttgctaaggttatgtcttttacatttggagatacaccaattgcagaggagggtgaaattagcctgagagcaggaccataacaataacctgattctaatggaggctgttaccagggcagccagtacccgaactaagtcatcattctgctggaagcattccgtttggctgcagttcaacaaaaagaaaaaagaacgcactccagaaaatcaggaaggtttgcattatctatcagctatgttcaaggagatgtttgtggaaagtcgagttaagggttcctggaaacattaatctctggacatgctggaggatgcaggtggatttagagccaggcgagtctacattcacaaatcacattaacatattaaaagacggagagctcttactctgaggagccccatttagttgtattcaacccagctccatatattttttaaatcacaaaatgcttttttttttttcgtgaaacattcattaaaattaggcaaaactcatcttcggtgagacatgctttgtgaaatgtgagtggagaggttcctctgaaattgtctaaaaggtaacttaagccctgatgttttagaaaatttgacttattatgtaacagtgaatatacctatctgtgtagtttcactattttagaagtaaaacaatgctttgatttcaaatattaaattaacttaggcattgctctcccactccatctcccaagctgtgactcagatatcagaacaaattttttacctagttagggaaaaaagtttcccaagtttcagagccataaaagcatcagtaaagcacctatttattgtagcactctcttgttttccatcttcaatttcctaaacattgaatatcttgtttttcatttttcttctaaaagcatttgtggtatataataacaccgcatgaaagtggaagagactatattggctcaggatgcacttgatatttgttttccttaaatgacaaatgaaactcccaattcaacactaggataagattttttttaagttattaaaccttagttaagttatatgacttcatactgggaaagtgagttccagagaagtttaatgaacttgttgaaggtgactttgctaacttattacaaaatggggaatacaactctggtttccctaatgccttttgtaaagcatcccagataaaaatctaggtttcagaagattccttatagttaggtatgaaaaaatgttatttctgaaaatatgatttccttatgagaaaccattgtttagatatgtttaactttagaaaaaatttccaactataattaaaatctatgaattatagacatgttcagtgaaatacactgtctcatagaaaccatattcaaaaaacagaatgactggaacagatgttatgtatggggattagagggaagttatccagttatattatactaatttgagaaagattccaaaaaaatcctttcttgggggccggtcaggggtgggtatagcaaatgaaagagaaagataaggaaatgtgttccttggtgttgagttttgaatagatcactattgtgttatattcctctgaatttaggatacctgttggattttgttccttatcatgtctgttatgtggacaaagacaacaaacgtttgtttcttcttgtcaatttcattatgcacaaggattctgaaggtccacccaagatctttcgtgcactaaatgtctggtgtttgtaatacaatgaacaattttggggagtttgaaaatcttttgattatgaccttgaggattagagatcatttggtgtggatgacttcgaggaagttatttaattttttttttgtatgtcagttttctcagatttaaaatgtgggtaatagtaaccaccttgttagaatgattgtaatgatcaaaacatgtaataatgcaaagtgcttatgcttagtgcactagtgttttgcacttacatctagttatttttttctcagtaattcaataggctaagggatgatctagtacagattgagatatgggatttttgttgttgttgttgttgacaagttgcagacaaaatgtttggttattcctctcactgaaataaaacccagaaatatagggtattataatatgttaaacatttagtggctatcaaaacttattttcttctttgaagtcagagtaatatttagagagggcattctggggtttccttttagcaaaataattagaagtaatttcccttagaatttttagaatgactatattaggaggaaagggaaggttcttacctaaattgtattgcaacttttctctgaaataaaataaacatgctgtgttaaaattgctggtataggccaggcacagtggctcatacctgtaatcccagcactttggtaggccgaggtgggaggatcacttgaggtcaggagtttgagacaagtctgaccaatgtggtgaaaccctgtctctactaaaaacacgaaaattagcccggcatggtggttggtgcctgtaatcccagctactcactactcaggaggctgaggcaggagaatcacttgaacccagaaggtggaggttgcagtgagctgagatggcaccactgcactccagcctggacaacaaagccggactgtgtctcagaaaaaaaaaaaaaagaaaaaagaaaaaaaaaatgccattgtaagttgtgccctataaaatgttaacgtttctttcaagtgaaataatgacttactatttcagcagagatcactctaacatttagttttaatctaggaaaaaaaccccatataactagatttggtctttttattaaaatgaattgatcttagaagagcacatcatatgctcaaaatatagctgtcatgtaaatcaagacatatatttgttttgttcaatgaaatctagaaactcttaaaaaaactgtttactggcttttgatgtttaattgggtggaatgtataagaaatatctgatgaatttttgacttctctattgacttccaagcttatatacagccaatgaacaaacttttctaagtcttgtactctctttccatttctacacaaattcatattgaataggaaatattgaaataagatctttagaatcctcctcttgcaaattatagaacatattaaaaccaggttaaacttatttaaatctctttatatattgtttacccacctaccacgtaaatgttactgatttttccatagtaaaaagtctaaaaatccaatgcatcttacctcccctaaactacctatctctccaaacctctcattattcctccatatgtaccttctttcaagacttaattcaagccctgccttgtttttgagttattctctgtctagataaattattggtcactccttttaacccagaaggcaccaatcatttctattattaatttgattcttagtatttattttctttgttgggagttttatttatattcccttctaaagtagatattttacttttttggaaatctctgcctactagcccagtacctaataaaaggtcaatgatgatgatgatttgaaaaaccatgttctacagtgttcagatgtgcttttagataaggggatgatataactttatcatcaaactttataatgaaaaataatcatgatgaaaatttaagataaaataattttagaatatattatttggctaagtggaaaactatcatggagtttaattaaaatttcttcatattgaaagaagacaggtatatagaggagaaaaaaacataaaaacaaaaaacatctcaggaattccaccttcagctgcccttacttcaataccatgcctcagaaagaacttcatgacttggcaggtttacaggttgactcagtgtatatgctgagaatagccaagggcaaaatttagtgttaactagatcaagaactcaggggacccaggtgtctactgttttccatagaaataaccataaacaattttaaatactagatctgctttccttttgggtttgtataatgtagagtcaaaatagaggctctggcacctcatagacacagatttaaatcccatttatgccattggtaaactatatgacctctggcaagttatttaacctccttatgccctcatctctaaaattgtagtacgaaagcaacaccctaagtatgattgcaaggattaagggaaataaaatgcaaagttcctggtacataattgatatctactaagtgtgaatttctctaagttcctcatatcacataatggtagatttttatttactgggtggttattctgtaccaggcactctcctaaacacttatatcatggggattaacacatttaatccttgtagcattcttttgcaatagctactatcatcatcatcctcattattatcgtcctatttcacagatctggaactgagccactgaaaagtaaagtaacacaactagtaactagtacttctggggttcaaaataaacttttcatttctaaaattaacccataccttcttatccagtagacaacataacctctcccactatcaggtcatttccatggcctatatcctgtggacaatttgaaagcgatttccttttaacccttgtttatctaattagaacatagtttggagaaacatacaatgttttccatagctgagtataaatcatttcttccatccttttgaattagccacatcattgctctctttccattgtgggaaatctagccttgcttgtttgtacctagacaaaagcacactttttgtgtcagaacctgtgaaaatctcatcttccttgttaccacctataaatgattaatgagacaaaacattttcaaggattccaaataatctaaaaaatcccacaaattttgaaaatccacaaagaggtatctaggaaaactttcatgaagttaagagatgttatctgctgttctaggcgtgggtgactttatcaaaacatttcgcccactttcaaatttccacttgttaaaacctgaggccttatttggctgtcacttactgtacagtgtttttcagacaagttcctggcagctaattttaaagagattttgtgaaaaacacaagctgtggagtgctcctgttggaagagcaccctctgaccctctgccttaacataagaaaaaattgccagtctgtccaaacctcacccacctttggttatcttcagaatcttacaatttgtgtttcctaaggcagcaattttcaagcatgactttgaaacactgcaggctttttcaagttatttcaaggactggccaagaattctcaaaacaaaattaattttgtatttttaaaaagcagtatgcatatcatgtatcatttggcagatttaggaggttaacagtaagcattaggaaattgaatcaataataataatgggatatggggacctgtaaagaaactctcaatcctgcttcattacttttaatggcaaaaactgtaattacttttgcaccaaccaaatacactgaaatcctttaacatacaccaaagcaatgggagatctgcagaatgcttttgtccatgtttaaccataatgatcaatgcattttgaatagaatattgttatatctactatttagcttaattgtgatcattaacaaagtgcccagactctctgaacattctacatggcatactatttgtgagaagatcagcatgtaaatagtttactctttgtaagctcttctacaaggtggctaaaagcaagaactagaacccagagtcccttgcattcaatgaatttccctattattgcccatatcattctttcttttctttctttctttctttctttctttctttctttctttctttctttctttcttctctctctctctctctttctttctttctttctttctttctttctttctttctttctttctttctttttctttttctttctttccttctttttgagatggagtctcgctctgtcgcccatatcatttttagtataatctcttcctttacttggtcactaagaatcacttttctctacttagagccagacatttaaatatctccagcctccaagatctcgtctgggtacttgggctgcactttttcatgtcaatcattttgcacttgtcatctatcctattaggctataagctccccaagggcagatatagagacatagtatcaagctaacctttttatttatttatttatttatttatttatttattttgaggctgggtctcgctctgtcatgcagtctggagtgcagtggcatgatcatggctcaatgctgcctcaacctcccaggctcaagcaatcctcccatctcagcctcctgagtagcctgggactgcagacgcatgccaccacactcagctattttttaatgttttatagagacggggtcttgctatgttacccaggctagtcttgaattcctgagctcaagtgatcttcctgcattggcctcccaaagtgatgagattacaggtgtgagccaccacacctggccaagctaatctttaaatatcctagagcacccattatagtgtctggcaaaaaataaatgcccataaatgtttgttgaatggaactgagtcttcagaaactagagattttttctaaaatatttttttttgccatttcagtttaatacatattagtttttctcacttatcctatcatctgaattttttatttctttgaacctgaacaggctttgtgtctacagactgctgagcctttaattttgttgtcgtttgttttgttttgttttgcacaaaactaaaaacatgtacaaatacatttttaattgcatttgttcattctagtttttactcgtaaagtgcacttctttcttttctttctttccattaatttctgaaccttcccttcttaaactttacccagagttttctcatcatatacgcatttcattttcattgtacttttctgcatctgactatttcattttccagttgttctggtatgtttttctaagtattgtccaatcctttccattaagttacaagctccttgagggcaagcattgcacacctgttttgcacaacttctaaggccgttcagtccctcagcccactgtatagaaatatagtatatatatagacaatacacacacacatgcacacacataccttgccacttaatgatgtaaagtgacaaaaacttttatattggtaaaaattatgagaataagaataatcatatcctgattcttcaaattcaaatatttgtctaacattttttgatgaagtcatagcacttatgtgtcattgaattgttgtgggcatgctaacaggaaagatggaccaagtggttgaccctgtccttctgtgaatagaacctcagagtacacttttctgtaaacatttaaaagacaaggaattggaacttaaaatggagcaaccaggggggcagggaaacagaataaacttttaaaattgacctaatagtaatcataggaaacaaaaagaatcattccagtctccatttttttttttctggatgcattttgtagctccctaagttattgggtttttaagaaacataaaatattcctagatcgttagagatgtgatttgatttcaatcccacatggtctgtagcatcactaagctactgggaacttccctatgcaaaggtttgagtttctttccaatgctgtttaatgtctgcacttctagtgtccacataaatgagatttaacaggctttacttcatactttcttgttacaacatttttactttttttccaattgcaaaattatttcttttaagctctctgaataagtttgttgaagctctattcatcacacataaaaatcttacattaaaaggcaataaaggaaatcacgaaaagctagatgtattccaccctcttatagttgaatacataaaattgtatatatcacaaatagtaattgaaactactcttatgaaaactatctgtccttctggaggggcattagtttaaatgcaaagagaaaacatatcatttgtgagtctaaatagtgttgttagttctttgaaagggccctaattaataaggttgtagaacacaactgcaacctgtaaagcgttccatgtgtagtattttgaaaccttttgtttgtttgggttctaactagagacagagggagaaaaagtcaatttcattctcatgggatttgtcttatgtggttcatcagattgagtttagtaagcagggaagtatttctccttgtgtagctagtgcttgtttattcttcccttattaaaaaaaaaagagagaaaaaaacaaaggattggcatttttcttttatgaacgtggactgtagggagataaatagccctgcgggagaggaaggtcaagttcaaagtttttctttcctttggattcaggaataagcaaatggaaagactagccaaacaacccagcagcaggcatctgatggttaagccctccccccaggactttttatgtacataagcagcagaagtcactcgcgcagctgcggcgcattagttccaatagtttaacaggctgctttgtagcacggacaaagccgtgcgagcgcggtgctttccctccttgttcatttgctatgcgagcttgtcagtgatctttggcaggggcttgggagaggaggggtgacgtttaatacgcttccgcggaggagtgcgctcgcctcctctgcacccagccccaggctctacagagagactgaggcaggcgactgaatgcactaacagcagcaggctcagacctgcttccctggacatttccgggaccgtgagcgagggaaccacgttgccctggattcttgccagctgtacaaagttgaccaggaaaatggctcagcagacaagcccggacactttaacagtacctgaagtggataatccgcattgtccaaacccgtggctgaacgaagaccttgtgaaatccttgcgagaaaacctgttgcagcatgagaagtccaagacagcgaggaaatcggtttctcccaagctctctccagtgatctctccgagaaattcccccaggcttctgcgcagaatgcttctcagcagcaacatccccaaacagcggcgtttcacggtggcacatacatggtaaggtttgcgcagacctcgcagaaatggtggccgtttcccttcagggagtcctgctctcgcgcctttaattttgggggtagggagggaggaccatcatcattcctcaccggggatttatggccaagtgatctcccttaaccataaatcccacaaatgtccaagtcagggcaagaatcctggagactggtactaggagtggttgaggtgggtggttctcaaagttcaattcctattgcaagttcctacaagaaaattggatgccagatgtcaaataagaatgcagttttattcccatacgtacgtagtggcgtttctttgattccttaaaccaatttccctgccagcttccccaacagctgaggaaagaaaggaccagaaatgaggggaggaaaatcatagtttgctctgttttctgcatgatccccacttggacagagacacatacagtgtgtgtgtaatggtggtgtgtcttcataaagcccttcctcactcctgactttgatatacagtattcataatcttaaacatgcctttccaaaggaaagaagaaagggattaggaattctacgcagaaagttgcaggctggtacttggtagtattgttgtgttctttgaatttggattgttagaacattttgccaatctttttattttctttgtgaatatttttatcttctttataatgggtgaatttgtttcatgcatatgcttccatgtatttttctggaggattcctcatcttttcctgctcttggaaaaaaaaaaaagaagaaaaacccaaatattaaaacagaccatcatgtgagcttatttggagtatttggagtttctgcctgagtagaggccattccaaactctgatcagtgagtccaagtactagggtctatgttacacacttagataatttcaggtagtagtaggttctatacattacatctacattttgataagatgagtataaattatgataaagaaaacataacaaaaaagaatgagtgtgttagttgagaaactgtatgactaaataattttttacagttttgccataactaactaaacagtatgtacgttagcaatgggagggaaaaaaaaagcagaaacaaggcttttaggaggaaagcagcaaaaagtaaaaggaattaaaacctaaaccagtgacaagaccgtgctcaggaatgcattgatgttatagatgaaagtcaatgacaaaggaaataaaagccatgtcacacccaaagacatgaccaacctcaaaaatttggttttaagtagctagatctctgactgggaaagtgttattgtccccaggattttaacacctagatggcatttctgagtttggtagatgtaatggccataagaggagtgagacaaacattgactttttctgtcttaaagcagttattgggaaatgatggcttctctttgaggaagattttctttttggaaaaaattgtgagcaacaaacagtgaataaaagaaaggcatgaataaacactgggagatgcactgaaggagaaggttggctcaaggccaggcatcgggtgccagagcaggagagctggcatgagttcctacggagccaggaccagaatttccgtgtccagtgtcccttttggttgcgctgctttatcactgcagttcctaaattgcacccattgctgaatgagtggccctcaactcagctgtttgatttcagtctgagtggagcaacctagagttcagctggaggttatctgaactatttagacatgtcgggatgtaaggaaggcaggaaatcccatgaaaataggctttcttctgacatttctggcacttccttttctggtgctgtttggaaaaacttcatgagcacaatttctatcaatatttcattttagtgtatcaggtcacagcccagtaagaaaagcataaagagagcaatggaaaccagaaataaaaatcatggtatcgattttcagtaactcagaaggaagcagtttcccctatggactaaaactatcaggcaagggagttggaaagagtatctcaagttttccatattggttgaatgagccccaagacgttcataatatccacaggcatcttttgacaaaaatctcatttgtgctttcacagtttgtgctaagcactatggagaattttgaaaatatgtttcaaattgttctgacataaatataaatatatttgtatctaatttgttgctagtacagtgttctgcctcacagtttcctgctcctggtattcccctccattcgctatgcatacacttaatacctactgagtctaacatgtttattctgtacctaattattacaaagttgagcaagaaccatttgttggtttccaataatttataccatggtagaataaatcaataatattggaagacatctgttttagctaagataatcttgctgttctacaaaatagtctccaaatctcattggattgacacagtgaatttttatttcttgcttctgctttttgtggggaggcagcctgccctagccactgggtgcctcagggacctggaattctaccatcctgtggttccattatttgcaacatgtgattcccaaggttgccaggctcagatgaatcaggagaaagaccatgaaagaggatggtatgtgtgaacttttatgagacaggccgggaagtgcacatgtcacttatactcgttttcttctggctggaactcagttctatggccacatctaactgcaaaggaggctgggaaacatagctctgttccaaggcataaggtaaagtgctggtggctaatctatcttggttatatagtatgttaagggctatctgatttaccctctatgccatggttgaattcttagaataacatctgtaataacatatgccattgttgaattcttagaataacatctgtaataacaagtccttgaacctctcgtcaaacctccttgatgaagattatacagaagcacttctgttgtttgatagggctgttgattggaaagaccttgcttctaaacagtagaagtctccttccctgcaactatcatccatggatccaagatctgctttgggaatcctacaacttgaatttttgctcccttccattatgaagccctaaggcaagtggcttggagtaacccaccagagaaccagggccctattcattcattttggtatacccatgcttggcatgatggctggtcaatggtggaagcttaataaatgtctgctaaacaaattcattaatcaatattttagtgttctcatgctcttaaaaaagacttctcttgggctaagcatggtggctcatgcctataatcctagcactttgggaggctgaggagggcggagtccctgagctcaggagtttgagaccagcctgggcaacatggcgaaacaccgtctctactaaaaatacaaaaaattagccaggcatggtgatgtgtgcctgtaatcccagctccacaggaggctgaggcacgagaatcacttgaactcaggaggcggaggttgcagtgagccatgattgtgccactgcactccagcctgggtgacagagcaagactctgtcaccaaaaaaaaaaaaaaaaaaaaagggacttctcttttcttaagtaaacatcctgttatttcatttctatatgctatatttaccaggtagtttttatctagacttctcttgggttttcatgatccatttaaagaatagctactgaattgacagcatactctaggtgctatgtcactcagcaccaaagcagttagaaaagagactaaacttaaattcttactttgcatttagtaattgtgtgactttggtcaagttacttaacgtgtgcttcagtttccccgttagtcagttttctgggaatagtatctattgggggttgtggtttaattaagtacaattatgtataaattaagtggtttcacagggctggacccttagtgggtgtcattataagctagtattttttttattatgtactctgtgcccattattccagccttggtctgcatgaacctttaggatcatgtttaaatttctagatgattactctgtcagtcatttgtggatgaattagagtgaagagacaagagttgaaagaaacgagtgtatgtcagttttattactgtaggaaaggagaaggcagaaatgagagatactactgaggcagaactgtggggtttggtgtctcttctctgcccactgcaaaaatacatctttcaaattcctggttttcctaaaaggttcctccagttctcccaactggaagtaatccgttccttccttcaaggaacagatttctattgcgcctcttgtctctgatactctcaatgcttattagtaatagttttatcactagctagtatgtgttgagcactggttttggtctggcaccatctgttaggattagaattctcttgtgtctctgcttttcactaatctgtttgactgcttttactaaacatgcaatgccttgtagttctagtgattatagacatgattcagatttcatctggtaggggattccctctatcatcagcaggaactacaaagtcaatggaatctctggtgaagaaaacttaacttccagtactagtttatttcaggaaaattgaaatcaggaagttcttcacattcttcaggcttttctcgtcattgaattttaagcacagttttggggtgtaaggcctaaataagttttagaagaacaaggtagaaatgctggttttcagtctttgggaacttaaaagttgctgtttagtcatatttaagtcataaaacctgttatcttcacatattcttttaaaaagtaatttagcattataatcacttaagttataattttttcatatttttataatacacatctatatatccacgactcagatttttttttattttttattttattattattatactttaagttttagggtacatgtgcacaatgtgcaggttagttacatatgtatacatgtgccatgctggtgtgctgcacccattaactcgtcatttagcattaggtatatctcctaaagctatccctacccgctcccctgaccccagactcagatttttaaaatgccaaaattttgtcattgtttgcatcagttcttttatttttttaagaataaaatgttacagataatgtctaaagctgtcacccatcctattcttcttccttcgcagaggatcctgaaatcagtgtgttcttccttgaatgtcattgtcttttaacttcatatgtatgtgtcctgtttgtgtgtttaccattttatatatagagatggtacatgtatatatatctccataatatgccatactataaaatgagaaagagcaagctatatatatatatatatatatatatatatatatatatatccttaagcagtttgctcttttttagtacgtagtataggaatagagttgtgaatatatatataaaatatgtgtgtgtatatatacatatatatgcatatatgtacctatatacatatattatatatacctatatgaacctatatacatatatacacatatatgaacctatatacacatatacacatacgtacctatatacacatatacacatatgtgtacccatatacacatatacacatatgtacctatatacacatatacacatatgtgtacccatatacacatatacacatatgtgtacccatatacacatatacacatgtgtacccatatacacatatacacatatgtgtacccatatacacatatacacatatgtgtacccatatacacatatacacatatgtgtacccatatacacatatacacatgtgtacccatatacacatatacacatgtgtacccatatacacatatacacatgtgtacccatatacacatatatgcatatgtgtacccatatacgcatatgtgtacccatatacgcatatgtgtacccatatacgcatatgtgtacccatatacacatatacgcatatgtgtacccatatacacatatacgcatatgtgtacccatatacacatatacgcatatgtgtacccatatacatatatatacctgtgtacctatatatacacacacacacatatatatatctatatacctacatatatatacacacatatatatatacctggatcattttttaaaatgctcaacagtacacacatgtaacagcatttcagtcaatggtggactgcatatttgatggtggtcccataatattataacggaccagaaaaattccaatcacctagtgaagtcatagcacaatgcattaattactcttgtgtttgtgggcatgctggtgtaaacaaacctaccatgctgtcagtcccataaacatatagcatatatagttatatattatacttaataataactatgttgctggtttatgtatttatgtattttaccattgttttaaagagtactcctcctacttatatacaaaagttaactataaaacagcctcaggtaggtccctcaggaggtatctagaagagggcattgttctcataggagatgacagctccatgcatgttattgccccagaagagcttccagtgggacaagatatggaggaggaagataatgatactgatgatcctgtccttgtgtaagcctaggctaatgtgtgtttgtgtcttagtttctaacaaaaatatttagaaagtaaaaaaaaattaaaaataaaagcttatagaataaagatatagagaaaatatttttgtgcagctgtataatgttagtgtttcaagttaagtgttattacaaaagagccaaaaaattaaaagaaaattaagagttgtataaagtaaaaagttacagtaaccaaaattaacttatatcaaagaaataaaaatatttataaattaagtgtagcctaagtgtacagtgtttataaagtctatagtagtgtgtggaaatgtcccaggccttcacattgactcaccactcactcactgagtcacccagagcaactttcagtcctgtaagctgcattcgtggtcagtgccccatacaggtatatcattttttatcttttatactgtatttttaactgtaccttttctatgtttagatatacaaatacttaaccattgtgttatgattgcccacaatagtcagtagaataacatgctgtacaggtttgtaggctaggagcaataggctataccatctaggtttgtgtaagtacactctaacatgtctgcacaatgatgaaattgcctaatgacacatttctcagaacttagaataagcaatgcacaactctgtgtcaatttgcctctaaaaacccagctgtttatactcttaaaatattgttactatagctgtcagtatcacactccaatctaagtgaatgtcacaatgaaaaacattgagtcattttactataacggaaatgaagatgtaatttcctgaatttaacagtcaatttaggctacatagtgaaatattttcaagctactttgaaaacattaaccattaaaaactaatattcatgggtagcattcactaagatgcatcaggtttgttatttatgatatatctctcaaaaacatttttaattccaaatataattaaaaccaaatacagttttctaatataagtaatttcatggggattatattcctgattaaggactagatgaaaacattgtcaatttatactgtgctcgatgcactgaatggaggaaaatgttccagcgtgtatataagcgaaattaggtagtaggatatctttaggaatcatggtgactaggtaatactcaactgtataatttttataattcttgtatacacatatgtatttttaattaaaacatatccaacagtagaagaagtacttagtaacaatcttaacaacaaaataatttctttaggtggactttcaaaaggccttttaggagacttttaataaatcttaaatgtgtttaggaagctaaataagtgattttggccatattttttgtttactataaatttctctttatcaggcattggcattagatgtaaagttgctcatatttaaaagtaaacatttgctttctgagtcattatttcttcagcaactgtagttgtttttatggttgttaagagaaatataaatttgcaagtcatagaaggggaaagaaaccatttgtcacctataaaagagaaatacagccacttagagtttgtagagtaaaaatacacatatacacacacaaacaactgagtagattttcaaagccattatttagtgatttctctttgaggtctctttctccctcgttccatctctcttacttctgccctgcttagctttaaggttatcttttctctgtctcttatggtaataatacccggagaagagcattgctgccagtctcctgggaactaggaacccagaggagggctgtaggcaaagtgtaataccagaaggtggggagcaagtttctgggggaaatcatctgagaagcacaccaggaagtgctgctggaatgtttggggaagaccagtcagccctaaccttcagccatgtctgtggcataactggctgttgccctctgtggaaatcatgggaggtggaggcgctgcaagttgagggtgtctgtaccatttgaaaggcatagttggctttccacgaaatcaaaagacctgaggaagattttccttttaaagaacatgccgattggcttgtcatgtttaaggaattacagggattacattatgacaattggcattgagaaaaaagtgaagaaaaccttggataaccttgcagcttattattcacgtgtgcttcccatgaccattgacatttatcttaaagagaaaagatgtgaagcctgttcgtacgagctgaagccgttgctactgatggtaaaatctcttcttaagaagacatggtctttcttgcaaacttggcagaaatgttgataagaagaaaataaaaacttgaatcttaaagttcattaaaataatgaaaatcatggctttgattttttaaaaaatattctttgtgtaaatttctttataattgaaaagctcctatgtattcagataactaaaggagtttcagcactttttttttcttagatagaaagctaccaaatttgttcttcaagtagcactttcaggaagaagctttactatctctaatgtagcaaaataatgtcttttttttaatggttttgctttttaaaaaatcatgtttttaaagctgcgattcattcagtatattgaaatcacatatttccaggtcttctggtcatttgatacttgaccttagttattcaacctttttgacttggagactctattaataagtcatatggttataaaggcatttggcatttacaagtaaaaagtaatgactaattaaatttacaaagtgataacaaactacagtctatttaagattagcaattagaaacaagttccaacttgctgctgtaagaaagtaaggtagatgctacatgggtaaaaacaggaaacagaattatttaataattctgtgactcataaataggattcagggccttcagaatgaaggtattggtggtattcacgttaggccaccatctgaaaggcataattttaggtaacagatagggaaatgtatagatcactgtaaagattctaatttaaaattctcttttactagacttcaattttataccatcttaacacatcagtctcttctactgtaaataagcaaaacagaaaaatcattttatgtgcagttttaaggacataaatactctccaagtatttcagatgaggcacttattctcaaaaggagatcttgaaaagttgatctgagaagaaattacatgatttcattttggaataaaaacacttaggttcataataatatagctttataaccttagattaattataacatagacgtcaatgatttagctcctgccatgtgtcaggtactttgtgtacattaaccccttaaaacaaccaaggttggatgtaagtattgttaaccgtactttacatatgcagctgctgaggcccagaaaaagttcttacataaccaagatctttcagctaaacagctatgaaaccaatagcattaaaacttgaacccaagtcttcctaactctccatcgtgtgttctttctttcagcattaccttcctttgggctaagaatcacattcacatttgttaccctaccctgcatgtgtattgaagttataacaatgaatattcaaagattttacaaaatagtagttaacagaaaggtagagacagagcccttttttggtgtggaatctcagtttattagtttacacatgtggcttgtatagaagttgacatccttataaaatattcttataaaaatatgtgtgtgtaggagaaatatatgtccttggtgaaaaggggtcaatggagaacatttgattcagggttgtttttacataagaggtgtaaaaacaaagccagccagagaataattttatagtcaatcattcagggaaagaaaaaagtcttgagctctaaggagaaagatcaagtcagaaatctgttaaggtttgactctggaagagccagctgggaatgatggccggctagttcaagtcactaagcaacagaacagcaaactgcttggtaacaagatctggcctgactcacaggctctctttgagtgacctaggtggccagatagaggaggaccaagacccatcttacctcaaaacaatatccttccatttccactttgccagccttcatgccaaattccacattatagaatagtctctttgacttgagatatttccttttagaatggaaatatctctgggactagaagctaatattgttgtctttcttctcagaaatagtgtttcagagattgttttctgtgattcaatatattatttaaaaagtgtaagctttaataagagcaaacaaagtggaaacatttgagttggtggtctgacttttggttttcgtaagcaaatgtatacagggccaaaactacctaccttcattgggtgcaatctttctttccttgggctctcagactgaatgtgttgacatttatttgtcattttctatgttatgctgtcttctagttcatgtttgtatttcaagtatgtagctggactgtaagttcctaaaaagtaagaaccggccgggtgcggtagttcatgcctgtaatcccagcactttgggaggctgaggcacgtggatcacttgaggtcaggagttttagaccagcctgttcaacatggtgaaacctcgtctctactaaaaatataaaaattagctgggcatggtggtgcatgcctgtaatccgagctactcgggaggctgaggcaggagaatcgctggaacctaggaggcggaggttgctttgagccgagattgcaccattgcacaacagaggagataccatttcaaaaaaaaaaaaaaaaaagtaagaacctccacattcatcaatcattgtatccactgtgaaggtacaagtgccacctgtataatatacattcaataaatagttgttttttgatcgattgagaaacataccttctgttgctgtgtcttttatgctgaacacccagggggatccatacccttccagactagaagtcctggtgatgttggttttgattgccatagtggaaaaaaactttgaactcaatgattaaccatttgtgtggactttgtcaccatgactcagtgtgtgtctctgtgtgtgtgtgtgtgtgtgtgtgtgtatgttttgggtttacatgcacatagattggtatagttggctttggtgtatatgaatgattctgtatcttattattctgtcacaataatttgtcaaatacatgcattttaatatttagcttatactttgaaaattatttatgcctgttatatttctgaaaaaaatctgtgtaaatgtatctatgattcttgggaaattactgaataactagcttgttaaattctgatgactaatccttatcttttagaattcataacagttaaattatatatcaagacctaagcttacaaaagaaatgtcaagattttgagaaatttgcaaaaaaaaacccttcatagtttcattttcagtgttttaatttggagaaattttaactggcagaaattaagtaccatttttccaaagtagatcttcagaagaactaaaataatagaaaacctttttgaaggggtttagcatagaaatattattttaatataaatatttttatacagttaaatattatatatatcatttttaaattgcagtaatttgagaccaatttttccccattacccttttgagataaccctctgattaaattagctattattaaaataaagtggcttcctcttcatgttattagtagggtaccagttttttggtttttttttttcatacatggctaatttcacatttataaatggtgaagtgtgtattgttgaccttttgaagcaagcaactttctgacttaagattacttggattatcattcctgcttgtttgccttctttaggttaatagtatttgttttactttgctttattttgtgcagtgtgattttttttatgaccttctattgagtgattgccaaatagaacagcgtatgatttatggatactaataactaaaatatatatgaattgcaggctgataatgcacaaggctgatttctacagttctcctctgaatagaaccaggcttcctttaataaagccttcttactaataagaatagcagtttcactaacacattgatcattcttgaatcaccttcacaattttaggtgcaactgtgggccatttatactgtttacatttaatatttctagtagacttacatttttatttaaaaggccatatgtttaaaaataaagctttgtatattactgtaatttggaactagcgtcatttattatgcatagaagataattgaaaaaatatacaataaacaaggcaaaatagattcaagtttagctagataaccatgaccttccaaagactctgagcctgaggtctgttctctgtttaaaatggcatttagcaaataatatagacatatgaaagaccacaattaagtctttcttcttaaggtaataagaattactgaaagggatttggaaaggaaataagcttctccttatttaattcaacattttaaaattcaataagccacatcagctatgccaaacaccatctttgtacaacctcaaaccatctaatataccaacctgaaccactgatacttccaccataggaagagggacatttgttcttgcagaagttcttctgttctcaatcccttagttgcaggtaaacacactgaacttggattgggtgatgctaatccctaagcagaaagtatgttggtactctgttttcccacactgtaattattaagttcttacctggtagctgcacagatgcaaaaaaaaaaaaaaaaaaaaaaaaaaaatgttctgtggaaaattctgtacctgccaatggtagattccaagttttacttccaaagagtgtaaacatgggtgttttaaaaagtatgtctcaatgcaaataaatgagagctaagtaaggaaccacatttttctaccctgtaatcttttttactctgtaaactaattactttccatgctagaatgctcacacagcactggctacgtaatttgtagggcccaggtaaagtgaaaatacagggcccgttacgcaaataaatattacaaatttcatgatggcaacagcactgcattcaatccagcacaaggcccttctgagagtaggatcctgtataacttcataggtcacacctgtgaagccagccctgcacccacaataggtctgatgtgatgcccagaaagtcgactttgtaagccctacaggtgatgtggaagccatacgttgagaaactgtcttaaagggacatctttttagacagtctcactctgttgcccaggctggagtgcagtggcacgatctcagctcactgcaacctctgcctcctgggttcaagcaattctcctgcctcagcctcctgagtagctaggattacaggcatgcaacaccatacccgcctaatttttatatttttggtagagagggggtttcaccatgtttgccaggctggtctcgaactcctgacctcaagagatctgcctgtctcagcctcccaaagtactgggattacaggcatgagccactgtacctggccttaaaagaacatctttattcataagctcctcattttacactgttgatagaaacttcagaagacaatgatatgcgttgaagtaaaaaaacagaagttccaagaaaagtcagagttggaccagctataaattaaagagaaacattatcttacattcatcttgagagttttctttgcaaatgaacacgtacatacacaaacaaacttaaagcagcattgcctttgcatttaaagtcacttactgatatgcacagtattagtcatggcaaaatattattagcatttgaaattgatgctcatccctctttgttgatactgtctcatttactggattaactttattcatatgagatctcccttttcttttcattgtctctgtttccagcaccttaattgaaagtacccccggttacataattattcctttgaccttattcagtatgttccctgcaccacaagtgtctctcctctgttcaattccaactgtcagctcttttaataaaccctactcttaaacctcatttcccaggctcaagttccatatgcctcctctggacatttccacgtggaagatccactcttaatttatatttaacacgcacaaaaccaagcttactgtgcccccctttttgatttttctacttctgtttatctggccattatcttcccaaaaaaccagaaaaaatcatatttgacttctgccttgccctccttctgcctaggcctatggattatttcacctattatctcttgctgttctgttccctcccaataccaccaggtattttaatacttagatttgtgtttgatctatttcaataacattctaacttgtctttgtgccactagctccttcccactaaggatgtcctacttatactgtctcattaattaccctacagttctgctttgattgtccactatctatagcagaggtgaacaaaaggaccagaaaataaatattttaggctttgcggaccctatggtctctggggcaactattcaaccctaccacggtagtgcaaaagaagcccagatatacaaatggacattagcatgttccaataaaactgtatttgcaaaaacaaataggctgaatttcgcccactggccgtaatttgccgatccctgccctgtaggataaagttcacacctttaacatggcatctaagcatctgtcatcagttctgcacctatctctgcaaccctatgtgttattgtgtcctatggatacttcacatccttcgttttgaagccgaatctagagcagggttgctcaacctcagcagaactgatgactgggccagaatgatgctttgtggtgggggctctcctgtgcattgtaggaggttaagaacatccctggccactgcccactagatgacattaatttccaccatgaggtgaaaattcaaaatgtctccaagcactgccagttttcccttgtaggggacgagggattgttttcagttaagaactactgccctagggagtaaattttgtgaaggggagaaccagttctacctcattcacaggtgtatccctagcacctagcacagtcttgtgatatacaaagaggttcaggaatctattgcatagtccaactctgctactcactgtgggatcctagggttatttaaattccacaaatcacaattaagttcatctgtaagtggaactattactaattcatacatgtttcataaaattatttagaagttcaaatgatatatttaacaaaaagacctcttgaaagacagtagtactttcaaataaaaggtaaacatacaattgatagaacactgaaggtgatctgagcctattgaaatctagaagcttaatttgactcacatactctgtctacactgtacaaattactatatgggatgttattggggcattgtctttgttctcaaggattatgacctaacaggtgttagaatatgattactcaaccataaaacaatagttgccataactaagcataaagagtggttggaatttatgggagggagacattgtatctggtactaggaatcacttaagacctcatgagtgagatgaaatagtcacagagaagtcccaggcaccctactgagcattgtcttagatgatctcattgaatattcactgcaacttgattaggtttaggttttattatcacatttcacaaagagagaggggcctaggaaggaatttgatatgaatgtgaagcatgggagatttcagcagggagagaactgcagtgaagtgtggaaggaggggaagtgacaggaggtgttttctcaccaagggaatagtgtgaacaaatatggggattacatggggtttaggtgagtttgagtgcctctagggaaggtaggttggaatcagattttgaaggattgctaacatctctctctctcttgctctcgcttgctcgctcgctcgctctcacatcacacacacacacacacacacacacacacacacacaccagggatttatatgtataaaagaaacatgatgatgttatctttcctaacagcttcactccacataacaggaagtgacattttgagttcttaccccatgctaagcttgctaagccacaagtatgtgcactgaacactttcaatagttggactttgagactcagttcaattagaccaatctataccatctttcagctagctactgctcttctacttttcccaagataatccttctgaaatagatacacaatgctgttttcattcaaatcagatgtgttaattctactagtggcacttgtgttctgatgcatagaacagaggcattatttacgtgaggactgtgccttccttcttactgaattgcaaaagtatacaattcttagaacacatctagcagttctgaggggctggacacagaaaaccatcttactctgaaggtaattttctctattttatcactagctcaccaaggtgagagtcaggagtgaaatatcctattttcttttcatccattcaaaaaatagtttgagtgtttcctgtgtacctattgttcttctggagatagagaactgaatgaaatagacagtcttccatacattggggcatactttttttttttttttttttttttgagacagggtcttactcttttgtccaggccgcctagagtaaagtggcatgatcactgctcacctaagccttgacctcttgggctctgggttcaagaggcctcccacctcaacctctcaggtagctgggactacaggcacatgctaccaggcctagataactttttattttttgtagggatgggggtctcactatgttgcccaggctggtctcaaacttctgggctcaagccattctccagcctcggccttccaaagtgctgggattataggcatgagccactgcatcaggctaaagagcacatattctaataaaggagaagacaacacacaaataaatattccagtgggtcagagaaagacaagtacagtatagaagaataagtcagggtaaggagttacagagttgtatgtaagacatttcagcagagatctgaaagagatgactgaacgagctatatgattatccagcagaagtacatttcattgtgatttcaagtacgccaaatgtggttggcgtatttgagggaggggggaagttatagaaaatgaggtaggagccacagaaaggcatcagatcacatagtgctttgagcctgtagtaaagacttgggtcattccttggtgatgactgtgatgtattgaagcaaaaagtgttagtagtaggaatgtctgtgttaggaagggacacagtctatcataagttttggaagaatcatcccggctcctgtgtagaaagtaaagatgtggggaaaatggaagcagagaccagttaaactattgaagtaacccaggtaacatgtattggcagtgtggactagagaaatagaggtaaaagtagttaaaaaaaaaaaaaaaaaaaaggtcataattctgtctaccatttgaagacacagccaacagaatttgtggatgcattggatgtgaagagtgagaaagaagaatcaagaataactcttaagtttgtggacttagcaacaggtagaatgtagttgtcatttgtcaagctgaggaagattgtggaaggagcatttttaggggaggtggatcaggagtttagttttaaaaaatttattttggggatgcctcttagatttctgcatggaggtttcacttagataactgaatgtatgagtctgaagtttggagcacagattagcacttgagatgaacacttgagagttattaaaatgtaggtggtattaaaagtgataagtctgaatgaatcacccagggagcaagtatatatagagaaaagacctgagacagttggggcactttaaaatctagaaatcaggaaaatgaggaaaactcagcagagaggccagtgaggttgaagaaaaattgagagtgatatctggaggccaaatgaacaaactgtttcaggagaaataagtggctgggcatggtggctcacggctgtaatcccagcactttgggcggatcccctgaggtcaggagtttgagaccagcctggccaacatggcaaaacctcatctcaaataaaattacaaaaatcagccaggcgtggtggcaggcacctgtgatcccagctactggggagtctgaggcaggagaatcatcacttgaacccaggaggcagaggttgcaatgaactgagatcatgccactgcactccagcctgggtgacagagcaagactctgtctcaaaaacaaagaaacaacaacaacagaaaagtgataaactgtggcagatgctgctcataggtcaactaaaataagaactgagaattgatcattgcattggcaacatgcagccaattggtggcatacaacacaagtcgatcagtagagtagtgatgatacaggactgactagagtggaatataacaaatttccccaatgcttaaaccaacaagcatttattattgcatacagtttctgagaaatcagggagcagcttagctggctggttctgactaaagttcctagaagaaattgcactcaagttgtcagtgaaggctatagtcatctgaagctgtatctgggactggaagatcagttttctaagatggtgctgtccgcaggcagccttgctttacactggctgttggcagaagacttcagttcctcactgtttgtgcttctccaaagggctgggtgttcttttttttgttgttgttttaatactttaagttctagggaacatgtgcacagcgtgcaggtttgttacatatgtatacatgtgccatgttggtgtgctgcacccattattaactcgtcatttacattaggtatatctcctaatgctatccctctcccctccccccaccccacaataggccccggtgtgtgatgtcccccttcctgtgtccaagtgttctcattgttcaattcccacctacaagtgagaacatgtgatatttggttttttgtccttgcgatagtttgctgagaatgatggtttccagcttcatccatgtccctacaaagcacgtgaactcatccttttttatggctgcatagtatttcatggtgtatatgtgccacattttcttaatccagtctatcattgttggacatttgggttggttccaagtctttgctattgtgaatagtgctgcaataaacatacatgtgcatgtgtctttatagcagcatgatttataatcctttgggtatgtacccagtaatgggatggctgggtgttcctacctcaggcacaggagtcagtgattcaagagagtgcaaagtagaagccacaacgacttttatgacccagacttggcagcaacacactattactctgccatattcttctgctcacatgtgccaaccctggtacagtgtgagagaggactactcaaagttgtgagtatctggaggtgaaggcctccttataaaaggactaagtcaagtggattcaagagatgatgggaaaagaagtggtggcaattgttaactcttggagttttgttgtaaagtcagttggaggggataggaagaaaaatgagatatgggcaaagggtgtgttgtcaattgtattatgtttgtgtggttttgagaaagaagcagcagaaaggggacatttgatcatgagaaactggggacaattgcaggagcaatattcttgaggaggctttgggggaataggggtaaggagaagttcagatagtgcacaagccaaggagttgcccttaatgggagtgctgattgttcagtcctcacaataaatgagaaagaagagtaggacagtctgagagtataggaggtcagtatcttgatagatctggtttcagagtgtatgaaaagtgtctcttaattccttctattttgtgataaaataataagctcatcaatgtaaagacagagaacagatgttggaggtttgaggagagagaaggtgagaaatgatccatcatctctgggaggagagagtgctttgtctagagaaatgtgaaattcccagacggcactaaggagccacctcaggccagtagttacaaattcaaagtcatcatggttgtgtttttcctcaactatcattgactgcttaggccacaacaagcacggtttgaaaaaggttggtttaacagagatgagatatttcagtgaagtctgagttttaaaaggatatgcaaagaagtgattatgctgccatatttactctaagctcactaaggaaaaggggacataagtttggtgagggtcagaacaacttctaaggtcaatgcactggaggactcattgggtttggaagatttttggagtcagaatactggaggggatgagctagaaagagagaaggtagggagagacgcttaacagtggttatggggcaccgttatctgtcatggcaaggccttgcttatggtaaggaaaggaggtttcaggtaagattatctgaagggagatccagaaactgggagaccgtgggaggaaaagataattatgagttatgtaagagtttgcgctggagagagacagggctaaaatgtttaaagactgagaggagagacctttaggtcagtagaaaactggattaggaggggagcagattaatgatgtgagttacaaagacattttagggcaaggaagagatcatggtctggaagcagcagagaagaatgagaaagactcctacttcactaggggcagaggtacaaacatgtggaaggaaaaatagccactgcatcagagggctgaagtaaatccgtattctcggtgggcagccagtagtgtcagagcaagatggtgcaggaaagtcagagaacatgctgaagatacaggagcataaggagattttgctgatgacagactgaacgctaggagtcacgctggcgagtttgcaggaattggggaaggctggggatttcaaagtaggggatttacagagccatctggtgatgagcaatgacctggcagtcttggactttgtgtggtgacggttgtgtattcaagacaaggaccttggttttaagaccatgtagtcagacaagcacaaactcctctgctgggatggccggtttctttggtctatttaattagttccagaaacagtaattcatcctcactgcatttatagaaattgaggggagaggtggtgggtaccagactggccaggtctgcccagtcatcttcacttcaacattcctgtctggtaaagtcatattattctcacatcttggccgtgtgtgtatgctccaagaatgagacagatgacagaagatacagaaaaacaattgggaaattgctagtttgcagatgtatagccctggcacagattttctaatatgaaattgccattttttccatgatttggacacaaaatcctgttcttgaatatgatgttcagcctagatattgaagaactgaaaaatatttttgaaaaaatatatatattgcatttgtcacaacagtttatacacataattatcacaatgatattgcttttcttaaataaataggttttatgtgttggcatgaaatacttttacaagatgatgccaggttttaacatttatacaggaatattttcattatcataattgttaataaaacaaatatgaaatgtatagctttctctttggagtttgaattgttggttcttactgcctgcttgcatatttatattagttgtactggctggcagttattaggaaatacgatcttctgtgtcttaggagtgcgccctgcaagcaacatgtgcaaacatttttttctttctttctttttttttgccctaaggaaaagggtaagctctggcaccttttaacctgtaaggattatgtggctcttgctgtgattgattggttggcttctcctcaagaaatgctcctggtgcgtattttatgttctcacagagccagggctttgctgatcagcacgtcacccctgtcaagacgtgggcttgcttttgtgcatttgctcttgcagcctgggaagcatatttcaacacactgtccagaattggctagaacatgcctgtcactcccagctgactctgatgacgctcttgccaacgtagatttacatcaacacagttctttactggaaaaagctcattcagaatatacagggtggcccatttaaaagaggcatagcgtcaatttgaagagaaatatattttaaagggagaactctaagaaatacacagtcaattgaaggctccatggagcatagaattataactagcatcacccgagaatttttcccctggagattgtcctaagctctaacttctagagactggcttatcctgaaaagagaacctttctgttctagactttttctttcagcatgctagatatgtaggcatttttagcctcttctttccctaaccatataatctgaacaccatattcattgaagaaagcatgagatgtgaaagctgataagatgcaggattatgtgacaccattgctttttacctgtgcaaaattcagtttggtaatcaatggaaatacagattttacccttcacataaaattgtttggcatatgtccatcttgttttttgactcatccttgatatcacaatgaatgtttgggataggcatattactcagatgtgtgggtctatagacaggaaatcaggcattcagaaataaagcttgttaccatagctatccaggaaaaaaatacaacactgtctttgctgtacaaaagaaaaattcaatactactgtcacatgatatgtgattactattattatgacccaatgctactcacccttcattttcatcattctagtctatttcaggtcattacagtaatggatacaactgaatgggtttgtaattttaccccttctctcatgacaaccagcaggattctcaatgacacatgctttgatctgtctgcttttaaatctcttaagcagggtggctctagatagcttcctctcagaagattttatgattctaatagacctcatgatgagttctatatttgtgcttgtttagatacatcaaagtcaggctttatactagggccacctggaaagttaaggtcatcagctttttgttatagtcattggattactgtgatgctcagcaataacaaagtttgaccttgtaaagtgatcaaaagttgtgggttacaatataggaatattaaagtatattctgccatgatgtgtcttctgttgtagtttgtctagaattaatattacagtcacaattaactccaaagtgttctatactgcttgcatacagtacagtgggaaagaagagatgtcaaaatcagagaaataagattcctccattatgaattaacatacaaaatctacacttaatgcatcagaactaagatgcaatgttttaaagagattgagttgacaggtcaatcagatggtaggactggtaagaatttgagcaggcataaacaattggcagtatgtattcaaacactgtttatgagagtgaggaactattggttaacaagctgacattaagcatttagattatataaatcaccttattaactgcattctatctatggatctattatcgatctgtatctatctatcgatctgtctgtcatcttttgttttgtctggttccatgcttccaaagacattttctgatcttcattgttacatagtactctctactgagtcctaaagaacacagttctgtgtcaggctgattgaagtgtaatgatttgagtgatgattgtagtgctcaatgaaaggaaataaagaatatttggactctgttcagcagtcatatgggcttgtacaatatgagtctgcttttgagagaagaaacttgcacaaatgtctctttaagagcctgcttttaattcttttgggatatatatctaagtgtgtcttaagatagttctatttttaatatattttttcatactgttttccatagtggttgcaccattttacaatcctatcaacagtgcacgagggttcaatttctccatattcttgtcaacacttacgtgtgtgtgtgtgtttacagtagctatcctaatgggcatgaaattatatcttattgaggttttgatttgtatctctctattagtaatgttgagcagcttttcatgtacttgttggccatctgtatatcatctttgaagaaatgtctgttcaagttatgtactcattttttggtggagttatttaatcttttgtttctaaaatgttttgaatagatcaaggtttaacagtcattcctctgtgtgcttttatgtcatgtttagaaatgtgactccattttaagcttcttaaatctttttttactttaccattttttgggggctctctttttttatatttaacttttgtctatctgtaatgtgttttgattatgaagaataaggaaaaaatttagggtttgtttagcttcccaaaccccactttatagaataatcactgatcatgtactaacttataatacttgatcattttaagtaggctttgttattgagttccacatttggcacacctactggtgtaatgattgctctagtattagtgcaatagtatcgtgttagattttgtttgcagtgtgctaagtggtaaacctcagctattaatctaccttgactaaatatgtaattgttccctttattaagccctattttctttcaaaataaatattaactatgtttcccactcattcttttttgggggaagagtaaatataaagaaatgtttccagcaatgtgggaggccaatgtgaaagaatacttctatattatagaatgactatttttgcaaatgcaaaatgataacagaattcccagataaggaatagcaatgactgtttcagggcattacctaagtgtgtttcttgggctaaatttagaatgcctgattactgcacacctggtatgaaaatagaaaacccttgtgcctacatcacataatgcttaccacattgaggtacagataaaagaagttctagaattagggttgttcaaagcctggtttactatattttggatataaaatggagtaaatctcataatccttctgaacattggttttctcacttgctaaataggaataaataacatgcatgaatagtatagaatggttgtccatgtgtctaaacatgataatttgtggggtatgtactttataaatgattatatgcaaaaaggatggccagacgcagtggctcacgcctgtaatcccagcactttgggaggccaaggcaggtggatcacctgaggtcaggagtttgagaccagcctgaccaacatggtgaaaccccgtctctactaaaagtataaaaattcaccaaatatggtagtgcatgcctgtaatcccagctactcaggaggctgaggcaggaaaattgcttgaacctgggaggtggaggttgcagtgagccgagactgcgccattgcactccagcctgggcgacaagagcaaaactccatccacaccctaccctccccccaaaagaagatgatgatgatgatgatgatgataattgatatcagtaacaacaacagtaatactggtgatagaagatccttctggtgcaaaccattctcaacaatatgtttgctccagagaaggtagggccagactcctaatcccaatgttgtttaaaagcccattcagattatgaattcatttgaagcattttaggacccgagagactactagaagtttaccgttaaacttagatgacatacagttagaaaaattttccatagtcagctttttcttctcctgttatcttctgtattttactaagagaatgtttagttttaactactagaaaaacgtaatttcaggttgattaaaagagaagaacctagatatgtaaataaagatgaatcttttagacatgtagtcagtagctttcatgttactaatgaaaagttcttcatatcctatgatttgaaagaggaaaatcaagttttgtggaagaaaatacgtgaaattttaaataaatatacggcaactttatatagccagagttaattcttctttttcagtaaattgtattaccctgaaacaccaaaatgtcaatagtacaattatggtcatattgagagcacttgttattagacacaccctttagatttttttcttttgaatagaaactgcaagaatttttaaaaactgggcttattgactggacgaagggttttaaaaagaacagaaagacaaggcagggcaaatcctggtgtatttcacctgcgtagtgacatataggaagaagggacctttcagagatcatcttgagttttgactagatgataaaactgaggttcaggatggcacagaaaagtgtccaaggtcacacatttaggaaaatgtgggacatagacacaaattgtttgatgtagttcagtagtctttttagtctgacccagagcctttggggatggggacggaaggagattgggaagagcttgtcattgattcagtatctctgctcagtgccctcttgaggtttttgtttgtttgttttgtttttgtctttctggtatttttctgttgttttgatcctggatttggagtacaaagagactaaaccattttccatattgcatacctgactttgacttacactaggtgcattgaatgcaagaagcagttatgtagaaatgaattaatagataaatttactgtaaatctagacctttattgttgttcctcctatgctactagttagctgagtgatcacaggcaaattacttaaatcctcataggctcagtttcctctaatttaaaaggagagtgttgggtagttgatctctaaagtcctcttcagtgcaaagtgctgtgcttgcccctctttacctgaataattcctaagattgctgaagcatcattatctccttgttcttagctactgattgtatatttaattccacaattgggtttatctctattttcattcatgcatctttgtatcattaattccgaagtctcatataaaatctttaattcaaaaaattgagtgatggtacaagaaaagcaaactgcctatgaattccacgtgattgtgcccctatttacaaggtataaatgtgttaagaacttaaaagtttttgagtattgattattgttgccaagtcgtcaagacaatgcttataaagtaatccattatccttttccacactcttttcccttttagaacaaaaataccagcaagaaaaaaaaggatgactgttccaggtcatcaagaaagtagactacttggtcattatcaaaaatattttgaacatgtgggcactttataaaacaaagaataaacaatagaaaattatgtacttagaaagtccagactgttaataattttctgcacttaacacagtaagtgggcccacagacattaaggtactaaatgatttatagatgaatttattattcagtttcaggacaccagcagcaataaagtattttctacttttataaataactcatatggaacttttatctagtgatacactaactcttgtgttagaatgtgtaaagaaaatattttataatgcaattgtacagtgttggagtgattaggattcaaaccttcaacttccaatgagaattttaatacttagtctttaaaaatagtaaactgagatttatatttatgttatttcataccatcctatattccataatcttctataacatgattttatattcctaccttttattcaaccattctcttcatattggacattggctgtttttaattgttttaagataagcatacttgaaggtcaatcctggattggtgcattaagatgcattctcagaaatatgatgtatagagttaaagaacattttaaaggtgacatcgtgttctgcttttcagagactgttagcagtgtgcttgtagcgtattacactgctgtatcgctgtatcactgcaccatctcaaatattgagtttttttatagttaagtatttataaaattaatatgttggataaaatctaatttatctcaattgattaacattgaggctgcaaatatttttatagtgtaaaagaattttctattgtgaattgtacattagtgtcttattgagacattaacatttcctgtctttgttgttgttgctgttgttgttgttgttttgacacagagtctcattctgtcacccagggtgaagtgcagtggcacaatcttggctcattgcaacctctgccttttgggttcaagcgatcctctcatctcagcctcccgaatagctgggactacaggtgtgcaccaccacacccagctaatttttgtatttttagtaaaaatggggtttcaccatattgcgtaggtcagtctcgaactcctcacttcaagagatctacctgtcttggcctcccaaagtgctgggattacaggtgtgagccactgcacccagccctttctccctcacacttttggaaaaaatatttttctcagtttgttgcttgccatctaatttattacattgctttttaatatacaactatagacaaaagaatcacttttcttttggaaaatttgatctatgactttcattcatataaaagctttcctcaccctcaggtcaatgttcacctttatttttttctagttttttttaaactttgtttttaatcactgtgaaaataattgaaagatgatatttagataaaaatttgtgtaaagctctactattttgatacagattgaaaaggataaaaagaaatgagtaagaagtatgcgtagtgtttagaatgaacatgaatgataaactaataggtattattttacaaattatagaatattaaagataaatatactctagagtatagaaatatattttatattattatgttaaaatattaaatatttcaggcatgtaaaaatagatgatagtgtagccatttatgcatcaaagagttcaaaccatacaacactaaaggtaaaactggggcccctagtgtacccttccccaattctatcacctttccttcccacccagaggtaactactattatgtgtttacttttcttgagtatgttcttgaataggtgtgtattcaaaagagacagttcctttttgcactttggaaaacaaataattctgccttcccccccatgattgcattttatatgttttactaagatatttattataataaatattacaccacttttctctgtcctattcatggggaaaggaactctttttgttcaaaatttgtcattcttatattgtactgccccatattctgcaaatctgacaacagaatacattgtatgacaaatgtgatgtttggtacaaatatgtcagcttatgtatgctgttgcatgtgttgctcagcattgcgtgtattactgagcattgcatgtatcacttagcctgtctataaaaaattgagacatttatttaaataataattgtcccacaatctattcatgtttatgcatgtggatatttgaagcaaaatatgccatagaaacagtatctcttgctcactgaattttaaagtattttaacatcagtagcaagtgcataataaatctttaatgtataatacgaactgatagaaaaatagggctctgcatattttttcttgaaaaacaaatgtgttttgagaaatatagctttgtctaatgctgcctttgtaaaaccgggaagtcaaaagacaaataatattttgattctatatgttatgttgattatatatagtatgtatgtgaatgtgcataactatatggattcatatatgcacatatatacacattcatttatactcatgaaaatggtaaaaatccagctaatgatttaaacattgggtcaatagcaatatataaaaataatattaaacattcagatctttgcaaaatctaaatgggcttgtttttaattttcatgtggacatttgaaattttatagataagactaacaatatgttttactgtactgtgagaatttaagattaatgaaatattatgttattaatttcttacatttgtaaagttgtttttcacaataccgtggcctattagattgctaagaaattatgtatgtcaactctttctttatacaaatattgaaaatgatagtaagattaaggaacttgcccaggtcacaatttttttctttcaaatttcatggctgatttctaggcaaaaatttcaggggcctgtccaatacgcatgaattaccctactataaacaaagctagggaatttaatacataccgaaaggcattttgtaatatatcagaaactatacaaaaccaagaatagtcataaaataacattttaacatttttaaaaaaagattattccaaatgccctcacttccaggaatgcgactttaaaagcctaggctttatgttatgtcatcaaagtcattgtactcaattagacaatagtgctataattaattaaatgttattatgtaaatgcagaattaccaaagagaatttcaaagagtataacagtattaagtcgtttccttagtaatttctcattgctgtgaaaaacatctgtaacctaatacatttatattcatttttcatattatattatgcacatattatttttaaatatttgttaacaggtaattttctgattaccaaagtaatacttttgtattaaatgtttgaagactgcctccaaaaattgcaaagaagaaaattttaaaaccgttataatcctacctttgaaataattattcttcaaatgttagatatttggaatgtttccaggtgtttactggtatagttaatgctgctgtgaacatctttattgcacataccttttaacctctgtggaactgattgcttctttcatgatttctcctatattttgtcaatcatttcctttttttctttttcttttttttttgagacaaaatctcactttatcacccaggctggagtgcagtggcatgatctcggctcactgcaacctctgcctcccgggttcaagcaattctcgtgcctcagccttccgagtacctaggattacaggtgtgcaccaccatgcccggctagtttttgaatttttagtagagacagtgtttcgccatgttggtcaggctggtctcaaactcctgacctcaggtgatccacccgcctcagcctcccaaagtgctgggattataagagtgtgccactgcacccggccaattgtaagaattattttcaaaggaatttatatcaagttacagtgccccagaatattctgttattttagctgtattgaatatcataattttcttaacatgttttgtctttagatggtataaaatactatctcaatattattttccatttgtttgtttaccctttatatttccatttgcttgaactctctgctggaatctttcaatatctacctgatgaatcaatgtttatctgttggtttgttttctttttttttaattaattaatttattattattatactttaagttttagggtacatgtgcacaatgttatacatgtattttatttctttttgtcacataaatttgactctttattttaagcaactatttctagtcttttgttttttgttttttaaatttttattgtaaagaagttttgttttggccaggcatggggtggctcacacctgtaatcctagaactttgggaggccgaggcagatggatcatttgagacgaggagttcaagatcagcctgaccaacatggtgaaatcccgtctgtactaaaaatatttaaaaattatctgggtgtggtggtacatgcctgtaatctcagttactcaggaggctgaggcaggagaatcacttgaaccagggaggtggaggtttcagtgagctgagatcgggccactgcactccagcctgggccatgaagcgagattctgtctcgaaaaaaaaaagttttgtttctgtgatagatattttgcttagcatgcttgctttttatatttagaaaaactaaatctattccatctaaaatatattttggtgaataacgcaagatatgtaatctcagtgttatttataaaatgtaccattctcactttcttattttgtaaagcttgtttaatttcagagtttgatatattgaagagtcctattccactgacttaaaaaattgaggcagaaggatccccctcaagtgtcacatcttagaatttgtttgatggtacttcaaggcagttggtgaataatttagaactcaaactttgggctgcagattgcctgaatacaattaatagaaaacaaaatatttcctcaaattacattctttgacattagtaatcattcctttatatacatctcaagtctaaactcccaatctgtttatatgcagagattcacagctttaagatttatgtttcataactgcaatatcactctatgatacattaatgggattctgtactcaactattccattggcattcaagtgaataatttttatacaaaacttcttcaggagacaggcccaactgaagtgtatcactttaaaacaaatatcctatgggcaatagataaatctgatatttttctgagtagaagaaacataaaacctcaatataggattaatagggttcaaggggttttataagcacagtgcttgtgaaagtatgtaattcctattaaggcttgcattcatgagcacatcatggtatatgctctctctgggaatatgtaaagccagtttaaaattcaattacagacattgcagtctagacctccgcaagcctttgcacgtgactggactcactcaggttaatctctgaaccagttgtagagagcttttttcatctctccctcacacatttccaaactcttttctttctgtgttttttaactgtgacttttctttacaaaaggaaaagagaattttttttaagtccatgacatatccaatgaaatcgaaatgatttaatacatggagttatcttaatatcttttgcttcttgacagttctctcatatctatctagaaaatatctggccaaaaaaacccactttactttgtttatgagatattagattattttgtacattttcacattccagggctacaaggagaccacagtagacaaaatcaaaccgtcttccttttctttataggcttgtctcagcaatgcagcactgtaatgtctcttacttgaaggaacttcattctattgtaaattcttaggacaaatagaataaggagatagaagagttgtgtgagttataacttatatgtaattttctgtatatatttggaaagttcaacatcagatattgagtctatttcagtctgttgctgtgaatagaatacactattttatcctattggttcttttcttaaactgtcaaccatggtttgagcatagtttaagaaaaaaaaaatgaatgctttaaataaaaccagtacctgggttggaggtggcaaatatatacaaacctgtgtatgtgtgtttgggtgtgcgtgtaatctgaggattatagccctgtatctgtttcagggagaattttttttacatcagaccatgaaattgaaaggtgattctgataatctatttcattaaatagaagtttatgataccatagactctggaataaaaaattccttaaaattccctatttagattaatgcagatttaatccttaacccattggttcaaaactcaagtttactctttcagtaataacaagaagtggttgtcaataatactctcattaaaaataattatttcagcatttaaaaagtaataaaattggtattttctaacttatatgcttaatactcatccacaaaggttaaataattaagaaattaaagactgtgaagaagaagggaagaaagaggaaggaaaagatggtaatatggatgctattaccattcacaaaaacaacattgatgattaggcatatgttgacatttcaattttttgaatcttggtaaaatagtcattttaataacatacttaccagattacttaaagtaacatttcaactctgtttcagcacagcagataacattctaatccatgtaatcataagtagaaaaagcagaaagaaatagaatcctaacactttccaagcttccttctcttttgttagattataattcatgtacatccttattggggtatgggagacactggaacttattatactacatctcatccatttgttctgtctccatgactgacttctcaaaataatctaaactcttcagtgagccctttaaagtcatggttttatcctatatctgtccaggattttatctcacgttttgcatgtatcccagctcaaaaggattacttttctgaactttcattgcccttggattttgaccttccatatacttgaaattctctctttttaatatcaccaccaataaaaatccatccctcaagacctcacccaattattatttcaaactctaaatgctgatcaactatgtggagctgaccttttcatcctgtaaataagtgttattttctccttaagggatttgccacatgaaaactttgcaaacaaggacagtgtcttattcattttgaattctccattgtgcaatttctagctcactgtcatacagaacattactatcatatttagaggctgaataaatcattaaatggataccatcactgggcccatggaattgacttacttaactcaaatccatgtgaaagtcacttaataaatattaaataccatcaattctcaattattcatggggttattattcacaacttacttgtgatatgtccttaaaggtcatatttacataatgaatgattctgcctatttcattggcataaataggttcatttaaacagatttcattatttaattagctccaatttttcctttaccatctttttcagaaggcaagattttgcttttagctgtcttgcctaaatctgaaagctcatactgatcatttccatttaataagggaagatgaaaagggccggtcaggggactgggatccaaaaggtcaagagttttccattccttcttccatcagatcttcatagtggagttttgttaatttgtgaatttagttcaatgagccaaaaaaaaacttgctgatcaaaacaaagcccctttggtagggaggaaattctgtctctttgttttctcttcctttctctctgtgcgtgagtgagtgtgtgtgtgtgtgtgtgtgtgtgtgtgtgtgaatgtctcctgacatttgaaattcacagtgcaatttaacaataaaataataaaatatagctttttacaaaaggtgtaagcatagattaatgtacaggttttcagagaaggacaggttagcttgcttcatttttaatccttaggtaaaacagaggaagaggaaagtgaattttattgaaattcacactatgtacaatgaattacaagagaactataggaaatggttagatatgattaaataataattattttgaaattaagataaatgtcaaatgggaattatttgctttttcattaggaactgcaatgatgtttgcgcagcagtgatctatctagacagattttggaagatgtcagcaattttgtttagtctgtcagcatttgcagtggcaatgattgggatttacttgatgcattcactctggaaaaaaccttttgtgcacattagcatgacaactggtgtccatgaaatacaagaacaacattcagttataatgcactttacaccaaattaatgaatagtttaggaagggaagcaagagctgacttagatgacttacaaatatctgcttttttgcattttctaaggtagataatttgtgtatatttactttaaaaagtattttgtaagcaaagaaatgactgaaggaaacattaactccaacaaaacctaaattaatgtgtgtcaatgtaataaacttaggaagaaggcggttgcttgaaatattgtagtctggcaccagctccttcaaaatggccatgttttaaaagtatggcaggtgtgctaaaaagtctttattgcaaaatcattagaaagtctttttttgtcagtttaaaatgcattcagctataagcaatagaaaactaacaatggttgaatcatctaagggtttgttggtcttgtggaaaaggatatcaggaggtagcaaactagggctagtacagtgattctatgataccctcaaatatgtgatttccttttattctttcttctgtgccagccatcctcagcatatgggcctgtcctgtgcttgtcatctcacgaccattggcgatactgctcccacggcactatctcctcattccagggtaaagaagagaaatggaaaggaagtaggaagggatggtgtctgtatcagggaaacaaggatttcttaggaatcctcagcttatataaacccagctaccttgcccctctctgacaacctgttctttggcaagaacaatttcatatacttgcccctaccttccagggaagctgaggagcttgttttttttaactagacatattattgggtgattaacattaggcttatataaataagaatgaaagggagaatggatatcgtatatacaatcagcagtgtcagccacagtcttatagttaagtggacaccactaaatttggtgggattagaaaagcaattagttggtgagatataaaaagcaatataacataagggttttcaaacaaaatatcagatgatattacctgtatactattatgttaggggtataataccataaatatgctaaattcagattaataaaaagtttttcactttctgcacaatcatgacctccttttattaaaatagacaaatagtctggggttagtcacacaaagtctatatggcacatgactacaataattgatctgcaacctctctgttctttaaagtgattctgtgatatcaaggagtgttgaaattaaaccctggaagccacagaagatgccaaatggacacattttgtgactatttatagctgatccaaaaatgaaaggggagaatgaggaaactgattgatagtccccaattctgttttgatctgaaatagcttgttaaatgaatctcattgtcagagctagtttaaataataaatgtctctactctccactattccgtgcatatgtgagtctgaaagtaaaagtttgtaattaaagtgactgcattttaaagtttaaaaattgatctcaactaatagctaatactaataaaataaataactgcattctaattttttaattaccctggtttggaagcagaaacatgttttgtacatagctgtaatgttatttcactttaacctggttgtccccagtttagtatctacgaagctttgcacgtatcggaactccatacctgcttctcccttggtttctcttctcagtgataaaggatttgacttctttcttccccattccagcttgcacattcctgaagttttccggcttggaacaaattatattactaggtctgcagtatcatttagattgagaagtattgtgatagagcaaggttcaccctaagtattgactcttagaatctgctcattccatagtctgttgagtgcctttacctgtcactgttgtcctaagcaccaggagtgtagcgatgaaggatttctagtcctagttatctaaggactcacaattaggtttctattctggggctattttgtacatttgtgtacaaaagactgcatttttaaggtgtctgacttttgacttggtttcagaaggcataagaagttggtttcatggttacaaccccatgcccagaaaagttaagagtggtatttttaattaatttgtaactagaattaaatatagctagaattatataggaatacaacaaaagattaagatgtatatacatccctctgaataatataaatattgacaggctgatattgggttttctagacttactttcgtaggtattttcttagtatgaagatagttaaaatatactaagtgaaaaaaaaatactcaagtcactgtattagtggttccactagtaaaactacagacctcatctgtttctggaatttgcaattttaaatattgatttttggaatgtggcgacttacactgcctacttttagtttgccaggtgagctcatttttgaaaatatcctatactctgcatttatcctttgataaaatcatggctattataaattttaaaaatggtaaagatcatgtcagaataatgaatcgtgcttctaatttgataaatgtagcttaatcacaaatatacgaaactttctgttggtctggtgcaaactttctcaaggagaagatttagtgtttcagaaccattggagtagatgctatattaaacattgaggctctctcacctttaactttataaagctaaatatagtcaacaaatgaattggaaagacatattagtaaaatctaccgagtctaggcaggcctatgtgtcaggccaagatgcttcctggaattattctgttcagaatgattcctctttctttctcattctctaaagataggatgtcaacagtttcttcataaatgtaaggttataaaccatgacatttgtgaaactattgcaataatcttgggttgtgtagggataggatgacattttcagaggaaattctctaaacactttcacattaataacatctgggagccataatattataagcataagaagtggatctcatataaaaacataaaatatttttttcacatttatatgaaataacatatgtacttgtaacaactgagagtccctgatcaaattaggaaatctacagccatttattttaaatcttgctctaccaaaattggattgagagacaaattaaacacaaatcattagttacattttataactatagaggatgtgcagaaaacaaatattcaaacccaattttatgtactatattgtgccatatagtcacaggaaatctgttttccttctaaattattaataatttaaaatcatgaataattgtttatgtaagacagctggccaggctattaagggagtacagctacacagtaacaccaagagtgaggtgtccatctgagctaccacatggagaaagagcagctggctttgccccaccatattcagttgaaagctgcttattactgagcatttgaataacttgaaaggagagaaaaggaaagaacaacgtcagggtagaatgtttacttgtttgagcctcccaggagaaatgccatacaaagatttgacttgatttttaaatcaaaccaaagatctttcagattacattggagggctgaattgaaagttaacattgtataagttgtattatttttatgttcttttgtattatactatgttcccttttatattatgttcatattaccatgaactttagagtcgggatagatcagagctcaagtcttaatgtcatctcttccaaactgtgtgacctgggaaagacatttaacgtgtctaagcctcaatttcctcatctatcaaatggggataatatgtttactgactacaaattaagtaaaataagacctacaaaactgggtgctactgtatgataacacaacagttactacagatgctattattattaggtcacgtgtgtgaagagaaagtaaaaagaagacaagatgcaaagataaagaaggcaaaatgcaaagatcctatttcaatgaagccaatagtagtctttcaagttgctgttccttcttatttctcttccttccaataataataattcctattgtctaccaagtattgagagcctgtcataggtcagacacatggcatgcattgagagaaagagaattcaaattattctcttgaacttttgagcaactctatcaatgggtcttatttggttccatgttactgctgagtaaaagaacatgctcacagagggtaagaaacctgcccaccagcaccttaccagtagacattagagtcaggactttaaacaggcttttggactccagaaaccatgctctgcctactcaaatttagtagctgttctgaggatctcattctcacttatttccccttttttatttgtttgtttatgttctaaccactgatttgaaacaaattctcagaccagaaatttttactcctgtggaaagagtaattggatgttctcattacaatatttttttcttcatgaatgtaatcaaacatcagctggaagcttgcttttaatgcgtggataaaccagcccacacattttattttccctgaggcgtattgctgggaaaatctatttctgattttaagaaatcaacatatgctgaaccaactgtctattttcatttaaattgacaggagctgagactcaaaaattatgttgtattttccacttctaacattgttgatagaaaagttgaggtaaacactttattctgccttagatgcctgctaaattagtctctctaagtaaaaatgtcaggaggctattgttggattaatttaggtggagttgatacagttttagggaagaaccgttctacagtatgagaacaacttttaatattatgttagttataatctggagcatttatcataccttattatatatcgtatgttttgactttctcctctattgggctgtgggctcaattaagataagaatgtatctcccttatctttgtatatcggtgcttagtgcattgcctggcacatagcaggcgctcaactctgttgaattaaatgatcaatgagttaaactagatggctatatagttgatcttctatatagttgatcttctatattcaaaatatagtttacatatatgtatgcaagtgtatatgtgtgtttatgaataagaagaactatatcttcatactgttgaaaagttatattgtttctcatacagattttattcctttagctaaagttgtatcaatattaaatttataactaaaacgatattacgttggcacatgagggttttagtcagctccagctgctacaacaaaatactataatctggataacttacacaacaacagattaattttctcacaattctggaggctgaaagttctgaaattagggtgccagcatgtttaggttctattgggggccctcttcctggcttgcagtcagtgccttctgacatggtggagaaagagcaagctctctggtgtcttttcttataagagcaccaatcccatcattgcaggccccaccctcatgatctcatcacctcccaaaagacccatctccgaatactattacataaagggttagggcttccacaagtgaattttgaaggggacataattcagtgcatagcaatgagtatcttgtaggcttatgaccatataatttgaagctatgatttatgtagaagttggacaaaaatgtttcacataattagttatgttcacatgatctaatgcctgaaactcatttttaaatatgcctgaaactcatttgttaaaattatagtgttgggaaaagaagcatttaatatttgttagcattgaacttaaaaaaaattaaacacattgactttagagaaatgtatatgttgaagagtaggtgtggatgaaatgaaagaagagagctaacccttctcagtgccagacacagtggtgtgggcattaataattcaaccctcatagcagtccttagggtggtcttaaccatttcatggggaaattgagactcagaagtttactaatttggccaaagtcacataattgtttagagactgattcaaatcaatgtcttctttattccaatcaatcttttagggaccttatctgttatttatatgaaaaaaaacaactaactttaatgtttatggagtttgtttaattaaataaagcccttaggatttcaaattgtttcctaagtccaagagatcccaatgagaaggaacacaaagtaatttttaatgatttaaagtaaatgctttagactgaaatggtagcttctttttaaataacatttcaaattaggtttactattaacatttacaaagaaccagggctataaatcaactttatatgcagtgcattccattgatcttaatagttgtatttgcaagctgagtagaagagatttacagttctctctcaagggatagatctccttttttgggcaatgaatatactccttcagaaagtcctcttgctcttttacgtactcttttttgcttggtatttcaaaggctttttgttatactttaaaaatattcaacaaaaagtcactgaatatctacaatgtgtttatatcttgggtgtaatgcctaggttaataagatgcatagaaatatggacccagtgctacaggcccagcagtgagcaaaactcagggaaacaagtgacactaaacagtgtggagaatgcaaaggctaaaggctatatgagtcctggcatgagcacggaggtatgggctgagcagcgctgcctgaggaggtgatgtacaagtgggtatttatcccccccgggcaaaccagaaggaaaggtaaagccaaggaacaaagtagacaatggagatggtggggaatggagggagaagaggaaagaatcttggagagatagtcagtcttaaggtccaattaaactatttcatggcagccattattatcctgaattttatggatgaagaagtgaggttcaaaaatattacataacttgccctgtgtgacaaaataaatgaaaagcagagccaggttcaatgaaagtatgtttgacttaggttttaaaattctagtcataaatggcaatttaatgttgttatatatttgtattgggcttcagcaaaaacaaaaataaaacctcaagtacacaaaagctctagtaatagagccatgtttgtgcagttatttccagcaatccttggaacctccaaaattctcctcagcctgacattatatgccctatgtgtcatttcattatgtcaccacctggtggtgcactcacacccactttgggagaaagggggttagagaagggaggacatctgtggacaagccaataaaagcatttactggcatcgtgacttcataatttacacttttatttatgcataattaagtataaataaacaaaaacatgtattttctaactgctacctgttctgtttccagtcttgcttgaaaatcatctttctcaaaaaactacctatcatgtgctatgcccattacctgggtgacaaaatgatctgtacacccctacaaaatgcaacttagtcatgtaataaagctgcttatgttccctctaaacctaaaataaaggttggaaaggaaaaaataaataagataaaaattatctttctctatcagagtaatttgacatcttgaggaagtgatcctgggacttcatattctttaggattcaggtgtccagataatcccagaagtagccagcaatttggccatttggggtgtagaaaccttcatacctaggttattgtaatacctcaggctattctctccaggtttccagtgattaattagctgtgaacctcaaccaacacctgactctagaagagtcttcaaataggtcctagaaggaccaagtaaaatcaccatccctcaatccctcaatttttcctttttccaagtcaagaataaaagaagtctgggaaacattgccaggtcagcttctttttaagctcatgattttctgctacctgagggaaggagagaaggaaaaagaaaagaaaagaaaacctcaatgaatgctccataacctggattttaatctctctttccctttttgggataaaattgtttaatgtaattaactacaaggagaaaagttaaccagtggcttctgcttttgctgaaagcactttttcaaacccagctgtcatgtcaaatgcattcaatattagtttggacaactccttacgtgggtctcagaatgcatctctaaagaaagtgtttaaatattttttaatgtgaaaacccatatgggtattttggtgataggatttcttctatgattcaggaataaagtataatgcccaaataggcccttgccattcctatcagggacattgcatccataatccattttccatatccgtttgtatgtaaatgaaaagtctcacacatcacaacttctgtttttctcattgtaggatcgcctcatctgtatttatccacattagtaaaaattatccaaatcccagaaatataacaatagtccgtatttcttgagcatttactctgttctaggctctgtgttaaatgctttgcatgtaatgtctcatttagttttaccacattctatgaggtatttactctccttttcttatatgggtaagaaaacatgttgagttattcaggtaatttgcctatattcacatactggtcatgagaaaactagaggacccaggagattgaagcccatatttcatcatttgactgtcctaggaaacgccttgtatacttgtttttttaaggtattctgtcacccaagaacattgaaggtatatgcagattctcttttcctgttctattccactagacctgaatatgagggatgaaaattgctttggttttgatgtgacttcagtaccttctgtatttgacacagaggtgagtcacatcctgatcagtgttgaaagcatttagtaagattattagtttataaagaaggctgaaccatgactatataataatgaagcaattgtaaaaaaatcagaaagcattcacattcattccttgaatttccaaaagcattcaacaacagaaaaagggcaaacacgtttattccatgtatatatactgaattcctactatgcaccttcaacaataaaggcttttggtatataggagtatactgagcccagttagattcaagtgaaattcctagtaatgtcctggtatacaaggagcttaaatgttcaacatataacattgtttcttatgataggtttcacctataagccctctaaactgtttgtaactctataagaaataattaataaaccccaacaaggtctatttaatgtcttgagacagatcattctactcactttagatttcttatagataataaccagcacctaaaacaatttttaaagacataggaaatccagaataaatataactatcataggaacatggaaagaattaaagaaatggcagaagttgggaaaaaaactactggaggaaaagggtgaaaatgtgtgacaatgaagatttgcaaaggttctagaatactttaaattaagttagaataaacttttagttgcactgtgctttgactttttattcagcctaaattgtccttttaaattcaggttgttcatctccaaggatgaatgtaatttaactgaatcttgtattagagacttgcacatttctcactcattaatatgatcaaaagcatcttatttatgtcaaaagacgagaaacgaaggccatttttggcattgtcctaaagttgtgctttcttgccttattagcatttcatttcaagcaatagattgaacagaaatgcttgtgattgaatgaagattaattatagggtatgggaatattcaaacctttttaattgttctgagtagtgtcttctgctgttttgttatccaaaagggagtaagtatttggggaacaaagattgtgacacatctggtaatattcaagatgcacaccccctcactagactgtcaaaaggctgggcttgtcacagatgtcgaggctgtgatgtattgtcactcttgctgcacccatggatgcgcctctcctgatatgcgactcccattgggaatgtgaagacacagaggagatttttaatcaagagcataggtaggagtcaatgatgcatagctggcagatgcagatttcagcctgggaatatttagaataatttggattgctttatagtttatagtagcatcttttatgcaggactctgacctaattatttcaaaaattattgctactgattataatctcattgttgctttcttttatctattcattgtttaaacagcatttttagggggcagggtagggagaagcagtgtagcttggtaataaagggcatatgatctggacccagcctaccttggaaaatgattaagccccaattttcctatatgtaaaatggagacaatactagcatctacctcacaatattgttgattgaatgaaatgagataatataagtaaattacttccagtagtccctagcacataagcactcattaaatgttagcttttaaaattgtattccagattaacatgcctaaaaactagggctacgtactgagaattcatagaaccaattttactttgtgtctgtgttcttatgcctgcatcaggcattacgaagaatacagagagacaaactttctattcctcagggttgacaatagaagagaaataataatacacaggaaataagtaaaagtataattcaaactccaagtttaatgatgtataaaatgaagaggtcagtttgggctataacaatcagataagattcactaggtgctaaactcgatctaaactgagaaaaatagacaagacttataaatattagtttaaaacataaatctgaaagtgttactcccctatattttagtaagacttctctgtggcccttgctcctataacagtttctttaaggttaaaactgctgggtttctgagctcttctccatcctactaaatgagaacctctaatacaagaggacagtgcttggaaatctacatttgtatagaacccaagtgattcttatcaagcaaataatggaaattctatcttagagaagtctaaacatactaaggcccttgtttagactctatgtaatttcattttcagccactctgggccttgacccctgagaaccagcaaaagagaactttcttcagcacttggcttagccctcccctcttttgtgaaggagtttcccttcactggtcagtgttccttgtctttaatgatggtcttgaacaccactatgttgttgtacttaaaacacagagttgtaactgtttacaggtttatatccattaaaccacttgatcttgtgtttcatgctctcttattctcaccttagcatttagttaccactcactaaatcagttgatcttgaaactttagaaatcttacccttacctgaggggtccttgtttacaaagcagatttctagatgctcttgctcaggtactcttattctgtagttgaaatgggcattttagggccagacactttggctcatacctataataccaacactttgggaagctaaggcaggaagatcacttgagtccaggagttcaagacaggcctgggcagcatagcaagaccctctctctacataattagcctggcatgatagcacatacctggctactcaggagactgaggtgggaggattgcttgaacccagcattttaaggctgcagcgggccacaatcatgccactgcactccagcctgggcaacagagcaagatcccatctcttaaaaaaagtgagcattttaacaagtgtgtaaatagtctaccattctcttaaaacacacacaaacatacacaccttgaaaatgcaaatgaatgaatgtgtgacagagtggaagaaacagcttcagaagggagaataaacatagcatttacagaagatagtgagaataccactgatttggtatgttggatgctggttgggagaattttatgggaaaaataccagttgagtgaaattatggatgttcttgagaaatagcagagtttgaattgaatgtggctttttgcataaagtggtaattttggaattttggaataggagaatgaataaagatggcatccccaatagttgtcatggctagtcttaggaagggttggatcagatgatctctaaaatatctcttaacactgaaatgtatagtgttatgctataaaatatgtagatattgagttgtattaataaagccttagcttgtattcatgggataaaacttctacttaaataatattgtaatttcattcattaatgcatgtgtataaaagtggatcagtattgtggaaggtttgcttaaggtgagatacatgcaatggtagcctggagccaggtagtagtaccagctcaggagtactaactgttacgtattcaatgattttgagacctggttggaaagcacaggcattattaaattatataaacccgtaattaaataaattatatgaaatgcaaaggtaatcaatactcaaaactcattagttcccaagtacttcattatattttactattatccatgctcttgaggttatgtagtccatcgtatctgtgtcgtggaaatactatataatgaggtgcagctacaaatctcttcccaactccacattcagggccatcacattggtagcttgaaataagacatgctgatagtagttacaccatggaaatggacatactgcacaaatcaggcctttttttttctcctggagagccaactgataaatatttaccagcataccaatggctcatgtttagaatagtcccattgttttggggtagaaattcattttggtacatggcctgactcaaaagttcacccctttagtgttacctcctgttcagcattgaagccacttatgtctccttatatgaaaccagaaacaagaggctttttttttttttaattctaagagtggctggctttagttgtaacagaagagagcaggtacctttattgtacttcaatttaaactcctttcaaaaggatctgagaactttttcaaaaaaaatttattcccccaaatctgataaatatgcctctattttacaatcttttacaacttttcaaattactacaatctgaaagacattttcaatctttcttgaaagacagggagaatattgccatggatgaagaaaacaatgacttgtttctttcattgtataaaatcattcttcatcactgtgaaaataagaaaatgaattttttttagttgagcacaatctcgagatctttctaacagcctctgttcttacagtatggatgttactcttggtttatagctctgcaaaggagtcaaagaatcttccttttatgagggccctgaagaaagaaaattgtgctgataaaattactttatgtgcgtttgaatgatgatatggccaagcattcttcagaaacttctgaatttttcatgtatgccttcaagagttgtaatccttacttaagcaaatgtctgtttaggagagattccagagattttcctatttagagtgttttaaaaattaaggaaggtgttcaccagcttactagaggttccttgtgaaaagagaaatgagttttcttcaacagtcttatgtctttggttcaagctgacataattaaggtgtaaacatatcagtatagtttgttttgattaaactttagatggacatagaataggtaatcaaattcattggatcgaaataagtattcttactctgaaatgaaacaaaatggaatcttcagaaacatggaaacaatgacccaaacatcagagaggcattgaagataaatgggaatatcactgggaatagtgtaattggagcagtgttttccaagcccaatcctcagacctctcgaaaatggagattgtaacactagattgtgggcagtctataccaaaccaacagtactgaatcagagtgggttatgggaatggctagagcatttgcaattttacagcatattcagaagatttttatgtacactgaagttgagacgtgctgatttagcaaaggtaactgacaatttgcctcaattccctcatctgcaaaatggggattataaaagtagggttgttggaggactgaatgagtacatatatgtatagtgtttaggacaatgtctgctgttttacagtaagtgctctattgttggctcttgccactattattgttttgtcaagggcttgtctgtgctagctggaatggaaacttaaatgtttctaattattgcaactgtcagatttcttaaatatcgtaatgaagccagcacagtgaagagctgtcctcagtttaatgtaacattggatctatcctaataatttttcttagtttcctattgcatttgtaactattttatttaaatgttttatttttccacagggttacatttattttattacttcagaaatattagatgtcattctgaaattgtggctgtgcctttatcttgcatgtggaattcaattttttatattctttacaaacagtatttataagaaataaagataaggttacagtgagttgttgtatgagatggtaatttacatggggtgctccatatgcttagcttttctctgaagttatgcatccccacagcaagggaaatatttgcatttctgagagtgagaatttatgttcatcctctactaggaatggtggcagcttttccaggtcaaggccctgcagatgcctgatggtcatggtaaatgaaggctggatgcagggaaggcagcaaaatgagaaaatctcctgggatcaattaatgggagtcatctgagagagaataaaggcaggagaacattttcttctagtcaggaattcgcatcagttttgcctggtaatgggtttcatgaaagccaagatgaaagggttttatccctaaggaaaaaagggctctcctcacatcctctttctgtgctcttttatcaatgactaataataacatgcttgcatccatgacaatctttcagaaaactgatgcaaaaacaagtccaaaattagagtgtacagctgtcgtgatttcctggagtttctggtgtgtgcttagtaggcacacagtttgagttacatggcttcattatatgattacacactactttgttgcctcattggtggttaaggtgattttaaacttttcagtacccaaaagcagtgtcctggaacataccaatgaagacggagaattgtttcagtcccagagatatcccaagcaaatacagcagtgaactcaatggatatttgtgaaatgaataaataaatgaatgaatgagtactactgtgaatattcttgtcatgtttgcttgttctcatttggagagtttctttgaggtccgtgaccagaggttgaattgctggatcttaaagtaagaggattaccaacttccctatacgatgctcaattcctctccacaatggctatactagtttactgtctggcaatcggtgtatgagggttacctgtttatcacattgttgtaacatttgattttgtcagatgtcaggttctaactgaggtccaaggggagttggtgggcaagtggcgggtagctggaaaaacacgtgaggaactgtagacagtttcaacatggatttactctctctctggccatgagccatgagcgcaagatgtatgtacagcgtcagcagcgtagttgtaccttttacagacaatagtggctccaagccaagcacaagcttacatgggtgatcacctaatgtgcctcacgtggcgtggttacataatgtgcagagttgtgagcctgtgctccaaactcactgagtcatgctggaccggatgtctgcttcggcctatttttgagagcagcacatccattttccttacactccaccctcaatgccaaaggagacacaggccttggacacacaggtctaagacacaggccttatacgtacactctggggacaaaggccctggacacacaggtctgacacataggccttaaattctactccctaggctgaaggagtcttttaaatggagaaacatgcccacagggtggaaccccagacccagaggccacagcagtaatacaaggagcaacaactccaggttatgacgggcaaacaccccatgatgatgttacccgaatttactttatgcattaagccaggtttttatttccctacctttaggggcattggggcatgcaacaacaggttaccatccgtttccatcctggtcataggaggtcatccttcctcccataggtcttgccacatggcctagccccacatgggccagtggccaactagccacttctgtattttccaggtgcctaaccacaaggttaagcctcgatagaccacacagctattggtgcagattatcatatgtgtcacctctttggtgatcaccattcatattgctctgacttcagcccattgactactttgtccatacccggtatgaaaccatatggagtcagtactaggctggactgtgagcagtccaggcagtagcagcaccccagctagacccatctgtgtaccgtgccccatcgggcatagggggggatgcccttccttaaatggtgaaggctcagcatgtaggggtgcttcaggccccatgtccttaggccccatggccttatcttgcattaggactgctggtctcaagacctcttgcaactctgctgctaagggacttgtactcagcgtactctgttgcttcaagtaggtgccccactttgctaaagtggatgtctgcactgtcccagtccggggggttgttatcaatgaacacatccatcctgctatcaggtaactcgtctacacgacaactgtagcctgtcctgccatgctctcatgagcccgaagggcagcatatgcagttactaactgcttctctatcagtgaatactggagctcagcttctttccatagttgggaccaaaagcctactggtgttctcaagcactccatgctctgccacaggccccagccaaaaccatctgtggtcacatgcacatccaactcaaatgagcacccttggtcaactacccatagggcttgtgcctgctgaatagcctatttagctgccaggaagtcagtctcagccacactatcttaattctaggcaagaggagcattgccgcttctaaatctgcaagagaatcagaggttaacataatattatcaataagaccatgacatatgatggggctatgcatatatccctgcagcaacactatgaaagtccactgtcaccttcccgtgaaggcgaactgttcctggctctctagagcaatgttaattgaaaatgcattaatcaagtccaccacatagtggcactgtccaaattccatcatcaagcggtccatcaaatctgtaatagatgggatggctgtcaggccatgtaaaacatccacccccagaatatatcagcgctggtgtttaccagtgccagcacttgctgtatgttggtggaggaccagtggattgctaatttcacatgtggcctctatttgtctggtgtccccccaggccaggcacctcagccagttccctaatcaaacagaaaaagctcaacatttccacctggctgcagcaagtagtctttgagttgaagcacctgagtgggaccaggtcatacagcaatgtcctccttccccttctgcatttcctggaattgctgctcttgagacagttatctccacaaagttaagagtacttcattgggctgcttatcgattttctctcagtcaaccctggccaaagtcaaatctatccacatctgtgagtgggtcacttgttggggcccccttttcttccatgatggggaggctctgcaggtggggcatcttccccttttttacagtgcagacccagaccaagcaggggtctctggctgagatgacggacccaggcctgcattcacaacagcctctaactccctttccaaccctatgccaggccttcaggcaccccacctgcacctggagatccccattcatggcagcctctaactctttttctaagctgtgtagctgggcctccaggcaccctgcctgtgcccaaaaggccctttcctgcactgcatccctcagggattgggagtgtacttcttgtagcacagaaaaaatgcccatccaactctgctgtcaaaggctcattccttctcggtgctctgcacttccagctgcttcagtgctttctccgtgctcgtggggtacccatctactgctggccaggtttccaacagagttcacccttgcagcacagctgtgaccaggtaccacaacccatgtcgtggccacattgccaacccagaatcagcagggaccaaaggctcgcccaccttgggatcctgttcgtgatgccaattgtcaggttctaactgaggtctgaggggagtcagtgggtgagtggtgggtagctggaaaaacactagaggaatcatgcacagtttcaacgtgcctttactgtctgagtgtgagccgtaggtgcaaaccataggtacagtgtcagtccggtagttataccttttacagacaatagtggctctgagccagttacaagctcatgtgggtgatcacctaatgcgccttacgtggtgtagttacataatgtgcagaattgtgcacctgcactccaaacttgctgagtcatgctggacctgatgtctgcctcagcctattgactgcagcgcatacattttccttaaatcagatttttaaaatttttgcctgtcagatgaggtatgtctgtcactattgttttaattattttttcctaattgctagcaaagttgcctatcttctcaaatgttcacttattgttttttttcctgtgagttcttgcatccagtttgaacagtactatttaactttgttttaatgctgtcaaattcctaaaatagttgcttatgtcacagaagttctaacctcagaatgatgatatccatgccaaagcagttgaaatttaaattcttagataagtaactttaaatattccagtgttatagtaaaacatttatactggactattcactcaaaaattctttaaacagttgtcaaccttatttatttcattataataattgtaactttaaatgtgagatatgataaccacatctctgaaatgtgacaaccttgtccaccaatgttattatgcctgaaacataaatcttgggcccctgctcagaacctttgccttctagtttcagtaattatgaaattaattttgtgtttggtgttttgcaaattaaacttaccctattaaccctatagcgtatatacattatagatatattattataattattatatttttaaaaatagctttatgctcattgggcagaatctgtatcagcacattttttggcagaatagattcagtagactaataactctgttataaatccctggtagcaatgttgggtaaattcagtggactaataaatctgttataaatccctggtaacaatggtggggttttaatgagtaacataaagaacttagaataaaacaacttaaatatatatatatatatatatatatatatatatatatgaataatattaacctttattcttatatttgtataatgtagttatctgatttgcagagggagagaaagagacagacaaatggatagacagacagaacgagatcatttagaccataaggttagaaaaatattatgagactatggaaaggtaatgaatatggtagagagagatggagctgaagattataattctttacttatggactgctctaggataactttgtttgatgttattttagccttctgatatcagtttatatactctaaaacgagtagaaaagaagcatcagtttgtataaatattctatttaaatattgtcaaagcaggtccatgcatcagaagtcaaattaaaactcactggggaaaactttgaaaaggcctgaaggaaatgtacttgatttttataatgtaattggcaaaggaaattgtagtcaaatatgagagctaatgaaagagtgaatggataagtaaaatccacaaataagcacaaatgtcattgggctgtttccctttccttaccaaagaaaatttcatgagagttgctaatgaataagatctgaacattatataacctttataagcattttcctcaaccatttttttctggttgagatgtcaacaagaagtaatatatcataatatacaaaagaagatgcatagtgtattaataatatgctaccaattaaaaatcgctggaataatttggcattggaaatgatgaaggcataaagagcagatcttgtattagacaaaaactaggaagttatagttaggttgtagtaaatgatgaacaatccattttgattgtgattcccaactagcttttaggcagagcctcaaccacagaaactcaatcctagtggataaaaaatatgcagacaatttgaagggagtgaagagagcagaagaaagtatgatgaaagaattgaaagattatgcaacagaggagtatttacagcctggctagataaatgaatggatatattattttttttaatttttttagctaatttacattgttaatttttatttaactattatttttaaaagaagataaatactgcagtggaaagagacttaagggattatactaagggcaattatgagaactcttgggacaaaataatggtcttatatcaacaaaaattccctggaagtgtgatatgtcagcttgcagaaaattttcccaatgtagtgataagaattctctgaagacataggcagattgaaaagacatgaataagaaacaatgtgagatacatttccatacttactgcagaggtaaagcagaatggaatttgtatcttttcctctgcaggtcctattagagaagacaatagagaaccctctaagaggtgattgtcaaattggttaatatgctgtggtttggagtgcctgcattgtgaacaagggcacattcattcaactttccacatcttcctttccctgtaaaatgtacatggagttatggtaccttattaggctattgttagtatcacatataaaaccatgtaaaattcctaccgtatgcctggttcagtcagtgctcctcaggtggtagctattggttaaccctattctttataacataattgaaattaggttatatgacttttaaatatccaaacagtcagaatagaaatattgatgagaaattttgcttcatctcaaaaacagtgttagaactacaccaatggagtatttttctcctaaaaggttaatcaggatatgacatttataggatttacaatcacaatcctgataactgtgaaatataatatcagactgtttcttactattttatttttaacattgacattaagttaaataatatattttgttactgtagcctaggattttattttccctgttatgagaacaaggataattattttacaaatgaaattttaagggattagagtgccatagacatgctcattgcattattaatgtgcagaatactggagttctgccatcttcatgaatccccacattacattttggataaagaataagttctgtatataaatgtaggcttcagaagcttttgttgattctttcaccatattttatacaaaggctttcttgctttcctgcctctcatgctaagtacaggcccttcctgtactttcggctaaacgagatggcctttcatgtataaaactcagctgaaaaattgacttcttcataaaaccattcctgtttcatccctgactcaaggtcctgacttgaattcttccgacttccctgggcactgagccagcatagttctggttcgttgtataattgtttatatccttgtagcatattcagatgcacatagtcaccatgtctcacccagaatcagaatctctcaaggaaagaaagcatgtcctctctttccctaataatccccaaagctctcaataccatgctgtgcccacagaagggaatcagttaaatctgctgcaattgattggaaacttcttttcccccagattttccttaggtggtctcctgcagagttctgtctaaagtaatggagacttgggatttgtattctcattatgctaatggttattacttcctttatttttgaaaactggttgtaggatctaagctaaccatgctattttctgcataccacccagcgattctcatttagcaactgccttcaaatcgtctactccctttggtctcctcctcccctcagtaggagaaggatgagaggaagttggaatatttacactgagatgagatccttgagcacttgagccctgaggctgcctctggactaacgtttctgttcagctgtccccaggtttttcaacaagagctgtcagaaacaagtttgtgactaaagagcagcttcatctgtaacttctgtttcttgctactccctgctgtgtttctggctatctggaagcttctcagcagggtagcaagttgttggcgccactaacacctttcctctttcaaattcatattcttccttgggaggtgagtttgcatttcagaaaattctattttagtgaaaccacccaggaatcagtgtcagttggctttcagctgtgaaataactgcagagactttgttacagctaagggggtgcgattcttttggagagtttagattttctgtttatagagaagagttcttaggaattttatgcttagctgaaagtattaaacacttttccttatttcctcaacatgaattctttttcccggggctgcaggggaaagggctctgatcctggttcagtctctagcttgatcattttagtcgagttcctttacttccatgcaactctgtttcctcaagtataaaactattagttgagtgggtagaagaagtagatgatctttaaagcactttttaagtctaaaatgttatgattctgctatcaaattcacagcttctcaacatcagataagggttggcatgagtgttgctgaaaatatatttgggttggaggaagggatatcctcgattaaaaaaaaaaaaaaagccagatgagaaattaagacttttcagccaatgctattgacataaactcagggtgactttcacgtcctaagtagaagtggaacgttcattaattaaagcttaggtaatacctctttatcaaaattaataatttatgttcaaattaatcatcatgaattgacatagctaatttgacccttcatggttatcagagtctttttggtgaatatcatagtctacattaattgaaagaggataaggtacataggtgtcctctcccacaactaagccatcatgtctaatgtagtaatgaaagcagattttggactgaattttgttgactggcaagcttttgttaccaaggagccacaactatcataaagcctattctcataagctccatagactcccagctttctgtcccttagacattgtgataagcgtcttacatggaagatcattttttattatgtctgtttgattcttctctctttcttccttattagtctagctagtagtctatctattaattttttcaaaaaatcagctcctgtattccttgatttttcaaagggcttttcatgtctatctccttcagttctgttctggatcttgtcttctactagctgtggggtttgtttgagaggacatgaacagacacttctcaaaagaagacattcatgcagccaacaaacatgaaaaaaaagctcaacatcactgatcatttgagaaatgcaaatcaaaaccacaatgagataccatctcacaccagtcagaatggccattattaaatagtcaagaaacaacagatgctggtgaggttgtggagaagtaggaacgcttttacactgctggtgggaatgtaaattagttcaaccattatggaagactgtatggcgattcctcaaagatctagaaccagaaataggatttgacccaacaatcacattactgagtatatactcaaaggaatataaatcattctgttacaaagatacatacacaggtatgttcattacagcactattcacaatagcaaggcatggaatcaacccaaatgcccatcaatgatagactggttgaagaaaatgtggtacatacacaccatgggataccatgcagccataaaaaggaatgagataatgtcctttgcagggacgtggatgaatgttctcacttataaatgggagctgaacaatgagatcacatggacacagggaggggaacaacacacactggggcctgtcagggagtggggtttagtgagggaaagtattaggaaaagtagctaatgcatgctggtcttaatacctaggtgatgggttgataggttcagcaaccactgtggcacacatctacctatgtaacaaacctgtgcatcccgtgcatgtaccccagaaccaaaaacaaaaaaaataaaaacctaaaaaaaatcttatttcaaaaacaggctatgggctagatgtggcctgagggccatagtttgttaaggcctgggactagaccaacatatgcatgtgaccatcttgtggatgagtttccacaagactgagagctccataaaggcagagactgtattttctcattttttattcccctcagtgccaagaaaaacagtaattcaataaatgtttgttgcattaaagaatttattcacgaagagttataaaaatcaatccactgtttttccatttgctatctctgaacatgtactatgtcatttttacttgaagatatttatattgaaatctctggttagtgatgtctcacttctgtgtacagctaagaagacgtacagtttttaaaataatgttactaactgtaacaaaaactattttatcaagaaatataaaagaaattctttaacaaggttgagaggttacttcatgcattaagtttctgctatcttgctgatgttctgctataaaaccttacagacactatgtctgtattactggtttcatttgaaattttgccttatgattaatctaatttggtttcattgtccataataaaaagcaattgagcatcactgatgtggataccattttctttaggttttaagaaaaccactctaatattttttcagggccattattttatcaaatatgtatatatgtgtgcataaggagaaggagctcggaaaaggatttatatttccttatagtcaattttatgttctttctaccctaccactagctccaccatattgaaaatatctctataaatatgggttatgtcctataagcaaaggatacattctagaattcatttctctctaaaccatgaagcatcatccttaagcaagatgctaaacctgaaacctctgtagagcacatttgggtagacttatgttctcattcttgcctagaagagagatatttctagttttcttatttgctaaccttataatttgagcacagaatgtcagatttgtttcagcccttcgatttaatcacatcatgtctgatatcctagcatttaattacccaaattcccagtgttgttcaagaaggtaggtctgtggtgggttagccttaagctagtggctgaaaaggtcttgatttgcccccacatctaacctagtcacttcctgagctgaaactcccatatcacctggggacaagcgaccctgaaatcctcactggccacagcttcttctgagggaagctgcaggaaaaagaacaaaaatgagcttttgtgaaaggattaacttgggtgaagaacatcctccataaccaaataaatggaacctagtaacccacatggccaatccccagggcactagtgtctttggggatatcagggtgtgtatagaatttcgtttttgtcattcttgaaaacataaaaaaatctctgaaagagtactagtggtcaaggtactagtctagagatggaccaaacaatcatattaaacctaatttaatctccagaatttatattttgagattggtagcactactatcttcattttgtactttccccaacttcctgcagctaggattcaaatacagaccatctaactccagagcactgccctttaacattgtgctataatccaccactttgcatagttgatcctacaagaggataagtagagatcaaagtaagaagtgatcaatggattactatgtcaagcatgattccctcaaactattgggaagaataaataccataacatgtatagggtgctgtgtacaattcctggcacaaagttaagtacatgataaaatggaactattaatattagtaacccagataggttctgggcacattagcaggaaaggtcttcttaatttaagtaaggtgctaaaagcatctaattttattaggattgttatgaaacaaaaactaaatgtgcaagaaaatatatttaccgtagcctggggaaaattgtcatggtttctcttttcaaagaattcaatttggtaagaaacagccttcaatggtccatgaaaagtgagaagtgtagggaataagaggctctttcctatgtttgcatttcaggcttgccttcttacttttaaatttatctttacaattgccttcctgctgggtttgtgtcttcctcagtttagggaaggtgacaagaaaagtcctgtttgtgtgtaattgacatgaaaaatggtaggcttttaactcaaggaggctccagacaacagtttggttattaaggaaggggaggacctaggggaacaattgtttctggcctctcttcttctcaggcctggaacaatctttcatttactatattcttgccacaagagcacagtcaatattaaattccaaaaaaagaaaaatccctcacagaaacagctgtgttcaatatacagccagtttactctggcgaattgctagacatggaacagttttcatttctttttgtgtttatccctgatagttgtcttgtaaaatctgccttttgtaaataagggaaggctggttttaaacagctttgactaatattggtagttggagtattcagtattacagagttttagagaactaaaataaacctgatggaaacacacacatatttcaaaggaaacattttaaggtgttctggttccattttttccattttgtatgtaagttggattatgatacttttatgtctacattgtctcttagtcaaaaatgtgagagacgccattcaagtctagacttggaccctactgaatgccttgttcatggacaccacacaatctcgatgtaaatgtttattgctgatctgtacaaaaaggggaaaagtagttttttgaacaacagaaaataccagttaatctcactggattcaggaattatagcaaagcaatccaataagtggattctctgagagtaggaactcaagtgtgttatctcagtttttatccagtttccagcacaatgctggcaccatttaaattctcagtcaatgctggagaattgaaaaagaatcctcaaaatttggatgacaaaatgacaaaggtgtcccctgatacagaaatctgtccatggcagaaagattagtgatttgagatatggtgtcatcattgtagatgatggtgtcccattaagcatgttttcactaattacaataaatgttgaaagaaggagtttcacctagtatccttactaatatcagggaatggcctgggctttggggagatgagagtcctctgctttcagtttaataaagtaggatatttgtgtttttgtttatattgttaaatacgacgggttagcttgtcacctacataatattgtgtggcataaataaaggtgaattcccaaatatgtgctccatagtgttgacaatgagtaaatgttcattctaataattgtaagggttacctccctcgcactccttgaaatatctttttattcaaatttttcgagctggaggtcatgtgttacatttcctgttgtgtaacatggcctccctctctttctctgtctcactttctcactttctccctctttcttttactctctctgcctctacctctgactccttctccttcttcccagctttgcatcagagccatgtaactgacattttcttggttccctcaggacctgtcataatagcaggcaaatattagatgatgattcaatgtttaatgaatttttcttgaatgtatgtatgttgcttcaagtcattcatgcacacattgaagaggacagacagagccctgctgaacaccactagcaaatctctctctagtagaccacaacaagtcaatctgtgctctttgattacagttgttcaaccagttactaatctaactaattgtaactggttgaacaactgaacccaaagggtgcaaagtagaaacatttcattgtgaagtcggctggggacaaagaaaacaccaccagaacccccttcaatatgcaaagggaaaattccttctcaagtacaagctacatggtgcctttttgaattatcatcaatttgtaatgctgtatcaatacatatgtattatctgttcttttggtaagggttgtttgaagtataaggtacttcctccattaaggtgatactaaccacatgttaattattgtctgaaagtcaccaaggatatgaataataaaaagttttaaaaataagacctgtttcttttattgatagttgtacctcaaggctgaagtgaggtttgcaatgtaagttgtaaaatgtgatgtgaaatagacaattctttgtagtttatataaggcaatatatccatgtgcaattatggtcaaaaacagcagacttttaagtgattattctaaagttatttttttccaaaataactttattactcttgatatcataccatattcacaaaacattctggtaaagctattgctcagtgtgttgtcccagtgagactcagggaacatttctatgtgacgctttaggattgaagacagttccacgttttctgagtaattccaaactgtgtaagagattatgttccctttgcatattggctgctaagaagctcactttttcacttatgatacttggatgcattttggctttttgggtttttgttttttggtctaatttttttttttttttttttttttgagacagggtctcactctgttgcccaggctggagtgcagtggcaccatcatggctcactgcaaccttgacctctcctggctcaggtgatcctcccacctcagcctctcaagtagctggaattacaggcatgtgccacaacacccagctaatttttgtattttttgtagagatgaggtttcgccatgttgcccaggctggtcacaaattcctggactcaagccatcttcctgccttggcctcccaaagtgcgggcattacaggtattagaggtaggagctactgcatctggccatgggaaacattttgaatgataactttgtttgtttgttgtctgttgagcaggctggagtgcagttgcatgatcacggctcactgaactctttcctttaatttttttattctctcagcacgattataatttattttaaaagtagggaataattggccaggcgcagtggctcacacctgtaatcccagcactttgggaggccgaggcaggcagatcacaaggtcaggagatcgagaccatcctggctaatatggtgtgaaaccccgtctctactaaaaaatacaaaaaattagccgggtgtggtggtgggcacctgtagtcccagctgcttgagaggctgaggcaggagaatgacgtgaacctgggagggggagcttgcagtgagcccagattgtgccattgcactccagcctgggcgacagagtgagacttcatctcaaaaaaagaaaagcagggaataattagtaagtgcctaactaatcaaaaattgtttccaggtgatgttgctgttgatgtatgaaaacctctttcacctagcttccctcttcattcttttctgtcatatttctattgaccagtgctttcttggcccttggaaatgtgattaacttttgccatgacctctatgttagtgccacacctgacacctttatgccactctctgcctccagaactctgtgtccatcttatatgtttttaccttctgctgggcctcaggtctggatgcaaagctgtagaggaattgagctgtttttcacaagggatccaagaacacatagcatgtgtgaactgtactaaagctttgagaagttgtgaagaagattcacatcaactatgcaccacacagccttcttgtcttgctggtaccatctcctcacctctgtgttgctcctcttggagtcttcaccttccacaaccagcacttctattctcactgtctgagtgtgactttccataattgtgaaactccttgggcttatccctcacactcattcttgaattctaaggaatggcattttctccattgtgcttacatttgcttttcagtattaattgttctagagaaaagcattcattcactcactcactcattcactcatttaacaaaacctgtatgggtatctacagtactatgttctaggtatactgaagacactaacataaataatacaaataataaccttttctcagggaatttagattaaagtagttcaaattggagcaggggaagcaaatatttacgtagattatcagggaaaatgtgtagtgagtgccgtgattagcactatgcagaagattttatgggagtggcaaaaagcagaacctaaccttttctggggtgaaaagtgtgacctaaactgagtcttaaagaatgaatgtagggtggagagaggaataggaagagcatttcagggagagaggaatagcaggaacagagacactgatgcaaggaatcccatggtatttgtgatgaagggatgatttagtagttcagtgacaagacatgagcctggagataaataaggtttaggttctggggaccttgtgagccaggttaaggactttgggttcatcctcaaaccatgaagcattccaagcaattatgtgacaagatcagattctaggggctgaatggagaataaatatgtaagtggcaagattgaaggctgggaatgtaaaaggtggctcctgctgtggcttgggcaaaacatcacataggcttgagctagctttgtgattctacgggattgagaggagaatgctaatttcataaatgtttagtggatatgattggcatgtgatctgaatgcaactggagaaggggaccagtcatttactgagttgatattggtaattgataaataagaccaaagaaggtgaggtttggggataggcagtgtaaattttggaagtaataaggggattgaggttctgtccatggcattggtggggaaatctagcatgtaaatacatgtaaatagataagtaaatatgcctatacatttatataagatatctatacacttattctccttctttgttcatttattaggtgtgaaatctacgtgatttttttctcccatattatttttggtattcaataaatgtgaatcatgaagagatagctgttttatttaatctctgcaaagtcacattcttacccattttgattgtaataaaaggcctatgtcgttatttaattttttaacctttgtggcatgatttatagaaggaaaataaaagtgtcataggtatgataggccaaagttgggttgttggtaaaataataataccacaaaatgtttttctatttagccaactactgcaaagttactttaattgtgtttgcaattaattgatttcactttaaaccagaaacaatagagactgtaatcacacagccctgcagttctgaatgttttgttcttccttttattggttttctagatattcctagttggcaacaggatagagttcagtaatggttatgcaatttcattgtgcagggtattaaaatttgtgaccagggatcccaggagaccagctattagattttcaatgcactattagattaaatatatctactcaaactaaagggatcctgcctgaggctgtctgatcaatagtctatcattcctgtgcaaatgaagctattaagattctcttaggaggtagactatctaaattggatctaactagtagatggtgactgaaatgagggatatactgatacttaattggcatcaatctgaccttgataagattttgaaaaaataaatacctttttgctacaggttgaaaaagaggtgtaaaatagtccctattttatattattggttcttaagtacttatcagaaaaatgacaaaagtcagtgtccataaacaaaggttccattgatctttgatcaccaaatcatcatttctatcttcctcttttttgtttaggtcactgcagtcaccattacctccaccaccatcataattatatatagctaccacttcttggacactcaggtctgcttgtgtttgaaccagacatttctagctccaaagcctgcattcttaatttcctgcagtcttaataccatctttttaatagaagacccccacaggaaaagctgattctataatttaaaaatgatttggggatccaataagtcatgattctattttatataattttggaagatgtggccagagagctaactctttttattttattatttttcttttaattgttgacgtacttataaccaccagctatgaagctataatttattgccacattgagtatgttaaattgttaatttacataatttctgattcttatttctcccctctcaaattcaatttgataatttaacatacctgcttctgtgtgttccatggaactattaatataattttttaacagaattatgagagaattacatttccccagctgtagatcaattgagaaacagtagaaatgaaaaggttaagaaattctgcttcaaaatctcaaatggtcaaagtcattgacattgtaagctcttctgttcgactcaagcctggtggaaaatgtaatgaagaggtacaaagtacactgcataatccagcaagctaattgcccactttaaggcctcttgagcccaatggccaagtgaaacctccactctcagggaaattaggcaactgctaaggtggttttgcagttttcagagacacagagattaggtttttcagccttatatagatctgtgatcactaatgatagtctgtgctaatgaaggtagttttttgaatcaaatgcatattgacttaggtcttcagcgcagaatgttgattcactgctgtcatccctgtcaagagagctgcatatgtaattatggttttcttttgaatagatttgctttgggactgtcacgcaaattccatttcttcatgttcttgctatctttcaacctcaaataaataaataaatagaaaaaatatctctaagcactatgtgtgggctgtcattctttttacatttagtgttctaatgtttttaaacaagtcagtttacaggtaaagtttgctgtaataggattgaatgtgggtgtatgtggtggtgcttcagatctctttccttctgcttgacccttcatgttgggtaatagttttaaagcgctcatgccagaaagtaaaccacaacatagtcaacttctcaaatatccatgcaatgtagaaagtccggggtcaagatgattactatgtgatctgcttaagtgggaacagggccatttccctcgccttcaacacactcagatacatctcagccaaccaacattttgctgtttgaaaaacatggcagactttatcttgtccctaaagagaatgcttttctccatccctctgcttaatatcctgtggctccatttaacctccaagccaaagtccagtttcttttagaagacttcaggcaaaattaggagcctcttatagtgggatgaatgctttctatactgtttttgtaatatttttgtaacatttgccatattaaactccatttattttatgggtctgaatcttcactagactaaactgcttgagagaggagcatgtataattcattttcatgttcacaatgctgaaactgatgtctatagagcttcagtatttgtccactgcataaaatcagtaaataaaggcaggaaagtttgttacatcaagtaggaccaagggctagatccattgggacaattcaacagggcttttcattggttattctagctgatatcaacctgccctgacctgaatcaactctgagcccctacctaggctgttgtttcttagcaagtacataataacaactcatcagaatagcagagatcttggtaacaggttgcctgacacttgactgatatgggaaaatcctgaacaggtttggactggaatcttggctcacaacctgtgtgaccttggtcaagatattttatctctctgagcctcaattttctcttctgttaaatgagcatagtgaaactttgttcattggtttgctttgaagagtaaatgagatggtaagtgttggtgtatgtagtgcaggaacataacaattcttgatagatattcattgaatacctgtagtacatagaacatagaaagttcctgttattccactcccacccccacacacttgcccttcaggtctcaggttctccttcctggtacccccagaaagattaagcccctttggccctctatgtgcctcttttatagcatttaacacaattataattaattgattatgtaacttttttatttaatagctgtctcttgtagaatataagcacataaattcagggactatctattaatgaattttcctctagtgcctagtacttaggtggctcacagtaaatgctgattcaatggatgaataactttattcagtctgctcagtgtggcctttaatttagattcaccccaaattactccccatcaggaaggctttcttattcaactttctcatcctcaagattagcaaaactactctctttctattcccaaatatcttctctcagtttcattaccatgatcagaaagtactcttccttgaatttattttctagactagatctattttggggttttcttaccagtgattgtaactattgatgtggtcttttttctgttttttacttctcatatgtgtatctctttccattagtccttcattccttcaacagatactttctgttgtgacagccactcttctaagcactatggaaggatttaaagctgtgtgaagcacagttattccggtcaaggaacttaaaaaaataatacaagtgacaaaacatgtgcaagtttgactaaagtatgagactggaataaataccttataaaaaccaagagcttcagtattttcctgcagttttttgctctattgtattctcaacttttactggtttctcatcaaataaatgtgttaaagtataactcagatcattgcttagatgtacttacttttccaacaaggccttccctgaacatcctatttaccattgcaaatgcattcctctccactagcgccattcttaccctctctttccacatcaatgaatttcatagcacttgtcactttttttcatgctgtataatgtatattaagatattgcttattgtctgtctcccttcaatagaatgtaagctccatgtgggccaggatgtgtagtcattgatgtatccctagaataagtgcccaattatagtagtcatttgatggacatttattaaatgaaattatgaatgaagtagggattggcagttatacactaagactctggaaaaatggcctgagttgaatcctggctttaccattcttggctatataatctcatattatttactttcagcctttcatttcccagatgcccctaccttctagggttgttgggaggatggaatgcataatacatgtaaaccagcaagttcatagtaacaaaagttgactttttaaaaagttaacttactcttctttcctatatatgtgtaaatcatattttattttctcattttaaaaagaagacaataactaaaggtattagcacataatgattcaaaacataatatttccacatgtcgagttgaatgactttgagccagataatatgagttgaaatcagtttaacaataattaaatcagccaagagcagtgtctcatgcctgtaatctcagcactttgggaggctgaggcaggtggatcacttgagctcaggagtttgagaccagcctgagcaacgtggtgaaaccccatctctacaaaaaatacaacaacaaaaaattagccaggtgtggtggctcatgtctgtagtcccagctacttggggggctgaggcaggaggatcacttgagcccaggaggtcaaggctgcagcgaactgtgtttgtaccactgcacttcagcctggacgacacagaccatgtctcaaaaagaaaaaaaatagaataaaatcaaatacacaccatttttgaatatgtcaccagtctgtgtagttcatcttgaaaggacttcaaggtccaatatgcatcatgcagagagttgctagggcccagacaagagtgacttgaccattggcctgagtagttaaactatcagataactagtgaaacaattcggctatttcaacaaacatgttgcatacataacgtgttatgcacagagatgacatttggtataatattatggcaataaaaggtgcagttcctgccttggggaagcaattgtaatatactgtgaggagctaagagtaaagaaggggcccttgtaaatgaggggtgggtcagtagggtagcagttggcagaagactcacactggaataaatgctccttgactcgatattttttttttttcaaaaatgcagaagcattattgaagcccggatgtttgggttctatgataaataaaagatatggatttgagctgctcattaaattttgaaagaaaagatcctaaaaggttagagaccatggagatttcaaagtggctgaccttgattagatataagtgtaagtcagatgggtattcctggggggtcccgactttaatacaatttgaaagtttcatgattatgagcacctctctgtgcctccttggtggagagctgacctatgagtagttactgtgtgaattaatgaacatccttcagcaaaagttattaatagtaatgtttggtaaaagtcctttagaagtagactgttatgtgtgttactagttataatcaattaataacctgtgatttgtaggagcaaatggtcatagggatacagtatacattttaatcttgctcttcaaacatcaccgtagatccatggtccttctcaagacattggctttgttctgaagcagctcccacgctcttccagaaatctctatgcgggactctgaatgtggtcaagaagaagatgtactggatgcacattccctatcaggagtctcttaatagtctcccacccagttacaacatattgctgtaatcccacacaacagctgaaacatcttttcttcatttcttttaattcctgtagcatttgatgtctccaccgtgtaatttacatttaattgtaagttgttttgcatcatttaatagttgtttcaagtatgaatgtcttgccttcccaagaagattaaaataagattcctttaagaacagaggctcactgcgcagtgccagacatagacatagagtaaaccacaactactgacttcacttcaagctgacctaaccatcttcccagcgaagacggccaacctggtgtataactcattcttctgatctgcacttactttatagaggaataaatacactgagttattgggagtttgtgaaggaagtgactagaatttcaataaaataataaagttttgttttgtttcatttcgtttgaaaagaaactgctgcatggccaagatatttgaaaatggaggctgggattggacaggggtgaagaattgtgtcacagactttgtactggaaaaatgtctgccttaatctagtgaataaatatgactgttctttgaagtcctttttttcctccccgagtataaattcaaatgctattcattttctgagttgcctgtatttctttagcccttaaggcatcaacctttgatgtcttattttcataatattttctctcttagaactgatccacatattcagtagaatggaggtataaatcctaatccatagactactccgagcttattgaaagtgaatcttatttagattctttcctttatctgctcactgacagatctaatgttaaacagaaccttattatcatcacaaggaagtagattaaaaaatacttttcagtcattcgtattcaacaagtacactccatcaaatcttgcctaactttttttgcaaataactttgctccttggatcctctcccaggtctttatcaaaatggaaccacatacatttgtaactacctcataattaaagttttgagtcattaagttcagttatctttaagggtaaacattgaatttgctgtaaaagttccatttgtttcactaaaattcgcaaatagttgtgattttctttgcagatctgtccagtttgatcttgaaacaaaactgcttaaaactttatcagccttccttctttttggcttagctttaataaccacttttaatatataactcagatctataaataatactgagaaaagcagtggaaaacattgcaggtataaagacttttcatgttgactatttttggtaaagattctggacatttgagtgaagtctctcatgttttattggtttattttactctggcaccgcttatgaaaaaggggacttgaattactagagggtaattttctttctttattttatttatatattttttactatttttttccttcagttatgttgtttattcaaaacttgaaaacatatacaatttcagggtcttctagagtatatttacatcattctgatgaacaactttataatttttaaattagcaaatattctcaaccctgtcagctttaatattataattaatgtgcacaaatctgaaaacttttcttgctcatactataatacattaaatagaccttagcaaacaacttcttatttgaatacttgtctgtccctgtcactcttctcatactttagcctcataactttggttataattatgtaaatggttaatattcatgttctcattgcaaaatgaaaagtgaggaagagaaattaagccatttgcctaaggtcacaagtctggtaaaatcaacagaggcactcagaatacctccaaaatcatttccatgatgccagaacctttaaatgctacagaaacaagctaaagcgatgcatttaaatgtgcttctatgtagggcttgagctgtatctaaacttaaattagagctcagccaacatagaatctagttcagcaatactctacaacatgagataaccatactgatgtttgatataaaatgagattgcagaggaaacacattttaatacctgaggtgtgtgcttaatcttcttgatgtatattaaaagctcagtacgtgagagtaatatgaggtgatggggtttactcttaaagagattactaataatgtttatttggaaaaagatgaagattttagaggctatttaagaaactggttctgggaaaaccagccataacttaagagttcttctttcacccaatccccttggaattctgctttgctatagaaccatggtcaaaccaaggcaagcagcacaaattacatgaacaaagaatacaacaataaaaagcggatccttaagaccctcccaagaagaccaagagctctctctttaaaactctgtaaaatacctaggttctcaagtcttcctatgtcttatttcttaactaattgcactatcaattcaaaaatggaacaaaggatattctacgtatcagaaccttttttcctatacattaagaagaacttttcccacatgaataggtaatatcacagtctaaagccagaggatgaaacctatgaattcttcctatcatatattttaacaagaaacgtaaatatctatgacctacttatagccaatttatattttgcccaggttgttttgtttctaaacttacccctcatatggcttaataatgaaggccataaatgtgcctctttcctatctcacccctatgacttgacatgtattataaaatgaacttcctatataaaataatatttattgaatgaaaggaaagtattacatacaactttcattattatattattaagcttattttttgcacatcatggctagatcatcttaaaatagtttggctctgtctcttttcccatttttttttttattatactttaagttctagggtacgtgagcacaacgtgaaggttcgttacatatgtatacatgtgccatgttggtgtgctgcacccgttaacttgtcatttacattacgtatatctactaatgctatccctcccccctccccccactccatgacagaccccggtgtgtggtgttccccaccctgtgtccaagtgttctcattgttcaattcccacctatgattgagaacatgcagtgtttggttttctgtccttgcaatagtttgctcagaatgatggtttccagcttcatccatgtccctacaaaggacatgaactcatcattttttatggctgcatagtattccatggtgtatatgtgccacattttcttaatccagtctatcattgatggacatttgggttggttccaagtctttgctattgtgaatagtgctgcaataaacatacatgtgcatgtgtcttatagcagcatgatttataatcctttgggtatatacccagtaatgggatggctgggtcaaatagtatttctagttcaagatccttgaggaatcgccacactgtcttccacaatggttgaactagtttacagtcccaccaacagtgtaaaactgttcctatttctccacatcctctctagcacctgttgtttccttactttttaatgattgccattttaactggtgtgagatgatatctcattgtggttttgatttgcatttctctgatggccaagtgatgatgagcattttttcatgtgtctgttggctgcataaatgtcttcttttgagaagtgtctgttcatatcctttgcccactttttgatgtggttgtttgattttttcttgtaaatttgtttaagttatttgtagattctgtgtattagctctttctcagatgggtagattataaaaattttctcccattctgtaggttgcctgttcactccaatggtagtttcttctgctgtgcagaagctctttagtttaattagatctcatttgtcaattttggcttttgttgccattgcttttggtgttttagtcatgaagtccttgcctgtgcctatgtcctgaatggtattgcctaggttttcttgtagggtttttatggttttaggtctaacatttaagtttttaatccatcttgaattaatttttgtataaggtgtacggaagagatccagtttcagctttctacatgtggctagccagtatttccagcacaatttattaaatagggaatcctttccccatttcttattgttgtcaggtttgtcaaagatcagatggttgaagatgtgtagtattatttctgagggctctattctgttccattagtctatatctctgttttggtaccagtaccatgctgttttggttactgtagccttgtagtatagtttgaagtcaggcagcgtgatgcctccagctttgttcttttggcttaggattgtcttggcaatgcgggctcttttttggttccacataaactttaaagtagtttttttccaattctgtgaagaaagtcattggtagcttgatggggatggcactgaatctataaattaccttgggcagtgtggccattttcatgatattgattcttcctatctatgagcatggaatgttcttccatttgtttgtgtcctcttttatttcattgagcagtggtttgtaattctccttgaagaggtccttcacatcccttgtaagttggattcctaggtgttttattctctttgaagcaattgtgaattggagttcacttcggatttggctgtttgtctgttattggtgtataggaatgcttgtgatttttgcacattgattttgtatcctgagactttgctgaagttgcttatcagattaaggagattttgggctgagacgatggggttttctaaatatacaatcatgtcatctgcaaacagggagaatttgacttcctcttttcctaattgaataccctttatttctttctcctgcctgattgccctggccagaacttccaatactatgttgaataggagtggtgagaaagggcatccctgtcttgtgccaggtttcaaagggaatgcttctagcttttgcccattcagtatgatattggctgtgggtttgtcataaatagctcttattattttgagatacatcccatcaatgcctagtttattgagagtttttagcatgaagggttgttgaattttgtcaaacgccttttctgcatctattgagagaatcatgtggcttttgtctttggttctgtttatatgctggattacatttattgatttgcatatgttgaaccagccttgcatcccagggatgaagcccacttgatcatggtggataagctttttgatgtgctgctggcttcggtttgccagtattttattaaggatatttgcatcaatgttcatcagggatattggtctaaaattctctttttttgttgtgtctctgccaggctttggtatcaggataatgctggccttataaaatgagttagggaggattccctctttttctatcgattggaatagtttcagaaggaatgttaccagctcctttttgtatctctggtagaattcggctgtgaatccctctggtcctggactttttttggttggtaggctattaattattgcctcaatttcagagcctgttattggtctattgagggattcaacttcttcctggtttagtcttgggagggtgtatgtgtccaggaattcatccatttcttctagattttctagtttatttgcatagaggtgtttatagtattctctgatagtagtttgtatttctgtgggatcagtggtgatatcacctttatcattttttattgcgtctatttgattcttctccctttcttctttattagtcttgctagtggtccgtcaattttgttgatcttttcaaaataccagctcctggattcattgattttttgaagggtttttttgtgtctctatctccttcagttctgctctgatcttagttatttcttgccttctgttagcttttgaatgcgtttgctcttgcttctctagttcttttaattgtgctgttagggtgtcaattttagatctttcctgctttctcttgtgggaatttagtgctataaatttccctctacacactgctttaaatatgtcccagagattctggtatgttgtgtctttgttctcattggtttcaaagaacatctttatttctgccttcatttcgttatgtacccagtagtcattcaggagcaggttgttcagtttccatgtagttgagcggttttgagtgagtttcttaatcctgaattctagtttgattgcactgtggtctgagagacagactgttgtaatttctgttctttaacatttgctgaggagtgctttacttccaactatatggtcaattttggaataagtgcaatgtgatgttgagaagaatgtatattctgttgatttgtggtggagagttctgtagatgtctattaggtccacttggtgcagagctgagttcaattcctggataaccttgttaactttctgtctcgttgatctatccgatgttgacagtggggtgttacagtctctctttattattgtgtgggagtctaagtctctttgtaagtctctaagggcttgctttatgaatctgggtgctcctgtattgggtgcatatatatttaggatagttagctcttcttgttgaattgatccctttaccattacgtaatggccttctttgtctcttttgatctttgttggtttaaagtctgttttatcagagactaggattgcaaccccaccttttttttgttttccatgtgcttggtagatcttccttcctccctttattttgagcctgtgtgtgtctctgcacgtgagatgggtctcctgaatacagcacagtggtgggtcttgactctttatccaatttgccagttagcatcttttaattggagcatttagcccatttacatttaaggttaatattgttatgtgtgaatttgatcctgtcattatgatgttagctggttattttgctcattagttgatgcagtctcttcctagcatcgatggtctttacaatttggcatgtttttgcagtggttggtactggttgttcctttccatgtttagcacttccttcaggagctcttctaggcctggtggtgacaaaatctctcagcatttgcttgtctgtaaaggattttatttctccttcacttatgaaacttagtttggctggatatgaaattctgggttgaaaattctttaagaatgttgaatattggcccccactctcttctggtttgtagagtttctgccgagggatcagctgttagtctgatgggcttccctttgtgggtaacccgacctttctctctggctgcccttaacattttttccttcatttcaactttagtgaatctgaaaattatgtgtcttggagttgctcttctcgaggagtatctttgtggcattctactagagggtaattttcttttagggtgttataattattttaaaaattgattcattggaatatgttatcaatgtcaaaacatgagataacttgatgattatctctttatgaatttgaggtgctgagtatttcttgtttttcaattacagcattctttcaaatagccagtctcatgtttctatttctctcttagctgcttctttctttaatattttgttgctaatgagaacctctaccaaaatgagtaaccaaagggctgaagaaagttgaactgttaaatggtgtttgttaattgcttcttcaattacagaaggattttatatgttgagtaacatgccatttgaagatttgacaattccatcctctccttggtaactccccagtcatttggtctagattgatccatcatctttctcacttaagagcatttagttctcaccttcaaataatcagcagattaaaatagtggtacatagtcatctgtaggaagaaagaaataagctgtacagtagagtgctctgtgggtaaatatttgttgtgttgagatataacctgtgtatatttattaaatatcagtgacatttctttgcttattctttcattcactcaacagatattattgaacagctgctgtgtactaggcattgttcattttcccaaattctaaaattgtgatcatttctatttttaaaatgtattatttaacaaagtactggtaatgatatatatctttatttcccagtgggttttggcaatatagcataaagatcatgaaagtgggctctagaatctgagagcctgtgaaaacttcagctccaacactttctagttgtgtgagcgactttaggcaagttaatgaacttccctaagctcatttacttcatctttacaataggtataataatagtacttacctcatgtccactatctaaagagtaaatgggaaaatatgcaaagcatattgcactgggcttggcaggcaagtaatccctcaatagatgttaaatttgctgctgttattaaatcatagttcttgcttagttgattgttataatctttttcagtatttattgaacaaatacctatgaagtgtactcagagtaaacttggacagtgagagacaccaccatctggcctgttgtgtcataaacaaaagccttaaaactgggtcttggcaatggtgaggggaacagatgctctaactgccttctagaatgtgtttttcactatgtgtctaagctgcgatgaatgtcactaatgtcatctctctttctattttaggtaagtacatcaccatttttgaaactctgtgcagatgggtaagtcttgctgctggaacttttcctgttgatttgcatacttggaggatctggatcagacagtgtgcttatcgtggtcagaaaatgcctttattttattcaagcagagatctggaaaggtaacagaatttcccacacatgctttccatctctgtttcaaatctttggcagaaaaaaaaaatctgttatttttaattagataaaatgctatgttaaataattgaagatttaatttcttactctgtcaatagaaggcagagtagtttaaaagacttgagaaaagaaaaacaattgtttgcttcctattagaaatcacaaaatcctctctgaagtaaacatacaaatctttgtttttctgctttcaaacagggaaaattttttcagtgcctaacaaacaggtgtttcatgattagattattaatgagaaataattttgtatcaaatagaaaaagtgacaaatggccctgcaagaccatgtgtgcataatattgtagaaggaattcctgttatgactaagagttgatgtagttaatttagtatgtctaaagttggctgtaatctatcaccacagaagagctggaagaaatgatcttaaatcacaaaggatttagtaaagacctacgtgagctgtgaaagatgattaaactatgaaatagttctcaaaaggaagttataaattccttgccacttgtgaaatctaaaaactacatagacagttatgttcgtattagaaaataaagatttatcctgccttggcacaatgtattgaattggcatgttgttctcagtaacaaagtcccaatttgcttcatcagctttaattccctatttactccatacatactctatactctatgtgttagtctgagtcttgcaagaagcccatgccaaaatgggattagaaatgcaagaattttaggaaatgcccttgtagaggaatataaggagggagccagttaaggctgagggaaacgtcaaagcatgatccaagtttgactctgagtaaagaagggagagagaattggtgagagcatccttgattgggctagccaaaggcatatgggagtcctcaagccaaaatcagccatcagaggaatcctgtttcccaggaatgtgtctgccacaacatgccctctgtgctcagtaaataccaggaagcagggcatgggaggtatggccttagctaaaatgttgcagtgaatttcagaggcatcagttggggccctttgctggttatagttcctatagttggaggtctgcagcatatcctcacggccccacacagagactgttagatcttggttctttctgtttcttattttctattacaatgccttctatctccacatcttactcattcttcatgcccaaatcagttaccacttccttcatgaaggttactctgtacaacctagtggctaataattaccattctcttttgtaattcaaaaattcttgtatttttctgtgatatttattgttttttgttatccatttattcaaaaaaatggtatcgagagctgcatttgtgctagccacttttctatgctctgtgggggagaggatcagaaaaaaatgataaaacatgacagtctaatggaaaagataatactgtagaatacattaaaatatgacagaaatgtttgaagtatgagcaaaagatatgaggagacagaagaaggaagaataaccttttgggaaagaagggagggcagtgctcagggagggatggaggatttaaagcaggacttgacattgagttttgtcttggagggtgactagctcgttaggagttgacagttgaataggcatcattttcaagttcatggttatatgaaggagcatagaaaaggtttgtagtacagagagccttgcatgtcatagggaatttatgggattacggtcaaagagaaatctgcaaaattggcctaaagccagattatatggggcatcgggtcttggcaagtagtttggactttattctatgagcccaatccaattcagaacatctcagagtcatgtgggccaggctgaatgacaaaaatattgatgtatataattctgttatggcatactaaaatggtatgattctaccaaacaaaaaagatggtgatactatatatttaaatatgttgtctatatctaaaaactactaataaattacaatgaagaaatcacattttgataaaagaagataaaaatatagggcataaggccaaaatgtaatggaacgatttagcagactcttaatctcaggtgtgagatttgtcacgaatagctattttctgctcgatatatatttactttctgtacagtgtggttataaagacataactgaaaaatctagttgtcctcgaaatatgtaaggtatcaaaaagcaggattttatgctgagtgtgctttataatatttggaaaatagttataactagttgaagcattcaccagaatgtcacttgacaattctaactttaaatatctataagccataaagttaatatattatattgattttgatttttaatttgatgtaatttcagatttactgtaaagtggcaagaatagcacaaggaattcccagatacccctcaccaatatcccccaaatgttaacattttactacatttactttattcaatctctgtctctcatatctacctttctgtctatctaatcatctatgtatccgtctacccatacacacgtttccttattgatacacattaagagcaagttgcagacatgatactcctttgcttctaaatacttaaataattcctaaaaacatggaattatcatacataggtacagttcagtggttaaaattagcaaattaacatggataaaatgttgttatctaatctacagactttattctaaatttcaataattgtcccaataatgttctgtgtagccaatgaaattacaaaatcatgcttttcaatcagttgtcatgtctctttaatatcctttaaactggagcagtttctgagtcttcgtgaaagactatttcatgacatttatatttttggagaattacatgccaattgttttgtacactctcttgatttatttgggctgctataacaaactaccatagtcttcatggtttataaacaacagaaatttatttctcatggttctgaaggctgagaaatcccatgatctgtgctaagcagattttctgtctggtgaggatcagctttctagctcataaatagctgtctccttgctgtgtttttacatggcagaaaggaagagagagttctctggggtctcttttataagggcattaatcccattcatgagggctctgtccccataatctcatcacttccaaaaggccacacctgtaaataccatcatattgctgattaagtttcaacatatgaatttggaggcaacgtaaacattcagtctaaagcatagactatctttcaatttgagtttattttgtgtttcctggggatgatagtcaggtcatacaacttgggcaggaatatcacagtagggatgctaactccttatatccagaggtagatgctgttgtttagtaccattactgacaaatttagctttgatcatttagttcaagtggtgcctaccagatttctccactgtaaagttactattttcctcctttgtaattaaaaagcattttgtaccatgataatatgagagcatgtaaatatgctgttattcctcaatttcttacccaatagctttggaatccgttggtgattcctgtctaaatcagttacttgtgttattatgatggttgctgttttcattggtttaatgctgctgtaacagataccacaaactgggtaatttataatgaatagaatttatttggctcatggttctggaggctgagaagttcaggatcaaggggctgcatctggtgcagtcctttttcctgctgcatcatgacatgatgaaaggtatcacatgggcaagaaatagggagaagggggccaaactcattttttttttttttttttttgagacagagtctcgctctgtcacccaggctggagtgcagtgactccgcctcggctcactgcaacctccacctcccgggttcgccattctcctgcctcagtttcccgagtagctgggactacaggcacccaccaccacgcccggctaattttttgtattttgtttagtagagacggggtttcaccgtgttagccaggacggtctccatctgctgacctcgtgagccacccaccttagcctcccaaagtgctgggattacaggccttagccaccgcacctggcccaaactcattcttttataaggaacctactcctatgataacagataaagtaatccattcatgaagggaatgctctcatgatctaatcatctcttaaatgtcccaactcttaacactgttgcgttttggtctaagcttccaagatgtgaactttgggagacatattcaaaccatagtggtttgctaaggggaaatcttgtaatttcatcatttcttcctcttttattagttggctttctattatgcataaaaatgtttcttcgtgcttgtttctgtgtggagtcatgaattctttatttagcaggttgttatcctttaatattgttggttaatatcattatttatcttaatcctcatactgtcctggatttggacagtacaaggtacttctagttgactcccttgtcattttaacacgttactatcattctttgagtacttttttactttttggttttagatatgagactcttgttcttttatccaagccttggaatcagctacttttatagggctctctgtttcctttcagtaaagaatggtttttagaaatcaaaatttggagagtaggtgtgcttttgcttctaggtccttttagtagacatatctagggggaaagtgtatgtatgtacatactcatatataaatgtgtgcatatatatgcatacccacacatacctatatccatgggtatattcagatatttgtatacattaaacctaggatttcacaatgataatccatcattgcagtgctcattctgttcttctccattttcgtatctgtaactctgtgagaagttacggtgagaagcctggctcccattattcacaatatattatatattgcataggattttcttacctgtggaatgtggtttcaaaaattactttcagaattacccactcacgcctctatggaaaaagagaagtaaggcaaagaaaagtatttcagtaagtagacttttagcattatttatgttttatatgcctaattctgtactcaaaattcacttggttagttcttttctcacagccacttccactcacttcacggttctgttacttattttaaatatggatcagttaatttgttttaatatataaatttgttttcatctagagttgaatcgattaatctggaatgatattttctgtttctatgtttaaaatatcaactaataatttcctttccttaataataagaaatctctagcaccatttaagactcagttaactgaggtgtaggtatccatgttttcctagagtatagagctgtgatctaaatcagaaaatctgaacaagtttgtcttggaccaaacttcaggataatctggaaacaacgggacaaatgttagtgcatgagtattttcaaacatagttctgagtaaattccaaatgcatatgtgggtttgtggctcttcatatctggttatttgtacatgatcacatctttattgtagataataaaagttgggtataaaagcaatgccattaattatgtattttttatgctttttgtttcaaaaaaggaattaagcaatcctaactttaaaaatggataaaatgcctatgtaaagctaagttagaaacacaaatgtaaaagtgtatttcgtacttggagttaagtttaggtcttaaaatattaatagcttcctcaaagatacagcaaatagagaaacctgataatatttatgtcttgagagaaaattatctttctataattaattataagacttttcattagggtctttgtgtaaagtaaagcaataatatgtttaatagtatttttatgtgagttacatacatgtacattattaatcatgaataaatagtgatgttcttatacttagtcttgttataagtcaaaatattaaatcattattccatgaaagtcttcatatagtaatttaaatcattgttaagtctggttacttgatgttgagaaagagcttagtacacatagtagaatgacttgccagccttgccattaggttatctttctcatacattacttaccttaagttggcaggagcttgattacagaagataactgtcatttatctctttgtgtggagtgcatatattgtgggatgtctataggagtattacccaaagggtttgtattacagaattatagttaacaaaatcactaggaaatgtttatggagggaagataaccacagatatatctgattacctatttggaggactagcagtggaatttcttgctgtttctcatgtggccaaaactaataaaataaaataaatttagaagagttttgttgtaccaagataatccatatatttcagttggtatggaaaaacatcttttctttcagccattgttactatgacacttagacactctagtctacaaaattatcctaggtttagcaatattggaattaaattttattgttccttcctgattgcagagttataaaaataaggattgagttattatgagaggccgattgtgtaatacatatcatgagttaaaagtaaacgttgacttttattataattgccttttgccacatgagagaaaataaactaagtgaataagactgtctctaagtcttctctgagattaatttgacaatttactagaaatagaaagattggtaatgctcagtctaggaaaggggtaaagaaacaggcacacatatattacttgagagattgtaaattttgtacagttacaatggtaacactccatgtcaaaatatgcatataacaatgcctcttgtagacatttatcctcaagtaacaagaagtaggcaaagattattttatgtattttgaccgtcaatgagttgataatagtaaaggactagggagggttggtgtttaaaacaggccaggtgcggtggctcacacctgtaatcccagcactttgggaggccaaggcggatcacttgaggtcagaaatttaagaccagcctgaccaacatggtgaaactccatctctactaaaaatacagaaatatccaggcactgtggcaggtgcctataatcccagctactcaggcgcctgaggcaggagaagtgcttgaaccccagaggtagaggttgcagtgagccgaaatggtgccactgcactccagcctgggtgacagagccagactacatctcaaaaacaaacaaaaaactaaaacagactaaattgtggtacttccatattttttttaatgatagagatattagcattgaaatttgtcacaaaactacacataatgtaattctttacacatttttaagtatatgggctaaagtatgaaaccaactctgagtaataggattataaatattctttatctccttgtatttatatttatttataccttaattaaattttgaaataatgttgttacttttacaataagaagttgtgaaaaactattaccatgaaaataatctagcaagaatttgatttaacattgctcatttcttgaaagcaagccaagacatttttttttactctttttgagactgagtttaaggtatttgatcaattgttagaggatgagtttatcattttagtgccttgctgatttgtgcaggcacctcagttttaagtaatcatgggattatttatttgttgatttagcatttgttcagtacttatgtgcttaatagcacttgaacatacaaagagaaatgagatttttggtccccaagaattaaaaatttaatggaggagataatcataaacttacagagaagtatatgataggctgtgtcaaagtgggaacaatgtagactagggaaatacaatgcttctcttggatgggtcacacctaggaggggccaaaggggacaactcactgggtattggaatgatctggatccctggattacttggttggtgctgggctgattcggaaaccctttctattttcaactcttctgctaaacatcattatagtaacatcagtacacatcctgctgttaccaagtgtcagtgtttggtcagtttgagttttacaggcatatagaactgccattttgtcatttctgtctacattgtacaaaaaagtaatttaactgagctttataacttatgatttggagaactccacagctcccgttgttctttctcaaaaaattattttcagtgcaacttagctttctgtgtatctccattgctcatctgccctagatggttcaggttggttgctgtctctattagtgtgacaagagttaataaaatgattaattaaaaagagccttaaacgtctacttagaaaacactagataaatgctaagtagggtgctttttggtggatcaagagagtccagatcactaatatatggatggcgtataaattaaatcactgtgtaagactgcaaaatgtcagagaaacattttaatatgttccccccagcatttgcctttctgtacatatgtcttagaattataatgcctacattttaactatggttttctgtgggtatatatacaaatagatagcaactgattaaaaaaaaagatctcaacttttttttttcaattcacaagattggagtatttggagatagggctgttttttctctttttttccttttaaagccatccacattttcttttctactgctttctcactcaaaaaatgtaagctagaaaaagttgatctcatggaagtaaaaaggagaacagagattactagaggctggaaacagtagggagaaggggaggatagagaaatatttgttaagaatacgaaatgacagctagataggaggaattaagtggtagtgttctatagcactatagtatgactatagttaacaacgatatattatatattttcaaatacttagaggatattgaatagtcccaaagaaatgaaaaatgttggaacatatgctaataccctgatctgatcactatgcattgtatgtattgaaacatccctacgtacaattattatgtatcaatttaaaaaatatctaaaaatatatgtgtacctaagtgtatacaccttatatatcctttgatttccttatgaaacacagcatagtttgagatttaaaatgaataaaatggttctttatgctctgtaaaattagaaaatccttcagcttttagaagctctctgttggtttattagttgatcacaaattaatatgtccctttggtttaatctgtatcataaaacaaaagttgactgttcccaaacatgtgcttggataagagaaagctgttaataaatatctattgactgaatgaaagtataaatgaataaatatttttagcccttagaaatatgtgaaaaatacctagaaaatattagacataccaaggtcaatgctaaatgtaaaatgtatttctaagaaaactctaagtatgcaaccatatggattgattaaaactagttacttaaaacctcttatgactgtatttttcttgtttttgaaaaataaatgcagtttgcactctccttgcttagaacttacgtattctatttcacaaaagtgcatgcttgtgttattaaatgtgtgtgtgtgtgtgtgtgtatatacatatacatatatcttgatccctaatctcagttagctccaaaggtgttctaaatatataaatgttataggtcacagtgtgatctcttaacactatattttttggttgagtgtggtggctcatgcctgtaatcccagcactttgggcggctgaggtggaaggataattggagcccaggattttgagatcagccagggcaacatagtgagaccctgtctctactgaaaatacaaaaaaattatccaggtgttgtggcacgtgcctgtagtccctgctacttgggaggctgaggtgggaggatctcttgagcctgggaggtcgagactacagtaagccaggattgcgccactgcactccagcctgggtgacagagtgagagaccctttttcaaaaaagcctacgtttttcaccaacacatttcaaaattacttttaaaattattattgtttttaaagataggtatgtgccaaaattagaactttgggtccaagagcatctccacattcacataaagaaacttaagttcagtaacttgctcaggctataaagtagaagagttaggatttgaacccaggtcagagggctccaaagccctttcactttccatcaaaaacatttgatattttgccaaaaatatcatgactgtttgtccattgccatttcatatccttcaaacagctataaagtgtggagaaatgataacttcataactcacgctacagctcgcagacacacttaattagcttagggacaaacagttgtgacattatgagtgggagttgcaaggctgagttgaatgtactgatggggatgttggttaaaaacaaaaagccattctattctacatcgtggcaatctttgtacttcaaaagtagtagtattctgagacgtttactgtgtattatagatttgaatcacaattcagcaatactagagaaggagaaatctactttttctaaattttctctacagtgaaataaaatgcttttggaatatttacttgaggaatgggttatctgaatgttctcactgaaactcattacaccgtatagtgaaaatctagttacaggtagttgaagtgtaggtatagatagtatgtgattcataatgacgcatgtatgccatgatttacctcagtcactggacagtaagaatgtgattaaggaagtttcctctgcaacatttcaagataagttagctgttttgagccacacaaatattaaactatgcattgtggccaagtgcctataatgccaaaagcacctgtttcaaattgtgagtaatatcttatgtgttacactattgaaatctccttgttacagaatattaatactacctattgaaaagagtaagaaataagagtttctcatttccacccttttggatttatttcatcaaatgatgtgttgatgaataatgccctttctgtaagatggataactcatggaaagaaagccatttggacatggatactcaagattttaaagaatttaggaggtggcagtgtgaatatcaaataaggtgccacttgtagagagagtatctcagaaaaggagcagagaatcatacaatagaaaagtgaaaagctgtttcctgtggtagatagactctaaataatgattttagagacagacataataaattaatttattggttcattgaagaaacatcctgagttcctatgacatgctaggcattgtgctggtgggggcgagggttgggtgagtagtggcgtatggagatgaaaagatgcatcagacatggtccttgtcttcatagaactttccacagggtaaaactggaaaaaccctgctgggacagagtgggcatctattccggcttaggcaagcatatcttatcctattgatatctgtacaatattatccttaaactagaaatacaataatatgttttattctgacaatgaggaataattttccatattaaggaataggttaatctctaaatagtatgctatttattttatcttactttttcctctgtgtttttaaatatttaacaatttaggtagcatcctagcagggcatcactagagaaataaaatgaagcatttttaagtaaatatattttacagatcatttggaattgtttcaaaaacttcattaacttttaatgaaccaaaaatatagttcattggaattaaatgttccatgtgaagatatttatttcggaaactacatgactaaaccaatggtaagttgaagttaaaaaagtgaccccaagagagggacaatgtcatattattattgttataacccatatatgtttaataatgaccatgcaggatggtgcatatagcaaataactaggtaaagtttctaggaatttttattctatttctcttctttcaattctaatgtatgggccaactcatcattttaatacagagctttgagagaaaatgcataaatgtaattttctgtatgatcactagatggcgccatgcttcccttagaatgaagctgctcaggaatttgcaagtgcagttctgagtatttcacatagaaacctggaagatgagacaattgtatttcccataaggttttgattcactaatatcatcaaaacaacaattagcacgtgttactttgcattcaaaaagggagtaacgattgggtttgtaaacagtatattgaaataatcattactgaggacaaaagtgaagcatgcctctaagaggtaattcggaaggtctcttttgctttccaaaaacatactagtaacaaggaaacatcttatacttgcttggaaaactgggtcctagtcaatgagctatgtcttaaggaatggaaatactggcaaatgtggtaaagtttacatagccattttctgcaaaccaagaagataaattgcattctgcctagtcttaggcaaacagttgggccatttactgttccatcaaaaaaaggattgtcagatccccaaaagcacaaggatgcatatagagtgtccatttaaacttcctgatcaaagatatacactcgtgaaggtggagtggaagacttctttataggagtatgattcatgtttataaaattggagacacttagaaagttgagttaaaagtgactcaaaggatatcttttcattgccctttttatagatggaaaaacatggatgtagctgtttcatacagctaagacactagtgcatcaaaacacaatacatttgtgagacatcttgttatgatttcaaagcagtttgtcaataaatgtgtatgttcaatggttacagtttgggatggtaagacatcatcagctcagaatagtaacatccttccctttatcttttttatagaactttaaacctggatgcaattttaagatcatatgcatcattttttctatatggtgattacattctagataaattaatttgtgatacactctggactttttgtattacatcaagttgaagtttccttttgtggacttagaaacaaaaaatttgcagtaataaaaatgaaaagagattatgcaaaaataattactaatgaccatgtttcttaggtgatgaatttaattgagtgttggtattttaagaatacgtgcatcaagcaaattataatgtaaccaaatatccagagatttgaggaggaatatcaggttattatcacatttcagagctgaatttttcttctttggttcattgactgcattgaatctttgttttgtgggtgatataaactttttcatttcattccttgctctaggagtgactctggggaatcattaggtacatgcttgttggttttccataataattatctctgagccctaatggtttctggatttggcctctcttcactttctccaactttaggcaggagttcagaatggccttcagttgcaaagagaagtataaatccaacttaccatctagtctctttctgtgtggtcttggcaaattttttaatcctggctaggcatgctgttactggcagaaatgaggttctgcctcaactttagctccagccctgccgttagcctgaagactttccaagatttagggagggtccatgaatatctcatcttcaagagtgtgctatagagttatcgagcaactcagatcttttaaaaatcttgagtttaggaatcatacatttaaatgtcagttctcctagaaaatgaagattttaatcctttagaaaaaaatctagggacaaggaattctagcatttcctaaagattccatcataagtagtgcttttaatgtaaagggtttctttgaaaaaaattatttctttactttttttttttttttccttgagacagggtctccctttgtcacccaggctggagtggagtggtatgatcatggctcctgcagcctctacttgctgggctccagtgatcctcccacctcagcctctcaaatagctgggactacgggctcacaccaccacacctgtctcatttttgtattttttgtagagaaggggtttggacatgttacccaggctggtcttgaattcttgggctcaagtagtccttctgcctccatctcccgaagtgttgggattacaggtgtgagtcgtcatgcctggctgtaaaattgtattatatttctaatatgaagaaatacttggtttctctttactgtttagaaagataattatcatgattgttttctttattaactcctatatgatactttgtatttttatcccctgctactcaccccaagcttatttttataattagaaaggaatcaagctagccaaacaggagttatccttccttaaggtagagaagttactattttttttcaaatggcgatctgcctgcctgagttgctatttggatctctgatgatttcttcctttgatcccctaactcaaagcaggcaatcaaggctatgctgttagttgtaaccagatggaaacctgatctccatttatactttgcctcttgtattgataacaggacatgaaccaggatagatacactaacagtatttgactctgctgcagttgccaggctaaataaccagaactcatatctcattctactctacctatggaaacactctgtataatgaaaatgtgtgttgaaagtgtgtgggtatatgttgtgtgtatatgcattaaaattctcattagcatgggctggttgtaatagtgcatacctgttatcccaactacttgggatgctgaggcaggaggatcatttgaacccagagttcaaggccagcctgggtaacacagcaagaccgccatctatttaaaaaaaaaaagtaaaaactctcatgagaataataattaaagtagctatgttgatcattgcagtaattaaaccaaaatattaatactcatacctgatatagttttttccactttattataattacatttctctcaaaaaatttaagaattagtatatgtttaacatatacaggttgaatatctcttattgtaaatgcctgggaccagaagtgtttcaacctttgaattttttttttggattttggaatacatgcatacacatagtgagatatcttggggataagaccttcatctaaacacaaaatttatttatgtttcgtatataccttataaacataggctgaaaataattgtatacaatattttaaaatgctttcgtacgtgaaacaaagttttggctgtgttttgactatgacttgtcacatgaggtcaggtgtggaattttccacctgtgacatcatgtcagcactcaaaaagttttggattgtggaacattttgcattttggattttcagattaatgatgcttaacctaccttgtgaaataatggagtcctttattaataacaaaacaataatagatgatacttacagagtacttgtgtgtcaggctctactctaaacattttatatgtattaaaccaattaatcttcacaaaaactctgaattagatatattattattatttccatattttagaggagaaaactgagaaacaagtaatctagtctgtactctaccataatgctatgttacattctatcaacactcccactgcctcttctgaattcattgatagtggtgtggtggcatagagtccacagagtggagcattaattaattttgcataatgtgaaagtaaaacttaagaaaattttaaggaatagacagtgtgcagtgttatggaatcataactatacaattaaggggttaaatgaaatcatgcccaaaatgctgtgttttaaatggtggcactgactgataaaatgtagatttgagttatttattgtttctacattctcaagtgaaaaaggaagaaagtaggaataaaattctggactattggggggggtgtctttagtcttgcaaaaagtaaaaaatagaaatagaagaaagtttttatggttcatattgtaacatcaaaatatggaatgaaaactgtggtctcccatgaagtatttcaggtgctggaaggaaatctcctagactaggactctcagcaagtccatggttcctattatgtccagcatgccatagaaaaactccagaattagttaaattttaataatttaatggagaaaactaatttttcaaggggcagctagttaacttcagcatgagtcaaaaagcacttcatctgtcaatatttatgtaaatatttattttgaattatacatttatttagagtatttatttacattagaatagagggaactaaggccgggcacggtgactcatgcctgtaatcccagcattttgggaggccgaggcggacagataacctgaggtcgggagtttgagaccagcatgaccaacatggagaaccatgtatctaccaaaaatacaaaattagccgggtgtggtggcagatgcctgtaatcccagctacttttgggaggctgaggcaggagaattgcttgaacctgggaggtggaggttgtggtgagcagaggttgcagtgagccaagatcgtgccattgcactccagcctgagcaacaagagcgaaactccatctcaaaaataaagaataaagggaactagccatctgatcatattacaaccaaagccttttattttcttcataacctaactgaatgtgtcaaacagtttgtgattctgtcctccaaatatgcatgtatattccaaaagaatctgtgaccctcagtaggcctgtttttaagtcagtgaactaattctttctttctttcttcttcttcttcttcttcttcttcttcttcttcttcttcttcttcttcttcttcttcttcttcttcttcttcttcctcttcctcttcctcttcttcttcttcttcttcttcttctttcttcttcttctttcttcttcttcttctttcttcttcttctttcttctttcttcttcttcttcttctttcttcttcttcttcttttttttcttgaggcagggtctcactctggactctgtccaggctggagtgcagtggtgcaatcatggctcactgcagccccaaactcctggaccgaagtgatcctcctgcctcagcctctgagtagctgggactacaggcatgggccaccatgtctagctattgttttaaattttgtagagaaaagatctcactatgttgctcaggctggtcttgaacttttgaactcaaccaatcctccagccttggcctcccaaagttctggagttacaggcatgagccaccatacctgctaactaattctgaaagataagtcatagtattgaccataatagtgatgaaaataagtggaatcccaggaggaagcctcatctgcatgtggtgaatatgtaacagtaaagaggatgatcatagtaaggctttctactgtgcatagcatgttagcttttactcttgcttttacatattcatctcatttaaagtttttgctcattttaattattctatgatagatatgacagaggcagggaaagtattatcctcttctccctttactcccaattacagaggagtacctgaatcccacagaattgacatatttcctcaatatcagttagtcaacatcaaagagacttgaactgctatagtcattatatgcagtcttaaggacacactctccacattttaaggtttaaggatggataggatttccacagaagtataaacagaaaaattgaagacagaggaaagaatactggacaagggcaaaaaaacaggaagtatggtacaacttggagaaaatgccagtgagctgctaagctcaggtacaggatgaagagaattagcaggcagatgttgatggaatgccgcaggaagatccatcttgaatggtttcgtgggaacatagactggatgtgtgatctaagaaatataagactagtgggttagactcagcaaggggtaatgtggagctaagtttgatgactatagatatggaaagactcagggacagatgctacagaaatttcaaagttttgataccatattacacaaactaatatggcgcttgaaaaagagtgagacatctaagatgattctcaggttcgggtctgaatgactgggagaataatgatccaggaacagaaatagggaaatcatgagaagatgctaaattgggaggagatgctgggtgtgatttgctgagtttgagtacaagcagaccatgcaagtagttatgtctaacttggaagcaaagtaatggtgtgcacctgtagtcccagatattctggaggctgaggtgggaggatcaattgagcccaggaggtcaaggctgcagtgagccatgatcccaccactgcattctagcctgagcgacagagtgagactctgtctcaaaaaatgtaatgcaatgcaatgcaatgcaacgcaacacagcaaaacacaacacaacacaataaaaataatgccttcagaacctcccccccaaaaaaaaattctaggagggaagtggggtaagcctagtgaaaattctcaggctaactgacaatgtgtatgttttgctaaatggacttcagttggcaaatcaaatttttgagttagacattaataatattgaaatgtaatatccacccacattgtccatttcatagaattactctgtttttgttgttcattttgacatttcctaagctgtcacttgacccagactgacacattatcatctgcatgcacctaggctctgccttatatatgtttacaacatgcaatgaagcctagtgcctgtaatcagaaagagggtgctgcagtccatcatgtgaaaaaagagctggactatgaatgaggaaacagattttactctgacatcaaggctggccgacagcatctgtcatgcccctaacacaatcatgctaattataagccatcactttcattcttcttggaattcagaagtcaggagggttgtaggggcaaatttctaacgggttgtggaatctatcattgctaggaccttttacaattcagttgcttactctttttaaaatctgccattcagcagtctttttcagtaccagtaagccacgctatgcattcctatgaataaagtgcacagcaacagcatccaaatgcagtgacggaactgtatggcttctccttggaatagcttttaaaaacctgcttaggcagggacactttattgcttgctgaaaaattccaaaagatttgtgactatgtttaataaattatcaagaactatatagaattccttagaccttttttctaaaataaacttttggagattttttgtttgttggttgttactattatttttagagaaaggacaattaaattatcttcagatcccagggaatggtagaattagtctttttggcactgatagtaaggtaggtcatgtcttagtccatttggactgttacaataaaatatcataaactctgtagcatggctgggcacagtggttcacggctgtaatctcagcactttggaaggccgaggccggtggatcacctgaggtcaggagttcgagaccagcctgggcaacatggcgaaaccccatctctactaaaaatacaataattagccgggcatggtggcgcatgcctgtagtcccagctactcgggagtctgaggcaggagaatcgcttgaacccaggaggcagagcttgcagtgagcagagattgtcccactgcactccagcctggccgacagagggagactctgtctcaaaaacaaacaaaaaactgggtagcttataaacaatagaaatttatttctcatagtgctggaggctggggagtccaaagtcagcatgctacagatttggtgtctggtgagggccaggtttctggttcattaatggtgtcttcttgctgtgtcctcacttggaagaaggggcaagggagctataacttggaagaaggggcctctttaatatgtgcattaatcctgttcacaaggctggaggcctaatgacctaattacctcccaaaggccctacctcctaacactattgcattggtgattagatttcaacatttgaattttgggagggtgccaatgttcagatcatagctggtcatttcagcttatttgtactctctaagttatgctgcaataattgttggcttctgtacatgggcaatatggaaattaaagcaatcataacattttggtagaggacctgaggagagattattctgaatgtgatgaagttatagtctttttcctcaggtggattagatcactttttggatagaaattttatgttgggaaaaataaaaatggttcagtgacctgaggcagaaaaagtctgttcacaggaatataagataattactccatcaactcacagttgtttggaatgtcaggatcaataatagtcctcagaacattgtaaccttactccagcaactatgctaacataaagcagagaagtctgaagtctgtccattagtattggtgacaaggtcatggttgcttttaaactttgcttgccaaaatacctggagggaactcaatgtgcatactcaagtttctgctgtggcaaattgactgttgctaccccaggagaccctaggaagacaatcagttcatgtctgactggagacattgcaactttatttgtatgaactatttgggtcaaatttcagggggacatgtcactacagaggggcagagggtcatgataatgaaaagaatcattacgttatattggtaattagatgtatgactctacaaacttgtttttccttgggtgttagtaacattctttttggagatagatggcattttacaaagtctatccacagaaaactggaagtatctaaagataatgataatgacgagaatatattcattgtaatctggcatacagaattttctctgccatttaagaagctgaatttcttttaagtatagaaaggttagacttatcaaccttatttgcagatactatttatgtttttcatgttttctctctgtccttaaatattttctgagatttaggcactgagctctctgctagacattttcaaattttatcttttaaaaaatcagaaaacctctctttatgaatgaaatttttcacaaaactctgatatataaaacaggcaaaatgaaaccattatggcaggaatgagtctgggatttgcctatttatttttctttcttctttctcctgtctgctaaattttctacaagcaaggcaagcagttcatgaatcaactgttgactacttctgaaacctaaaatgaaataatatatatgaaagctgttattcagtgatttatacttatcaaaatatacttgtcaaaatattaactgatttgtgtttgtcaaaataaatatattcatacatagcaccttggtaaatcacagatctagttgtattgtaggtgcctagaccaacatgacaacttgattatatggcttgagatatttacatcactcttaccacaaaaacgtcaataaacagagcttattaatcttttgaggaggaggaaatgaaggtgtaggaaagcatgtatgaagttctacagcatttgtatacatccatctttgggaactgagtgagcaaaaaagaataaaatgttgatattagcatgaaaactctcactaactctataaatttcttgtcaatattaggcctgtttctaaagccaatcagaatgaaggaagagctttttaaaaataggcaaatgttggttacattggcttcaattttaaaacaaagttctacattctcttcagaatgcgaaggaggttgaaaaaggaggcatttcctgcatatattttgagatgagacgagggtgagaaaaggagtagagctgaatgttatgttattctgttaacctttgtcaggcccatcaggctttatatggttcaaatttctgctgtatattttgatactttctgtctccacagcagttactcaggaatatatcccaataatgacactgaaaatgcagtgaatttataaatagatcccgctgctgcatagattccattatttagaaaattatacagcgttctgtaggaggttgaacatacagtaaaatagttcatttgcttagaaacaattattataattgttattataaaatctaatagattattagaaatatcacaatataatcaagcaagcatcagactaaataaaatgattatttaatatttgcttcatatgataaagaaaaacttaaaattgattttctatttgaaaaatatcaacagaggctgggcacgatggctcatgcctgttatcccagaactttgggaggctgaggcaagcggatcacctgaagtcaggagtttgagaccagcctggccaacacagtgacaccccatctctactgaaaaaaaaaatacaaaaattagccaggtgtggtggcaggcacctgtaatcccagctactctggaggctgaggcaggagagttgcatgaacccaggaggcagaggtcgcagtgaggcaagatcacgccaatgtactccagccttggagacagagtgagactccatctcaaaggaaaaaaaaaacaaagaaaaatatcagcagaaataagtgagttgagtaatttctaaatcttatttcctatgtaagtggttaagaaataattaacttttgttctagaagtattaaggagacaaattgcaaaatttaatgtgaagccttggctcacaataaatactttctttaaacttaggatatatttaaagtggaataatattttccaacttaaaatgtaaccatttatttttttctttaatgtgtttgtgtatacatctccttctttgtcaaaggtttgagtagaattagaaatagctgcaatttacaaaactctattttgaaaggaagaaaattaataataaatagcagaagtaaaagttatctttctggaatctaggactctcacccactctcatcttcaatatttaccccattgtttcacatatggaatattataaaattaaaatataagagaacggatatgttattattcaaattattttcattgagggtggtttgcccagtttcttagaagcaattaaaaggagaggataaggtggttttcttaaaatagtgctttctttctgctgaatttatgtaacttttttaagaatggcaatctaagtgtacaaatgatgtttaattctcatgagatttcattttaaaccttgctttagagtaaactttatgagtaataagattatacgtgtgggaaactgaaactaaaaggattcaaatggttttgacaaacaacagatattcagggtcagtgcaaataaggttacagataatcactccatctgctccattgtcagcaaaaatgaggcccaggtgttgcagtataccttgtcctttctcctgaattgtgaccattgacaaataagattttcaaagagaagtctgaattccttagggtttagcctgagctcttgtaagagtttctttccagccaaagtattttcttgttttcctgtcaattcaatgggttagaccattccatccattagaagaaagtagaggaaatggctcaaccttgcccagagtacagctggttggaactctgacaacggaactgtggcccagggtaaagagcaagaggctgggggaagcacgtaatgcttcttaaagcctttgatctaaaatgacagactgtcatctccactcacattccattagcccaagcaagtttgtggctaaccagacaatgggtctcagcaatatatcccccctcccagaacgcctgaacattcaagtggcaaaagagtgaattgttgagaacaataatatagtctataatagcatataatgttcataaaattagcaccccaggcaaacaggacagaatgcctatccccagccacagctttatcctggcctacaatgctcatttatactttctttcctgtgtgaaatgaactacacttagtttattttaacctgatttttacaaacccataaagaatgcaagagatgcagtgggccaggaagaagtgagaatgttgccctatgtgtgattttttctagaatctgtctaagttctgctttattcctggatatcttgatatggaaaattaataggattgcatggtaacttccttatacacaagtttatttacctaatttagctcaggagtatgactcaattactagcaacctaaacatgcaataatgaagggaatctccatgttgcttatgcaaacatctagagtcatatgtcactttgtaagtagacaaaatgtagggcatgtgggctggacatgtcaacatgctgctgactttatctgtcattaatttttgttgtgtaaattagcatcctaatgacacacccccactgtattcattctgtgccctgtctcgccccttaacttggagcaggtaatggagtttttaaacatcatttgataatttgccctcttcagaaagtaatactaaggaaaagctatttaaagtgagcagaattccttttatctgttgatttagaaatattatttatattgccagaaatttaaaatgttcaacatgtttatagttattaaaactttgtaaaagtaaagtatgttaaatcttcaggagtatcactggaggagctagatgacaaaatatatatatatatatatatataatattatcatgaaaatgcagtgctggcaaactgctcctgggattataaatatatcagtaaaaccaccctttctcctgtatcctttcagcattagccataaaatagactggccagtaggggttactcttggcattatgatctaagagtggtagattagagtttgaagacataatgagtggtatttttaaaaatagctattatcgttgtgaatttaggtgcaatattcagaattcagaattggtgataacttgctttgagcactgtttcagcagcttttatcctattcatatgactgtcagacatattccaggaactattttacttagccttgttgattgtccctcattaaataaaatccacaggtcaaaattgtaaagtagccttttagttcaatttggcatctttttttcctgggtgatattctcagtcccaggggtttgaattccagacatccttgaaaacaaagccttatatgaatgtagtcagaactaactctttaaaaggcaaaagcacaaccacattcagttaccctaaagtaactgtagtcaggtggctcttcaattttagaaaataaattactttcaaaaagaagaaattagaaaagggaggaaaaaaataatgaagcctcatggacatttgtttttgagagagaaaaaataaataaaaggaagtggttttaaatattggtttcataaaaacaaaacttagaaaagctttttgtctgaagcccaaatggttacaaatgagctctgcttactaaacatggggcagaaagagttcattagaataaaatactattaccttcagaagaaatatgtattaccaagggatgaaatgcaaaagttactaattcaatatttatttatttatttatttatttattttggcgacagagtgagactctgttgcccaggctggagtgcagtgctattatcttgactcaatgcagccagcctctgccttctgggttcaagtgattcttgtaccttagcctcgtgagtagctgagtctacaggtgtatgccaccacacttgactaatttttgcattttcagtagagatggggcctcgccatgttgcccaggtgagtctcaaactcctgagttcaagcaatccacccatctcggcctccccaagtggtaagattgcaggcatgagctaccatgcccggcctacttcaatatttattttttaataaatcaagtttgttatgagagagttgtcagagaataggaatcttctaactgctggtatcttgatgcattcagagctcaaggatgtgtggtgtggttcagaccatttcgtgcacactgtagcagaaggattgccctttgatggctgggcaagggaacattatgatagatgagttatcaaaatattgctaaaattctttaggcagtttgatatagatgttactgtagctggacactgtcagagaaaggagatagctgtaacagagtaccaaatgaaaaacatttttgaatagactgtccttaagacttcttacctacgaagactcctaatctcttcttatgacataattatcggaaaggcctggaggccacaccttgagaagaaaagcacttatcagttgtgattttcattttcttcacagttttctccactcagctagcttacagaggaaaccaaaatgcagttggttgtttctctttactaacactcagttcctaagtgcttagctttagaagttttttctgcctgtttacttccacttcttgtgtgacataacaatattttagggttttatttttcttttcaaaattcttctggtctttggaaagaaaattaagacactatttactctatgtttgctgatgcagaaccagtaagtttgttcacccacccaagtgattcattctaagcaaattctcccattaggcatttgttgcaaatctgcaaaagttgcttttatttactgattcaacatatcccttcccagtataaggatctcctttgacggtgaaaatctccttggattgcataggttttcattgtacagagaaggcttgaccttaaaaatttaagttgcattaaaatttcttttatgttttagagagacagaggcactctgttgcccagactggagtgcagtggtgcagtcatagctcaccgtaccctcaaacccctgggatcaagtgattctcccacctcagcctcctaaagcattggcattacagatgtgagccacctgcttggctgaaacttttcttgaaacacacacacacacacacgaacactcacacacacttttttatttataaagatctcaaccaactttttaaaccatgcaataaaggaatatctttggcattggcaatgtatatttgttgactgctggagtcctttgggcaacatcaaacacccaattgctcattttaaaatctggctttccacgcctgtaattccagcactttgggaggccgaggcaggcggatcaccaggtcaggagatcgagaccatcctggctgacacggtgaaaccccatctctactaaaaatacaaaaaattagctgggcgcagtggcgggcgcctgcagtcccagctactccagaggctgaggcaggagaatggcgtgaacccagaaggcagagcttgcagtgagccgacatcgtgccactgcactccagctggggtgacagagcgagactccgtctcaaaaaaaaaaaaaatctggctctccattttgggttcttaggtagatggaatagagtttccagacttgagggttttaattcagcaacccaggatcaacactttctaggtgtgagactttagtaaataatatactcagagattcatggtttttttttaatctataagttgcagaaaataatatcactatcatgcttttttaaaggattaaataagatatatttaaaaatttgttatccttatacctggcatagagtaagcgaacagtaaatggtatatttgtaattattcttttttacgttgctttctacttaatatgcgtttattaagcttcaccttaagtataatttagcaaaggattatttcagttttcccttaaaccagtttataagtttacatagggaggttaaagccaacaggaatttttatgtaataaggaaattcaaatatttcagtatctgtgataagagttgtgttaatttgcagaggaataacacaaaacattgattaaatttggattgctaaatgttaaacagtgtttgtacaataaaagtgtgattcagaaaaagccttattataacatgcggaatgtattagcactctttggagacttactatcttttaatttattttattaagctgctgttgtgagctaactaataacataagtgtgaactagtttgaagaagaattgcgattttattgaataatattctgcaagaattaaatatcaataggttagcaatatctcctcattgagttaaagtatatagattgtatacatgttctatgtatatactatatataaatgtttagatagtatatatgaatggcataattactataagcttacagggaaatatgcagagttgctgttatttttagaaagtaaatgatgacatttattttttatctaaaactttaatctgttcagtgatttagattcatttgagctctaatgatttggagagtaaggcacaggcatagccttaatttattggtgatgaaaaaaatctacttattggcaagatgggggaaaaaatcacaagccttgtatggaattgtatgattctgcagagttgcaatggtgttaacaattgtgacaagttacactttctgagacaatcttcaattttagcaattaaaatagcaaagaattattatttataacagtattcataacatagcaaatggtcatattccttatagagacagcacttccgagtagtctttattttgtttttcaaatttgtcctttcaatatctcaaaatatcttgtgttgcaattacatttccaagtatatatttggttgggatgaaaatagctgtaatagtagtagtagctaccatttattgaattcttgccacgtgcctcatattttatgtggtgtatttgatcttaggccttaggacaactgtaaaaggcaggtattgtagaagacaatgttttctgagagactgaaatgacaaattagaaaaaaagttaaagacttcttggaaatgctatctctataaggaatatgaccatttgctatgttaatactgttatgaataataattatttgctattgtaattgctaaaactgaagagtgtctcagaaagtataatttatttgtcacaattgcaactctgcagaatcacccaattccatacaagacttgtgattttttcccctaacttgccaataagtattattaccataataaatatgctgacgtttcaaagtttaagaaacttcctacagttctcacacgtagtggtgacaatatggctaaggggttaggaatgcccacatcctcctatgctgcatcctgcctgtggtttagatttgagatagggacccctactttctttcccctaagagcagatctgtgtcattggctataactgctttctggtcagccacatgacacgtggacttaacagatggtttctaataagattgaaagcatatcttgactccacttacctggccagcactggagaaaggaagattaagagagatttggatgagtgtccttgtcacataacttcccctccctagaaaacttggtccaatacgttgtaatctggtggtgcaaactcacaacttttcttcccttctgtgagtgtgtatatatgtgagtttattgtatgtgtgtgtaaggtgtgaatgtgtatgtgaagtctgtgtgtgatgtgtgtatatttgaatgtcctgtgcatgagtttttttgtgactgaagtgtgtgtgaggtgtctgtatgtgggatgtgtgtgtctgtgaggtgattgtgtatgaggaatgtacatctgtgtctgtggtatatagaaaacgtgtgtgtggtgtatgcacttgctgtgtctgcatatgcatgaattgagtatgtgacttgagtattgtgtgtgtaggaggaggggggaagtaaaaaggcaaggtgacagtagagactggacaaatgaacatagccgggcactattcctttaactcctagaacagacataacttgaagtgatctagacttgaactttggagtatgaagttccagccagctgtgtaactatctatttaatatttggaagcgcttagcctgcttaaatcttgattttatcatttctattagagaagttttaacttaaatgctctaaggtgggggtgtccaagggagaaaatacagtcatgggttcttagtttctgtttctggttgggccagaaaagctccttcctcatccctcttttccacttatcaacagagacagaagctaaaaaccatggcttctggctgctaaagcctaaaataaaacaaaacagaacaaactcatcaacaataacagcaaaataaagcaggttggaaatgactgctctaagggtgaagtgaatatgttcaggttggagttactgataagttgtaaacaattacaaggatgtaaaatattgcatatttttattagtggcattacttttccaacattacattttatattgaagttccagaacaacaaaaaaacactaaaggtattgcagtgaggaacttatcagtaagtgcttctaccttcaaggaattaagttaatttttattggcaatatttggaacattgtatcaagaagaaagactagctaacgaatctcttttgcacatcaagctcttacagtgttaattcattaaacaactaagacaattttaagtaggagctttggtctaagatgtgtggccgcaaactgaaccaatactgacagaatttggcattaatttttttttcagagaattttttttttaatatatggcaatggttgaaaaaaaacatagaatattgtagttcctcaaattgttaaacacagagttatatgatccagcaattctacttctaggtatatacccaaaagaattgaaaatacatagacaaatgttcacagcaacattattcttaatagccaaaaagtggaaacaatccaaatagccatcagctgatggataaacaaatgtggtatattcatacaatggaatattattcaacaataaagaattcagtatcaatgcatgctattacatgtataaaccttgaaaacattatgctaaatgaaagaagccggaatgacataatttcatgattccatttaagtgaaatgtccactatagacaagtctatagtggattaatgattgcctagggttggagggggtatggggaattgaagattgagggtcaaagggtttggggggtgtactgaaaatattctaaattgtgttaatggaggcacaactctgtgaatgcactaatgtcactgaattgtacattttaaacaggcagattgtgtggtatttcagttgcatctctataaaggtgttaaaactaaatatagaacaattttcctaagtagtggcccctcctcatttattggaccaatagtttgggaggaaccagtcatgaccttcctgatacaaatcaacacctacagataggatgggaggcaattgtgctaacaaagtacctcaaaccacaaagtctgtcagtaaactgatgcttttgtcaaggatgaatgaccaggggcaggtaataggtgagcaactctcaactcttttgtatatggtactatagtctggaactagcaagtactgaaaaacgctagatgataaaagtcattgttattttattcttccctctcccttcctcccctcccctgtgctccctttcctcttcccattttatttatttatttgagacttggtctggctctgttgcccaagctgagttcagtagcagtatctcagctcactgcaacctccgcctcatgggcttaagccattctcacacctcagcctccagagtagctgggaatacaagtgcatggcaccatgcctggctaatttttacatattttgtagagacggtgttccaccaggttgtgcaggctgggcttgaactcctgggcttaagggatctgcaggcctcaccctcccaaagtgctaggattataggggtgagccaccacacctggcctcccctccctttttcccctcccctcccacccttctcctctccccttctctctcttcccttcttcttctttcccccttttcctcttccttcttccctcctgtctttccctttccactcttttctccttccccactcataaatagatattataatgaattaatttagaattatagttaagcatacatttgaagtaattgttccaatttcataattttgaagtattttctgagaataaactgggcaaatgcagaattgggacaaatcctatgtgcaataattgctaataggaagtgttctgaagtatgaattctctcctcctttcttgtttgacttgtcactgaatctccagtcctacagagtactatgtcctgcttattgtttatttataccacaccccacttctacgtataaacatcactttcactacggtggattcaaatgatctcttaggaatttagttacattacagtctcacataaaattactgcccttaaaaacatttgtttgctgggcagggagtggcgaaaccccatctctactaaaaatacaaaaattagccaggcgtggtggcgggcgcctgtagtcccagctactctggaggctaaggcataattgctttaacctgggaggtgcagcttgcagtgagcagagattgtgccactgcactccagccttggcaacagagtgaaactctgtctaaaaaaaaaaaaaaaaatttttttttttgctaacattatttgaagaatagtcagttcagtatgcatctatgtagacctaaccaatagttgtattttacaagtttcagttttgaaatgttggatgatatctttcagtttaaaaaattagtatttctataaagtgtctttttttggatggaaatgtttctggaatgtgacacttaaattttaattactattattaaatatcaatggatttgttttgcataaccaaacagttggataagttcagtttatgtgctgtgcaatactaagatatttacttggcatggagagaatcactggcttactaaataaaagaattcagcattttgtttgtcaatcctatgttaattgcatttatatttctgacagtttccttgatggaattaaaaaaaaaaaacatgcaataagatctgaattgagtgttgaaatgagtgtttcctgagctccaattagtgaaagtattgagatttgaagaatggttgaggagacaaggttttataattgcccttctgggaaaaagaatgagtaaacaataaagtcttgagatctctcaaacaaatatacagtcataaggaaagtttaaaagccacagtgaaatgcacacctcttaattatgttaacattgatatctattttaaattgatatcaatattagctgtgaaagtttcgtatattttgcagggacaaattctcttagtgtactccaaatgcttattgttacacatcctgagcacacaacgcaaacatattgggcaagcaaagaatctaggctgatatgtgtgaatgcttatgtggcattctatcaaaggagatagatgtacataaggggaattatggagaagtgaaaatttgtctaaggttcattttttcagtagcttaattttaatagtaaactcttttaaggaatgaatggccacaggcagagactaatggtgtactttcagtgttctcagtgagtgcttcacagattaggtttccaagagaagaagattgcctctgaggaagaagagatggggtagcaagaggcatatatgagaccgttcttgggaccaacacctatggaggggagggaagaaggcagaattatgggaccagatagaagaagttggtctgcaatgcagtcttgaggaaggcctcagcagagccaatagacagttccgaagctggcatgcccttgagagttgtcctaaattcgggtgagagggttaggcctttatatccttggtcacttgatagtagatgctggaacaaaatggtgctctttagctaaggcaatttacagagggctgacagctgagagcacttgtagaatctaggaaaatgagtctttcattcttgaaggggaatcttcacatcatccactacaaatggtgctatattttggaaccagcagacactgagaaatgccaggtggatagaatccttccttcttttattctatctttttttctttctttctgtctcctaatctagtgcttctccaaaaatacttttaagaattagaattaggccattagttattataaggaaggaagggaaataatcattttcataaaactcagcaattcttttaatgtcaagatatggattattattacactcaacaattataattattaatattttccacggaaaagtttcatatattgaatgacccaagtactccatgtgaccttccctgtctatgtaagcctagcattctgtcagccaaataaaattttggaaggaaggtcagataaaattattttttcactcggtgttaaagaaaagaaaaaataaagaacatttattgagcatgcactaaatatgacataaaagatctttgttttctgtattagaggttgagaaagaatgaaacagtctattgatttgaaaagctttgctctcatttagcaattattattattattattattattattattattattattattattattgttgagacagagtctcactctgttgcccaggctggagtgcagtggcgcgatctcggctcactgcaagctccgcctcctgggttcacgccattctcctgcctcagcctcccgagtagctgggactacaggctcctgccaccacgccaggctaatttttttgtatttttagtagagatggggtttcactatgttggccaggatggtctcgatctcctgacctcgtgatccgcccacctcggcctcccaaagtgctgagattacaggcgtgagccaccgcgcccggccaacaattatttttataaaataaaagtttattaatgaatttatacaaatagcactttataaaaactacaacacattcatttgggctgggctgttgcctggttagtcacattttttcttctttatttagctattgcacagcttctgaggcaaccacaaaaacatcaaattatggagaagtgagtgcatagatatatgaaatcaacatttcaaattggtaatagaatgaccttacttattaagtagtgatcttttatcaagctgctacaataaaatcgaccataacattaaacatggtagatgttactaaccagaaatcttaggtatttaaagttatgtttacttattttttttaataagacttggaagtgtcacttaaatcacacttaagaatggatattggctaaaggctgctgagtcttttaagattcctgtgaatttttttcagattgttcctcagtcaattcaggatacttgtcattgctggctatacagcagagtgcagagttagcccttgcagacacacaaagataactcaaggcactgatttctgcatcttcagcctcctcatttcattaactattaaaattaattccctgtagagataatttgcatcaatcaacagaatagaagaattagaagagcttctgaggcttttctatgactaaaagagcaattcttttattgactaccataaacattagatttactaaaaggaaaaggtgttttaaattgaaccacccctctaatttattcatcttagttctgaaaacatgtaggtaagagttaatcatgttactgaatctaatttaaaaagtgagagggaaagtactgaatatttttcctctttgaaattacatgttgtttgcaatattagcctgcctgtatttttcatgtaaaccttttgtacattgaaaacaaattcaaaataaagaacgtttgttttcaggctcagaccttaagaactgatggtcttttcttttacttctacacaaaagtctaagcagttctgaagaaacactacagtgacattgggtcattgctaaaaaaaaaaaaaaaaaaaaaaaaaaaggttcacaaactatcaacattttaacaatctaatagttgattgttgtttcccaaattggtgattttgaatgattattttatgtagaatggaactgtgtctttttcttcattcatgcaacaaacatttcctgatggataccaagcaacggtgacaggtaagcatgccatcctagatcagtgttatataactcccaagcttcagtgaaggcctcatttttgttattacaaactgcctctctgggacctcatgaaggtactattcctgtttcgggaataggtctatccatccttgtctttttgtttcctgtcttgattctacaatctcccctttggccattaccatctcaaaatcctgcttcccaaggtaatccgtctagcttttctaatcttctggcttcccattactcatttcaattccttcttctggctccctgttgctttcctaaccaatttcaattacttatccttatcttgaaggccattcaccactctgccctgctgacgtgtttttcttatcacccaagattcctcccccggctcacacttctgcatgcaagcacgttcccaaagtatgaaaatgctttggatttatatcatgctgttgccttgaagagttttattctcttcctcatatcttctcagagaagaaagtaatttggctgtggttcaaaattcaccaaggcagtaaaatcttgtgttttgtacacaacttcctttctaatgacctctccctttcttcacctcacattgggcattcactcataactatttaagggccttctcttaggcggctgccctgttttcaggttgtgccctatgtggtcacaagtggctattcttaataaatcatagaatcgtagaatttaagtactgacagggatttcctatatataagaatccaacttcctactctgcagaaatccatctcagaacattctcaatgcttaaaattgccttttcgggagagaacatcaactcgtaagacaagctctttccttgttgcctaggactcatttttagaaaaatattctttgtaatgaattgtttccctgccacttcctccctttggtatgaggcatgttgccagaaagatacaaaataattctaataatctttcttagccttgataatgcaagagaatacagcaataatttcctccattaaaccttatttttttttttttttgaggttagatgcctaaattacttcaaggattcttcttgtggaagcatttttgagaattttcttgtctttctgcacctctgatttggtaacttgaccagcagacttcacaagaagcttgctgtcagtgttagtccaaacacaacctatcagttagtgtgtttagtcattaatatttaagagtgttttcataacctttaaattaataattagtcatctttattctttaatgactacagaagctcacattcatagtattttggtaactaaggtatccataggctcaaaaactcttcaaaattattgtgtaatgaaaatgttaaccatatttaagagagtgacttggaaaaaggccttgtttttcaatctcatattttgaagaactattgagatgtcactgaatagtatttttagaatttttgaattgctcacacatgagcacttggggaattggtcagtgaatatatctcctgagcactttgttccttgaaattatcaaatccttcttggaatttctttttctctctctcgtgatgtgtgggtgggactgggacattaccaacacaattagaacttcatttctttttcttcttagtgaaatttattttctaaaaggtttgtgtgtttcactctattagcagttctggaatcatccaagagtctaagtagatgtagcagagctcttatggaaactctggatatatacataatcacacagagaatttgtatttaattttagagttacatgtaccactggaatcacattcatatttctattacagtgtagtgattctgggttaagaatcactgatttagttctacctcattttacatataccttttcctgcaaagatatataaaaataaaatcatatgaataagttatgtgtttaatagttccattcagtcatctcataagacaaaattactttctaagttaattttaattcagatctttatagaatattgaggttttaaatgtgaacacatatatataattttatgatacaaccttttcttctgaatacttaaagtgttttcacagttggaagtatcaaaaactttgttctctgtaaaccttcagcttccatccttcttcagtcttatctgcagttatctcctgcacatgtaaatgatgtggtagaagatacggtttaagatgaattttagttatttaaagtgtgtcataacctgaacattttacagatatatttaaacaggtataggtatatttaaaatcactattttaattaaaaaaaaaaaaactttgaaaaatccctaatttcaaaaatatatttaaaatgtacatatatgaataatatatagagaaagataggaaatattaccatgaattatacagacctcagtttatctaaatttacagttttaaaataataatcttatccttattatctgaagatgtcattgatgatatgtttcatttttatatttggctttagtttaccaatattaacatataaattattaaacaattgtacaccagctttgtggtctctcctttgtcatgtgtgatttgtgtaatttgatgaacttgatgaaagcttccatttcaacttgaaggctgtgaatatgccagattatgtgcattttgtagtaaggattatggagctgaacaagtatgacagacttgttaaatatgttgtctacaaatttttttttgtttttgtttgagatagagtctctctctgtcacccaggctggagtgcagtggcgtgatctcggctcactgcaacctccacctcccgggttcaagcgattctcctgcctcagcctctcgagtagctgggactacaggctcgtgccaccatgatcagctaattttttgtagttttagtagagacagggtttcaccatgttagccaggatggtctcgatctcctgacctcatgatccgcctgccttggcctcccaaagtgctggaattacaggtgtgagctaccgcacccggcctattgtctacaaattttatcacttttggtaagaaatgcacaaagcctatcatgatgtcattgctagtttatatgtttgtgaattttaagccaaacaagcgttcaaaacgtttgccacaaatcgaggacctaaaacccagttttatatataaagatatttaaaaacatatttctggagaactatgcatatactaccaacacttacaaggcaaattaaattaaaaatgttgtataaggaatataatattttaaatttttagtgtaatcaagaaaaagatacattgttttatcaattgattaatttattggtcataggatttggcctatttatatttctgagtatccaacagaatcagtcccttaaaatgctgaatatcacaatttgcagttcggctaatacatttatatccattttattacttagttgtaatataaaggaagttacctcttcatatcccagggaaactatggtagttgacaaggagtgggtccaggctttataccaactgatgtcttatacaactcgaggagtcccttttaagagaaatggatacatcattggaatatgtattgaatgtggagattgaatatttatttaggatgtaaaactaaatcacaccagattataaaattaataaagctgacaaattctacaaggataacaaaatttataaaattaacttcattttcagaaaattaattgcttgatacatttctatgatttttttggctctgtagttttggttgcttattctctgattgcctcttcattttacatgattctattatgttttctatgttgagaataacaagataatgcagtcttttctctagtataattgattgtaatctgtcattttattaccgatagtttagaaaagttacatcaagtttctcaatttttgggggtgatttcatatacattcttaggactgtgaccaaacttgggaaatatctctatcaaatgtctttcatttgtgaactgtaagatttggaagaattttcaaagagcagttcctggctttatatgttttgaacattgtgtctccttcactccacacagacttgtggtgcctgaagctctgggcacattgattttggagtgatctctgggcttgcactttcatgttaccagcaccatggtaatcaggtgtgttcgtggaagctacacccagacagccagcaagaacctaagggtacagggaagagactgagaaccacaagaatataatcacaccaaactgaaactaaatgaatctttaactcagtttctaattagccagatcccaaaatggcccacagtcaccccagtgctaactaacccaagggaaaagtgtgatataggcaaaatcagtacgtagacattgatcttaaacttctgcagttaaaatgtctcactcatgcaaaattctaaaagcaaaggagcatgccatcccacccctcgagccttttccagtgccttaggaaggagcttgtgcaagtgaggggccctgaagcttcacccttcctagcctcacggtaaatccacctctgtggtagacagaaacatttctagaccacaggaaatctgtttgcctaaggaaacacagaagctgtccttacagttaaacagaaatagttctatttttttcctagagttcagcaccatttctcaaggggtatttcttagaagttcattttatgaagtctcctccacaagttctttttgatagccaataattcaaatgtcatgctacttctttaaatcactccagtcattgaatagcataatcttttcagggggcaaacagctgggctccagtaggctttaaatgttcatttgttttccaattttttgacttgcataggaagaagtaatccctttcatgtgaaatattcccctcgattaattttaaagaaccaatggcattgtctgataatgggatgaaagcccaattcactgaacagaatgtgctatttgtaacctggattatcctttaggtttttcggcatagtcctcgagaagctgagaatctgtcattttattgattaaaatacacgtacagatacacacgtttacattagaaataaaaatgttgtaagctcaaataggcagggtatttcacctgaaagcctgaaataaatgtgatgagaacctatgaactaagttccagtgtaaacaagtgggttaaattctcattatagaaacttccagtgagcaatgcagcatgactgtgggaccataattcaggaacaatctgcagagcaaaatatagaggcactaattttgttatatttgcagcccacatactgtaataccagatttgctcctgttgttctggccaaagatgagtcaggtacctctgatataaccattcctaaaagacaacaatggattcagaatgtgagactgagagaaatcctagaagtctgaccttcagatcagtttaactgtagatcaataatccattactcagaccaacacagtaccaaaaaatctcttcagctggctgccaaggtactattttatcttaaataagctggttgagagcagtcaatatagatacatttttcccactgacaatttgctgattcagagaacatgcaacatccagccacgaaatagataaagctcaggcctgccctgtagaatatggtcacctggctttcctgttctcctacaaatgtcctactggaagaatagcccttaatcccttaatgttcatctaaaccaaggcttgttctaaattctctagactctatctcatgcattattacatctctcttggcatacttctcttcttgaagtgcataacatttatataccttctacaaatgttggtattattgatattgagggagggggcagacccaggtctatggccttatgtattattagtgaattacaatttcttagagtaataggccaatgattaaagtcacatgttaggaaaactttaatccactagggaaaacttccaatatttttcaaagtaatttactacatttggatgcaaattatataggtgtttttggtggtatccatacttgctttcttgtcaacctgaagagatgtaaatgtaaatcgatgctaattgtaccgtgcttacacaaagagctaatttgagtaatatcctatcccatcagttcattttcaccatacatttttttctttacaaaattgtttttaaaactccactggaaaaaaatatataataaactacatgtaaattacacaatttagtaaattttgatataggtatacacatctgtgagaaaattaccaaaactgagatagtacacaaatatatatcacccccaaaagtttcctcgtgtctttgtcattccttcctccagctttttcccagaaatttcaccttcctcaggctgatcaacactcagctgaagactcaagagggggcctgtgcagatgtccctgagttccctctctgggccactgtctcctctcttttcagcaaattctagttaccttgacctccctgaattcccagctccatctcctcaacttagggagactttcaggtcaggcagtgatccctcctccttatgctgggacctggaagctctccagcatgtacactggggcaaccataggcgtcatctcattgtattcattttctctaatcaccatgctaagctaactgttgcctaaggtctgaaaactgttgtttcattcattttgtccagtttttccattctttcatgagcaagcataaacctgactcctttgggcaagaagcagaagtccctatagtgactttatttactttattgttattgtcagcatttggaaaaaaaaatgtagagattgactattttatactatttaagtaattttttgttatattgattttacctaaacaagagtttattagaagtattttgttatacagcttataacaaataattgtacaaaaattagaaaaatcagatgaacaaattttttataagacttctcgtggttatagaatgactctaacaccttgtagtgtattttttaggattttgttcttagtgcatgtgttagtctgttttcatgctgctgataaagacatacctgagactgggaagaaaaagaggtttaattggatttacagttccacatggccggggaggcctcagaatcatggtgggaggtgaaagacacttcttacatggtggcggcaagaaaaaatgaggaagatgcaaaagtggaaacccctgataaaaccatcagatcttgtgagacttattcaccaccacgagaatagtataggggaaacttcccccatgattcaaattatctcccaccgggtgtcccccacaacacatggaaattatgggagtataattcaagatgagatttgggtggggacacagagtcaaaccgtatcagtgtatatgtttagagggacatagaaaactatataagtttaataagaatatatacatattgttattaaatgaaaacatttgaaattataaaagtagtaaatattttttagtaaaattaaatatatatatagtaaaaagtgaaagctgttttacttccattcccagagaaaactttacttaaattttatatagttttttccagagttcttcctacacctgaaaaacacagtggattatttttgtgtacaaaagaaaagaaatcattctatatgtatctcctttacttccactctttttctttccacttaattcatacagataaactttaccatttaaatggcctctggtgattcctttataagaatgaaccattagatagttaaccagtttactaatgacagacatttatattgctcccaagttgttgccattgttcatttatttatttctttagtattaattcctagataagttgctacatcaaaaataatgtacatttaatattgcaatagttacaaggaaatctgtacttttttcagtaatatattagtgtctactttcaaaaagctttaaattctgagcatcatattgtcttctaaatctttgacaaaaattaatgtaaatgaatatgctattttaattgtcatttatttatttgattattagtaagatttagatttagatttcagtctttttattagccatttcagagggatgagcattctctgcctatggactttgcctggttttgtattgatgtgttcattgttttcttatttcctcatttgtaacatcattttaaagtgcttttatttctggacaatgtttttacattttttaagactcctattgtgatttttattaaaacaaagttagatctatagaaaagctggaaagaatttgaagttttaacgatattcgctctccctttccagaatatgtggcaaaggagggaaaagaagggattctgaaggaacacacgggaagtcggcagtgtgggagtgatggatatgttcattcccttgcttgtggtgatggtctcactggtgtatacatttgcagtaattgtcaagttgtacactttaaaatatgtgcagtttattttatctcagttacatctcaatgaaactttttttttaagtggcaccaaacatacattaaatagctttcagccaaaagtaaaaactgagtttggtcagaatatttttgtgctattttggttagatttcttctgtcacagttataatggctttctaaaataaactaggaagccggagaaagtcactttaaccttcaagagtagggaaactgaacccataaaaaaagtgcttccaggtcagactcagcctaaaaaacctgaaaaataaatgtgacttctgagtagcagtatatgggaaaaattttctataaatctctgagaatgaagttgactggagactacacaagagacaaagagatatagaattgccttaaatctgaaccatggagttacagaatgataatggcattatgataaatttttagagaacactcttgataaacaggcacactcaaaaatagctttttgtttgttgttgttgttgtttgttttctgtgcaagaggtgacaattgaatgaggttccaaaaagtagtgtgggcttgcattgcacacatattatcaggcaggatttgtgcagtagagaaaggtgactgaagaatgtagtggaaggacatgctactggaagaagctgccaagtgacatacacagggctgtgagtcagccagggttgaggctctgtccagtgggacagcaggctctgtctccacagtggggactgcctgagagctgggtgctctggttcagccattgtagcacaaaggcacttgtataaatttccgtgaaatggcttgaaacctactttgccataagaatgagataaatttttaattcaaaacttaaaatatcttgattagaataaggaggaggaagagaaagaacaggcaataaaaagttatttattgattgattgacttaatgcagctagctgaagggtgagaggaagaactccggctccagagtctgaaagccagggctcaagtttcaatttgggcatttcccagctttgaacaacagaaaaacactgtttaccttttcagaacctcagtttccttagatctgtaaattagcaataaaaactaatgtgccttccaaggttatggtaaaaatcaaatatcttatgcctgtgtaaatctttttcaaaaaacaatagacactgcaaatattgggcattcttatgatgatgtttattcttcactgggagcattgatggattgattgttacttttcaataactttttccatatttgctctagttttaaatttgcaaattttaattcagtattgtttataataagacaaaagctcttctttaaggttggggcattaatgttaaaaaaaaaaaaagaactgttacatcaaatgtacatcaaatgcagtgactggacaacaaccaaagaaacttcctgtgtaatccccatcccatcacacacacacacacacacacacacacacacacacacacacacactatagacactatatttaaaattggcaggggtgatattatgaactcctgtaaaaccaaattgatttgtgtttgtcaggaatgtgtgggtctgtgtcctggaatgctatatatttccactgtgcactgcccattgaccatttctactaggatgccttgaaggcacctcagactcaacaagttcaatttgaaattcattatgtactccccagttgttcacgctaggagccttcaggccacccgtgacttttctctctccttgagtctctccttagcttcccatggatcagtctctgtaccatgttgattctaccttctgagtatcctttctgctctccctcatctgcacttctgttaccactgcctgagttttggttatgggcttcttagtcttttagtcttttctctcccccaacccagccatcgccaccagcaagaactatctttctaaagcaccaattatctttccaaaacagaagattttctcttctttgtaggaatttaactttagggcatagtcagataaattagccaaaatatatgtgaagaagctgttcatcacaatattgtttattatagtaaaaaaaggaaaaaaaccttaatatctcaaaaatggatcagtaatatcgagactatacacaatagtcattacattggtattatagatgtataataatttggaaatgatattataaaaaattattaaataatgtgcatagaaaaatttgtggaaaatgttttatgctataaaaatatttctaggtaatggaatttagtaagaatttttctcttcctacttcccaccaaacaaaagcaaaataaaactaaaatagaacaaaaattctgctatgtagccctttacaaaagatagtgcttctggcaagaaactgtgactgaccaaaatcctgcaattcagtacctgtgaaatgccatataacaaatttactcatatcctaaaagttatgagaactgggggcttcaggacatctcatacctgcctcattttttcaagaaaatttgttgtagaatcttttatataaaacactatacactgtccttaatccactatgtcctattccctctatttacaaatgtgctttgtccttacatttctttaaaaaaaaaacaacaaaaaactgtgttcacacgtatctttgtaggctaaagaaaagtgatactataaggattgggaggtagagggtgggggcactgaggaagccctgctgccctcaggttaagctccgtatctctctcatttaaggtccctgataggagttacttgttctcaaacatgtgtgttggctctttactgtcttttaagtagcatttatgatgaattccctttttttaatggtggtattacagtatctgatgttaggcatagaactgctcaggcagcaagtcaccttttctttttccccttttttgatagacttgagagaccaaggcagcacacacacactcctccaactagctttgcaatttgcatacatttcgattctggtggtctattcatcatttttatagaaatgcttttatgaaattcgatctcatggagtgagttaggagtttctttgttttttgctttatgataacccattgcctcagtaaatatcttaattattcccagaaaaaaataaacccaactgattagacctaatcccttctcaaatcactttactttctttgtcatttcctatccatcctctctctacactcagatgtctttgttttattatgaaatatatttggcatgagtaacaacattaagtaatatgaatcattttatttggttaaatgtctacactcaaagattagtggagaatttggaaaatataacgaaataatactggaacttttgatatttccctagctacttgccatattcaaaagatgtgtctttgaagtgaagagcagaatagtaccttattatagtccatattaaatcatatttatggctttcaacagaagtattgaaaaccagattcagttgctgcacccatcaactcatcatctacattaggtatttctccgaatgttatcccttcccttgcccccaaccccccgacaggccccagtgtgtgatgttcccctccctttgcccatatgttctcattgttcaactcccacttatgagtgagaacatgcggtgtttggttttcggttcctgtgttagtttgctaagaatgatggtttcaagcttcatccaagtccctgcaaaggacatgaactcatttttttttttttatgtctgcaaagtattccatggtgtatatgtgccacattttcttcatccagtctatcattgatgggtatttttgttggttccaagtctttgctattgtgaatagtcctgcaataaacatacacgtgcatgtgtctctatagtagaatgatttataatcctttgggattatatacccagtaatgggattgctgggtcaaatggtatttctacttctagatccttgagaaatcgccacactgtcttccacgatggttgaaccaatttacactcccaccaacagtgtaaaagcattcctatttctccacatcctttccagcatctattttttcctgactttttaatgatcgtcattctaactggtgtgagatggtatctcattgtagttttgatttgcatttctctaatgaccagtgatgatgagcttttttcatatgcttgttcatatgcataaatgtcttcttttgagaattgtctgtccatatccttcgtctgctttttgatggggttgtttgtttcttgtaaatttgtttaagttccttgtagattctggatattagacctttgtcagatggagactgcaaaacttttctctcattctctagcctgttcactctgatgatagtttcttttgctgtgcagaagctctttagtttagttagatcccatttgtcaattttggctttcgttgccattgcttttggtgttttagtcatgaactctttgcccatgcttatgtcctgaatggtattgcctaggttttcttctagggtttttatggttttaggtcttaagtttaagtctttaatccatcttgagttaatttttgtataaggtgtaaggaaggggtccagtttcagttttctgcatatggctagccagttttcccaacagcatttattaaatagggaatccattccccattgcttgtttttgtcaggtttgtcaaagatcagatggttgtagatgtgtggtgttgtttctgaggcctctgttctgttccattggtctatatacctgttttggtaccagtagcatgctgttgtggttactgtagccttatagtatagtttgaagtcaggtagcttgatgcttccagctttgttttttgtttgtttgtttgttttttcttttgcttaggattgtcttggcaatacgggctctcttttggttccatatgaaatttaaagtagttttttctaattctgtgaagaaagtcaatggtagcttgatgggaatagcattgaatctataaattactttggacagtgtggccattttcactatattgattcttcctatccatgagcatggaatgtttttccatttgtttgtgtcttctcttatttccttgggcagtggtttgtagttcaacttgaagaggtccttcacatcccttgtaagttgtattcgtaggtattttcttctttttgttgcaattgtgaatgggagtttgctcatgatttggctgtttgtctattatttgtgtataggaatgattgtgatttttgtacattgagtttttatcctgagactttgctgaagttgcttatcagcttaaggagtttttgggctgagacgatggggttttctaaatatacagtcatgtcatccgcaaagagagataatttaacatcctctcttcctatttgaatatattttatttctttctcttgcctgattgccctggccagaacttccaatactgtgttgaacaggagtggtgaaagagggcatccttgtcttgtgccagttttcaaagggaatacttccagcttttgcccattcagtatgttgttggctgtgggtttgtcataaatagctcttattatttcaagacatgttacatcaatacctattgagtgtttttagcatgaaggagtgttgaattttatcgaaggccttttctgcatctattgagttgatcatgtggtttttgtcattggtttcatttatgtgatgggttatgtttattgatttgcatatgttgaactagccttgcatcccagggatgaagccgacttgatcgtggtggataagctttttaatgcgttgctggatttggtttaccagtattttattgaggattttcacatcgatgttcatcaaggatatttggcctgagattttctttttttgttgtgtctctgccagcttttggtatcaggatgatgctggcctcataaaacgagttagggaggagtccctctttttctattgattggaatagtttcagaaggaacggtaccagctcctctttgtacctctggtagaatttggctgtgaattcatctggtcctgggctttttttggttggtaagttattaattactgcctcaatttcagaatttgttattggtctattcagggattccacttctttctggtttagtcttaggaaggtgtatgtgtccaggaatttatccatttcttctagattttctagtttatttgtgtagaggtgtttatagtattctctggtggtagtttgtatttctgtgggatcaatgatgatatcccctttatcattttttatttattgtgtctatttgattcttctctcttttcttcttcattgatctggctagtggtctgttttgttaatcgtttcaaaaaaccagctcctggattcattgattttttcaaagggttttttctgtctctgtctccttcaattctgctctgatcttagttatttcttgccttctgctggcttttgaatgtgtttgcccttgcttctctagttcttttaattgtgatgttagggtgtcaattttagatctttcctgctttctcttgtgtgcatttagtgctataaatttccctctaaacactgctttagctgtgtcccagagattctggtacattgtatgtttgttcttattagtttcaaagaacttatttatttctgcctttgtttcgttattcacccagtagtcattcaggagcaggttttttgattttccatgtagttgtgctgttttgagttagttcttaatcctgagttctaacttgattgcactgtggtctgagagactgtttgttatgatttctggttttttgcatttgctgaggagtgttttatttccaattatgtggtcaattttagaataagtgcaatgtggtgctgagaagaatgtatattctgttgatttgtggtggagagttctgtagatgtctattaggtccacttggtccagagcttagttcaagtcttgaatattcttgttaattttctgtctcgttcatctgtctgatattgacagtggggtgttaaagtctcccactagtattgtgtggaagtctaagtctctttgtaggtctctaggaacttgcattatgaatctgggtgctcttgtattgggtgcatatatatttcaggtagttagctcttcttgttgcattgaaccctttaccaatatgtaatgcccttctttgtctttttctgtcttttttggtttaaagtctgttttatcagagactaggattacaacaccttttttttttctttctgtttgtttggtaaatcttcctccatccctttatttttgagcctgtgtgtgtgtttgcacatgagatgagtctactaaatacagcacattgatgggtcttgactctgtctagtttgccagcctgtgccatttaattggggcatttagctcatttacatttaaggttaatattgttatgtatgaatttgatcctgtcattatgatgctagctgtttattttgcccattagttgatgtagtttcttcatagtgtcagcggtctttacaatttaatatgtttttgcagtggctggtatcagtttttcctttccatatttagtgcttcctccaggagctcttgtaaggcaggcctggtggggacgaaatccctcaggatttgcttgtttgtaaaggattttgtttcttcttcaattatgaagcttagtttggctggatatgaaattctgggttgcaaattcttctctttaagaatgttgaatattggcccccactctcttctggcttgtagggtttctgcagagagatcagctgttagtctgatgggcttccctttgtgggtaacccaacctttctctctggctgcccttcacatgttttccttcatttcaaccttgatgaatctcacgattatgtgtcttggggttgctcttctcaaggagtatctttgtgaggttctctgtattttctgaatttgaatgttggcctgtcttgctaggttggggaagttctcctggaaaatatcctgaaaagtgttttccaacttggtttcattcttcccatctctttcaggtacactaatcacatgtaggtttggctttttacatagtcccatatttcttggaagcttttttcattccttttcattctttttttatctaatcttgtcttcatgctttatttcattaagttgatcttcaatctctgatatcctttcttccacttgatcagtttggctattgatactgtggtaagcttcacgatgttctcgtgctgtgttttttcaactccatcaggttatttatgttcttctctaaactggttattctagttagctattccactaaccttttatcaatgttcttagcttccttgcattaggttagaacatacttttttagcttggaggagtttgttattacccaccttctgaagcctatttctgtgaattgatctaactcattttctgtccagttttgttcccttgctggcgaggagttgtgatccttcggagaagaagaggcattctgttttttggaatttccatcctttttgcactggtttttcctcatcttcatggatttatctacctttgttctttgctgttggtgacctttagatggagtttttgtgtggtcatcttttttgttgatgttgatgctattgctttttgtttgttagttttccttctagcagtcagacccctcttctgcaggtttgctggaggtccactccacaccctgtttgcctgggtatcactagcagagcctgcagaacagcaaaaattgctccctgctccttcctctggaagcttcgtccaagaggggcacccaacagatgccagccagaactctcctgtatgaagtgtctgtcaacccctgctgggagtatctccctatcgggaggcacaggggtcaggggccaacttgaggagggagtctgttccttagcagagcttaagggctgtgctgggaaatctgctgttctcttcagagctggcaggcaggaacatttaagtctgctgaagctgtgcccaaagccacccctccccccaggtgctctgtcccagggagatgggagttttatctgtaagcccctgactggggctgctacctttctttcagagataccctgctcagacaggaagaatctagagaggcagtctggctacagcaactttgtggagctgcggtgggctctgcccagtttgaacttcctggcagctttgtttacactgtgagggaaaaaccacctacttaagcctcagtaatggcggacacccctccccacaccaagctagagcatcccaggtcgacttcaggctgctatactggcagcaagaatttcaagccagtgtatcttagcttgctgggctctgtcagtgtgggattcactgagcaagaccccttggctccctggcttcagcccccttccaggggattgaatggctgtctcactggtgttccaggtgccattgggttatgaaaaaaaaactgcagctagctcaatgcctgcccaaacagccacccagttttgtgcttgaaacccagagcccttgtggtataggcacccaagagaatctcctgatctgtggctagtgaagaccgtgggaaaagcatagtatctgggctgggtagcttcgttcctcacggcacagtccctcatgacttcccttgggtagaggagggagttcccgagccccttgtgcttcccaggtggggagacgccccaccctgcttctgcttgccctctgtgggctgcacccactgtctaaccaggtccagtgagatgagctgggtacctcagttggaaatgctgaaatcacctgccttctgtgttgatctcactgggagctgcaggccggagctgtttctatttggccatctttattctcttacaattgaaaaataatgatcttaaaatttttgtctccacaaacaaaagcaagtaaattatctcagtaatatagttttaagaatagttgctcttttttaactgttggcaggggcataagggataagagaagaaatagttaagaacacaggtgggttcaaatctactctctggcacttactagctggggaactttgggcaactcacctaaaccatttaagcactactagttgcctcttctggaagatggcagttgtaataatacataattgatagtgtcattatgagataaaatgacataatgcaaataaagttattggccatgtgcttggtacaaaataagtactcaaaaagtacttcaaagtaattttttattctaggagccattccttacaggtggaaaaattgtgccttttgcttacattttactttgcatttcacaagatgtcttcaagagtatgacctcattttatcccttccacaaatatgagacatagaaattgttagctacattttctagggaaaaaaaaccgagcgtcaggaatattaagtgactcagccaagggtctacacctcataattagcaggatcaagaccaatgaaagtgcctcttggtaagatcatacctgaagctaacagacacgtgcaggcctcctacaacataggtagccatgtttagtgtaggcagcagttggacttctgtatattcatttctggcactggagactgcttctattatagaagttgtgaccttgtcactcatcaagcagatggcattgcttgattagagtcaggccatatttagaacatttctataaagccattctcatttgggcaaacatttttgccaattgaagtgtttcttttcactaattgagcaaacaaatcatgggctatccactcacaagggctttccaccacccatattttcaggaaggcaggtgttgagcttatattttcagaatatatttccagcttcatacactcttaagagaacattgaagcctctttgatgaaggtgagggtctataaacatgcttgtattcattataaggggattgtgattgtcctcatagaaaaatgactttaagaaatagatgtatcctgaagcaagataatatgagtgtcaggctggacacgtaaaatacaagggaaggtagtggggaaaaggctgagaaaagagtactgtagactttacatcacaatgcttaaattaatctaaaatgtaagctataaaatagactaaaattatatatagacgtatgtgcgtatgtgtgcatatgcataaaagtgtatgtatctccatacttcaaaggctaatattcacagatagattcaacaatcaaatacggagttagttttgaaggaaaagccaaataagacacctttgctagactttaaaattttattttaactgaaactacggtatagacataaccatataaactaatctatttacttgtaaaattaattgtttcattgtcattgaatcagatgtgagtgtatttagataagtcaaggtagtaaaagagtataataagaaacactgagacccagggatcatgctaactcagacttctgtcttgagtctgccacataagagcaatatttcctcaggcaaattattttcatagttttgaacttgaaattctcatctgataaatggacacaccaatgcctaacacatagggtagctgtgaggattaaatgacatgcgcaatttgcatggcttcctcatcaagttgccacttgtattagtcggctagggctgctatagaaaataccacaagcttggtgccttaagcaacagaaatttattatctcaccgttctggaggctaggagtctgagatcaaggtgttggcagggttggttctttccgagggctgtgaggaaggatctgtttcaggtccttttcttagcttgtagatggccttctctctgtattttctcttcgtcttctctctgtacatgtctctgtgtccacatttcccttcatgtctctgtgtccaaatttctctttgtcttctctctgtacatgtctctgtgtccaaatttcccttttattacaaggacaccagtcacattgaagtagggtgcatcttactcctatatgacctcatcttaactaataacatctgcaaaaaccctatttccaatagggtcccattctagggtactgagaggttaggcttcaacattaattttgatagggggacacagtacaacccataacaacactcagaagtcactttctcagacagaccatgcttgaccactgatgtagtttggctgtgtccccaccaaaatatcctgaattgtagttcccataatccgcacgtgtagtgggagggaccaagtgggaggtaattgaatcatggtggcagttacactcatgctgttctcatgatagtgagtgagttctcatgagatctgatggttttttaaggggctttcccttttttgtttggcacttctccttgctgctgctatgtgaagaaggacatgttagcttccccttccaccatggttgtaagtttcctgaggcttccccagccatgctgaactgtgagtcaattaaacctctttccattataaatcacccagtgtcaggtatgtctttattagtgggatgagaacggactaatacaactaccttttctaagaacagtcttaccctttcctagcacacacagtcccttgccctatataatatgccaaagtaaatcatagaatcatttattttcttattctttttctatcccccacactagtctgaagtccatggtgccagggccctacttgtcttggaggttgttctattctgggcttggagaacagtgcctggtacaaaatagatccttaacctctggcttgaggttagggctcaataagtaataggtggtataagtatctaaaaaagaatctcattctctatccaaattggtattcactagccatatgtgaaagaaactaaattttcaattttattttaataaatctaaatttaaatatccattagtggctattatattggacagcacagatatagaacatttctgctactgcaggaagttctatgggacatttctagacatagaagcatagatgaggatataatagtgataattcagttcagacccggtgctgcctgccaaattccacaacactgccctgcattgctgccctctcatgacaccacacagctcccagttgatttgttcttctttatggtaccaggtgtattgggtgtattgcaagcattttcttcttccattattaagttaaaaataccccttgaagttttgaaaagctgtaaaggggttgtcttgagagtcccattaacatttatagtgaattctgtggcagcaattttttattttaattgttgttgtctttgctattcagataagtaagcagtaggcatagataattaatgtacagattctgttttacacaactttaagaatgactctttgagaaacatgtctttaaggacaatgaactgagatatcccttacttgaggataaaatatgggtgcaggtacaaggagtcagcaggtgtcacgtgtgggctcatttcttccctcaaccctggaaagtatatagattctcaccatccttgttcagcctctgccttagggataagcagtgctggggtgattttatgctcaggaagtaaccaaaggctagcaaacatctctcattgttggcagtaaaaaccattgctatgaataacaatctatattttataaaactattttggcttcacataaaaatctgatgcttcaaggaacatactccaatgtgccttgaagtatagcacatactccaatgtgttactgaatcctgaaccacacccctaaaggaggcattcattgatatcactggcttaacaaaaggctttggggtggggtgaagggataatacataatgcagttagaaagtgatagaaagcatattgcttatataaaattcagtgctaggtaagaataaaatatgaaatacatgtggcaatgaacttagaatatgctccagttttggaaaaagaatagtaagataaaaccctagaatttggaacatttttaaataacctctattactatcattttaatctttgaacagtgacaaaatatcccacctgctttgtgacttttctgaaaagaatacatggtcacagggtattctctattggaataccattcacaccttcaaacttatcaccatccagttaaatttgaggaatggtaattgatgaccttaagtgagtcaagtcacaattacctgaagaactaaaaatgctactggaaggactagactctaagttggtacctaactaattcttattgcctgaatgtggttgtagagtagacccttcattaggaagtgaataggggaagtatgaaaaattaaatgtgtacaaaatccaaagcttcctgataggtcttttgggctattttgaagaataagacaaacaacagaagcattataattggaggattatagagccaacaaaggcaaagtaggagcatatttatcagacataataaagacagaaattaaagatcttatttatgtttgaggcataggaagcaatagaagcatatatatttgcaaggtctagacatgcctctattcatcaatgcattttagtattttagctcagcgttcattaaagttattaccttaatttatttaatcaaaatattgactctattctcatactgcaaataacttgttacatgatttggatgttaatatgatttttttaccactgaaagttaaactaatgctcatcctttcactattaaaatattaatgtcttctattttagtttagcatttaaaaaacaaatttgtagagatgggatctcactgttataaaaaagctttccatttttgtaaactgcaaacttgcagttagcttaactaaaattacataatagaatttccaaattaagaaattaagtcactcatttgttctgtaaagcagtcacccttgaataaagaaatgcatggttcaacatattttttaagaattcaatagtactttcagctttattgggatataactgacaaattgaaattgtatatattttcagtgaacaacttgatgttttgatatacacataaactttatgaaatgaccattaccatggttccatataaccattgtgtttaaaccatctaattctcttgttgactttcatttaaatgtttgatgtatagaaacctcatttcattaaatacttcagaggccaactgttattttatagaatccaacaaacattactttaatgttaacggaccctaaaatggaaaccaggcattggttttttttattttgttttgttttgtttttttgagacggagtctcactctttcacccaggctggagtacagtggcacaatctgggctcactgcaagctccgcctcctgggttcatgccattctcctgcctcagccacccaagtagctgggactacaggcgcccgccaccacgcctggccaattttttgtatttttgtttttttagtagagacggggtttcaccgtgttagctaggatggtctcaatctcctgatcttgtgatccgcccgcctcagcctcccaaagtgctgggattacaggcatgagccaccgcgcccagtcattggtttgtaatgccataaagaatccatgaataatatagtcgtgtatttatttttgaaagagaatgttcttttaataaagcatatgttttctaatttacacttgagcaaacctttattttaaagaaaaattgagaaatttatgtttcagagttatgagacaccgtcttcttatctaagatatgaaggatgcagcaataaattatccagatgttttggctatagtctttttttattgttgagtaacaaatttccatacacttagcaacttaaaacaatatccttttttttttttaatgtcgcagctctttaggtcagaaattcaggataacagggctggtttatgtgctcagagtctcaaactcaaggctgaaattaaggtgctaaccagctgtgatcttatctggaatcaaggtcatctctcaagatcattactgccactgttggaagaattcagtttcttgcaattataggatagaaatccctcttcttttgctagctgttggctgtagccccctgtgaccttctagaggccactcttggattcttatcccattggtcatcttcatctcagccgtggaagacctcccctctcacacttcatctctctgacttccttttttgcttctagctaaagaaagcactctgcttttataggttttataggactcatgtgattagattagacccaccctgataatcttatcttaaggtcagctgattagtaaccttaattgcatctacaaaaattcctttttccatgtaaagtaatataaccgtggagtaacaccagggctgagggtaataggagtcatcttagaattgtgtattagccaagatgtggaattcctatcaataaatttaagcagtgtttccattatatttgaaaaggagagaagattagggtggctgatcatcttgtatttaaatgctaagaaagacaataatcacagccaaaaagcttggtcacatgttgactttttaggaactcaattatagcaatcagaattgatagaggcagaaatcatactgcaaaggcttaaaggaatgctaagagttctaccatttgagaaataaagaactaccaggcaaaatgaagaaataaccatgtaattgaaaaactgccagaaataattcttaattagatgtagaccaaatgtctcaatagttggataacaaggcagaggccacataattcctctgtgcatcagtctgctcagacattctcatccattgcagattaaagccgagtactaccacgtttgtgccacagcgtctctgtggcctcctccctgatggctgcctgggaacatgttcctcactgcatcacactgcccttcccagtctctcaggaagcttaaaggggtaaagcaaagggaggagactgaaaaaaaaatgacaaattcgggagaagatcttttaactttctgttcattaagtgagaatttgtagatagagtggaaagaaccattgtgatcggggcaggagtatgtgaaggaaaggagggatagactgaagatgtcagagacagagaaggccccaaaggatggaacaggggatggaattaggagaaacgtcctgaaggatagaatggggatagaattaagagcgtgcatggatccatttagtctggaaagtgaaaatcttatttttctgaaatacaggaaaagaacagaaaatgagtagtggtttcaaatgagggagaaaaagcaattacatgtaagaaggcttctatcctctcaacacaacggggctgctttatatatattttctcttctgtaaagtgataaaaaatagtaaggccaaataatatttatgatagttaactgatatgatgcatataaactgcttagagtagcatataccacattataaatgcacagaaatgttagctattttttactatcattgccattattattttctattgacagtaaaggaaagtgaggtaatgttgtgaatttaaaagtaacataaagcttttcaatcacttgttaaaaatagcattgcagagaaacattgaaccctccttaaatgtaaatagcacgattcattgaacatctagtcaagatgactaatctttttttctagtaacgctcaacagtctagaaggtacagaaggcggtgggtatcaaggtttataaaaggtcaggaattggaactctggggacctggttgttctcatgagggcacataccaagatcagggtgagctaggaagtttaagtgataggaagataatagatttatttagagaggggaaattgagacagtttcaagcctcggagatggaacagaacaacagagctccaagcactgggatgcagggctggaggtgaccaagtccacgactttgtctttctaaagtgaagtggaggtgagtctgaagaaattatcactgtgattaaggttgttattgagggcaacagggcaagctagcttaggaagaaaaagtttggcctaggtgtaagatgtagttgtctaatattgaacagcacagattttagaacattagcatcaccacagaaaattcgattgaacagcactgtactagaggtacaggaaagtgagagggtagggtcttacagaaaatgttggagcagaagaaactatgccaaatgaggatgtgagcaaggatattctgtatttttgacaattttgaagcattatttattattttaacgtttctgaaatttggatgagtcatgcaattgatgtgctcatttaataaggttagtgtttatttttgtcctgaaaaaccattaagcaattaataatgcatctcacaatcagtgtcatcataatatcaatgaaatatggtaagagcaaggccaaaggaagggttttcttactgggtggtgatcacaacgataaagaatcaggacaaaaagactgaagagatgtggtgataatgggatatgagctgagttggaaaagaactagccccaagatattagtcagcactttggaggggtgatgaatttgccatggtttaaagtacttctttgagtttacagcacccgactctgtgttctcagaccttatgttgtttgagaattgggctgatggtgagtgtcaggagaatgatgtcagtcattctaaaatagtctcccaggtgctgatgcgctttggcaactacagtaggtcttccttaagattgggcatggaagagacaaatgtcggagaaaaatacccctcttgttttgagtggagaaaatcagaagaaagggagagagatcggggtgtgccgaaagcaaagccaatgtgatcatcaagataataatagccatacattaaggtagtcaagatcatagacttgagatctgaacttggatggagatgatgaactacacagttttagtctcatcaaaaagtcagctacatcagatggaactgaagttgtttgttttgttttactttttgatgctgtaataactctggcatgacttttcacagcaaattagaattaagaccttttaaatttgtcccaaatggttattgatacctgcaataatacttttccccctggaattatattttcctcttaaaatatatgtgtgtatgcatacattcgtatatatagtgtgtgggtatgtgtttgtgtgcatatgtgtgtgcatatatatatataaagaaaatagtgtagcggaaagaactctgttttctaagtcaaaatatctgattttgaacttggggtccagtgagccacttaatttcaggtttaacttctggcaagttttatcttctgaagccagaagtcattttcttttaaaaagaggcaatacttgtaactcttttaaagatcagatgacataaaagatatgaaaatataaactataacgtataaatatactgaactgtaaagtcatacaaatttaagtcattaatgttactgattggagttcatttctcagatttcacatagttgttgggcacagaaaatttggaaactttggctttcattcttgcacagactaatttagcatcatattcttgttctttgctgatttatcaggtaaggaaaaagtcaagtaaaatgatttggatgcctcactgccagggaatgcttgataaattaaaagcctggcttcctagggacattctgactactgttgtttataaccaagatcttttgcaaccttagacttcccaggaaaagcctgggctttgttgctgcaggaaggagaacagggaggaaaatatctttcagatttaatcagtgagaaactactaggaattagccactatgctagggaatacccaatcattattttgatacttttgtaagctgaagcatcatttaggggcctagcaggtttgctttctgatcatattcaaagccttcacctgggtgaactcctgtgagaacctataattcagggatgctaaagtcaccatggtgacaagaagaactcagctggcttcctattcaatgcatctcagatgaaggtgctcactccaggaaacataaaggatatccattaatttttagctttttttgtgtgaagcaaagggtattgctaatatacaacctctggaatagacctgatcagttacccagtctctggaagagggtggtaattgaaaaactaataagggcaggccctagtctaagaaactaaatctaagacagccacctgaagtgtgaagatggaaattgcagagttgagtctggagtgttttataggcttatagctctaacttgcctaattgaacttttacaattgaacttttacaaagaaagtggggatttatttatactcctactctagggggccacaaaaaaaaaagaggaaatgagagtataggagatttctctaggttatcataagaaagaagtctgacaatacaatccttgttccatttatctttttataataaaccacaaaatatttaagagctgttggaattctttgtttcttccccatgctggctattttgccattctcttcatctcaatactttgctgagtaaaagtcttgaaaccaaaaatatccctacaattcatgaccttgagtgacttcaaaattcagttagacaaaacagacagctgagttctgtggttctcaatctttgtacttttaaaagtattcatgctttggttctacccacaaagatcctgatttcactggggctgaagtgttgaaagattttatagccaccaaatcaccctaatgtgcaatcaagggtgagaaccttattttctcatatcccccttccttatatccactgatcttgacttcagttttaccttggcaattcacctccatggccacactctgaactttgtcatcagccagaactgctccaaccaacctcaaaatcttaaactcaaatatcccacactctaagcatagttttctttctttctagctcctcttattacgttaaagacctaatagtcttatttctcaactgctttcttgctaacccttcattgttctcctcataaacccaaacaggagataacaagccaggattaatccacctgtgtgatctccccatttttaacccttgtgtttccagagaaaaacacaaccacttacactggtgccacagcaagttcatactctccagacccaattggatggagcctcaatactgccaaaatcccattcatttctctagtcagccttgtgtccttttttcccaataaaaactctgtctcttggtcacatggacatttccatcctatttctgtttgaggtagaaatctgctcctgtaccttgagtcccacctgcttctgccttttcagttgacttgctccttcacctgccacttgtcttggatcaccagctttagccatggactaagtctttaacatgggtatttaaacatacttaaaacacttccttcaaaaagcaaagcataacagtgctaaagcaaattttcatgggtcctcctctgcctactgccttcctccctctaacagccaaataattttgcatctactctcaattttgcactttcctacaccaaatatactgacatttttagtgctaaatccaggaaattttttcttagtctttgttttactcagattctcttcagtatttgaagagtgtaggccactctctgtgcataaaacagtctattcctccatgggctcctagctaacagcctgcagtttgtcagttttctttggggtttcttgatcctctgcctaccactgaaatggcagtgttctttcgtcagcactttctgctgttaccccatattccagaggtatttagccatggctatgcatcagaatcacctgcaaagccttttaaaatgcagccatccgcttgctatgctcgatcatctgaatcagaattactagggattggggcccaggcacctaagttattcagaaattccacagatgattgtgatatgctggtggtcttcttcacatccatgccttctcaggcattccctttatcagtctttcatctggatatcctagaccctaggcttatattttagatatgtctgcacaagatgtccaaactcactgatgtgtccaagagagcctccttgcctccattcccttcccatctcatccaatctgctctaccacctcccccttttctcctcccccatatttcagtctgaatgagtgacatcagattttattaaattgtacaagccagaaacttgataatcattttgaattgttttatttatccctcatgtccaatcaattgtcaagtcatatcagtttcacctctagtattctccaaagttttttatatacatgggtattactttaggttaagctaagtcagtctgtgttgctataacaaaatacctaaaactgggtaatttataatgaacagaaactcatttcttacagtctggaagctggaaagtccaatatcaacgtgccagcatcttgcgagggctttcttgttgtgacatcatatggcggaaagtgagagggcaggagagagcaagaagggactgaacttgcccttataagggcaccaatgcctcccatgagggtggagccctcatgacctaattacctcttaaaggtcccacctcttaatactgttacaatgactattaaatttcaatatgagttttggaaggggagaaacattcaaaccatagcagccaccatcatctgtcttctgaaatattaccaccacctcctgactgtatcctctgtgtttggctttgcttactcccactaatctgtttttcacacaatgctcagaacatttttttctagaggataaatatgataatatatatttcctgcttaagacttttcagtgactatctgttgctttcagaatagaggccaagctgtaacatggcatatatggcccatcagaacccgacgcctgttctgttcttttgtcaggtcctctctttcattctgcacacagttttcatcacaattctctggcgttcatgattctctcttgtctctgagcctttgtttctttgctgtttttgcctagaacaccctcttcctcttggctcaggtcttacatcttccattcctgtcaaggtaactcctcctcatgttccagctcatatctgatatatcatcttttaaaaggatgtctgcctaaacctgtagaatgggcttaagagggcttcctgtttattctcatactgtgtacaatgaaaatctactcattgatttacttctctctcccacccaactttatgttcctttaacatagaaacttttaggcatcgaagaattcttttttttacatgacacataaactctcaatgattgttgaaggaatgaaatgaggagtattcagaactgttagtaaaaaaaaaaatcagaaaataatgatcaagagaggctttataaagggaaagtcagtagttgaaaagctagaagtagaatgagctgactgacttgaaaagaggccactacttagtgaaaagcacttcattggtatggtaggagttgaagtcagaatgcagaaaattgaggaatgagtggtgtatgagttttctgctgaaacaaagtactagaaacagagtggtttaaacagaaatgtgttgtctcacagttatggaggtgagaattctacgatcgaggtgttggcagggccatgctccctgtaaaggagctagggaaggaactgttccagttctctcttgtagcttctggtagttcctttgcttgtagcagcatccatccagtcttcacatagtgttccttctgtgtacgtgtttgtctcttcacatggtgttctttttataaaggcgtgaggcacactggattagggacctactctcttgcaatatgtcctcatcttcacttaatgaatcatacctgcaacaatcctatttccagtaaggtcacattctcacgtacgaggagttaggacttcaacacatgatttctgggggagacgcaataaagtgttggacttgggtttattcgtggtgctattattgtcatacattcatagatcaatattagcttttaatctcttattttagagtccacattgtagcataatatttactgtggttgccatggaagagaagttagtaaatgactttcactatacagggctaccacactggtttccaaattgagctcttcaaggttgaagatggaggacgatggagctcctccaccacagcaccctctctttgcctaatttacccataagcaaagcaaggtttgaaatccacctatctaaaataagacttttagacatgttggaggatatatttttagtcataatgttgatagcaaataagaagagaagatacaccctcagcaattggagacaagaaaatctgatgcataatttaaaagaagaaaacgacaaaaagtacgaaatcttatgtgcacttattacctaatactttaaaatcttggagatatatatatatatatatatatatatatgtaattattaggtctaagtaatacacaaagttaaacccttcactatcttagttggaatacgtatagaggtatagatatatatagatatcctttcccacacttattttagctcttgaaatgcatagaataggaaaaaaatcagaattataatctccatgggagcaactttataccaaaaaacacagaagcaattatatttgaaacctgctagagtacaaaattctagattatctttagcagtttacttttattttcatggataaaatttgaaaagacaagggccagtgactcattctaccatttgagagcatcgctagggagcatgacattatcacagagacagatatatggtgacttggaaattttttgtaggtaattcctattcttaaacttaatatgagttgccaatttggaacactgctacattatatttatcacagagttataacttttaatggtttgagggatcatagatctgaccacatcaatatttggctcattttcaaaatagaaagtgctgaaacaccaaaatactgagctgaattctttaaaactttaaagctgaaaaaccactcatgtacataaagtgaaataagaatcaacctagtgtaaatggctgcatttttgaaattccattgtaaatcttaataaaaaatattgttttaaaaagccagcatgtttggaaatgggtgtaatttgcattaaaatcagatgagattatttcttggttttactactaagacacatggacacaggaaggggaacatcacacaccagggcctgttgtggggtgggggaaggggggagggatagcattaggagatatacctagtgttaaatgacgagttaatgggtgcagcacaccaacatggcacatgtatacatatgtaactaacctgcacattgtgcacatgtaccctaaaacttaaagtataattgaaaaaaaaaaagacagattgtggatgcttatggaaaatacgtttactttttctagactcctagaaggccattttgaggacttctgtaataattcactaaatagatagaaaactgcctagacctatacttcgctgtaagatagtcctcttttggtctaaccctcatttctatttagctaactagctagtcaggagtgtaaggtaggcagtataaagaattttaaacttactagggtcacattcaaagtaagcctagagtaaaatcaggagatcagattaccccagctactgagactgaaatgtgaactgtattgttgaagagcttttcttcctcacaattgaagaagacataaagactggtgatataagagcaaatgcagacacttttggtcactgttagcttgttttgaatgtgctgactgtgtctgtgtccatcttgaaaatattgaggagtcagcaaaacatatttgactctttacccactttttcttaaatgtttcatagtcatgagtatttcgtgggggaatttaatctatgtgcctatgattcatttacactagtctcatcaaaatggcatagggagatattgaatggctaagaatccttaaagtttaagaggccatttaaggcttttatctctgaaccagaaagtcatagtgtaccaggactactcccaattcaaacataccagggttcaattttgttttgtctaatatatcccaggaaaccttactgtttgattcatgatttctaacctcaaaatgctggtctaacatatgtatatatatattaatgaagtccaggtaagaagcgcatggctagaatgggaatgttcaacataaaaatatcccagccaggcgtggtggctcatgcctgtaatcccagcagtttgggaggtcgaggcctgcagatcgcttgagctcaagagtttgagaccagcctgagcaacatggcaaaaccctgtctctacaaaaaatacaaaaattagctgggtgtggtagtgcgtgcctgtagtctcagctactcaggaggctgaggcctgagaattgcttgagcctgagaggtggaggttgcagaaccgagactgtgccactgcactcaggtctagatgatagagagagaccctaccaccaaaaaaaaaaaaaaatgaaagccacattttgaataactaaatttgaatatcagcacagttgcctgaggatgtatcaatttacagataaatgccttcctaccaactgaagaataactagtgctttaaaacttttcatccattaaaggaaagtcacactgaattactccgttggtgttgtgcgatattctatagtttttaaaatgctttaaaatacataatcttgtctgattaggtaaacaggattggtattctctccatttctaaaaggggaaaatacaattacatagaagtttgtatattgttgctttatgtgtagtaacatagactcttacagttctgagctatgattgtatgcaataatagaagcaatgctgcacatatctcatatagctctattttatttttaaattcacttttctcatacttgtaagaaatctttgactttggttttagttaaaagataaaacaaaatcataatttctatgataatacaaagcttgaatattatcattggcataaaattcagttctaatttttctccaaaataagatgcttactccaatataattatcttccttcttaattttacatatttgcattttaaagtggcctattcctatggggctaatgtcagagcagagtgttctttgaactcaatgtgtgctccccagtcaggtcaagtccagtcagggcagtgactaagaaatgggtcagaacttacttaaattatgcagttgcctggaaaaaagttcaacttatataatatatgggaatatgtgaatggagaatggcttcccccttaatgtgtaaactgtaactcaaaatatttttttgagttatagaaaaatttttttgtaaaaaaattaagaaaaaagttttttttaaaaattgagccaaatattaagataatcttcatggtgaagcattactaaattaatttaacggcagtcttaatgtaatgtaattttggtttactgatatgtaatcagttaatcttgaagatttcataagttctggcatttgttctttcctcttgtttctctcttataaattggtcaattctccaaaatatgcaaattaaatttaatgttaacctatgtgtaagtcaaggcatgtgaatcccatgaccaaataaatattacaaagcaggtgtctctacactgatgctgaatacctaccatttagagaagacaactctcttccccagggtctcaaggcatctcattcccctggctttcccccttttcccttgaggactctgcatcctcctttgctgcatcctcctcagctttccaaagtcttagcatggacatgtcccaagcttagtccttgcagtcttctgtcctccttctgcgtatctcttacacctcatctaatcacaagacttcaaagtctatatgccattgtttgtcaagtctctaccgatctggatctctcacctgatacagactttcatattcaactgccttcctgtcatttccaccatgatgtctcctctatacctgaaactgagcatgtccaaaaccaaagtattgctctttcccagcaaacttgctcctcctggagccttcctgatctcagaccaaactttgttgttgtctttgactctttttttcctcacactcccaattccaatccaatcagcaaatccagccagcattctttcaaaatataacccagaatttgcccatttctcaccatcaccatggcaaccagcttggttccggccaccaactttcccacctgtgttgctgcaccacctcctgaccagtgtccctgcttcagcctgttttgcacccctcagcagagtgaggctgctccagtctaggtggcattaggtcacttctttgctcagaatacttcagtaacttctgattttcctcaaaatgaaattgaaggtctttataataatctactattttttcctgtggcctctcagattcagctcctactcctcctcctctggtccagtcactctggtctccttccattcccacaactatccaagcaaagtcctgcttcaggtacttcatgttctcaagtccttcagccagaacttgcatcagcctgatatgccattgttttctttcctcacctctttccatcctttatttggatatcttcagagtgaggctatccttttattttgtttttaataattatatcttcaccatgcctgttcctggcattccccatcccctcttctttttaaattgttctccctgcaaactgttatcatataatccttatatagatttcactttttctttttgtttatttttcatctctcctaccacgactcaagagccctagttatttcatagttcactgctatatccctggcctttagagttgttcttagcatatggtggcagtcaataaaaatttgttgaatagataaataattactgtctatcttcctctccttaggtagaagcaggctatataaaatataaattattggattgtcagacttgcccatatttatattcaaatacgataatccaacttggttgttggaatctgtaaaaaaaaaaattagaacatccatttttaaaagattgaacaagcagtaatttttttccaaatctaaaacaaacaaacaaacaaaaaaaacagtgtcaatcaaggaatcagaatatatattgaattaattgtttttaggtcattagtgaacttgactgtgctgttgctctcaaagcactaaaaatagctgatatcaaaccaaaggtccttcatgatccttgaaacttccttgcagttctaaagaaaaactcaagcttataggaagaagttttaatgagacattgtgctgttcaggagagacaaaatcatagtttctgacctcaggggcattgataaaataagagagcagaagctctagggaaattagtttttaggaagtggaatccggtggctcattgcacattctaaatagcatcagagtaagaatgacagtctggctgattggctttagtgatgtggatagatttggctgctatattatcaaaactggattgaaatccctcaatatcaatgaagttttacaaaggtataaggactactgggccacagttcattctaggacttcatttaagtgacaaagtaaggtgggccaaagtgagattgggacaataagctaagtaatcttaaatttgttcttgtgtctatcctgatttgatcaatccacaaatattaatatttatggaacatttactgtgtaccaggcactgtgctagggagattgtgtaacagtgaccacagcagatgtaaaccctgcccttaagaagtttgtatcctagtgtggagacgggcattcagacagataaatgaatatacaagtgcaggttgtgatgagtgttacaaggggaaatacaagggtgctaggggagagaacatgagccatatgggttaaaccagggctatcatctgactgcttgtgtcctcccaaaattcttgttttgaaatcctcacccccaatatcatggtattaggaagtggggctttgggaggtcattaagtcatgagggcagggttcttacaaatgggattagtgcccttatgaaagaagcctagatccttttccccttgagccttgtgagcttgcagtgaatagatagttgtccatcaacaaggaagtaaaccatcaccagatatccaatctgctgatgccttcatcttggacttcttagcttctaggactgtcagcaataaatttctgctatttctaatctactcaggtattttgttatagcagcctgaatggactaagacaaccaggttgtcattaaaatctaccctgaaggttcagtacgaatccatgatgtatttgaataagatttgtatgtgaatcctctgtaaggacatccagatttgtggtctagatcccatttcttcccactttctaagagaccttgtacccctagcccctgtttctttctgccagcattttctgtttttctccactgactccttaccttctgccattatcaagttttacctattttgaaatataaatatcacatttaattattctccatagccttacagacttcatgtcttcaccactcaaaacctcatgtagtctccttttccccctcgtttacttattgtttcattgaggtgtatttcaatgggtttgaggcatgatcccatccaaaggactaatgtgcatatactcaaaatgttaattcagctgaactgctcacatctttgcttcattgcccatgtctttttgcactgaattgtaagccactaagctttgaatcaatgaacattttaaaatgttatttgtatagtgtctaaaaacatgtggcagttgagaatagattaatctgttctagaccaaaataagatcctggtgaagaggattttaaattcttgagttgaaagctgatcaaggtggaaccatataatgccacatgatacagtgtgatgtcagatagattattgtaacaaacacataattaattagtaatgaagtaatagggttttagatgtttaatcttcaagctggtagatataaattaggtcacattaaaatcagttctccagtctcaatagctctatgctcatattctccagcataaacctcagtaactcacacaacctctttcacttagcatctctgagactctggggggtgccttgcaattgcccctgcatggatctgcccaggatgtcactttgtactggtctctgctctaccagtgaccttgacccatgttcattagtctcttgattgcctaacggcagacaccaaccagtttgttccagctatgaatgttctctgttgtatctagggcagtaccagaacactattcacctgcagagtagaaaggagagtacatctcccttcttgctctctcaggggaagccaacagctgtgctgcttctggagctctcaaattctaggaatctagtgaaaaaagttctttcagttctccacacaactctttgtatttccgggatatgattaggagagttcatatgccagtcaccacaatctgccaagaaccactacacctttcaggaagctcagagtttgtggctgaggttcgggttattcataccagattccttttttctgtagagtgaattcttagtcagagacccattttctgttttagtgagaatgggctacaggaacaacaccaaaagctcagttgcttagaagagtagaggcttatttctcactcaagctacatgttcatgacaggtttgtggtggagggagagggttctgctcttcacttaggaacacagttaatgggagacaccacagtcgggaaagttcccagtcattgtggcagaagacagggcacttcatacacagacctcagtggtttcccccagaagtgacacgtattgcttctgctcacatatcttttttcttttttgtcttgtttcatcaaatcatagtgatattcagattaactacatatatatatgtgtgtgtgtgtgtgtgtgtgtacatatacaaattagagagatatacgtgtttctcatgctgctcacattttatttgccaaagtaaggttaccatgcctaacttcaaaggggcaagaaagtgcaatcttgccatgtgccttaaagagggagaactgagaatggtgacgaatagcaccaatgatgagtacaccttcttccttgaagttttgcatctatatccttctacttcccatccaatcctgccttttatgacatatctctctacatatgatcttcaatcatgtaaattgctcagtatttctctatattaattagtggttctggctaagggtctctcacgagttgttggcttgggctacagtcatctcaaggctcagctgcttcctcagtgactcatatagttgttggaaagcctcaactccttgccatgtgggcctctctatagggctaaccacagtattatagcttgtatcccccagagtgagagatgagagagacagataggcagacagagacggagacaaaagacagagacatcccaagacagaagtcaaacacagtctttcataatctcttcttgaaagtgacatgtcatcactgctgtctgataaccaatcctgggatagagtgggagggggactctacaaagatgtatgttaaatgccaggaggtgggagacttcatggaagctggctgccactctcattcaagaaggctacttactcttatgtaaatcttggctgccaaaaattgctgtctaaatcatagcttcttccaagtagcatacccaggacagggtaaatgcaatttaaaacttctctcaagggggttacttcatttagactagtgttggtgttctcctatgcaattaaatggttcttgtgtcttatcattttcaatgtccaatatccaaggaaatacatgcactcatccacagaatattttctttatttttaaagttttaatgctgtttttaagtcccttgtgtttaggtggttgttatacttgaaatgttagcagacataatacacagcaaataaattcttgatggttttgcttatcctcttctctagaagcatgcgctgtgtgagctaagtgtgactttaaataggacatagggaggaattagaaatagaggcaaagtggcagaaaccccacattaaaatccatccttgtcagcactctctgatttcacataccagggttcttttcggattaatcaaaaaattgttgaaacgtgttaaaggagaaatgcaattctgtaaggggaacacagttcctatttggagggaaggaatatgtatggccactataataacaaattaggggaaggcatgtgtgaatttttatgcactcatcgtcctattgagcacaagtagagaggtttattttcttttcttcattaattgttcttacagaaataaaccacactgtgtaggaaactaggcactcttccctacctactcctgctattgaaagagccttatctatggaaatcctcaaatcagcttcttcttattgtaccagtgatgtctcttggattaattcagacaaactgtgcagtgtaaccaatgcagacagtatgttagaagcgcatggatagcttgcttccttttcattccttcttccttcctttattgtttccgcattgtggttccttgtatcctaccatcttgaatctcttgtacctctaattatagtatgctcactatatgcaaggtttctcctcccacctaccccctgctgcctcctctactgacatctcacttcattcccaagaaaaacattgccctcccctccaagctcactgtgtttgcatttctctgctcttttccgctctcctccttggcatgctggtttaatcaattttaccaaatgactttcctggcagctgtaaaaagaaaaccccagagcaagttaatagcaatctaatactgcactttctgtcatttctctaaaacgtacagaactatttggtcattggattgatttttaatgatctaaatgatcagatgtttcaacgctgcactgcagcagcctgataataaataggaaaggggaggggcatggatgctgggcactcagtcagtgctagatgaataatcctaaaacagcagccaaggagacaagataaaatgtcagcctttgccaaatcatatattagcatttttaaacaaagacacctctttattttgattttgcatatggggaactaaaacaaaatgtttttgatgagggtttaggaagtcatcaatagggttaggaatcaaattacagcctaattctacgcgtatctgttgacataagcagaacgtcagtaaagtgcctcccaatatctctaaatagcctcttggcatctgaaacgtagggaaaaatattggttactttttaaccaaaaggcactaaaacttccaaaggtatatgaaatcagtaaattataaaacatgtccccttcccccccttctgtaagaaagaaatagaaaacaaaaagagagatgaatatggggaaaataaacaatgaaataatattatgaattaattgtaagacttgctaactggctgtgtaactttgggtgatttgcttaactattctgtgctttgttttcctcactgtaaagtggacaaactagtagtacttttgtggaagattaaatgaggaaaggcaagtcaagtattgagcacagtgcctggcatttactacttacgaaggttatgttctttattactccatctactctttccataattgcatcccctccaaccagtcctgtccagccttctccgaatccacaggacaattctggtctcccagtatggtgggcaaaggtaggttttggtgtccaagcacagctcagccatttactctccaggtccatgggcaagtaacttaacctctccaggttcctcagattcatcatctataaactggggaatattagtacatgctttataaggttattgtattaaaggaaataacttgtctaagtctcaatgcacaaagtcttccccagaagacagacttgaaaaaatattaactttatttcactctcctcctgctgccatttccaatgtgctgttgcatgtttctaaatggtatgtggaagaaagctgattagtttctttgctaattattaattgaattcctttagttaatacaatgtattcttttgagaagctcagctcaatttatagtgctagaaacatacaaatacagaatttatacgagttgatctggggttcacatagatgaaagggtgttttcctagcacattgctctgagaatactgtaacactcttacttcatgtatattcatgtatatacatatgtatatatctatatatgtctgcatctacatatgaatatatgtatatcaactgttcttatttagtatagttctccctgaaaaagaaggtactattttatttttaaatattggatcttatttttaatattggatctatctgtaataaagtagccaagttaggctgactacctgtctaatgagtttcccgtttagatggattagttccatttagtctgttccatagcccagatcagacagttcactaacaaatacacttaaattcacatcactttggtccagagggtgtaactaaggcccaaacctgcttctggtgaaagtgacccagaggtacgctttgctgataatatcaggagcatggtctttgtaattggaagacactgtctcccatctccccatttgttattgcaagaaaattagattctcattgaaataacaggcccaagaattatagtaacaggagtttgaacccctgtttgagaatgttggtactcctgggataaatgagatcaattttagcctataataacggtgctttctacactttttagatgttagagaaagtctggcagcaaagcaaagctttgtatataccatgggaggcagggttggagaataaaagaagaaagagagacttaagaacaaaattgtgtttgatgggatgttttgattttctttaaatactttaagtctctagaaataacaaatttattatctgaaatacaaataagaaatacttatatttggaaagttgataaaactcaattattgtgtaaaatgttcacaaatttccaatggatagaaaaaaataaacttttgcattgccaattattgaatacttattttcacctttggaaatagcaagtcagttacaaattttataaatctatataattgtctttatacataataaaaatattctgatgttttgtcagccaatatgcagttttaagcaccttcaaccctgttacatgtttacgggtttggaagttactggggaggaggtagaaaggtctgaccttctccccaggaatttaatatctggtcagagagaaagaaacagacttttgttgttgttttgttggtcttataaacagtgccaaaatgaatgtgtgtatgtgtgtgtatgtttgtgtgcacttgagcaatcatttttgtaggataaactcttacaaatgtaattgttctgaaatggtatgtatggtttacatttttaaaaatttgctaaattgtactccaaaatgtctctcctaatccatgtttctaacaactgtgtatgggtgtactgtttcccaccccctcacaatctgcatatttttagtcttttaaaaaaaatcttaaacgaatgtgataggcaaaatacctcattgtagtttgatttatttttggttatcagtgagattgaagatcttttcaaatggcttttgactatttatagttccccttctgtgatggttatttgcatccatgtcccatttttcttctgggttattggtcttactctaatttatagactctccttaaggcaaatgataccaaaaccataccatggctgtttacagtcgaccctcccagcttacgttgcattaataattgcttcttagaagcttatgttattcatccttctcctatttctacactgctgttttcttgcttccctaatttaacattctcaccattgcagtcagcaggttaaatggcaaacatctgaggaatcaagggaaacaactatgcattgagtacttgcatgtgctacatgatttaatctataccttctaatgtaatcctgaagaaatctaggagatatgtatcattgttttccagacgaaaaaattaagatttggttaaggttgggaaatgagactaagtaaataaagtggtaataagagactcaggtctgtccgatgatactaaaagcctgtgctccttccagaaaaccacgctttcttcagaaaaactgtttttacaagactgtattcaaacatatggcatgtcttgatatacatctaagtaaattttaaaattatatctatattcttaactgtccaataaaattgtgtatttatcatttacaacatgatgttttgaagtatatatacattgtagactgactaaatctagaaaattaacatgcattaactcacatggttatttttgtgatgaaaacacttaatatccactctgttaacatttttcaagaatacaacatattgttattgactagaatcaccatattgtacaatagatttcttgaacttatttttcttatctaactgaaattttgtttcctttgatcaatatcacacttgcacctccatttccagttgccccagcccctggtaattaccattctaatctctagttctatgagctcaactgttttaaatttcccatatgaatgagatcatgcaggatttatctggatatatacctagtagtgggattgctggatcatatggtagttctatttttaattattcaaagaacctccatactattttttataatggctgtactaatttacattcccatcaacagtgtacaagggttctcttttctccacattcttgccaacacttaatatcttttgactttctgataatagccattctaacaagtatgaagtgatagctcattgtagtattagtatgcatttttctgatgattagtgatgtggaatagtttttcatatgtctgttggccatttgtaagtcttttgaaaaatgtctttttagttcctttgcccatttttcaataaggttattttcttgccattgagttgtttgagtttcttatatttttggatacaaattccttattagaggtatagcttgtaaatattttctcctaatctgtaggctgtctcttcactcagttgattatttcctttgttgtgcagaagctttttagcttgatgcaatcttgtctattttggcttttgttgcctttggttttggagtcatgttcaaaaaatcattgcctaaatcagtgtcatatagcttttcccctattcttacatttatgtctttcatccactataggttgatttttatatatggtatgagataaaggtttatatttattcttctgcatgtggatatacagttttcccagcaccatttattgaagagattgtgtttccccaatgtatgttcttggcacctttgttgaaaataagttcactgtagatgtaggggtttatttctggctctctattatgtttcattggtctatatgtctgtttttatgtaagtacgatgctgttttggttactacaactttgttgtgtattttgaagtcaggtaatgtgatgcctttggcattgttctttttgctcaaggttgagttggatatttaatgtcttttgtggttccatatgaaatttagtattgtttttttctgtttctgtgaagaatggtattggaattttgatagggcttataatgaatctgtagattgttttgtagattgtttcagatatggacattttaatattaattcctccaatctatgaacacgaactatctttgcattcatttgtgtcatctttaatgttatacagctttgtaactattataaatgggattttaaaaatttctttttcagatagttcgctgctagtgtatatcaacactactgatttttgtatgttgattttgtatactgcaatttctattataatgaatagaagtggcaagagtggccatcttttcttgctctggatcttaaaggaaaagctttcaacttttccttgttaagtatggtgttaactatgtgtttgtcatatatggcctttgcttgttgaagtacattccttctatacttaatttgttgaggggtttttattatgaaaggatgttcaattttgtcaagtgctttttctgcgtctattgaaatgatgatatagttttcgtcctttgttctgttaatgtgatatattacatgtattgatttgtgtgtgttgagccatccttgcatccctaggatgaatcccacttgatcatggtgaacagtctttttattgtgtttttaaattcagttggctagtttgttgaggatttttgcatctatattcatcagaaactttggcctgtagttttctttttttgtagtgtccttctctggctttggtatcagggcaatgctagattcgtaaaatgagtttggaagtattccaccccatcaagtttttgaaagagtttgaggaaaattgatattagttattcttttagaaaaatttctattaacctagcagtacaagttagctagtttacacttggggctctgaggagatgtaatggagaaagagctgaaattggggttcagatttataaatctcaagttttggttgagcacgaaaggagagggagtgagactaatgataagaaggttaaagtaatcactggattgatttgggatgggcagtctcaaaagtgctgaggattcagttcctatttcagtgagctggaacacacaaacatagaggaaaaagaaagacagttcaagtataaatttgaatatacctaaatgtgtgtaaattacggaagaaacaacttcaaaagaaaataacaacaatgacatgggctacagaacagttaagattaatgatccctcattatagggtgccattcagacataggagttaaaaaaaaaaaaagcaaaccagaaccacacactgcagcagctccccagttgcaagcacactgaaataacagaggcctgccttcacgggaagaggattagttctactgtgacctgtttatataaaaacaatgttgtgggtagcaagattactagaaatgacttcttggattataaaggacaattatgatagcttaggccactagctttcagtacattccatctggtacgttacaaattagctcattattctgctgttcttacgaatgtgttagtctgcaaacatatcattgtcacaaattagtcacctagtgtttctctgaaagtgatttaatataagcacacccacatcataggatggaacagtaaaatgggtccttgctagatcctccaaacagaattcagcataaagcacaattcaatttccaaaggtttttggcacatacatcatcttctgattttctaagatgaaatgtgattgttgccctggatattggtaatacattgtaatattagaaacctcttgggtctccccatgaactctagagatccaagcctactgagaaatgatgggtccacaaattgagcatagcttttatttgtttttatttacatttgttatcgcaggtgctatcacaactgttgtttcaataatagcaatttcaatttgaaaattaacttaaagatcttattttgaagtgtgttttgtagcagatgagctcacccaccagctacttggaaagaagaagaaaagtgaggaaacataaacttcctctgctgtctaactggattacctactgagacatccccttgtgtgggttataataaatatttatggtaaacttcttaagttaagatgcctttggttgcaagtctggagcccccaacttaatggcttaacaaaaacaaatgaggaaaatgtactgtcttataacatgaattttcaaggtaggctattccagggtaggttattaagaggttcaaacacatcacccaggttctgctttgccatcttagcactttgtccttttgctcagacttactctcctcatttacacaggatggacagtcatagccagacaccaggaccaaaggcagaaaatgcaccctttcatgcctgagcaagaacttgtgaagatatatttttaagagagagagaactgagtagtgccgtgagtccaaccctaccctctcttaaagcgggctgcagttatctaactcacattaagctcaaagagagacctggccttcagccatttgatgtccttcccaagaggaccatctgggaaagccagtttggctccaagagcaagagttggtagggatggaaccactagaaaaccaaggccttgatgggggtgctggttaatcagcagcaattggaaaacaaggctcttgcttgagtcaaaggagttgcagccagaggacccagcagggataccaattatgaacccacaaaagtaccatgagacaaagaggcagctttcaacatctgccaggtctccaacatgtgatgccatcttacgatggcactaattcaggaaaacaaaacaaaactcttttcttcctttcctcaccactttctgtgccttccaatcccagaggagtcaataccaacggctagccagcctggatagccaaggaaggggaagagcaacccagtctcaatgccacccacttactccactgcacacagagactctgtggtgggcccagctgggagaggggagaaaatgtaagttcaatcaagtttagagttttgggttacaatttgaaatggacattctaatttctggatagagtctgagatgatggtttagcatgaatgcaaaggtctctattgcctaacagtacccagaaaagtcataagatgttctttataaataaagtttaaagggacagtttgaaagcaaataaaatgtgttttacactttgggagaccaaggtgggcggatcacctgaggtcaggagttcaagaccagcctagccaacatggtgaaactccatctctactaaaaataaaaaaaaaataaataaataaataaaaatagctgggtgtggtggtggtgcctgtaatcccagctctttgggaggctaaggtagcagaatcactcaaacctgggaggcagaggttgcagtgagccaagattgcgccattgcactccagcctgggcaacaagagctcaaaaaaaaaaaaagaaaaagcaaaaaacagcattttgctatctactacatgtcctcattttcagcaaatatgttacaatattgatatccatttacaaatatttttaactaccttgacaataccatatcatatttgtatctttcttgcgtgcttcccctttcttactctaatatttgaggggaaaattatttatgcctcctagcaaatatgcttctgatctttaaaacacctctgctccagcaaatggatcccaaaagagatgtgcattcaaggtgtggaaaacagcaggtcactggggggaatgggaaagttaggatttttattttttatattgctagagacagggtttcattttgtcacccactgcagccttgaactcctgggctcaaaggatcctcttgcctcagccttgcaaagcaccgggattacatgtgtgagccactgcactggctgaaaattagtattaatagtaatgtccttctgtcctagtccactgtttcactttcctttttcttcacggcttcctcctttagactcccttggactgggagtttagcactatcacctgcacactagacctgcagtctatgaagagaggctgtcagggatttggggctatcacagttgctcctcccagagcaaaaaatattcaaccctcccacacacacaggcagcagcctcatctcaaatggactgtgcctctaatcagtgagtggttatggaagacgaggagaaaagtgcatttatattttcattaactttgttcctgcttcctgtagcattttcattttgaaaatgagttgggaatttcaaacatcaataaaacgtgctgaggattctgacaacaaaatccttttttgtcatgtgctatgttgcccacttcctgctttttatttttgctccagtccctgtttgattgctaatctaaagggaaagggagggtcagtgagaaaagaggagaaatcttaaaaatgaatttactatttgatcaggtttgctactttattttgtggaaaattttaaagctcttttgtgtctttatgtattttacaaatcttggaactaaaaacaacagataaaatcacattatattccccattgaattatttcccacatttcaaatgtgcttcccagagagaaaagtataagatacagagctaggcaattcagtttcacattaatagttttgtgtctcatcagtttgggacgtgtattgttcatgttttgctttgttgtgcctattaagtgatttatatagtctattgcgatttttttaggaatggaatatgccaattatagagagaggtaggcgagttaaaagtttcaagtgctcagcattatagattcaccctcgagtcagaatgttaaaaacagcaaggaagagtgtgtaaaatgctaggtgaatgagagggcatctgtccacaatgggcaactagtatttaataactagccttgaatttattctacacttgaatgcaaagattattctacttaattatactacagtgactttgaaactattaattattctaaattattgggttctagtttaaatacatttttatatttttaagctttcaaatgattatttgaaaaaatttatctgaatatcctttttttcctaaaaaggaattctgccttttgagtactaaattattctctctataaatctaaaaatatcacagtatttcttttttttccaaaatctctctctctctctctttctctctctctcacctctccttatctgaaacaaactgacatttaatgaagaaaactgtgaaaaggggttcgagaaaatgagaagctagtattttgattggaagtgtaatagatgtcagtcagagaaaaagaacagtctccagaacatctagatgtggatgtagatgtagatacattgttaacgccactctgtgcattttaatttaagccacttgatcatgtaaccattaattcaatgtcaagttcattcattgtagctattcaatattacaatatagcattaattttaaatgactttatttcaggagggaaggaaataatttatgaatagcaacataaggtttcttatatgatgactcatcacaatgttgattgcaaaaaaagaagctgactcagactagctcctgtagaaaagggggaacatagttactatgaagatacagaaattaacagaaacaagtatagcagggcctattggattaggaaaactgaaattaaggcagctactctctttggggccatacaatcaccgatttctttttgtctctgtgtttctgttctttcctgccttctccctgtaattgccactgtctctttagttatcagtttgcactgaacccaaaatggtaacttcagcccctgagtctacaggacattttggttcaaccccaccttgaactgattagagtctcaatttcacttaggacatttcacattccaaagagcaaatattaatatttgctgcctagtaaatgaatcagatgtcagtgagtcaagttatcatgcttattcccatcagattttataatggtgaagtgtaggaaaggcaaggtctttagaaggaaacataggcagacataagtaatcatgtttggtatagagactcatttattaaatatttatgataataaaatacttaacaaagtcaatgtcaagataataaggactctgagtccttattatgcaccagatactattctaggcattagaggatataccaaggacaaaacagaccagaaaaccccactacccctagagcatgtaccccactacatgctgatgataatctttagtcatctatttcaaaaataacttaaaaatggagtggcaatgtctctgcgtagtcaattcaagatgccgaaataaaaatacatgtatatgtgtcttccttgtgtgtttctttttttttttgtatttctcgtgttgaacttgcatggttttctaaatgaaatattttcatttttaatgtttcatatatgtgtctgtatatatatatgtaatatacatatgttataaatatatacaaatatatgtatttgtaaataacatagtcatatttgcttttatacctaactctgttaactgccaatgatgtgtaattatatatgtgcatgggttagaagtggtggatggggcctttggattttaaatggcattttacctgcagcctctgatgcagcctcttccagcttcctattaaagtgactgaaaacactgcaaaaatatatatatatataatttttaaaaagcactaaaaaccagtactggcagaatattaaagaagcgttaaattagattgacaatatatatggtggaccacacattgtattccattctaaaagtaggaagaataatttcttagttttacctggaccatacaatacatctactatgtcctactactgtagtagtatatgcagcgatatactacttaagatttttaaaaagaaatatacaagcagacctaaaggtggatcaaaactaaagagttaagaatagaaacatccagaggaataccctcttgagatcatctactggtaaaaattcatcacaagagttttaaagagaataataacttttgtaagccccatctgattgaactgccttccccagtaaacctgtgagagtggagaggtttgagtattttcatggtaatttctttaccatgtgccatctggcaaataaaagagttcttttccaggcagtactttttaccaaattcagaggtcggtgaaatattcttacaacaacataaaaatcggtggtaaacccactattcctggaggggaggaagactggaaagaagtatactgacttgtcttttgggaatggaattatggatgacttgcttctttcttgtgtgtttattttattttatttttgtatttcccatgttgaacttgcatggtttcctaaatgaaataatgtttcctctttaaaaagaaactttaaatgatattgaatctagttaaaatgaaactatgtgataagtttcagattttataaatagattgtcaaaatatgtgttaaacattcttgataaaattacatctttgcttcaagcaattgtaaagaaaatggaatctattgacattacaaatagcaattttagcatccataaatttgaaattgtataaaaattgtacatattctgggtataaaatgttaatgcttgtcatgtaactttgtaaaaactttattttttaaagcatttttaggttcacagcaaaattcacagaaaggtccagagatattccatttactccaacccccacacatgcatagccaccccattatcaatatcccccccacaaaagtggtacatttttttttacaattgaacctacattgatacatcattatctctaaaacatatagcttacattagaatttactcttagtattgtatattctatgggtttgcacaaatttatattgatgtatatcttccatttttgtatcatacggataattccaacatctctggcatgtctagttctgatgcctcttctgtctctttaaactgtgttctttgcctttaactatgcattgtaattttttcttcatagctgggcatgtactggataaaaggaactcctgtaaataggccttaagttatatgggtgggccaggcatggtggctcatgcctggtaatcccagcactttgggaggtggaagcaggtggatcacctgaggtcaggaggttgagaccagcatggccaatgtggtaaaacctcatctctactgaaaacacgaaaattagccagtcatggtgacacatacctctaatcctagctactggggaggctgaggcaggagaattgcttgaacccgggaggcggaagttgcagtgagccaagattgtgccactgcattccagcctgagctacaagaacgaaactctgccaaataaataaataaataaataaataaataaataaataaataaataaaataaaaaagttatgtgggtggtggtgtggtaaggggcagtggaggggaagctttctatcattccataattaggtttcagacttttggtgagcctgggcctctggattgtgaatctcctaagtgtttttcaggttttttttttcttataccataggtgagagagaatggctaacgtgggctggaattgagtatttcctttctccttgatggtaggctagagtgggctggagttgggcatttttctttccccaggtcagtgaggctctaatataacaaaacaaaatggaacaaaaaaccccagcaggttaggctctgattaactagtttctcctcaggaagaaccaagcttcagcagatttaaagatgtgtactttttcccttctcttgctggaagcatgagagaatttttctccaatatttactgtgagaacttggtagcactcctggaggtaaaacacacagaattgtggggacctccctattactgggttcctctggagtttttcaactttcagacttgcctgcactcagcctctaacgatttgtcaattatagttgaggtttttctaccccagcactggttctcttggaggtttctgctccggtatgttgtgattctccatagcctactgtctatctcaccagtggtttgggcagcagtttgccctgtgacctcacttctcttatggatctaagaagagttgatttttcagtttgttcagcttttttgttgttaggacagattggcaacttccaagctccttatgtgaggaactgaaagctggattatgttacttttttactgggaggttgagtgatagaagaactgtcatcagaagtttaattaaattatcaatcagtaacaatcaattaaatttccagtgaaagcaaatctattttggatacatctaatcaggataaatgaaagaataagtgtgcattcttacaacatttctcttttttttttttttttgagagccattacaggtgcgaaccaccatgcccagctgataatatgagtaagttttgaagttgggctttattttattacatgagaaatatttttgctcctttgaattttctaaacaaatattatacaaagcctttagaaaagcttaagatataaatgaaatgtaattccatttcagaaggtagttttgacattacattatttgtattttttcttttttttccattttgattccagtaaattgcaaaacaaatgatctgtattttattatattttactaagcaaattttaaaggtatatgcaaacaacatttaaagagctcttcttattaaaaaattttaaattataataagttaaaattataataatctaagtgtttgtattacttccatgctacggataaggaaattgtgtctcacagaggtttcatgcgttggtcaaaattacacaaaaagtaaaaggcagaacctgaaaataagggttcacatcttaggactccaagatggtatacacatttgacttttttgtctttaaacttgctgtgaacatttttccacttttgattcttaagtataaatattaagtgccttctttgtatttcagtattaggcttttaagtcttctacttccaaaaaaaaaattaaaagtaaaatttaacaagcattctaaatattccaattatgaaatatatttcatattatgagatttttcttctgtaaaagaatttatcatttaagattagaagatttaaccttgaggagtatgatccaaaatggctttttatattagttgaatcatgaaaagtcccaacaaagcatttgctggttttaggtgatgaaactaggtgtttaatgaatttattttttcttttctaattggtgattgtaccctgggttatgagaatatgtagaaattgaatgtagtagctactagcaacttgctgaaacatgatgcatttccctgactctcagcaactgaaactgcggcttcatgaaaggcttctcgtatttcagttataaatgttcagaacagcatgccttcagactttgctagaacttgccaggagtggaaagtcatgactatcaacatcgttattagttaacattgactgagtaccaacaatgtttttggtgttataaatatagagaagaagacactgttctgttcctgggggattggctttctgtaaaggtgagatagagaatttggtcttgaatgttcttttcttgctgggaggtggggttggaagcacagccacctcaggtctcattctgatggcacactcacctctttattagttgatgatatatgcaataaaaagaaaaaaatgtataattacacatacatacacacatgtgaaaactcatgtaaattttattttttattggtaaaaaatatatatttatggggggagcttgaggcaaaaagtcacatcctgcaagatatccaggtgacagtagcttctatatccttgtgtataatgtatttatactgttattaatagtatatagaatgtgctaagaaaagtacatagaagtttttgtatgtgtaaatatatttatatgaacccaatatgtagaatacagggaccaagtgttttgtttttgacatctaagggacaaaagtaatccagcctcttgaaagaatggagactttccaaaaatatctgaactgattattggtattcatataagataaataagtcatcttttaggtctttattctttgatgtctaaatatacaggagttttatttcatcaagttatttaagaggcaaacattgacattagctattgattataccaaaatgcaatgatgacaaaaaaatataccttaacatttgacattaaagttactttctgaaagtgaaactcagggaaaatcaatgaagtaactcatcacaccctctgataagtacaagtgactaaagagtctaggaaatacccaacctcaggaactagggtgtgactttattatactatgcttatactagcataaaggttgaacttaatcattcttttatgctcattgtgaaggaagtgtgtaagttgaaggcattttaagaggatgaaatactgaaactgatattacagagataagaatttgtgtagaaagtattaattctgtatttctactgttacatttttgtaattttttttaaagagccagactttttttgtatgtattatcaaactttgagataaaactagttaaagcagaagagctcttgttgaaacagcacaaagtacctggcttcctagacccagcacaaagtaccttgcccctcagctgacctgatgcaactttgaaaaaccatagggttcccagaaacttagtttgaaaaccttcactcttatgagcataaccctataaccatgagagaaaagggttttattggaaaaggacgtgggacaccggctagttaatacttctggctctgattctggatgcattaagcgatctttcaatgaaaatgttgaaagtattttggtttgctctgagtttgtagtttatcaattaattgagctttttattgaatcagcctcatttaagggtagttaatataagttcacttactcttgtgcttgctgtgggattaaaatttaaaaaaaaacacaaaacaaaacaacaaaccagtctttgctctagtagagctgaggttatgccatagctgcagggacttcactgaggttatgccaatttgtggtgccctgctaataattcgcactcctgtattgataaaaataatggggctgagattagccataaagataatcttttatggttactcctgatatttctttttaatttttttagagacagagtctatgtttcccagcctggtcttgaaatgggctcaagttatcctcctgcatcagccttccaagtagctaggactacaggcatgagcaaccagaactggcttcctgatatttcttaaaagtttcatgaaaggatgattatcttttagtgtaacaaaatagattagcattaccctaacccaacaacattttttcatttttgacaacttgtttttagattacaaacctattagttctgcctaactgttgtttcttgaaggccatacatgtaggaagtattaaatttgtaaagtatcagcctataaattagtagacataactcttaagaccctctttctaatataaatggaataaaatgctggaaatgagttatttctattttctaagcaagcctattcttttatatttgttgccttatgtctgcaaaaatattcaattttggattgtttaataatgtgtagtcttgattctctgaactgtgaaataaattacagttttttctttgctatctttcaagcagaaatttggcttttctgttatttatcatagtttctcagttgtgtttccttttgttctaatttgttagactttattctagacagttgcatgtataaaaataaaaatccaacgaaaattcactttaaaaatattcagctaaaatgtcctcttagtttaagtatatttagtagtttaatggccaaatcatttgtattttatttataaagtgctttgcttatatcattgcccgcaaatggaaatgtagctaacaagtattgaatgttgaactgtgtggtagtggagaaagattcagaggtattcttactatcctatcacccataggtgatggtttgacatatgaacagagtagaataaaatggactaagaaaataatgtcagataaatgatgttcattacaaaggaaaatatatttttacatctttttaaaaaatctttgcatttgctactttctatggagacctactctcttgtataaggactgaatgttagttttaaaataattaaaacccatcattatcatcatcatgatcaaagatcactaaccagagtcaaataatttgaattctcttccagatctactgctcacaagatgcctgataatgaacaaatacaatctttttggcatctccaaaatgggcataataaatgtcttaatctcctcagcataattctgtgatgccaaaataatacatataacaataatattttagaaagtataaaagtataacaaggtggtattattatgattacagaggtgctagaatattgtggtaatgtgtacaggctctggagccagacttccttgattcagatagtgactcactagatatttaacctcagacatgctacttaacatctgagtgcctcaatagcctcatctggagaacagggctagtaacagtccttaactcatagtgctgttgtgtggattaaatggggtaatactgtaactatcttagaatgggacctggggcattgtagatgttcctagctcttaaataataatatttaaatgtctaatataatatcaaaattttaattacttgattcaaaacattcaaagcttgttaaaaacaatgtaggctgaagttttctgggccagattacaaatgaccttatggaagagatttagtccctttagcaaaaaggggtcatgaggacactgcctaggctacaggaaatctcaacaaatattctcaagattcttttatgctgtagtggcatctttctgaacctacaagttcacattgcttttaaggaatcacccagttcttcttcctcctaggaatcctccttttaggatcatcttttgatcaaaatgaaaattctccaaattatggtggtttttaagattagttttctttatactaggttttgaatttatgggacatgccctccacccaatcttgggtaatattttctgcaatgacaggacctcactggggaaatcctaaatgaagataatagcatgttatattaaatgttgccggtattccatttaatatcaagcaattgcgtaaaagcctttttaaatacctaagttaaaagtggtatattaatgttgagtgtacttctactgcaaagtccattctcccactgatttcaaacaaataccatttaagtgccaacctactattacaagagtttactattttattcttgctccaaaatggcatcaacagtgatggggtgcttttgggggattattgaacagaatttttgcaacaaaggagcaagcatgaagaaatgcaaaacatcagtgatagggattgcaacgttttatctcagcattcctcatatctacacaccccctaatcaaacaagcagttttatggcatgcgcaattgcaattgaagtacaactgacttctgcagaaccggcttccataggatttcctgtccaaaaatcaccatgtggtcatctgcagctaaatggttacaaatcatcaagtaaacaaggcttccccaccccggtgctttttttttaaggagtgaaatccaccaaactctatcatttgcaaattatctctggacttcttttatttctttttttttcactgggtaagaaggaaaacgagcaaacaaaaaatcctccctccgtatttgtttaaggcgtaatttccctgtgaggtgttttacaggcttctccttgtttagcttttcttgcctggtaattactgaaagaagtctgctcttccagggcgagctattcctttaaccccttttgcttgctcttacttggaggttagcaaggagtgcgcggctctgcaatgtctgggaacccacctagagggcccccttgacgccagcacatcccctgtcaggcagcagtctctgcagctgagccaggctgctgcagagttaatgtacagtaccacggagcctgcaagtgtcctgagctgatcagagctggggcggcacagcccagggcagacaaggcggctgcgaggattccaaaggttctgctggaaattcggcgctgggggactccagcaggagcctgttgccattgtgttttaaaagcatgcaaggtctgtatagcttgggcatgagaatctttcagaagatgtcagagcatcagaataaatgacacctattggaaaactgaatttggggtgaaaaacaaaagagattgagagaggaaaaaaaagaaaagaaagacatcgggggaagaattcttagacaacgtctgacttgcagctgtgaaattcattttctttccaaggcaaaatatgaaaagctcccacatggttttgataataacaaaataaaggggattctgcagtgaaaagatcaatagcttagtcattttacttaaagagaacagccagccttattatggggttaggcagcagaaatgaatttcatcgtgacagcatcttctgaagtcatgatggtagttaatggtaatcttgtcctgcagagcagaaattactcattgccttcctacttttgcagttgaaccagcaattctgaaatctgggaaagaagttggctttggtgatacatggtttctagcccctctgcccaggcctttgtccgacacgtctcagacggtagcactgcgttaaagtgaccatacatgaatatgtgcctaagaaagaagaaaaagcaatattcatttctaaaggacagcatggcaaagcaacctgaagttttccatttcccttctaacacttctttaacaaggatatcaagaaactgtcttttgactcctttcttcccacattccagagtccttccttaaggatgcattaatttacactcaaggcggttagattttaccaggacaatatttgccaccatttaggattattagttgaactggttattttagtatgttgactaactagtggaacctaaatggatggacccatacctgcagtgctctgtgatgtttcttttttcaaatcctggaaggccttttgtaattgctatttgtttttattggtggggggagattttttttttttttttgggattcaatacttgttgcaataattgcccacgatagctgctcaaacaagagagttggaattcatctgtaaaaatcactacatgtaacgtaggagacaagaaaaatattaatgacagaagatctgcgaacatgatgcacgtgaataattttccctttagaaggcattcctggatatggtgagtaatcaatattcccttcagtttgtaaaactcagaattatcaaattccgtgacaggtaccagatgaggatttgtcttgaactagagtattggtatcaagtgagaatgaaaagtaaactgtgcaaaaccgaatattgtctgagaaagtaatggttatgcaataaaaatactttgttaatatgaagcatccccaaataagtcaagcatgaggacttgagaacatttaaattgctaatatttcatggaggaagaaaaaaactttgagaatggcaacaatttaataaatttttttaaagatgaggcttagggtttgttttttgttgttttgctatttttatttgaaaattccctggggaagggcacacatgaatttctgatatatcaatttgtctgaatttctaaaagaaggttaagggaaacttagaatgttgactcaattttaaaataatgctaaaatgtgttggtgcctcacagttaaggatattttagctattcaagaaatatttctaccagaatgaaccagtagaattctagtagaattctaacatatgaatcaggaagtgctcaggctctcatagaacttgcttagtgccttgatatttggtcatctattaaggttcaatgcaatgcattcaggtccctggacatgtgatatcatgtgccatttcttgctggagtttatgactaaatgtgtgtaggaactcattgctgagggtatttataagagcaaaaggtcattattttaaaattgcttgtttttgccatacctttagggtcagctggattctgactttcatagcagaaactttgtgaatgcataataaaggcacatgttaaggcttagtgtctgctaacatgggttgttttggaaatgcagtttgtctgattttgaaagtatatctttcaggtaaatgttctggctggactctggatgaataatagatacctaaatataggtttcggagggctttccagctgcttttatgacaatgtctcaaatgaaagctccctgagagcttaaggtaccaccaaaatcacctgctggtttgttacagagttttcggctttcagctaaaaaatccattgcagagaaggatgggaggcatcctctcccactctaggcaggtgcttattttctaacaacaccagatccatccagagtcgatgctgtggcgtatctaccttttttgctgaccagagctactatccccagtctctagaatgcttgggtgacatgcctgcaaacctcggtggcccacttccaactgcatcaccagagtttcctagtcagggggagccttggtgccattgccttgcttgttctgttggtgagggtcaggcatcagcaataaggtcctcattattcttacagacaaatttacatcaatagtctttaatcttgagattaaaagatcctggaaacagttcctggcacgtagtaggcatttgtcaattatttttcttctatgccttaggcttttcttcagagttcattttatacctcttaagatttgcttgggaggggaaattaccagtctcctttctatcaagtgtaccttgctacaaagcaacagtttttgttctacctaagttctgctgtttaagcccatttgtttatgttgtaatacataggatccatgtactctttgaatgcctgcaattataagcactttttatttttattgcattagcctcacctatacttttgactggaaagaaataagctattcaactctgaagttttggaaagaatgcaaatttgcttattcatgctcctctagatctgtaatacatatgtttgaaagctgtatggagaagttgagagtcctgttggttttcttttgtgcctggagttaggtaacccttcatctgcttcactgcatgtcgtaccaatctgttgttgttgttgtggccaaactaagccaatgtagaatgttaatgctctgtataactcctactcttcctgggccccttgcagggattcattaatatgatgttggactcaaaggaagaaggtggtggtttttttccaggtgacctaattaattttgtgcttggttcttgactttctcaatggttgttgttttcctcttatttatagcctccccttccagtactgcagtaagagattgtaggggtttgttgacagaaaaccctctttccctttgtcctactgtaagagcccctatagggtgagatttcaggctcgtgaattatcgtgcttagaataaaggtctcgccaaattgctcttttcatctccaaagactccccctatcctcattctcacatttagagccttttcttcgtgaagggaccgatcagaagttggcaacaggccagtgctaaggaataataaacattgtaaaagacatatgtgctttggtttcacgagccctagctcatctctagaaaggctctgtaccctttggagaggcgggacttggcatgtgctggtcctctttctgtcctgctttttgagaagcaagaatgagaaaaagctgagacacaggaggtctagggtagtcttcaaattttaccagaagtagtaattgaaatagaagcctgtgcacagagttcctacttgtactctcatccacctgccctagggctggtgtgttgattattgagcaatagtattacaaattcactctttatcagttatgagttaaagttaataagtggtcctattacttggtttaatagaacactaccccttccgtgctaaaagagtggtatgaagaatgtgtgtttcttctttgaagctacattagaaatattagctggaggattttattgcgaaggcttctttccattacacttttcagtctttttactgccaagccaaacaaagataagggtttgcctcactggatagataagtactatatagctcttcttatttttccttctggctagttgttagaatggagagatagcctggcattcaggaacaagtatggcatggttgaaagaagggaaatgcaagtcagctttctaggaatttaaatttcatgtagcagcagttaagaggacctttagaagcattatgacctggaatcacatgccagggtctaacatgaatgacctaacacagtgtgactaacatgttcagctttttgcctgacttaaaagatatataacaactttttataatcttatttgtaaaaatactataatttcatgccagaaacatcaaggctatgttgaatgcaattgaatttcatagctaaacaatttaggagggcattttatttaaatacctttgcatccttttaatgatggattcacatggctaaaaggacagtggaagatagaagctaaaggccctggctaggagaggctgtggaatgctgccatggagggcccctctgaggacaccagaggaagatttgggattaatgattgtggaaggtgattaatgatttgcttatttggtgcttagggtttaatttttaaaggtaggacatctaaatgttttaaactgtctttgtgatgctgagaggtaactccagtgaagaggcaaaatgaggtgactgtggcactttcactcaacatggaggcatctttttccttcttctaggaccctaaattctttcattagactgtccttttccaggtatcaatttctaaaaggtttagtctagaaagttatttgtttgattgttcctctatagaccaagcattcaattcataaactaactcatactgttttattctgttttgatctaaatcctttatggaatgaagcaagatataaatcagtatattgataatatattcatatatgtgttcataatttgcatgtatatgtgtttaaatctactaatataatgaatacgtattcagagaaagtcagaatggcctgccttctaatgaaaagataatccttcctatctagcctcatagagtttcatcttttaaggttttctcctcttcatacattgaaattacagaaactcaatccagaagtgcattttccagagtatgtgttctgaccaatacattatattttattagaattttagggggtgggagcaatattgagtttgatgactatgtatacgttgaaggaaatgacgtatcaagtctcatgtaagataatggagctttgctccttttagttaacttaaaattattgcagtgtctgcttgtcttccagtgaaattgcaggtaatagctgaccttgcttctttaacatctcttcctctgggttacagaacaacccagaaattctaaaatataaataccagactgccagcttaattctgaattcctgttggggccaaatacaatttacttgtaaacacttaggaccaataaagtttagatggagctcataattatacaaactcatctcgttcacaaatccctagggctcaatgttaaagtcagccattgtttaaggcagaaattcaggtttagatatagtgtagcaaagattttccattatatgagatatcgatcctattaaacataaaacttttctcttggctttctattttactgtcttttgttgccatcagctgtatgccccttaattttttctagtaataccttggaatttaaaaatgaaattacaaatgtttatgttttagtgtttttaaaaataattcgattaagtatgctatgatagaggagcaaagttgttattagtaatatcaatgtgcttacaacttatggaaatgaaaaatagtctttagtcctagcagcctttctgctgtagtaaaatagtttgtgcactttaaatcgctgtgaggttacatcttcaaaggactgagtggcataagccagggaggtcttagaaatcttacaaaaggaaaaaaataagaaattattcctcatcatatgaaaattatttactaacaatgtatgatgttttagcttcttttaaattcttcactttccactcctttttgcttcttccttttagttgactattactgagttacttacactaatgttgaggtatttgggttcagagaaaaataggcaagtaaaggaaaattgaaaatagtttcaaattctgagatgcaaagaagaacccaaaaaaactaaacaaccagttttttattgccataggtcgaatgttcctttttaaaaaaatccctcatccttttctctcctctttcaatcatatcccacaaacgttaatgctcattaatactctgtctagctatagcattatccacatttttgcaatagctcaaaaatgtctccaagccataactgctgcaactgcttataacttgatggactattaggtgacgtttccagttgtttgagaagtaccagcctataaacatacccaagacaatatattacaactagggattatgttgtgtaaaatttatacatatatatctctccatatatgatttcaaggatagataatctagagtctacataatcaggctattggctggaaacataaataaactaaaaaaaaataatttaaaaaaagcactccaggtttctaattcagcttctggagtgttaatgttttgtgtgaccttctgaaagctctttgagtttttaccacttttgaaaactattacagcagatatttacccacttcatgttaagaagtaggctattaaagaaaatctcatagcacattggtaataacaatttattagagaccagcctgaacaacatagtgagaccctgtctctctctctatttttttaaaggtagctgggcatggtggttcatgcctgtggtcccagttactcagggaggctaaggtgggagtgtctcttgaattcagaaggttgaggctacgataagccatgatcatgccactgcactccagcctgggcaagacagaaagaccctgtctcaaaaaaataaaagaagaatttattagaatgttgacaatgacatgccaaaatctcttgtataactatcatatacttcatggaagagatcaacactgttgagcactcctctgcatgccatatgttttcacataagttacatcctttaatggcaatataactttctgagaatttcttatccaaatccctgtttgcagatgaggaaggtaatgttcacagagattagataacttgctgaaagttcatatatctattgctagggaagctgacccactcaaaaccaggcctggcctgattttagagcccaatatatttttaatccaccatattgttcttgtggcagatgacttagcactcttgtttatggatctttttgaaaattagattagcagtagaccagagaaaataagcagatttaccctgttatttagcagcctggctaagtatgtaggatgcttactgaatgtgaatagcctttccttgagaaactcttccttttaatgttagaacaatgacctatacttagactgtgtcagcagctctttctgtattttctcagaatgagaaatttaaaaggaatttgtggtgaactctgtttccaaggtcactgtggcctataggatcctttcactaaaaagtgcctctctggacgatatattaggaaaggtgtcacactttgaacagatgaagtagaaatgcaaactacagtacttggtgaatggacagagcctctgttcaaagcaaaagtcactcttcccactgggtacacacttggtgtgtggagcatagatgaattcagctctattcaccatctctgcggggcattgttgagccctgttcaaactgcctatctctggccctgctttgatacgggctccagctttactttgtgacagatgaaatggttttgagaatgctttgccaaaaataaaagatcatccacattttaggttttgctgccataattattactttcttcaaaatattcaactaattgtatgtctttaaacttcattttgtgctcaagtaaagaatattagtattatctgaaatcagatccaattgccaaagaagcattttaatcataaaatagcccaatttctgagttactgaaaaatgtcatggttagtgaattatattggaacaggtggaacacactgagttatttattcataggggatgcccagatgaatgtaataagagtcctgccttggagatactcataaactagtctggagaacagccacagaaacaaataattacagtatagtatggagcatattaatatagatatatacaagttgttacaggagtcagaaggagaaacaacttaactgacttgatccaaataccttaagtttcaaagtgaaaatatatttgatggatttgggaattagtagttactgataatacttcagagagtggtttaagggagtgtctgggggtaagttatatttcaggggtaataaaagcagagaaaagttgtgcaaactacttctttcaaaattttgcttaagaacgaaggaggaggagaagaagaggaggaaagaggagaaggagaggagaaaaacacagtagctagtgaagaacaccaagcacttttaagagtaggaagcatgtccctaaggaaatattctgatacagagctgggaaacttgtggacatgacaccctctgggatagggggaggaaaaggagggagaatgcagataatgtggagattaggtaggtggaaggagagcctgagggagtttttgttttatgccctgtgttttctctgggaagtattaaatggaattcaagatcacatctcagaaagaggaccagggaggagcaggtggaggagcttagtaagatgatggaacagctactagggggaattggaaaggttattgaagagagagtacaagacagtcaaacaagttggaaaaaggtcagtgatgttgaatgaatatatccagtcaataaaagacgttttactctacttgagaaattatttacacaaagtattatgtcagggaaatgagtagagatgtgacagaaatgttacaattcttaattattaaatttgaaactgttttgtgatgagaatgtctcctatggattgtgtttcttgggattccaaagaatacagagttgatcttaattgttgttgttgttttatttggtagtggtggaaactgttttatgaacatattaattagattgcagttccattttcatgacctgattttttgaaaatgtgagatttcctgtgctgccttgaaataactcttgggtgacaaacagaagctttaagatgtttgctttgaattttatcttcaaatgaataaaaatcacagtgggaagaaaagccaaaatgattcagctttgctccctttttaataggaacctttctgtggtttatgttagaatgtcacaaatccatatatatgtaacctgcttttacaaaaatttcttcaaaaccgctatgaagcttacttgaaagtgtcaccagtctctgagaaatgtactggaaataaggaaacataatatgactttaaccagaactgatgtaacccagtttaaatatttatacatttaaattctcttttatgtctccaagataaataggagaaaatgacaaataaaatatgtaagttaagggatattattaaatagccttataattttctaggtcatgagaataaaccctggaggatactgtgactttagccaatattatgaattcctttcatctcttctaatcatctcagcagagcttccgctattattgtcagcattcagtgctcaccactactttatacagagcttgctttgtagaatttttgctgtggctctaaaactctaaataagattctaaaagtcttagtcacttgtcagggaacttcattcttcctctcccttgagtctccatatttttcttttctaaatatgaaaatgagaaggttgacttaactgatcactaaggtgctataaaaatctatgatcttatatcttacctagttaatttactcatttctgtcttattcaggcataattgttcttccattaaaggtaatgcagagaaaccacacataaatcaacaaacacctccaggactgagctctgatgcttttctcaagtatttggcctctcctatggaatatccttagcctgtctaccttgggtattttgcttaattccttctccacaaaacctaactttaaatggcagcctttttcatggggaagacagcagcgttatgcccgttaatgctgatatccacagtatttgagaaaacatattccatatgcaacctatacatttctcatatcttcccaactcttctcttgataaaggtctcaggcccttcctttttcatatatcctccatttaatttaaggaaataacatgatatgaagtcctcaatcttaagaaccttgtcattgggttgctcactatgtttaaaacaaataattggcgtaatgatggagagtcccttgatgttctagagaagaaaggaaagctagcaatgtgacagtgggcaaattgagaaaaccgtagtggtattgagatcagtgaaagagacctcttacaagtcctaaagtaaggcatttgagtcttaaacctttgggtgtgttaattttaaaagaagaaaatatttgtgggaaaagtcctattttttagaaaataatctgtgccagatttgatttttgagagaggttgaatgctaagttgcctcaggatgtcatcatttgaaagggtgaccacattctgtgagatcttcactgcacacaaccttttgcttcaaagaactttctgagaccaagctagcctttgagaccaggtattaacattataatctgttctattcattgcagtagccacctcgactacttttttctactttataccacaatacccagcatggtgttgtacttaataggtactttttaaattttttcttaataaataattatgtgtacagaaaagaatgataaataaaaattatattgtcaggggaaattttaattaaataactttatatttttcaaataatgttattgtgctatgttttgagataaggtagggtcgtatgctataaaaaataatacagataataactatcacatttaacaggttatccattccaagtatagactaatttttttatagacatcattttacttaatcatcccccaagtctgtggcaagggcttgttatctacttactaagggtgcaaccttgggtcacttatctaacctctccatgatctgtaacatagggacagtaaatagttctcattgcatagggttgctgtgaagattaaatgagaaaaccagtctagtgcttagaacacctgtcactcagtaagtatccaataaatattgttatagtacagattaggcaactagctgtgaatggttaaccaggttgcctagggtaatcagtggcaggccacttccaacctagatcttacccattaactataggttgcttggaggtctaaactgcctcttctatatcacattcttgttcagtaaatacagggacaataccttgggttaagtttgaattatgagggataatttatacctcctcatctctcaagcctcagcaagaatcgactgatgtgccctcccatgttgagtcagtgcctaccttatacaggatggattttctgtttatgactgtcttactcaggccctgcttcattagattctctgttcttagcacagtgcctgacacatagtaggtgctcaataaaatgattttagagtaaacattacttttccagaattgtgtcctgggaatttacggcttttaatattaatttcaggtttttaggatatagcccatgtttttggggggatagatactgtttctataaaaattgtcatcttgagcataaataattcccacatatcttgatttctgtcacttgggagagtttaactggatttgtagaagcaaccatcctgccgaactgggtgtatctgtaaaatctaaatgctattgctacaaatcaccttatctaagacaccatttcttcaaaactaataactagctcattcactttcatataggaatctttctttccttgaagatatgtatgttttatcttgctggtgagataaaagtctgtaaattatctccacagctggctctgatgcttgattatgcccctttctgcatctataacattgatgtttcattttaattacttttcatcacagtacatgatgtggtcttcagacatagaccagcctctacgtgtggctcttcgttctttttatacatctttcactgtcaaactaagctctaaaaatcatctccctaatatctcttcacttgccaagaaaatgtactagctttgtattatatgtaatacagcataaagctctgcctcatctggcctcctcctttctagtctcattgtagaaatgataatttttattaatattatcagtgttaattaatttctctcattattctagcatacatatcctatatttgagtttttaaatatatcaattctttagtatagtggttataatcacactatatatgtatagaatgaggttttattctcactttattatgaaagagtatcaataactattttatatcattatatgtagttttgtcagagaacatcctgaaaaattaacttcaatgttttaaaaagccatagttctcagtgtgatggagatggtgaggattggagaatgtcattagggaaggcagttgtatcatttatcagaaataactgcaagactttgttggggggaaagtaataaggagtatgaaaatctggaggttgaagagtgggtaggaagaggaagtgacaggtatattttgataaagcattcgagggtttcatacctctctctcttaaccagtagtacaatgcaagggaaagatcccatgctttaaagctgtattgaaccaagttcaaattcaactctgatgctgactggttaactttgagcaaatcaccttttatgagcatcacttaactcatttataagagaaaaatagaacagttccaatcacccagatttactgtaaggattcaatgagataatacattatttaatttgtcatttttaaaccgcagcttttcccaggcagcatttaagacaaccaacaaagttatatgtgcataacttatagggagaatgttgatgaagggcaaagagaaataaggtatgatgttcctactcacatatgtatgtaatagttaaaaaatatatatatatatattacctttacaaacggcaccagaatcctcttggggaaggaagaaaaatgtctttgctagaagatatttatatatatatatatataaatatatatttatatatatatatataaatatatatttatatatatatataaatatatatttatatatataaatatatatataaatatatatatttttatatataaatatatataaatatatatttttatatatatatatatatatatatttttttttgagacagagtctccctttgttgtccaggctggagtgcagtggtgtgatgtcatcccactgcaacctctgcctcccagtttcaagcggttctcctagctcagcctcccgagttgctgggactacgcatgcaagctgccacacccagctaatttttgtatttttagtaaagatggggtttcaccatgttggcctggctggtctcgaactcctgaccccaggtgatccacccatctcagcctcccaaagtgctaggattacaggagtgagtcactgcagctggcctagaagagctattttgaacgtgcccttgggataggaagaaagtccctgaggatctgactataggtaggtgctcaagtgctctaagggtgaaaacttctctgcataacagaagaagaatttagtgctaaagagccaatgagaatgatggagatgaggcagagaaattaggagagaggacaggatgaggaaaattcgccctgggaaggctgagaactgcgggtatactccataaacagatccctccccagtactgacagtggttcggtgggtgaggggtattggggagggtacagggagttgctaggggtgggaagaccactaatatatgtatgtcttacttgaagcctcaggagtacctgaagtaagtgattttgatggtgttggtggcatgtgaatcaaaatgagctgtgttgtgttggcaaagcaggtcaatgagcccagcctttaggaaattatcagaaatttagaggtgagttttgggattcttactggtcatgaaattaggaagttcaaatcaattttgtttagatctcaagggaggcagagggccttccatctttcaagagttaagcagaccatgaagtccaagggtatgcaagatggaatgtaaagttctcactaagcttcctaggatccagggtaaatcaggaagcttaaacacaaatccccgtgtccattggataaacaatttgatggatcagggaagcacaccacttatgatactaagatcagaaagaaatttgtcctaagttgtgcataaagattaatgatatacatatataaatcatggtatctgctcaacttagtgtgtttgatatattttagttcctctcctgtcccttttttcccctatggatttctgtggaagattgtagtatatttgaaagttctttgaaaattgtaaatactattgttagtttataattaaaagaaagcggccgggcgtggtggctcacgcctgtaatcccagcactttgggaggccgaggcgggtggatcacgaggtcaggagatcgagaccatcttggctaatatggtgaagccccgtctctactaaaaatacaaaaaattagctgggcgtggtggcgggcgcctgtagtcccagctactcgggatgctgaggcaggagaatggcgtgaacccgggaggcggagcttgcagtgagcccagatagcgccactgcagtccggcctgggcgaaagagcaagactccgtctcaaaaacaaaaacaaaaacaaaaacaaaacaaaacaaaacaaaaaacctgtgtaccagatttcattaaaatctgattaaatactattaaagaaagtataataaaatagatagtataagaaaaggataatccaaataaaaaatatgtttcttattaaaaaatggtatgtcttgccaaattttgaagttaaaagcacagcattctcacttctttaacccaacttatagcccattatagcactagattttagaatcctgagtcctatgccatctgtaatggcaacagtcttacagggtgatacaaccttttgtaattcttaaggagacttgaatttttgaggcaaatgttgagtctatacgtggacatttgttgtgtaagagtggaagtggaagtcaaaattctgaacaaggttgctcccaataagatctgtcagctcacaagattgcttccctaggcttgaaatgtttcaagcacaaattcaattcataaggaaaatgagaatcatgaaaatgattatgaaatagcaagcagtctggaaagaggatgtagacgaatgccaaagcttctggaatttatgaaatatttccatttatggggccaggtgaaataagttgttctttcagaaatgtgtgacatggctattatatattatccccctaaaactatttgatcataaaacaaaacaacaaaaacaaaaactgataaacagcaatgacaaaacaactaaataaaaaagaaatgcagttcttgaatacaggatataaaggctcagtgcactttttcattttcttattatttcttttccctggctaggtgagttggctgttttatattggcactaagagtttgataccactactagaatagtcaagtatttgacctggccatgagtaaaagatgtttgattgacagatgagtctatctgtgtcaaacagctttaccttgagaaaaatcacaactttgaaagcagtaacacttcaaaagaatattgaagattgtggccactttcccccacctctccccaaaatctatcttcattcaagttcattataagcagctcctttgggtaatttgggttgcgtgctttctccaccccttctgtatccttggcttcttcagagcgtcaatcaagacaagcaaaagattcaagaaaaaaagggaaatgacctttcagtacctgagtcttcacaccaattcatcattgctaagtgctccaaaactgctgagtacagtatttaggaagtgtccagtacatcagcctggcatatattgttcttaacttgaggttactaatgcctattgcaaatgtgctttacgtcagccaaatgatgtgtttaaaaacctctatgtctagcatgaagaagaatctctttcattctcatgttaccttaaaagattttcataccaatatacatcagggaggagcaaatttttgtttcatatgttacacatgttatggtgcacatgaagactggaaacggtagttatttgttgggcatgtgtatgaattagtatgtaaaatacacagcatttttttctcttctaagttactaaatattagatatttaatgtatttcttttgctttgctaatttattcaaatgtaatcctgactaatccattattttgttaacatgtctacttgattaatgtgtttttcccctcttctaattctgatccacaaattttatagctattcattgtattacttaatctaagtccactaaagattatccttattcatgtttctccattaaagacaacgataatatcattgagttagcttagttcggatagaaatttggctagcattcattatttgattttcttggagttttgcaatttttttttttttgcatatttgtcaacattgtatactcctgaaagcattgtgtttaaaatacctatttcttgatcagtagaattgatatagctgacttacacggatcaataacatgattttaagagcatttcaaggaaatctctcatctgcattgtctttttttctaacacagtttgcactatttacaagtgaaaattttatattactttacatattttcctgtaaaaattagaaaactgtattctttggcacccgaatgtgtccttgaattattaatttgttaattttgtatgacatccttatttattagagaagcaataatatttctcatgggaatgcatgtattaatactttcagaggtccagaaagtatcaggagattaaatactgagattaaagagtactctcttcccactattatgttcagttctgattttccagctgtgtagctagaacaaagaaagaatgtgggttttttttaaagaataagacaaggctagaaggtatgcccttgtgagggcgccactgactgtgtcatcacaggagggccctgatacatgaatattcggtctccaggaagccaagtatgatattcacaaccacataataatgtgctaacctcattcacggtaatcacagataatgtagtatttgtgtctgccatacagttttgaaggtaaaatatggaacctattttggaaatttcacataacatcttaagctgtattaatagaaccagaataacccaaaataaagaggtaatgaatgcacttgaccctgcatcattcagacctcagctggaatattgtgcttccttttgggctgcagacaaacagaagaggactcaggagagtgacaagagaggaagcaagctcatgccttgtcacatataaagtggttgaaagactgcaattgttagagaaaatgatgcagtaattgaaggatgggtactgggaagaggctagttctttgaggctgctaatctgaaatataacaagtggatgcacctgcagtaaaagagattaagccccagaatgagtctggatgttctaatggtcagaacaggcatttcatatgacatggcctgcattggtccaggtggcgaagtaaggatggacaaacatgcgttgtttgcaatgataaaaaatcataagtagatgataacattgatttgctgaaatttttctcttttttgtttggtgtaaaactttatatgtcgtactttttgccttgtggtttttttgtatcttaggacaaaggtattcttaatccctttctttgtcttcttgaaagatgcaaccatgcagaaaatgcatacctcctgtaaattgtttcctgtcttttagtaaacctttgtttaaatgagtcatatgtttagcaattttaacattttaacttggctctaattaatgataatatagcgtgatttatggtcttctaaagaaatgtagacatagaaaatggagatagaggttaacatgtgaagaagagtttgtattttgggttagaaaattaaatattggcttatgtcagtaagattaggccttactatttgattgtacgagtttactttaaatttctaggctttcagggctttgtaaagataaattttattttaaaacagctttagatttgcagaaaaatggcaaagatagtgcagggagtttccatatacccctcacccactgccttttattaaagtcttatatgagtatgatacttttgttacaatgaatgaaccagtattggtacattattattatttaaagtccctattcattcatatatccttagttttacctaaggttctttttttctattccagggccccactcaggataccacattgcatttagttctcgtgtttcatttatctttgctatagaattttctcagattttccttgtttttcattaccttggcagttttgaggagtactgattaggtattttgtagaatgtctctcagttggaattttctgattgatttttcatgattagactgtagttagtgttttggggagagagaccacagagggtaatgtgccatttttccatcacactgtcaacatgactaaagatgttaaccttgatcacctgatcgaggtggatttggtcaggtttttccactataaatgtattatttttccttatttttattattttcatacctaccctttggaaggaagtcatgataaacaacccacacttaagagggtgttatactccatctccttgaaggcagagaatctacataaaatatttgcaattcttctccacagaagatttgcttattctccctcatttaattattcagcatttatgtatatcagtatggactcatggatatttattttatgcttaggttataatccactactgtcatactaatcgtgctgtgaaattgttccagctttggccattgggtactatttcttgtgtccctttgatacatccccacaattgtggtggttttgttttctgttttttgtttgttttgttttgatgcactttcatcctttctagcattacacaatacttgaggcttatcaacaatataactccttcctcatcatagattcagccatttctccaaggagcacacgttcctttcattggaaaatggtattaaaaaccaagatttgagcaataggtgtgttcattgtttttgggttgtcatttccttttggccttcttggctgacagagcaaggacatatatttgtgtataccaacctgtgtatgtacacatatctaacaatcaggaagcataaatagatagatgatagatagataagcattagttcatactgatattttcaaatctaactcattaccacatgggtcattctagcttcttcctcttgcttatctataatcttccactccaacagtgaaaaactaccatccatcatttgcttacttaattgttcaattccagtggtgctgttccatttatccttactgaagttgaaatacataaatataagctgaatttttctcaaacccttagaaaaattatttttcccccaaaatgttttttaccctgcaaactcttaagattttaaaatgtatttgtgtcccaaatgtttttctgtacataaaaattgatatagtcaactttatattgtttgcagttaacttgggacatggataatggaaattctcagataattccacaatttaagtttatctcttgctttcattatttctaatcagcatactctccatatgacaactatatctatgataagaaaattgacttctttacctataaatctctgtactttcttgacagacaccaaagaactacatgttgactgtatcttgctggtaacttaaggagaatagtaacttgtagtttccacctttagcaactggacattggccatactctgatttaccaagagagtccttgtaatcacaaaggaaagcagcgatttggcttcagatattaaagcaactttttttgacgtggctagatggttaggaacacactgaagaatagattttcagtaatgagccatactttcaatgaacgtcccaaggaaaacaattttaagatcttgcataaaatagttcatatgcctcaaatttgcatttaattcttacattaggttgaaagctcatgtagaaaacatgtaatgtaaaaattggagagcccaagaacacagtcatttccccttgggtgctaacaaaaatatactacccaacagtgcctttgtttgcagtctaatattttagaaggaaaaaaagaccccacaagcaaacatgttttttttttcttagtccagaaagaagaaatacagtgtgaacataatacttagggtagacaaaatggccaaaatagattaagttggcatcctttttagctgcagcttccttaaccttgtaccacaccctgacatcatcttcctacatggccacacctcatccccccatagccaaacattatttgcattcatcactcattcgtagatgccaaatcagacatggttcttgcccctatggagtttatgattaactggggaagacatgcattaatcaaattctctttctctctctctctcattctctcacacacacacacacacacacacacacacacacacacacacacacacacatgaaactgtgactggatcagatgctacgggagaaagacacacagggttcaaaaatctgtgaagggtttttttatctgttcagggaaaatcaggaatgtcttctctgaggatgagtagttcaggctgtgatttgcaggatcagtaagaattaaccaggaaaagaaggcaagagagagaaccttatgtggtgaatgaacaaatgtttaatataaaggcagcagaagagccagggtggaggcaggcacagaggtgggagataaggctctggtggccatgctaaagatccttacttcaccctgacagtgatggatcatcacaacatttccaagatcaagaatgcacttcccatctgtgtttcctctaaagtcaaaatatggcccatctttcaaaaggaaaattcaaatgttacccattcagtcttctaacactttcatttcctaatctaattagaaaagatcattctggctaagaggtggtatagtagtttaacccacccactcatatgcatgtgtttgtatttatatataaaattttattttcacatttctttttcctagtggcattagcaaaagcactcccagtttcattgagtctcttttaagttttgcttcccctctcctcctctcttcactatgctctgctgtcttggtgtctccccactactcatgtactctccctccatttctcaattctcatatgaggggaggtgccccagagggtgacgaaggacagtgtggcagaggacaggaggaagaaaacataggcacagctgcacttcagcattctgaagctgtaatcatcctgagcatctgtccagggacttccttgcccagttgctttgccatctgtacttgaagccaaggagcatcaggtgctttgcctttcctcaccaggcttacgccatagccttttcaccccactacccacacctcccagtgatgctgcaactatttctcctctgggctccatgcagtaactttctgggtttttttggttgttgttttagagcatttttgtagacagggttttactcagtcatccagactggagtacagtggtgcagttatggctcactgtagccttaacctcctgagctcaaggcatcctcccacttcagcctctcaagtaggtgggactacaggtgcaaaccaacatgcctggctcattttttatttttttgtaaatatagggtttttccatgttgcccaagttggttttgatctcccgggctcaagcgatcctcctggttcagcctcccaaaatgttgggattataggcattatccactgtgcctggcccagtaactttctaaatagtgtacaggcctccagtctcaccacctgtcccattctccttctctttccttctgcagagacctaagagccaagcggagcccatctccttcctacacattcttccagcctctttaggacctgatttcacaacctcatgtgccacaccccagctgcaccctcctggtggaaagtgttttgcagcttcttaaagatatcattctgcttcattcatcaacctttgtccatggtgttccttctgactagaatgtgtcccccaacccctttgcctggtgagaccctcctcttcctttgagacccatcagaaggcttgtctcttcttggaagcttctcaccccactccagtgctgcatccctagtttctgtgcatcccctgcaacctgtgcatcactttttcaaacatcgctcctcaagtagcattgtgcatgctgttttcttgcctttctcactcacacaaatgggagtttcctgggggccctttgtcatcaccacctgcctgactggatacactaacactcagcctacctgccacctacttggaaccttacaggtgtttctttgattaattaattaattcatgttttctcctcttctggtcagttcttccactttacctgtgcttgtttggatatgcagagctctagctggcgagagtgtccttctggctagattgtctcaccaaaaagagaatgggttttccccatccgggtgtctcttaattttttcttccactcgtgtttggacaaaattatttattgactggaaggaccacatggcaactcttcatggctttgaggccccttaatgagtgtccaagggagattctctctcacttccaagttcatggcagacatttacctacccagtcagcttgaactgagctcatagaagttttatttctggcttttgcggatcattttttatgctgttcctctcacctgaagctccctttctatctctccctagttggataatagtacacatattaaatgtgtaccttgtaccaagtatgctgagacctgcttataactaattttgcttgatcttcatgaatagtgttttgaaatagcatttttctatccctgcagataggaaaactagaaaacaaagaataagtaacttccccaagctcacatgacttgtaagtggcagagctgggatttgaacccaagcccctctgaagctaaagcctgtagagtacatgctcccttcctccacatcacactgcccctgcttgttcacactcaatgtgagaatccacttctcaagtttgtcttgcttattccaacctgttttgcaatgaatctctttcaacagctctatagttcctggcactcacttggcatccatcattttctatgttgtcatgtttggtatcttttcatgtatgtaatgtgcatctcttcttaggagtaagaccagaacttttctgctctgcagttttctccctgtgagggatggtgaaacttggtggctaagagcatggtttatacagacagacttcttaggtttatattctggctctcctctgtacttgctgtatcagctagggctgatgtcttcacttttttatgattccatttctacctctgtacaataaggcaaatatgaatacttacctcagagtgttgttgtgaagatggaatgaattaatggccataaagcacttacagctgtgtctggtacatagtgaccactcactaatggtcacttataattccttcacaacctgtaagggtcctttccacccaggtgatgtccctatgtctcaactgaatgactggttagggatatctttccatgggctactgtggctgcagataattgcattcttatttgagagttatgttaactagtgtgggcttttatttgcttctctctttctatcaatgagtcctgctgcttcaaccctgggttaactgaaatttgaaacctttttctactcaaattcctttgatgctgaaattcctctgcggtcacagctaagcactttgtgtggtaaccttctcttctgtcctcaggcctgctgagatcatctgctcagcagcatgtctgacacctgttgccacctcacccagccacttccttggtgacctggcaatgcccagaggggccctgccagcttggagccctgtggcaatgctgtttgattcagcaaactgatagccttctgacatcctttcttcattttagcagccaaatcacatgcaccttaatatttatcaatagctaagcaacaccggaaggaagtgagacagagcctctgggctagtcactatctctgattttacagaatggttaagccaggtgtaaaatatctcacaataacatgccctgttgtcctgaggattcaattccaccgagatataattaccatatgaggaagtgagaaatagggtttctttctaatacacagaaaatagaaaataagatgcttttcttggccactgttatcagtttcctgttaaggttctgctttgtttaaaacagtcctgttttgcttaaaaacaaactctaaggaatttttctaaaacatgactcaacctaactaggtatatatactgtactttaaagtgaacatatttgaaataattgtgagtgacaaagagacggaaaaacatagattttgaaactagcattattctaatgatttttatcccagtggtttatttggaaatgaatttccattcacaacatcttcatttgtcttctaattttcatgcaatttgaaagggttagtttccttacccacaggatcatcctggtcaaatctcaaaagattggctagggcattctgattttacaggcaaatttatattttgccgtttcaggaaataattccttcatggttatcttttataaagagcttatttgtataatatatacacatagtatatatcaaataaaagatctggtgttataaacataagaataagcaatttcccttttgtgataggaatatgaaattccttctggtagaggacgtttaagagcatgtccaaagaatggctaatcaatgaattctctcattttgtaaggagacacttagatgcatttctgaaaaaaacaaaacaaaacaaaacaaaacaaaaaacactttgggctttctctgtattcttcaagcatttctaaacatttattgacatatgcagtagagaaaaactggtatcaggaggaaggcagtaagtagccagcagtcacaaggtacaaagaataaaatgcatgcaaacatgtacagtattcactttcaggagttaatctacattttatttaatttttttttttttttttgacagcgtttcactcttgttgcccaggctggagtgcagtggtgcgatctcagctcactgcaacatctgcctcccgggttcaagcaattctccggcctcagcctcccaaatagctgggattacaggcatatgccaccatgcctggctaatttttttgaatttttagtagagacgggtttttgccatgttggtcaggctggtctcaaactcctgaccacaggtgatctgcctgcctcggctgcccaaagtgctggaattacaggcgtgagccaccatgcctggtcccttttaaaatattttaacactgagaccatattactgatgtactacttctttctaaaagtaattagaataaatgtacaccctcttctttaaactttgcatttttcaaatttccaaaaacaaaaactaattataagtaaatccataagcaaaacgctgttaattaccacttccaaaatctggaagcggtgacttgctttactaagacaagaaactttagacaggtgaatacttttaacaaggaacacacttaactttgtctaattgagcaaattacaaatcagagctagtagcttgttaattataagaatatctccattacttgaatacgtgtactagtcatggtaggcaaaataatactccaataacggacgaccccactgtggatctgagaaccccgcaggccagcagtctccatgtgattgccaaaagcaatgccgccatataaaccacaggtgtctaccttcaccatgacagaagaaagggttagagattccagaagtcacaattaaatgcttccaccccgaaaagtggatcatatttcattttccaaagcaatgcaactttgttaacctcaaagaggcagggaagtacaattttcctgtggggttggaagaagaaaactggaaattggtgaacagttttgaaatgtctgccataacttttaagtgaggaacttagtgttctcttactctgtcatgtttttaaatatctttttgattgaaatctttcaaggctttccagatccctgaagataaaatacaaactctccaacaagaccttttggccatcaggaacgcagcacctggctctctcactagtatcctctctctgtttgccatgtcccattaagactgtctccagaaacaatgaatttattgttgcctgtttcctgctagcttttccccgtatttacacagtttgctttatctgctgggattacccttccctgactatgctcaatctctatctcccttggcaattctcctccaggccccagacctgagaactggaccagtgctctgctctctcctctgagcttcaccacatcctgtgaaaacttgaacctaattcttactaggttttaatcaactgtttacctgtcttttctccccactaaagatgaaaagtcgcagagatagcggagaacaagaaccagatctcacagtcatggtgccaaaagagtatctaaccctgaattggagttcaatacatacttgttgaatgaatgagtgagtgaatgaatgaatgggttttttttgtgctttcatctacctgattggtagcatattcaggacagtatgtttttctcacctttttacatgctataagacataaaacagataatgcgtgtagtgggttcataataaaggtttaaataaactttacctacagttttatcactaggaatatatttctgatatctattacctttgaactttttatgccagattatgtttaaaaacatggtgtcactcgtaagccacatctgggactgattttcatggattgattaaactttacatttcttcggagtattcactgccaagccctctggtgccatgtcctaaaccaaatatttcagaaacattgcaaaacaaggctgcccttgtgctttggaaacgctttcaaatgacatgccattcctttcaacttgaatctattaaagacttgaaattgtagcaatccattggactatatgtcaagaaactggtatttttaaagggtggcatgtttcttcatttatatgtaaattatttccatgtgctttggagagaaaaatggaaattttgtgaacgtacttagcccttaaagaatgtgattgatccttgatgatgtcgttccagacaacaacaaatacacaagaactctttttgagtgctgtaagaagcttctcaaaatttccagtataatcctaggaaaacatttttttttaatcttttctaatcaggaagtctttaaagtgtattttatcaaaatgttcagtattgtggaaacatactcatgagctattagctatagctgacttttgaggttataggtgaaaagttttcacatcaggaagtttcatgtagaacaaccagcgtcattcacgctcatatctgtggcttatatccaagagggccactggaggcttaggggctttgaagttaacagcatgaaacttctccaaaacaaacatttaatttttttctgttcgtttccttaaacaaagtccatgtaataaatgaaataattttgaagaacattgtaatgaatcccacataccagtgggtcccaaattactggaaatcataacatggctcatgtgaagaaagaattatactattttcaagctgttgtatgttaaactattatagtaagtagcataattggcatatattttaggccgtattttcaataaatcaatatttttgctcaaaaggcaaaatttaataatttaataatctcataaggtgaaggatggacaggtaccatgttaggaatttgacatgtgttgttgctaatagactcatttaataaatgaagtaaatgatattaagcagtttcctcatgaccacagagcacagagccataatttgatttaaatatgagtatttctggctcatgctctttctctttctacctattgccattagtgaaggctgcatttagtttttttttcaagaagtgtctagcttacaattttgagcttcactacccccaacctcatacacacctcatgtggcttagagctatataaaatccatgttttttaaatacttctaaaattggacattcatattatgtgtatgatgttttacatatagtatgagtgcagtgaaagttagtttccttaagttttcctgaattcagctgttaccctagcatgactgcttcagcgaagagataagagcttctttgactttttccactggaatttttcatgccagaagaaattgaacatgtgagcctggtgtctggaagagtagcctggatttatggtatcagatgcacatttttaacaccttcagttttctctttaaaatatctcttcaatcccttacttttctctatttgtttcaacattaaaatatgttatttttcttcaaattgttggcattgacacctcttctacaattcccagtcatctgcatgctactgcttcagaggaatagtcttatatatagaaaatactttttttttctcagcacatttatatctaaacaagagaatgatatgcttttacccagttatctgcgtggctcacttccttcaaggcttcaccccaaagctacttcaatgtaacattttctatccattagattgagaactgcagttttaatccctaaccccactcccagactcccctgctaaagttttctctattgtccttgtcattttctgatataccttctaatttacctatttattttgtttaatattcatatcccttcgactggaatgtgaactccaacaaaagttcatatttattgtcttgttgtatctccatagctacagtagcacttaatatatagtagatgctcaggaaagatttataggaagaaaaaatgaaagcatggtttgcaataaatctaaatctataaacattccttttttagtagtattgttaaaccttacggttcctgtacaaccaggtgtatgccctctagagccaccaataatattccaatattaaatatacataattttataaacaggtgtgattttaatgtctctagacctttccaaccagaaaagctgaatccaggtactgctggtctttttccttccataggttctcattttccctgatgcagttattgccttttctgtttatactttcttccctttaggtgacttcacttacaaatataggaatgctgattcatgtttagcattgtgtggtttcagtatttattttctgtatttccacattgctattttagctcattctttaattaaataaaatgccttattctctcacagtatcagcaactaaaagaaggatacatcacctacagttgttagtgtgaactgcttatattaactcataggatatatattggtagacataaacctactgactaaattatttctgaagtatactctacaaaccatcattgtatttttacatttgacaaagtggaaaaaaaaaaacctggccacaatctttaaccctgcccagtgtctctggcttttaggcacacagccagtcggcaatggcggcaggggtggcatataaagattctagatctcaaaatgccaacctggccagaaaataaaactcactatgtgataccattggaacaagcttctataccaatgtagggggtgatggaggataatatacattgcaaatttatgtaaaaccagaccatgtggtatttccaatagttgttacaacattgcttaaaatgatataaatggccttatggataaaagtagaagtttaattttagaatagttcctattttaagactagatttagcaaaaatccttatggcatatgtttactcttggggaaccttgagagatagtgaacaagaaacgttagatcatagacttcttggctgcaaaaagtttatttatttcatcattttactcgtattccttttattatttgaaaagctttgtataaaggatttttagagatggcatttcattaaggttatatttattagaaaacaaacttgaataatttaaaattacaaaaggtaagtcattttatgtatttgcctacttgtttttgttttctccctgccaccctccctttcttcctttgtccttcccttcctcccttccatccttccatcctttctttattcatgccctgcctatttagaaaaggatttgcagtaagttacaaaaagtacaaagtcaataatttttttttaattcagaatgttaaaaagagaaaattgggtgaagagaaagtgaatatttcaataataagagtcatagtgcttcctctgaaggagcccagaaacccatctcatagttacgtggtggccaaacttagcaggaaaacaaaagaaatgctagacgagaagaacacaacatccatttctcaggaaagactaagttttcctcgtacagaaccctgaaatgtattctcccctgggatactgtttggataaacagtgagtgctgtaatagtcaatgtctttacccactgcttcacagcaaagcagaattcccaaggtaagaatgtgaccatgtaacctcattgcctcaccattgttctctccactctaatatttcagtactaaatgtgtgtgtctcttagggttgctgtgctgaataagtgagagtcacctggcacagcagacatctagtgtgtgctaaagaaatgtacagagaatgagagagaatttgaataaaaaatgtaaatagaatattatacagaagttaggaattaattcacaagtgtgtaagagatactctgtctcagatgtgcaggccactagtagtgcagtgtgacactcactgcctctcaagagaacttagtagtcagaaaagtgaagaaatgacatagcttttttacactatattatgtagaaagcttattttttaatgttaaccaagagcaaggtccataaactctaataccttccagaaagcacaaaagacattgagatacatttagagaaatagaggaaactgagctagatattcacgtgaaataggatcattccacatcttccagcaaataaattgaggtgaccaaggtcccagggagcacagatggtcatattctaatgaagctctggctcaaaaacacacaagctgaaaacaaggcgaggatgcttcataacaatgtccttttgtaggagaagtgaggattagtgatgagggtaggagtggagcaagagacagggattaatttgcatagccaccttggaatcccaaactgtcaatggtgtcagtgatgctgtttgcttgagtccctaaagggttgaatgaaagaagttaactagatacagagttcacagaaggtcaataatcttagctttccaacaagttggagatcggggtaaggagaagggcagaccttaagaaaagagttatacttattgccaggaaacagtgcttccttttgctgtttttccacaaacagatttacctttgccctatgcatttcatcttattttaaaaaacaaaacttttattttaggttcaggggtacatatggagattttttttaatataggtaagctcctgtcatgggggtttgttgtacagattatttcatcacccaggaactaagcctactacccaatagttattttctctggttgtctccctcataccaccctccaccctctggtaggccccagtatgctgatcctctttgtgtccatgtattttcattatttagctcccacttacaagtgagagcatacagtatttggttttgtgttcctgcgttagtttgctaaggataatgcctctagctccatccacgttttgcagaggacatgattgcatttttgtatgactgtatagcattccattatgtacctgtaccacattttctttatccaatctgccattgatgggcatttaggttgattccatgtctttgctatggtgaatagtgctacaacgaacatatgtgtgcatgtgcctttatggtagaattatttatattcctttgggtatatacccaggaatgggactgctgagttgaatggtagttctgtttttagccttttcagatgtcaccaagctgctttccacaatatttagtcttcttacacccccaacccccttggaagtttagaatggaagcacatttcttcagatgattattaactctttgctttttctgtttttactgcatcatttaaattatggtgtggaacatcgaaaagggccctaaagcctctattgtcaagtatgactgacctctcttggtaaagcgagacctagttctgactgagattcctccagtcgtttcatggttaactttccattcagtttcagttgtatttcattgtgtttcctgcccagtggagattcagcatagatgacacctaaggaaaaatgctagtcatagtgtgagaaatcatagccttctctttcaaatgcttttattcatattcctttggacttgattttagatattgctcgccaaatttagccatctttcttggtagacatttctgaaagtttagtgattaaaagcttagagtctagagttaaatggagtctagagttaaatagtctgggtgtggactctggcctggtcacttgccatctgtgggcaggccacttctttaagcctcaattttctcccctaaaaaatggagggggatgggggccatcatgatacttactttataaagtggttgtgaagattcaaggagaagttgatacatataaagttcttagaacagtgcctggcaggctgtaaacaactataaaaagttaatcattattttcagaaaaaaagttgagtcaaacctgaaacagtggtacaatgtcaagagcaggaactttgccttattaattgtgtcttcctaactctatggacttaggatctgagactctagttcctacaaactcatccatcctggggcctggcatatgggagctataaaccacatcagccctcctttgctctttttccttagggctgccctgaggaagaaagctaatgtgtataacatctagcattatgccaggtatgtggccagagctcaaaaaactatagctattattgtattatatactttgctctattttttatactcctggttaatgacggagagctctgtgaggggctgctagagggaaggttcaattattttagaagctttagttcttccacatttcactttgtaatgtttgccttgccttgtatttattaaacaatagtttactatactcgttcctaaaatattaagtatagcttattatgccctgttaatctttctcagtggcatacaataatttaaatatctgcttgaaaaatctcaccaagcattcattttaatgtggcttagaatgttatataatatgaaaaagtacgtgttctttcagaaattagttccaaagaactccctatatctagagacaggctgtgagaatggagaaagttgaggagtgtctctgttaggaatcttactactgcttttaaatttcatggaacacctattaaattgcttcgcagctaggttatgaggaaggggagccctgctcactcttttaaagttaaaagtgaaaagttacttgcgggtgattagggaaaaccatctcagaggagtggactgttggcatggagaccccacatataactcttgggggatggcaaaaacttgagagaggatgctttatttctcacctcctaaaatgcctttcccagctttctgtggtgagagagaatgagacagcagtcatacctaacagttggtgaaacagttctatgggagtgagggaaagtgaggggcctaggatgagtcagaaacatgtacatacggaaagggagagagacaatcctgattaaattgtgccttcttgcaaaaatatatatatttccacatttgatacaaagtgaagtatataaccttgacaaagcgatatctgtcagaaaaaaaattagaaaaattgctttaaataaacagtccttcaaaagatgtcaggcacagagactttctgagaaaatgtttccaaacttttaaggaacaaatagtatgttatataaattttctagagtttgtgaaaagaaaatcaacttttcaattcattctatcaagtagacctatttgcaataagaaggaagtccctcaaccaatcttacttttcggtagataaaatcttaaatacaacttggtaaattgaatcttgcattttgttaaaagattcatgctcatgtcaaataaggccgagtctgtaaatgtacatatagttaattttgatcaaatctggtcacagaatccatcatattaatatggtgaaagaaaaagcaatagacttgtattgacaggtgccacagtggcatttgactaaaacttaatatccatttgttgttagttttttttaaaaggatgcagtgaaatagcaacagaagaatatagtgtttatttcaatggtgaaaccaatttttaagtgtgagtcgtttctattaaagtcagcttagttataagcaataagacgtaacataatatttgtatgtaatatttgtttgggaagttgtatagttattgtcaagttattgttctagtacaacaacttgaaacataaaatataaaatgaaaactgactttatagctatgtgggtatttacctggaagagccaaaggaattagttgaaatgttattagaaatgattcagtaattcagataggtagccaaatacaaaattacatataagaaagctattagcttttttatagaaagtaataatcagttagatattataatgaaaaaaataaaatacctctttatttacttactttcttactgttgtccaggctggagtacaatggcacaatctcagctcactgcaaccttcacctcctaggctcaagcaattcttctgcttcagcctcttgagtagctaggtctacagacatccaccaccacccctggacagtttttcaaaaattttttgtagagatggggtcttgctgtgttccctaggctggtctcaaactcctgggctcaagcaatccgcctgtgttgacctctcaaggtgctgggattataggtgtgaaccactgtgcccggccaattctttttaaatagcacaagattctagtcacaaaaacatactacacctatatttatgagtgaaaataataagaaattagaagggtttttttggtattgttgtgaagaaaacaaaaatgtcttaactaatgctaaacaatccacaatattcattccactataggcaattccaatcacattttatttttgattttaataaagtatttcaaaaatcaagctaacatgggaaaatcaagaaaaagttgaaataaagcacagtgggtaaaggttggaaggatgtagaacacaccattccagagattatatcataaaaattacagtaacatatatcatgtaatatataatattgtaagaattaggacggtggctcaaatgaagaattagataaagttgatttggatagactatagatttcaaataagactcatttatgtatttgtgtgtgtgtgtgtgtgtgtgtgactgaagtagcattttattcaatgagaaaagggatgattattcaataaatggtgttgaaagcaacagctatcgtttgggaaaataatataaagttagattctttctttaaaccttatataaaaatatacattggatatatattttattaaatatttatttaaataaagatttcattaatatataatatataattttattaatgtaacaactaaaaagtagtttagttaaaattactaaaataaaataaaaatgagtatttaaatttcaacatagggaggatatttctaagcatatcactagagcgagaaagcatgaagaaaatgtctgatagatgtgtatacattaaggaatcaaatttttctacacatcaaaaacaccataaagaaaacgtaaaggcaaatgaaaagggtgggattctatttccagtgttactaaagagacattgactttaatgtcttaaaaatccttagaaatcgtccaggtggggtggctcacgcctataatcccagcactttgggaggctggggcaggtggatcacgaggtcaggagtttgagaccagcctgaccaacatggtgaaaccccgtctctactaaaaaatacaaaaattagccaggtgtggtggcacgtgcctgtaatcccagctacttaggaggctgagataggagaatctcttgaacctggtaggcggaggttgcagtaagctgagtcatgccactgcacttcagcctgggcgacagagtgagactctgtctcaaaaaaaaaaaaattcttagaaattaataaggaaaaaaatgacctttcttccaggaaaatgaacacaatccataagaaacacaattggtgagttacatgaataaaaccccaactttaaagaaatacaaattaaacaatagtgaactaacattttctctaaagagtattcaagattaaaaaacaaagtcaaaactagatgataacaaattcagcgtattgactaaagtcaggacattcttattcattagcaatgaaagtgaaagtttgagtagctttctagaagagaattcaagtcacactatgaaccaacaattttactttgaagaatttatcctaagaaaaaaattaagaatatgtgaaaagatttagttacatcaatgtttattatagtggaaaactgaaaatgtgccaagaaaaaaaatgagccaaatattcagcagcgggaattagcacaatataccttgatatgttatcaaggtaaatgtgtatgataggatactgatgcataaggataatttttaacatggtagattttcattatgttaaatgaaaaaataaaaaatacataaaatgagagcccatttttataataaaaaatatatagtcattcaaggaaaacatgtagacggacatcacaaaataccaacaacaggtatggttcaaagtgttataggtggttttcagcacatagattacccctagcaaagagacctctgtgacacttcgtttcttcatctgtgaaataaaggaatcatactagattagttctaaatgcttttagcaaaaatatttcataattctatgagtattgatggttaataaccttgagaaaattgttattatttattgaactttggagttagtagagtaaaaccaagtttatcctgagctatcccttgttttagttaaaattagttaaatttaacatcctgatgtttatttataaattgtgcatgtgtacatgtgtgtgtttgtgtgtatatatatagcgctttctcacaaatgcctgttttgctgtggagtgggttgggtgggtacagagtttcactgaaatgtatattcccctatagaattcttagagacacaaatatatcttgttaataggttatatatattttcatgtttcatctaccatttgaaaccctataaccatttgaaatcattcttggttttggtaggtttctttaattaacattcacattgagaaactataagagattcaacccttgaaaaagtccttttgctaaagagatttgcatgtgctctaaaaattggtggaaaatggttctgctctaatcaaacgaatgtcactctactcttatttctagctaacagtaaaactgcctggaaaatgataacgtacaacaaatatctcaagtggttatttagtaccttgttgtgatagtgaatgaaaaacacactcagttttaatttgctgttgaacacttaacatttcacagtggctggctgtttggaggccatatacaatggtagaaaaagtagctttctaaaagtgctttgcctcattcttgcttaacctggcagacgtcatgaacttccaagagggaacatattttatttgccttataccaccagaggacttggccaattattgctatttatttaatgttggtgttgacatagtgcctttgccctgaggagctccaggtgctttataaaattagtcagcaattcacctcacagcctttacgccagagagtgaacattgaaaataataatgattcgtggaacctacagccacccctaactcctatttctgtttgcccagtgaaacagaacaaatatgcccagttccctcagagagctagcagaaaaaagttctagtggggtgtcatgggagtttctctcttgtgtaactaggtgaactcctgtaaggaaaatttgccatgcaccctgcagagctgagacttactattctctgttgtaggacccatactttccccagtaaggaactccattttttttcaggcctttgctcaaatatcactttcttaataagacctttcatgaccatctgtttttaaaaacaactaatcaaaacctatcctcaagtgcagactttctgtatcctcattcctgcattatttttctctgtagcacatgtagctattcagcacacttagatttttatttatttattaattaagggttgactccatcccaccagatcgtaagctttatgaaggtagaacatttgtctattctgttgagttatgaatctttagaacctaggtgggtgcctggtacctaatgggtgtgaaataagcatttgttgaatgaatgagcgaaggaatgaatgaataaataaattttccccagtggagcaacaagcaacagttggagtcccttgttgtcaatcaaatataaagatagcaaagagtaagtaagcaagagtgaacttgcatcatatcaagatttcttttatattccttaacattgaaaatattcatgtggtgaaatacagtattagagttttctcctttagttgcaaataatagaaactgaatttaagccgacttaaacaaaatagcagtttgcaggatcttgaaactcaaaaattcaaaggatacagctagttttaatggttgtgaggattgctgcaggccctctcatgatttgattgagcgtttgtctctgtctttctctttctctccttctgtctcactgtgtttctaagactttctctatgtggtagcaaagaaagctcagacagcacaaggctgcctgtagtaattcttgtgacatgagagcatacatctcccagtagttccaaggaaaacccagggctgacttgaaacgtgtgcacttggattacaggtcaaccttgagtcaattgtgactgactgaccaggcctctgtgtgtcccggttgtggaggtcagttccatcagtaggagggggattaatcaaaggaaaatcagaattctttatcagaataagaggagaagatgcatgacaagtattcagagatacactgtaaccagaaaaaatggtcatatgtgaagagtatctcattacaacagggaggaatgtagttctaagtcttttaaagttctgctttcctataatatcagatgaccacatatttcacagcataattgtgaaaatgatattttgaaaggaaaaaggaattcttatctgagataaaactgtcaaaaaagtcaaaatttggctgtgaaaaaagtgaacgtttacttgaggttgtcattacttatttccttcttatataattcatataattctatattattatgacattcatataggcaaggtgttaaattctaatttgattttataatttttcaaaagagacttagaatgtgctagaaatcctaaaaatttctgttccaactattggtatttgaattatgtatatactgcccctttttttcctataaaaaactgatagaagttcatagataaataaaattcacagataatgttacaaatttatttcaaatgttacttcttgcctttttctatgccaagatacttaacaaatacttcaaaattgaaagtatttttactccttattttatctattccacagaatagttagaggtagaggaagaattagataatatatttattaataagtcaacatcctattaatggatgaacatagaaccaactcataggcaacacagtcagaaaatcaaggtgtggcttggttggcatgaaagcataatgcccacaagaactactgttgttggttatgctgtactgtatgagaagggcatttctgacgttagctttgatactagccttttagtaactgagtaaagttagtgagtatactcacccagttcagattattaattcagtactaactcagtaatttggtgttactacatactgagatatccagctggattcaggatttgctcaattcaattagcaaatccagtgttaaggggaaaaagaagctttgtgggtaagcatttctaaattggtgtttttatgaagccacaatattctggtagttcgtcttttccttcagttctctgaagttgtaatcatttctaaattgttgctttctaggtaaaagatgtgagataggggaaaggaaggctttcttaggaattttttttctttcattgcccagttaaattggatttgtgatttatatccattcatcctattcatacccatcatatatctgtatacatctgtcatatatccatcctgttcatatccaatccaattcataagacttttccatatttttcgtgagattagatttttttagtgggtgagaagaaataaaaggcacataatattaacatgctcctggcattccagcaacgaataatgccatagcaattttataaagattaaaaataccctagctcactatgattttgatgagcgcaacgcacttttggctttgtgggtcccctcctcataaaaaatacaaaattatattttgtagctgcatttatgtaaagataaatataatctaaactgttttgtactcattttttcagattttaaaagagatttaacatttctatgagctcctaaaattatgagctctaggaatagtgcttactgtgctattggataaactaagctggcattgtcatagctaaattggttacattttaagctgtgaatgaaagggaatttggtaaaccaaacaactgttgtatgcttattgttcattccagtataaatatatttttgctattaacattagttattacaagtggaatacgaaggggtggactcagggtttggaaagagagttaatgcaagtgagtatttgactccatcaacaaaactttacaagtaaaatcctcaggttttgtgcctgtaatctttttacaggatttaatgctattttacttcgtcaacaatttttttttcttcaaagatttgtatttttaaatgactgatgctatgaaagaaaataccctcatgattatatttatattgtgaatttttacagtaggggcaaactagaatttttcatgcggagagcactttgggttttactcaatatagctcttcaaagttcttcaaagttcaaagtaaaaattgatgctagagtaattttcctgtaatctaggtgaaaagcccacatatcatttaacaaagtaaatgctcattcatatttaatacaaactcttttttcttctgttgaagctgacttttatccaatttttagtttccagttatctatggttttgggaaacagagctaatttggattcatgaattctgtaaacaagtatttcttgagaagctcctggttgtgaactacctagaatgaaactgggtaaactaatatcaacatccattcttttgccaaacatcactgataaactgcaacatttttttttttacgtgagtggtcttggaatcagacatttctgcattgaaaacccagcactgttgctgactggctgcatggcctgcatctacttctcacatttctgactgcctaccaggttccaggcactgttctaggcactgaagatgaaaagatgaataatatggagttcccatcttcaaagaagttacaattttaaggaagactggcaaataaaagttaccccacaaaataataaaaatacaggggtaaaactagggcatagttatattttggctggtctctttacctctgaggttcttttgctttttatgtaattggattttaacctcagaagactgtaaggttaaagatgataatgtataaaatcagtactctgagtaatgatcaaaattttctgttgccatccacacatttgagtgagatgtagtgagtgctagaaaataaagcagttcgtatcaaaaagggtgtgttgaaagaaataaactaatccttgagaaacactgtcatgcaatctcatatctagaaattgtgcctatgttctgtctataaattgatgaattggcagggtgttacatttaggacacacattgacactacatatgacatttgtaaaaacacttgctaattcagctaacagctcgcttctccccttctccccactactcactgtggagagagcttccagctaatagcttagaatctcccagactaaccaaccattgatggaaccaggtgctatgtgattgtaggaatttatttgttgctctgaatgttaactaaaagtaatgggcttcttattttgtccttttccttttgtgttatagacggcaaagactgtttctcatcagtctcatatagctaaattagatttatctctcatgctgactgattaaaagggttaaattctgggcacgttgtcccctgagtcctctgaaatccatgtcagaatagaagtgctcattaccagactcgatgaggagctccttttccagaacttctctctgctacactctaaggaccaagcacctctgcctaaattccaagcaaccatggcctgtggcagtcttggaacttttgccctctggcatgggtagaactagcgtcaattgggtaattcaatccctgagttccttcttcaatgaatgagagaatccaggaatgtgttgccagttgccttttccttgtacctagttttccttgctgcagaatgatgacagtctatttccacacctcccctcctgccactacaggatttatggtctgcatgccccagttgtgaagctggcatgtagcattttgttgccacaggcctgtgagtgtttagaagtttgtgtttgtatttccagggctacagtttgaatattgaaggaacaaacagcaaacaattcagaggtcaagctgtgactgcttcctcatttggagagcttattttatgtctgtatattctatactcagattcccacataacttgttttttccaccttcattgctttggttagatgctttcaagtgcattttttctctaagaaatctccatagaagagttgtttacttgaagtgatgggtgagcaaagtttgcctgacgtggaacctcagtaactttcccctaaggaaaagttctggcgtgtaggggtgggcgctcttccatccagacggatgggaacatagccaagcagccaggagacacattgacttgtgaccactgggaaggatgcctagccagaaaagtcccagcagctgggtctgttaatcttttctgaatgaaccagcaggcagttgacctctctaaacctgtcctggattcctttatatctttgtagtcacctttttaccccctcaagaattcccctataaagttgttcttaataagactctttttgcccacttccccctgaccttctgagttgaatatgaatttcactaattggtgaaagaaaccaccatgaccttgataaagccatttctactctggttcctcccttctaagaatttgttcattcaagcaagtatttgagtctaaatggatccacttggacattttaataattatcatgaacctcagtatccttaaagtgtggctaaaacaggctcaaaaaattcagatagtgtaatctactttctctctccctcctccagatttaagtggattaattcacttcactatgccagcacctgagtacagaataatttatttctgtgtcgtttcatgatgaaagtccagctggcattagctcaaattatgcagctggctattaattgaagaaaacttccctgtcactcctcagtcaaacatgatctgattcagcagatccttttcactctcatctcttctattctaccagtagaataaatgtaaataactttcacttggctctgcttgtcatggattgtaaattacctggcagcatgcagactgaccacattactgttttggaggcggcttgtttcagttgattagtatttctagaagagttttgcacatttcatctctgaggcctgaatgatgtccactagcaggaaatattgtagtctgccttttttcttacatactgtatactaaatttcaatctaatttcaacaagatgtcaaattctagcacctgtagggcaggtgttggtcttctatgaattgattatatgtttttctatcatactggatggtgtacaagcccaggttgtattttaaatagaatttcaagagagagatttgttctggaatttagaaatatatattatgtgccaaaattatttgatgagtgcattttgtaattcttaaaatacaaaactacttggcatgaagagatgctatagtatgttaacaattgtggaactttttcataagatgaaattctgtgcagaaatgagggagcagaattcttgtgggagtgctaaaatggttcatcaatttgatcctcacagcatatgagaattcaccaattatattactctctgaaaatatgtttcagtatcaagggcctctttttgcccttcctccatcccaatgtctgtactctctgtacagtgtgatcactgggtgctgcatgaccagtcattattatacgctcagccctgaaaatgaacttaagatggtaaaatcataccttgccaggatttgggtggctgtgagggattcagtaggattttagcaacagggactggaaaagaaatcagaacttggcagagaaaaaaatagcactaggatactagaagagacctgggagaactagcttgaccttagaggctggtcttgtgagtcatttgagaaatagtatcaaaagggcataagagggcccggcatagattaggctatttggggttacaggagatccaaagctagaaggggcaacaaaacattgtggtatgaggccatcctaatttgaacatcaggcacaggatctagtgtccatgaagtagatctcagggaatgggcagcctgagaagaagagtagatcatgcagaagccagcagtcacccctagatccagatctgagtgtcatgacctagatgcaattaaaatccttataatgggtcccaccctggcaggattctttcaggaactcaggctgagcctgaagtgagtagattcagctgaagggaaggtaaagaactataagttgatagacttgcaaaatggagaggctgcttttaggaaaccattgataatagtatcaatcccattgataatatatgtgattgcccttttataaggccatgtgctttctgcacaattatgataaagtatttagccaaacttgtattccctatataaagggggaggagatagtatcccatggggaattccttcccatattataaactggtagacaacttaagcaaaaatgtttttactcatatgaacactgttgaagtataaagccaggtatttaagtcatgataggtgtttatttactttgaacatttgccagaagtttgatgatgggtatatttgtagactgggtgttagaggttgttatattctaaaaagatatcttctgattaattttcttcatttataaaaacaatctattttgataacatttaatttatgaactttggtgtcatgttacactttatacattttggttgtacattccctgtaatgcttacagagacagccagtcaggcaataattgctacatactgagcgccttctattttctgagtactattgtaaattatagagataaagcagtgaaccagacagagtctccatcctaaaagagcctagtagaggatgggaactgatgtagtatcttgtaattgtcacagcatggtacacttgcttcttcagatgccattattaagggcgtcgtttctttaaattctgagatccctaactcagcttatgccagaactgatgagaattagaccttcctaaggtcttctttcttcctaaaatgaatattgaaataaatctataagataaaaataatcctaccaccaagccccaattaagactggatttttaacttgctcttctcagcacaatgacacaacagaggacacagaggttaatggaatgtctttggagcaaaggagatttcaaaaccaccagtttgttagatttgatgatcagctctgcaaaatgtttaaagaagatttcttactcatatcttataagttaagactataaatggtttaaatgggggaggatgtgacaggattgaaaatcttccccttcctttgtggctatgagaattcacactgagcaacagggaagagaaggaactagaacttggaatgagcctgtgtgtgggccctcattgttccaggatttacaaagggctacgctgtcatcatattaaataaatggctcctgctccttgtgccagcttaattgccaccttggctcccgaacaaagaaatcacaattgaggcaaaacatgttttgctattgaaggcaaaacctccttagagcaattttggggttgtttttccatttaattttttaacttgcagaaatagccctctttttttctgttttttggttttttttgttttcgtttttttaaatgatgtacacttgtgctgttaagtttcagcatggaatacaggctttatgtatttaggcagtaatgctgagttagatattggtaccaaaaaaaatgaaagaaagagagcaagaggacagcacatgtcaaaatgcctgatagaactgcatggacagaactaaatgtgcttccctactgttagttacacgtataagtcacatctcaaagcgtgttccccaggttagcatcaatatcacctaggaacttgctggagatgcaaattatctggttccatctcaggcctaatgaatcagaaactctaggtggaagggagcagtccagcaacctgcattttacaaagacctccaggacactctgatgtatgctagagtctgagatccactggtgcaaagaataccataggacagatgtacactaactaaactagttctgtttctcttaaaatgactttgacaatatttagaattttgaagaatggtatagaaattcatagttcgtgtgtgtgtgtttgtgtatgtatgtgtctgtgtgtgtgtgttttagcagaattctattttagaaaatatggggtagacttttatttagttttgttatttttgttatttttgaaaaattaagaggtaagcagagaagtatagccagctacttccataattttgtaggaataatgaagtttattctagcagaaagttatatcttatggaataacttctctaatattctctctagacatatattcttttttgaggcaggaacacaaaagaaaattggcttcttcatcaagttcaaagaaatggtgttttaattatgtagagaagtaatttcattttctcagagaaatgggtagacagatattagtaatttaactctcttcttaagtaatggctgctatagctcttaccaacactgaaagaagtagagtcaaatagatttaaatctggctagtgattagaattttttggggggtagggtgggtgaaactgtattgcagggaggtacgttgtaataagacagctagttattatgcactaccctccagttctttgacatgatagctaagggcatagacaaaaatctgaactctgtggtctttgtacatatctgcattcagattaattcacttaacaaatatttgtggagcacctaccatgggcttatcactataatgggctaaggttgtacagtgagcaagatactcacatatgtgattcttgtgaagccagaggtccagtggtaaagctagatgagtaaacatcaattacaatgaagtataatcacttccaggatgaggcagaatataggatgttatgcaagcagtcatccttgattttaggactgggtgatgtggagttcatgaatggttcatggaagaggcactaaagcctacagtgtgaatagaaattagcaagatgatggacagggcaggcagagacaagagcatatgcaaagttggaaagtggagagttcttgacattaccacattactgaatgtgcatatggtggagtttagggtgcagagaggacagttgcacatgctctggagaatgatgggagatgaagctgagaataatacaaggaagagaaaataacaggccttgctatccatgttaagaattccggacttcattccaacaaaagggaaagtctttgaggttgtagtatttggctgtgctgtagagagtgtattggggaaggacagtgctgaaggaaaggagaccagctgggacattgctgcaataattcagaccggtactcatggcttggaccagcagcaaggggagaatgaaaagtaaagagatttaggaaatagctacttaggaaatagattgaacgggaactggcattcaatatgtgtgacagcgaggaacaggaagacacttgggacaactagaagaacagtaggccattcactgagtttggggtccagcaagaggagtgagtttgagggtgaaattatgtgttccatttgggctagtagggtctgagaagtctgtggttgtccaagtagagatgtccaataaactgtggaaaatgcaatcccttaggcctctttattctcataaatacttctcatgctttttcacagcagaggctaaagccaaaaaacttttacagttgttgattactcccatagtgattgggccactactctcgatgtcagttttaagtgttatgtgaattttagcgttgcagaattttagcattgcagaatttttctgcacaaaatcctagaaagcaacttagtttactcagtgaaacctgcctgccaactaacaagacctattatttttcagttgggattttacttcaacagtggaaactatgacacaacagggatggtctaaccccaatttgagcactctgttctcattttcattaggaatcacttccctgtaatcataaaatggaaatatatttactgtagacatgttgtttggtgaaagcaacactaaaaatgagtagatgaatataacagctacaggataaaataagagttcccatttttaaaaagaaggactatgtttacaacacagctctccttaatgttatagtgttattatagcagtgaattttcaaataaaatatttaaattggaatgttagaagttttcttctatcatatcaaataagtggaaggccacctgtttgatgattacatattcaagtgatagttctcaaaaactaaagaaaaatctcatataaattataaatgattctgcaaagtttcacctaacattttctccatacttatgaagcttctgaagttattttacttttgagaagccacagacagaaaaattaatataaatgagataaatttcaactagccttgagaataaagagagcaaggatagtcatcaacacaattaagaatgaccaaatcctattaatgttttcaaattaccaaattagaaaagttaggaagcatgaataatttatttctgacaacatattctttttaatatctgcattactttggtcggctaaggagataaacctactcatgtgacataccatatgtaaacattttcctaattaataactggaaagcttctatgtgaaatacaaactttctgctcatacataatgtagactacaggcagacagttaagagttggtcaaagctgtcaaagcttgttttatggaaatctcatcttcttttcctgtgctctttatcctagtccaggtcctctgaattcttttactctacagtacttagctaatacagtgtttatcctcacattctatcatagcttttatattaaccactcagcaaaatatgtgtgcatgcacatacacgcacaaccatacctatatttaatcatctagtaaactatattaaatcttctgtaaacttcagataagcctgtttaaattgggggtgggtcgtattgtagcataccaaatggttcatataccaagtatatatttgtcatactatgtggaacagtattatatttaaaactgaagtcttatttcatgtaggttgtaccaaatttgtggtggtaaacattgtatttaggtcattcacaaagagtacagaaatacagattagccatatttttctatagtgccattcagtgtaataggtacacaatacatctcatattaaagaaaaaagagtcttttcaaaagcctgtaagggtctgaataaaggtcttagaaatgtgtcataacagctgaaatctaagagatttggaaaaagtgggagaagttaaatattgcaaatgcatagagctaagacttcttcattgaaagttgggtagttccaacattcatgtggaaaatctttaaaagtagccaaaaggtaattttttttttttttttttttttttttttttttgaggctgagtcttgctctgttgcccaggctggagtgcagtggcatgatctcggctcactgcaagctccgcctcccgggttcacgccattctcttgcctcagcctcccgagtagctgggactacaggtgcctgccaccacgcctggctaattttttgtatttttagtagagacagggtttcatcgtgttagccaggatggtctcaatctcctgaccttgtgattcacccatctcggcctcccaaagtgctgggattacaggcgtgagccaccatgcctggcccaaaagctaattttttaaattttccagatagaacttcatgtgtatttgatatattccattttcgtgtatccaatattaccaaatccatggtatttttattctttgttttagatattctaatcatttcacagcactttcattacacatctgcccagatttcctgttgctaaatttcagacactattctttaagtcttggaagagatcaactttttcagcacaacccatcccaaacaatgtaatgttactgtgctatattaagacaacacatgtgctgatctttttcaggcatttccagaatttttattgaatgtcaagtatgtgcaaggcaaagtccatctagcgattttaggatttccaggacctgccatttataaacttcctggaagaaaaattaaccccctcaaaatgggtgttgacatccagtttgcctttatagctcctctgatgccttttaaaaactatatttacccatcttatgtcaataaaaaggatgtatttattataagttgtggcagatagtgttttatagacaattttatagcccacgtgttaaaggtaaaagcaaagaaattatgctactttgctgtattttcccagtgatttatgtaagtatttattccctgtaggaaaaagttgaaacactattgttgacaacagggcccaaataggtatcagcttgatgtactttatcacatattatctttttgtttttgcatcatccctaggaggtaaatatgtaacactttggtttcattagcatcacaacagattattaggcaaatcaacagaatgaaattaaagttatattatctaattgaaaaaagccttcacttatattttcaagcattagttcttatccactttcaatcacctggggaactttaaaaaatctgatgcctgggccagacacccagaaaaatgacatcagactttctggggacaggacccaggtgactgtatttttctaaatgtctttcatgactccgctgctttagaggttcacagacttccacttaaagaactgctggttaagaaatgcatccctacttgctcggactcccagggatatcacttttcacctgttcctatcatttagaaaaaaatgatttgaatcagctagatacatgatagaggaccccccccccacacacacacacacaccaatctaagcacaaaattatcttgttgtcctcaatagtttgcatggataagtaatgcagaataagcatcatacccaatattaataaatacttaacaagaagcccaagattttaccttgtttcctattttttccttcagccatcacattcaaacctggcccaaaggtttctcacattctggcctccatcaccaccactactgctttggcctggccttttgtcaagctagaaattgccagaatttcctgacaacaggctctgtaagattcagtttagagcttacactttggctggagttcatcttcctaaaaagagactgtgatatgtaaatccacaacctgaaatctcattggctctccattgcctaccaataacccaaaatcctctactcaggaagtcctggatggtgtaactccattgcacacaggttcatcccacaaggcctcttggtaatggggtactttcatgtgcatactattctgctgctcttgtggaaagagtcttcaaccccattctgtataccctggacactcacctgagacccagctgaaacagaccttgtcatctcggaccctgcccttggttctgttgaaagaattagccaccagatccttgaggctgtctcaggacttttgcttcacctttattataacaattggaatgcaggcaaaatagtgtttccagttactaaaataaaactatagaccatacaatatgtttgttttgtgcttatttaactcgcaggggaaaatacccatatttttaagactctggatttaaaaaatctggttgattatatgagaatattgttggcttgtctgtttgattttgctttttttgggttgccaataaaattttagagcaagaaaatcaatctctggaaaatatgtctaaaatgcaagagaaaattccaagaaaataagctagatttcaattaacatgtgaaaagcatttcttaatatatacaatgtttattttacatggataatttatgtaagttattgaataaataatacttttaggtttgggttttaggggaggttttaggtttgggttgcagcagaggctttttcagctgattcaaatatctagttttcaaaatactctgcccacatgatttttagatatgacttagccttaattgctgactcagattttcaccttttaaaaagcaattgtgctttttcatatacactatcaaacaagattataagatattttaaggtaagaaagtaaaagggcatccactaatgatcatcagaatcacctggaagggccaataagccacacattaccaggccccttccccaaaatttctaattctgtagatctgtggtacagcctccaattttttgcttctaataagaccccaagtgacactaatgctgctagtctggagaccacactttgagaatcactgcattaaattaacaattttattggttgagttttcaccacagtgtgcatatctgttgactaacaatgaatagctttgttgtcgccaaacactgtaatgtttccaaatatccatatgtagtcacaggcccagagaaacaaaccacatctatattaagactgttttgttgttgtttgacccccccaccctttagtgttttaattacatcaatcctggagaaaaataactgttttctaatttgggcattacagatttgctaaggcaatagaaaattctatcttaaacctttagatttttagtcttctagtaaatataagcatatgagttccaagcaaattctgagttttaaaaaatttaataaaattgacaaatgttttcaataaaattggagaggcccatttccttgtacaaatattctaaaaatagatgataaaagttctaagtgccattttttgaaagatcagcaaaataattctacaagtatttgtgggcatgttatcttttctatgatactggttataaacttaagttatatgaagacagtgtgttagttaaattatgttctagtcctaccttaaggaaataaaaacaataaggctcttagggcctttcttctgcaccactgcagtacttgctaacatgttttaataacatgtagctgagaatgataaactctaggcagcagggtggcttggagatactaatggaaatgcccagtcaaaaagagcctggactagactgaggtctgaagactccaaataactttctgttatcccaccatcttctcagatggtccaatcatgctacactcagtctagggcaatgaccctgaggaatggtatgtttggcaaaaaagaaaccaaagaaggctactgccatgctttaagattttcccatatatctttttcagcatcttgaatggggtttctgaaagtctgaggagtgaactgtgaccaaaatggctgatattttgagctcaaagaaacttaaatttttaggtaaggatactaagaccgacttaaaaagtatagtatcaataatttacatttctttagctaagaattttcagaccacttcagtgcagatcacattgactgattctctaaaccactctatgaagtgggcaaagtgatggtctcatttttcaaatgaggactaaggtttatttaattcaagtgattaactcttcaaacatctagtagaggctagccagatgcattggctcacatctgtaatctcaacactttgggaggctgaggcaggcagatcccctgaggtcaggagttcaagaccagcctggccaacatggtgaaaacccatctctactaaaaatacagaaattagctgggcatggtggtggcaggtgcctgtaatcccagctactcaggaggctgaggcaggagaatggcttgaacccaggaggcagaggttacagtgtgctgagataacgccacggcactctagcctgggtgagagtgatattccatctcaaaaatcaaaacaaaaaaatctagtaagggtctatgtctagcgcctgcacttcaaatatgtgtttgtcatgacatcattagcccaatccaattttctttcattaattttctgaaataaatattttttgagtttatactatataccaggtgctgctgtaagtgctaggaatataacagtgaatcaaacaaataaaaatctgtgaccttttggagcttacattccaatgaatataggcaaaataatagcccctgcaaagagctccactgcctaatccctggactaaatgaacattacctcacatgcaaaaaaagattttgcagatttgattaggggcacagaccttgagatgtagtgtccgtattagcccagtgggcccaatctaatcacacaagtccttctaagcaaagacttttccctggttaggttagagagagatgtgataacagaaaaagggtcagacagatgcaactttgttggctttggaaatgaaagaagggggcctggagccaaggaatgtggacagctagaaagggcaaggaagcagattctcccttagcccactcagaaaggaatgcaaccctgaagacaccttgattttagcccattgaggcctgtgttggacttctgacctacagaactataaaatgatacattttaattgttaaatcactaagtttctgataatttgttacaccagcagcagaaaactacagaaaagatagacaatattcaagaaaaataagtaaaaaatatatgttggatagtgataagtgctaaggaaaaaagtcagggaatgacataggaagttatcagtagggatgcaattttgaatagggtagccctccaggttaacatttgcatagactcaaaggagatgaagggcaagaacatttcagatgaaggaaacaggaggctaaaagctgagactaggacaatgatcagcctgactagattctgaatatcaccattaaaagagcagtttctacttcagaatatatgtacaagcttcacctgggaaccatgtgtgatgatttaggatgaagtttcaaaactccacagatgacattcttatttttctataagcaaacagtcttgcccaaataacatcatttactttttcatgtttgctggagagttcattaagaaattcaatacaccgtattcaaagaagatgaattcttacaatcacttagaatttggtctaaggcaaacaattgaggatgttcagactgagtctttttggaccatctactcaacatcattatcaaccaacagcttataccccttcaaagggatctcaaattatatttgatcctgagttgttgctataataaatttagagctggagaaaaatagtcattgtaattattttgttattagagaccggcttacatatgctaaataaataaaaacaaaatgagagttaattctatgtgaaattcaccatcaattttgatgaaatttcctattgatacttccaagtacagtaggcctttcgtatccatgggttccacatctgtgtattcaatccaatttttttttttaataatatggttgtgtatatactgaacatgtacagacttttcttgtcattccctaaacagtacagcataataactattgacataacatttacattgtattaggtataagtaatctggagatgctttaaagtatattgatgtgtgtaggttatatacaaatactatgtcattttatataaggaacttgagcatccatggattttggtatctgcctgaagacctggaaccaatccccaaagatcctgagggaccactgtaatctaattgaggccaagtttcatgggtttgtatcctcttaagtacctgggggaaaaaactgtctgatttttttttaagttttagtataccatatattttaattttcaaagaaaggaaaacagaaattttatgatctgtgtcaatagaagtgttaatatataaagcaaagaaatgcctaggtgaatattggcctagtaataaacattctgcaatggtgcttcatgggaaatacgccttaccttgctactcaaaatgtgatccatgaaccagcagtatgaatatcacctggacttggtagaaattcttggaccccaccctgacctagtgggtaaccatctgcattgcagtaagatcccaggtgattcatatgtgttttcaatgtgagaagcacagcactggggccttacccggggccctccttaggaaacacaccaagtattgcatgttttttacatcctgacaggtccatatgaactcacatttttccgaatacagtgcactagcatatctatcatattttgaaaagctattttcatcaagggagcttagtatctggtgctcacgagatacctacagagaagtagacagtgttatgcttttgagaatttatcaaaccttttggtcatataatgtttttatttcaaaaccttaaattggtcaacatatttttaaatatttaatagttgagggatgaagaggatagaagtttaattagttcaaaggaaggtaaattgggaaggaaacaaacttttttgttgaatcagaattttcaggatgaaaaaagacaccagtgccctgtggttcagtgctaacacagctatgatgtgactcttcaaaggtcaatgcttgtgcccctattgctgcacatccttctccttgtcagtgttgatgtgtcattggctggctctgtgtcattggcttggtcttgctttcactgaactttggcctccgtgaaacttctaagtagcattgctcctacctgtgaatcttggaaacacacagggcaagtgaaattccattttcttcctttctttctttttttaatgattaatagacaatttatttaagcaagatccttatagtcatcattgccagacttaatatgagatgttaaatgttccatccaattttccttcctggataagtttttctttcctatccctgtcagttttgaaaacataataccagaagaagaggggcccaattccacacagagctcccaagagtgagttttaggagtgagtctgaaattagaatagacatttgctgatcttgcataggtccaacgaattaaggcaagatcttcgatgagcccttggtggttagagttggttgttgtactgaagcaggtactcttgtttcagctgggctcttatggccaaccgttcagcttgcatctgccagccttccagagatatgtcatatttggctgagtcgagggtcaagggcagagtggccaggtgcgatggagtaaactttgggaatgacattttggtgacccagcacacaactgcctgaaattccattttcatgtgacacttttgtatctgtaaccatcaggtctgttccctatgttttctattccttaacttggctaccattataccatcacatctctttccttttctagtgactccccattagactagctcctatctcataacctccttttgtaatttaatggcccaaagattagcaaattccagaaattcctaaagtaatccaattagctcagaacatcatagagacttttttttttctttgcctcatcctggggttatttatcaatgaaagtgactttagattagatagacactggctgccacatcgtatcgttgtgacatcctgcacttaactaaaagggcttgacttaggcaccatctccttctctcttggcagctgctcagttagatgtttttgttttaaccaaagggcaggacttcaaatgtgaccctatttaactccatctggttatattttgaccttatgctctttttatatcctgattctgtcatccattctcttagctgtccttcccagcttgatgtaatagtattttcccaaactacacccttttccataataaagattgtcactcctccctcaagcttccttaagcaagctttatcatatgtctgataggatctctgtttctgattgtactcagtatagatttgtttcctggcacacatgtatgcactatgtcacttaatcacagtgcccctattagattacaaactcctgtcaccaagggttttgttccctcttttcaaagcagaacttaaaagaattttgcttacctttaagcgtgcagttcacatcattgactttaactggatggtggttgatggctgatggtcaactaacaaaaaaggagttgaggagttgaggtttcagatataacagaaggatacttaagacttttaaggaataaaaaactaatttttcttagcacaatggttcagatgaaagtaagggtgcatcagagaaggctgtcattggtttatttgttatattcctagctcatggtgattgtatgttagccaaatatcttgcatttgattttaaaacaaatcagaagtagatgactcagaaatgttgacaataaaattatggacaagccccttgctacagcagctcttattaattaaatatctgagacagcagaattaaaagagaagaaagtgatatacaatttggaaggtttggaaagctggccataaaattatttctttcagctggagataccttacctacttataatatataaaatttttgaagaaataagaataggtcttattttactttgcagtgaaggcttgaaatatttgaaagttcactttattgcaataggattaagtacatcaaacttcatccattcttatctctctcaaatattaggagtataactttcaactgaacttctttgcctgctgtaatatactgttctatagtgatattttaaaatgaatactttgtgaacatagtactagaaaaaggatagtgttttgaatattttaatagccttacagggttaaaaaaggatcttataaaaagtatgtttagtaccattcaatttttacaaatttatgcatttgcttattcatatatgtaaatttaaaatttacatataagcttatactcagaaaaagataaatgttgtaaacacacttgcatgcacacacacaccataacaaccaccatgccattcagtggttatttcagggtaagtaggattgcagaaacttttacatattcacgttttgcctatattttctgttataagcttttattttggcatgagaagaaaaaaattttaaaatttcccaaaaacattctttgtaatagtcaaaaattaaaatgaacagtgtctatcaataggagaatggctacaccaacaaaaaaagtcaagtaagaaataaaattggccaggcctggtggctcatgcctgtaatcccagcactttgggaggccaaggctggtggattgcttgagcccaggagtttgagaccagcctgggcaatatggcaaaacaccatatgtacaaaaaatacaaaaaaaatagccaagcatggtggcatgcacatgtagtcctagctactagggtggctgaggtgggaggattgcttgagcctgagaggcagaggttgctgtgagccgagatcacgccactgcattctagccagggagatagaacaagaccctgtctcaaaaaaataaaattaagcaatgggaaaagattcctcttgctattttaaatgttgatcaacattcaaattttcagtggttttaggtaacaagacatgtcaacctcctgaaacagtaattgttgtagataataagaatatatatgagtttggctttacctgattttaaaagtggagagaaaagctgaattgaagcaagcatacaattattttctaaacatatcctctccagtttcagtgttttttaatcaaaccaccaggaatggtgcagcagacaatgccagtccatgtctcccccttcatggtcccttagttgtcattaatgggtgactgcagagaaccataggcatttgaggacttaacagagatatgttttatattgagagtggacataagctcctcattgcctcattgtggtttgcacttcaaactgcagcgtgtactttttctaagctctgtggtctgccttcctaggactgcttgccctgtactgttatttcagaatgtttatctagtgaggagtgctgcattgctccattgtgcatcacagggcacaggaagcaatggtatgacatttttgctgcacatctatttttgattattctcaaaagatgaaaatgtttatcactgcaggggtgtattagtccattttcatgctgctataaagaactacttgagatatggtaatttataaaggaaacaggtttcattgactcacagttctgcatgactggaaaggcttcaggaaacttaaaatcatggtggaatgggaaacaaacacgttcttattcacatggcggcaggggagggaagtgcagaggaaagggggaaaaagccccttatagaactatcagatctcctgagaagtcactcactatcatgagaacagcagggggatctgctcccatgatctaatcacctcccatgaggttccctcccccaaaacatggggattacaatttggattacaattcgagatttgggtgaggacacagagccagaccatatcattccaccttttgccctccaaaatctcatctttctcacatttcaaaacacaattatgccttcccaagagtctcccaaagtcttgactcatttcagcgttaactcaatagtccaagtccaaagtctcgactgagacaaggcaagtcccttctgtctatgagcctgtaaaagcaaaagcaagttaattacttcctagatacagtggaggcacaggtattgggtaaatacactcattccaaatgggagaaattgtccagaacaaaggggcaacaggccccatgcaagtccaaaatccaatagggcagtcattaaacattaaagttccaaaatgatctcctttgactccatgtcttacatccagttcatgctgttgcaagagttgggtccccaccactttggcagctccacccctgtggtttttcagggtacagtcccctcctggctgctttcatgggctggcattgagtgtctgcagcttttccaggtgcgcagtgcaagctgttggtggagctaccattctggggtctggaggatggttgccctcttctcacagctccactatgcagtgccccagtgggaattctgtgtgggagcttgcaccccacattttcctactgcactgccccagcagaggttctccacgagggccccgtccctgcagcaggctcttgcctggacatccaggcatttccatacatcctctgaaatctaggtggaggttcccaaacctcagttcttgacttctgtgcacctgcaggcccaacaccacgtgtaagctgctaagccttgaggcttggaccttctgaagcaatggcctgagctgtatgttggccccttttagccatggttgggactgaagcagctgggatgcagggttgcacagagcagggggaccctaggcccaccccacaaaataaagtctttcctcctaggcctccaggcctgtaataggaggggctgctgtgaagtcgtctaacaggctctagagacattttcctcattgtcttggtgattaacatttggcatctcattacttatgcaaatttctgcagctggctggaattttcccccagaaaatgggtttttctttgctattacatcatcaggctgcaaatttctcaaacttttatggtgtgcttccttttgaattttcttccaccagatactctaaatcatctctctaattcacagttccacagatctctacggcagggacaaaatgccaccagcctctttgctaaagcatagcaagagtgacctttactccagtttctaacaagttcctcatctccatctcagaccaactcagcctggacgtcattgttcgtatcactataagcattttggtcaaagccattcaacaagtttctcagacgtcccaaactttcccacatctttctgtcttctgagccctccaagtctctaggaagttgcacattttcccacattttcctgtcttcttctgaggcctccaaactgttccaacctctgcctgttacccagttccaaagtcgcttccacattttcaggtatctgcagtagtgccacactactctcagtaccaactgactgtactaatctgttctcacactgctataaagaactgcctgagactgggtaatttgtaaaggaaacgggtttaattgacttacagttccacatgactggggaggcttcaggaaacttacaaacatggtggaaggggaagcaaacatgttcttcttcacatggcagcaggagagagaagtgcagagtggaggggaaaaagccccttataaaaccattagagctccagagaagtcactcactattattagaacagcatgggggaatctgttccatgatctaatcacctcccatgaggactttcccccaaaacgtggggattacaatttgcattacaattcaagttgagatttggttgaggacacagaaccagaccatatcaaagagtttgctttgacaaaaggaagtgtatctttttatttacttatttacaaagcagcttattaaagttattaaatagttttcaaaggggcagcttttttttctactttctgtattagtaagcaaccatctatgattgtaatacaactgaggtctcccaagagagaatgtagcacaaaacaaggtgtgctatctaaacctgtaagaaatgttgtgcagtgaaccaactccagcacagatatggagctctctcagaaacaacataggaaatttagatatgtgaaattcaaatagaaatagaaaactcaatttagagtttagtttgcgtaatatcttagaaatgttttcatggttcaaagctgatatttgacaattgtgttagatctataaaaattcacaaaacatccctataattttcagatacaaaatgctaataaggattttaaagttcaatgtggaccacagggcttctgcttttgcaggtgtaccttcatttacatcctttcagttgaggaagggtgggtgtttgagagcaaaatgtatgtataaggtaagaagaaaagagaaatgagagagagaagcagaagatagtgagccatcaataatgatattagttggcattcatttcaaaagccaaccaccccaatttagaggatttgcatttaggactaattaaattataagctaattgagcagggactgagttaagcctactgatagtgcttcataaatattcatattaacaataatacaagatgttccttttcaaggctaaaaactttttctaaatggtgtatacaacttgtgagtcttggtaagtcaatgttgttgcattcctgaatttttctatcccttttaaggataattctaactcaagtgaaccgaaattttccctgtagcagtagaggtcctctgaaaattgaggaagctctccatgtgtaatgctctgaaaatggcagacatttcagagtcacattctgtatatcattcatgtgaaatggcataggcaattttactcctcaagattctttgcccagaattcgcaatttaataagaacaagtattatgaattgttgaagattcttccagctctcttggaaataaagggtcttctcaaattgtagctttggtacattaatagttactctgggggcctaaatgagttagttaatgtgcagcttaaacatctgaggcacacccagaagtaactcaggactgaggaattcaccttcccttgctactcaattgccgtttgtgtaaaatagtggacagtgacactgtttgtgtgcagctagcaactgtctctaagtcttgggtttgttggagcataaagtgcactccagtgccctgagtatacctgtaagggtatttaccatgattcataagacttgttttaaaattcctctccaaataaacaccctcttaaatttaattttcctcatatttctatgtggttatttatagttcaagaacaagtatttaaaatatttaaatgatagccattcaattaactattccaaattttagtttttttcaccaaggagctgagctgattatcaaatatgctttatgtgaactctgttttgtttaaagtgtactgtattttttaaatttgtgaacatgggaaattatacaatgttctataataatttcaaacctgagttttttttaaatctcaatgaaagctgtaccttatctgaaatgtaaattagtgtaaaaaccctttcattctcaataattgtcggctactatctttttatcttcatgttcatcaatagtaaacattcaaccttcaacggttaacaaatattaagtgtttaccatgtaccagacacttttctacattctggggtgacagatctagaattacaagtgtatcaaatattataacagacaggtggaaggtgctacaggatcaaataagaagaggacataaacttaactgtagagatgggttggggagggaggaagaagttagtgttagaacaggcaacttttaaagaattaaccaggaagttatgcaatttggggtaaagtggggaaagagtgtcaggaaatgaggttgaaacagataatataagatttgctatttattcaaaaatagtttagaggccagtaattggctgggagaagaatggtgcacagatgggcaagtgttgacctgcaaggccaattagaaagctgtgtctataagtaaaggcaagagatgaggatgacctggattaggaaacaaaaaaatcctctcttttacctgcaaaaatagctgttgactttgtctcccttccatacaagacttggggtctccacgtttccagcaagagactgggcagttatacatctgtttttatttttactctgacctgactgctttatgcaagatgggccaagtctcccttatacatcaggaatgcactgatgtaaagacaagatatctgctcctccagccacctttcttccaggtctatctgccttaattcctcttcccccattctcagtggtgcatcattctctactgctgtcctagtcctgcctcagttttccattagttttattttgcagcagagattttttttttttttagtgatctcctattgttccttaatcacccttgaaatatacctaattaacccaagtaaaccttcatgatgcatgtctcttcatcctaggagtataaatgatccttgtatatctataggaacgtttctattccagtctttgaaattgaggaatttcatatacattatatatatatacacacatacagacacacacacacaacgtgtatatatgtgtatatatgtgtatatatgtatatgtgtgtgtgtatgtgtgcatatacatattccattagttatgaacagctcttttttatctcttaaaagcagcaaaataaaatattgacattattcagtgaattgatagttgaaatgtaaggatttcagaatgaaagttatgtagtaaatcctagccctttccgaatcctgatttcctaaatctaacctatatggaatttcttttttttttaataaaggttccatgaaacttggcctctttcctatcatcttaaatcgttctcctcttatacttctcttagttctacttctttcacgtgaaatccattctaatgtgaacctcggtttctctgagaggtgcctcaccacaatgcccatgcctttctgcacttcccacgtagatcttcttgccccaaatacctactgtgagccttctttcctctgtgcctttcattattccactcatctgaaattcagtcgcaccaactttttaagcacctttatcaggcactgtggtcagtaaggtttacagatgaataaggcatgattgccagtcactgacaacaaatttggggcagggagaacagccccatccccataaatggtctcatgtttcttttgtttgtttgtttgttttgatagaatctcactctgttgcccaggctggagtgcagtggtgtgatcttggctcaccataacctctgcctcccaggttcaagcaattctcctgccttagccttcgaagtagctgggactacaggtgctggccaccacacccagctaatttttttgtattatgagtagagatgaggtttaccatgttggccaggctggtctcaaactcctgacctcaagtgatccccccacctcagcctccaaaaaagctgggattacaggtgtgaggtaccgtgtcctgcccataaacagcctcatttataaaccataaatacataagtgctgagatagagatttgtgtgtgtgtgtgtgtatttggggggtggtggatacactttgcccaacaaatccaatattgtttactacttcctgtgcttcccacatgactgttctctcatctttctcttaaattaatggaaataccctcctaaccagttttccgactggtgcttttgcccatccagtctaatctcatagcagagttattctacaaaaacagtaattagttcacatcgtgttgctctctgctcaaagccatccaatggcatgccatctagagtcaaagtcaaattcttgctatgtctgttaaacttctacatgatctatgtctaccgcccctttcaagtgacctggatctgacatcttctcaaaccactgtccgcctcacccactcacttctccactctgacttcactggtgttccctgaatgtgccaagcatgttctgcatcacagcctttgcactacctgttcccagtgctgggaattctcttcctctaagtatctggatggctggttccatcctgcccttcagatcatcgctcatatgttactttagcagtaatcctttcctattcatgctttttcttccaccttgacgttccctgctgtatttttattcatagcacctatgacctactgtatcctttgttatctgtttattgactgctttcatccaacaagaatgtaagctctataagggcaagggcttttttctgttttttcactgttgtatcctctgtgcctagaatggtacctgtcacataataggtgctcaatgaatatttgctaaaggatggaaggaagaagggaagaggaggaaggagggagagagagaaagaggaaagttgaaagaagaaaggaagggaagaaagatggtagggaagaaggaaggacagcagaaagtctcatgttggctttactaagtctctaacacttattaacacctgctttgtcttataaacagagataacaccggcctgtagcctagtgcctttcgaaggcaacattatctggatagaaactaataaggttgttctgtttatgctgcatttatggcaagagttactgactttccatttatagttgtgatataaagtttcttctttaaatgaagacattttatttcagtttttaaaaaactagtctattacagaatttttaaaattaataatagtatataggggatgcagaaacaacaaaaatcatgatgtagaaatgtggatatggcagaatcatgaagctggtagtcgaatgcctgaattggggataagtgaccccttcagccatgaaacattccctgactattgccatcttcccctctttcattcctgttgtttattcgactcctgtacactatcatgggttgaactgaaaccatttggtattgctcactgttgttttgggtgttttagttctatcttcctaaattgatataagatccttgatgtgagtgctcatgtcctgcccccctcctcctgggcagccaccatagtgcacagcccagcactgacaaaacagaacattaaggatgtttgcttgttgtattcatcatgactcagctacacaataagacatgaggttaaatagtgtgcagacagtaaaaatactcgagcgtgctttatttttttttttagcaaaagaaatacaatagcaaacatcattttgccttgcaaactggcaaaatgaaatcactatttttgccactggtgtaaattttatacacacacacacacacacacacacacacaaacacacaagtacatacatatatacttattcaatctggtaggataaattaatcactaggacaaaaccatgagttaataggagccaaattccagcacatccaattggaatgcttgagaattaaacctgctaaaaatactgactggaataggaagacattcataaaacgattaggcacattttagtggaagtcagcaacaacaaataattaattgatttaactaataaatttagatatttaaattgtcaaggaattctttgttcttctgttttataaatggtattagcattatcttttttactggaaactttaaaggtgtaaaatactgtcaagagcaaaagcaacttagattgcctgtaatgaccattacattgacaccattttttgcagtatgatttgctattaaatgtgaataacgtgaagaacaataacactcctagatcacctgctatgaaccaggcactgctctaaatagctcaggtattttaactcatgtaactgctacaaccctatgaaatatatcctcctttcagcttcattttactagtgaggaaaccaaagctcaatgaggctctgttaagttaccccaggtcacacagctagtaagtgtctgagctgggtgttagtgcacagtgatctagcacccaagtccatatacttaaacactacctttgaatgctgctctgtaccctatataaggaagctgtggcccaaataggcaaacctgtgacaaacgaatcctagagtctaaaacaaaggttgaaaggtgactgtaaaagtaggcatttgatctttaaaaaccaggtgaatttgacctgccattcttgacggcattagtaaacattacatttcttataatttacattaaaaatctaatacttcgtttacaaaaaaagactttcaaagaatatgcatgcattttatgcaaggttaaagaagttttcagtgctggctagtgaaatgggggttagatgccctgtctatactacatgtttaatcaatgtaatcttaaaatgagatgaccttgtagccaagcattttttctttcctttataagcaatattaactatattaaatcaagaaagctaatagtttttcgtatttctcaataaccattaagttcaaacattggaagagtttaatattttacatgaaaaatccacaggcaataattttaagtgacttagaaaatatttaccgtattttaaccttaaatgactgtgtatgtgtgtgtgtgtgcctatgtgtgtgcctatgtatgtgtatgtatgtttataatctagtagttctcaaggagtattggagaaagaatatgtgatcacatgtagtttataaaagctctcgtgttttttgaaagacaaattttttgtcaatctagtggtaacatgatactaattttttaattaattttaatttccctgataatacatttaagccttaaaaatattgttagtgattcatgtttctttttctataaaaattatttctaagccttcctcaaatttcttccagactcttttttctgattgatttttaagaattttaaaaatattctgcaatttctcttgatcacaacaagtgttggaaatatcttctcccgaagaaaagaatgattcttaaaaaaatactttagtagcagtttttttctatgaaaaaattagaagtagctttttcttggcagcgttttcttctagagcaatagggaggaaaacagaaagctgtagactgttatcttcgtccatacatatgttagtgctggaactcaactccaaaaactttgttcctttgaaaatcatatccctccagaattggtggagtggtgatggtgtggtgttgaaggcctattgccaggactgagaaggaaaagctaaagaaagagggaaaaaaaatccagagaaagtgactgcctggggaggagggataggcaagagaccaaacatcgattctaaagggaatcttgcaaatgctctggcaagtctatgtatgggaacatcatttgcctagaagatgctcccctttactccctttttccctattgggctggtttagaggtcaataaacttaattattttacatctagtaatgtcccagatgatataaaatgtcattgttttcattctatcatatagttcatgaatcacagttaaaataatgtttcccttctaaaaatttttcaagttttttatttcaccgtaaagttcttttacatatggaattgaattctgtgtgcagtgtgagaagaaatccacttttgtatgtttcccatatggctaactagttatttccacaccatcgattgactgatccatcatttttccactgactggtagtgttacctttgacacgcatcagtacagttggtctgctttacctttctagctataattgtggcgtatccctctattaattgcctcctttagtgttattcagtgcattttatacattttgttacgaagatcttatacattttttattcacatccactgtagacttctgttgctattacaaaatggcaacaattttcagttatattttccaaatgcttgctgcagctatatccaaatctaataatttttatatcgaacaaatatttagaaacttttcaaactttgatgtacttttaatgatgtttcttctgattcttttaggtattctttgtagacaatcgtatcatctgtgaataacaaaaatttgtttcttccattccaatttttatactctatattttataccactttttaaaatgatttattgactggctgcacggatgcttctctgactttaaaatatgaatccctgagggatccttttaaaaggaagatcttggttcagtggtaggtcaggcactgagaacctgcatttctaacaagctcccaggtgacagtgaggacacttgtccaaaaaaagcaatgctttcaaaagactgttaaatagaaatggagagaacaagcattctttacttgtgtctacaattaaagagcatgcttccacatttcaccatcaagattagatatctttgattagttttggtaacttcctcctattccaaatttgccatacatttttatcgtgaatggttgtttagttgaataattttctgtggtttttcccctttaatctcttaacattgtgaattattagaacatctcatgtttaaagcctttcatgccatatgcacacaaatatacatacacatataggtacatagaaaaatatgtatttattgctgctttatttgctaacatttggtttagactttttaacctgtctttatgattcagattggcttcatgtaatccttgaggattcttaatgtttttaagtttcattatagaatgaattaggtgtataccctcttattctaagctctttacatggaactcacttttatactagtttttgagacacactctgttataatcagcatcttactgatgaagaaacagaggtacatggaggttaaataactagcccaaagtcacatagctagtaagtgataaaattcgttggtttttgtctgttgaacaatgaagagaatggtttcctaaaatttgttttgtttagtcactgattcactagttcaatcttaaatgtaattcagtagttcagtcctagaaacagttttcaaagccactaaaaacagatttagatcctagtgaggtaaaaataaataaataaataaaatgattttgaggccactgagaaaagtggggcccctagtaatttgtaacagcctcccactccctatcaagaggaggtggtagaccgagattctaaattgaaaaatgaaggccgggtgcggtggctcacgcctgtaatcccagtgctttgggaggccgaggcgggtggatcacaaaatcaggagatcgagaccatcctggctaacacggtgaaaccctgtctctactaaaaatacgaaaaattagctgggcgtggtggcgggcgcctgtagtcccagctactcgggaggctgaggcaggagaatggtgtgaacccgggaggcggagcatgcagtgagccgagatcgcaccactgcactccagcctgagcgacagagcaagactctgtctcaaaaaaaaaaaaaaagaaaaatgtaaacacttaccttggctttgtcacttaatggcctatgtcaaaagcttaatttgcttcatgatttcatttaaagtgtatacctttcactgaattctgcagtgatttagcataattcactaataggtatatgcctatcattttcataacctttcaggaaatcatttggccctagtatactgactttcgctctaagttttcctttatacctgaatctcaatctctcttactgagatttaaacctgtatctttacagcgaacttcagaaacatgggaaagactgtcattatccttcatgaaatcctgtggtccacaatgaagcgtgtttattttgttaccactcagtttgatttctttcacattgtttcatggtttttcttaaattcttacttactctttagcatgtggaagtactgcctttcaatgtaagacattttactttaacaattcaaagagatttttttttctatgctacgtagatattagggtacagaagaaaatacaggagacattagcctgctcatgaaggttatgaactgcacaaatcatgtagtcttttacaggtttaattgcctcatttgtgaaaggaggttgaactaggcagtctctcacctctctgtcagctctgatgttaaaggattttgttcatccttacaatgttttctcattaaagctcaaatatgcataattaatgtaatgcattattttttaggagattgaaaacctatcatctagatgatgtgctaacctgatttttgtcaatatcattcttgattctgtttttatatctcaatatgatacagagttgcaaaatatttctaagctttgatcattcttttgggcatattcctgtagataattttgaaatgatatatttagtggagaaaatgtaaaaataatattaaatccttctaagaaaaaacaaatgtattaataattaaatagctgcactgtaaaccaatattcactattcaatcattgattaccaaaaagatagcggcatgaaaaacctctatatttttatctcatggtttaagatgaatattttgcccttcatatttatcattttttaaaaaagaacacatttagactttgaaaacgatatgtaatgtgcttctacattaatgggaaaaacaacctaaactgtatagtcaaataaaatattggaatcttataccttgacatatttttttaaactagacatcatctaatttcttttcaaaaatagaaataactttttatctttgtccttggtattactttatacttgtctgttcagtggcattgctattctgtgataagattttattacagaaaatgtctctatctgtacttgaacattagtctaattttttttacaaatgttccttgatttgacatctgtcaactgatttctgagttaatattatcttttcagtttccattcctttgaaataggaaatccaatattaaacccttcaataaagatgaaccctacatctgtatatccagaattttggtttgataaaaccaaaactgataagttcaatggggttaaacattcttgaagtaaaattggagagacatttgaacacctttaccccaagttcattcatctattcatcttctctttaattaagtctgtttgaaaaaagctttcattgattgttagcttcctggaatatgtcctaaatatcataaggcatatggagctccatgactcctcagaaaagagcacgttgattgatcagtgattctgcattagacatgcgtgctacaagtttgatttgactgacccagagaggaatataaccttaatggaaacagagaaaatatcttcatgtcacttggcttagcctgctcctttcaggggataagttgccacagcattcaaaagggtgtagtctatgaatatttttagaatctctaaagatgaggattttacaacatggtattcaacagcagagtttaatttttcttttttctcacttaacactgagtcattaacagttgagacattttacatgactgtgagcagttgagcacaaaaaccagatgttaagattgggtacagtcaaaagtttagacatccacacctgtgttatgttttgtttatgttctggagcgccaaactttgttacatctttgaacccacttcagacctcaaattaccacattttttaaaagcctcattagaatggtatcatatagtgctgaatccatagaacagaaattcagtgttttcagattgctaatcatgtatgaaagtttctgaaatcatattgtccaacgggctgtaacttggcctattcttctatctcctaaggaaattgaattgactggacactgttcattataaagatacagcaggtacttccttgtaacctgtgctcttctatatattttgaaaattattattcattttcatatttatcaaagtgaaaaaagcaacatagctactctacttatatagctcattttaaggaattttatacttgttttctagttttgtgaatttcttatgaattcacaaaaataatgtaaaagctaatggtctgtccctgctaccattgtgcatattagtcaacaagtacaagtagaatatttaaaagatttattagttcctaattatatatagaaaaagactttgaaaattacttaagccatgattctaccaagatgtaaccacttttattttcttttttccttcccaatgttgactggttatatgcatattaatggagctataataataattgtatactttttatcttactttctaaaccacattattattccttaaatattgctctttcttctgacacagtcttctcatgtatcattttgattactacataatattctgacttaatcgaaactttttgtattttttgatgttcaagcttcttttctcatttgttactattagaaatgatggctctagaaacatccttagaagttttccttatcttttaaattaaactgcttttattttactaaaataatctttaagaactgggattactaggtcaaattctacaatcatatttgtgtcccctgtcattttgtaaccaaaaagatgctatttgagtaagacctgcttgataacttacttattaatcttattttattttgtcttgcatcacaaatgagtcaaattctatttttctctaattaaatcttacgatcaccggtacttggatttaagttttacagtgaaacagaaagaattttaaaaaacggtttaagtaggagaaattatattttcagatctccttgcctatctgctggaatcactagtgccaccacttttcactggtgctccttttgcttcacttaactaaagagttttcactcagacccttatgatttctccaagatgcattacattttcctgctgtttccatatacctgggaaatagttctttcatttacatcttctgtctctatatttttccaggtaagtcatgcctcctttaaatttttactattttttatctatgtctgtctatctctactaagatgttctctacctttgtttctgtctacctaactagctagctacctacctacctatctggaactctacctctgtctcttatactatgcccattcttctcttttctctttaaaatttttttgttgctgttttctcttttcctctatttctgtatctcgtttgtgtcaaattgccagactacttaattagtatattcatgtttgtttttgaatttctattactgtattttctcttattagtatttgtttttataattattattttcctttacttttttgtgtttattttcctattttttctaagtaagttgctttgtgcattgagttttagcctttatttctaatacagtgatttaattctattgctttagtgacaatcccatatatttgatgcataatatatttattattaagttttaagtattttataaatccctttgatttcttctctcactcaagtgttatttagaagtactttttaaatgttttccaaaggaatgagtttttaaataaatacattgttattaatttctaattttgttcatctttaacagaagagatatttgtatagtacctattctttgacattgttgaaactaaactgaaaatattagttaattcatgaacactggattaattataattataatattcaaaaaatataattatattcaaaagtataattatatataagtttatataatttataaagtttataatataaacctatattttatatatttataacttaatataaaattataaagtttataatataattataatattcaaaaatattaatttaggcttcctatttatcctgctttctaatgtttgttttcttttcacgtcttttctggcattattttagatcaaagtgatttcctcccttttctcattgtatttttccttctagtttgtaagttttaaactctaattctattattttaataataaccctaaaaaattttccaaatatgtaacttaaggctgaagttaaataatatctttacccttttactgtcctcctgagaaaatacaaaagaatagatttttgttctcttcatatttgtattacattgtagacattatcattattattatagttgtagtaagtcatctttggtgaacattttctaacacattttccattttctttgctcagcattttttttttttttgcatctgagaccatcctttttatttaaaaatgtcttttagaagtttctctagtgactctccaatagtagggaattctcttcatgtgtggttttcttactatcttattttgtgcttagacttggaaggtagttttgttgtgtatgcattactgggttgacaactacttctcttcacctctttaaatacgatactaccttgtcttttgagaaatcacttttcagtctgaccagtgttacttttttctttttgggtgctttgaaattcttatttttatctttgttgttgtgcaatttcactctaatgaatccagaagttgagtttttcaaaagtttacttaaaatgtattggtattcctaaatatgagtgttggtgtcttttatttattttggaaaattcttagctattattgtttcaaatattgcctcgttgccattccttttaatctatcccaaccctagtaagacttatgttggccccactctgtcattcacctatcttaaccttgctttcatattttccacttctttttctactgcattctgaatgtttcattcatatatgttttctggctcactaattcaaccttcagtagagtctaatttgttgtttcacctgtttgttgagtttctaatttcagttattagacattcaattttagaagttctattggtctttattctaaatatgtgtgttgatttttattgtcttttgctcatttactaaattttttatcatttctttaaacagcttaaatatttttttttattttagttccttgatagttccaatatctgtaatcttgttggtctacctgtgcagtttattccactgattgtctctcaggcaagtttattttttttatgcattttctatatttttttacatatgtgagctcatactctttagtattttatctctggaaattatctgtgttgaaagtgtatttttcgaaagaggatttgcttataatttaagtaactgcatgtctgctaactatagatttactttaaatgaaatgttcaacttttgggccacgcaaatatccaatgccatattacatatcgcaagtatacacttgtgattagaaatttttgaaagaaatatttgttttaaatatgctgcctgaaaccaagacaagtcttgttctgcatgaaagattgtagcatgcctagttataggtattgacttttgggtataagactttctgtgaagtctgaatgtgagttctttctctgtttaggccccttgtttagattcttgccctggaacccaaagaattggtaaatgccttcaggaaaaaaacaaaaaaacaaacaaagcaaaaaacaattctagtacttagttatccctgtgggaccaagctttcttaatttcaagcctcaaaaacttttaatttaatgatttaaagcaatcatccagtataattttagagcaaattttgttgaattataccataagaggaaaaagcacacaaacctaaatgtaaaatgtggtaaatttccatgaagataacatacccatgtaagcagcaattagattaataggcagtatattgctaagctgtagaagcccccatttgtgtacctttcagattctgcccccaccccagagtaactactattgtgatttctaagataatattcatattatttaccaaagagagtgtgttctttgttctctagcttcttttcctcaacactgtatttggaaaagttatctttcttttttcttttcttttctttttttttttttttttttgagacagggtattgctctgtcacccaggctgtagtacagtaccatagtcataactcattgcagcctcaaactcctgggctcaagcagtcctcctgcctcagcctcccaagtagctaggactacagacatatgacaccacacctggctaattttattttatttttttgtatagactgggtctcgctttgttgcccaggctagactcaaactcctgggcctaaaggaacatttgtctttatatatgtagttgtagttcattttcatcttcatacaaatatgttataaattatttattcattttattgttttgttttgttttgttttgttttgtttgagaaagagttccactgctttgcccaggctggagtgcagtggcacgaactcgtctcactgcagcctctgcctccagggttcaagcaattctcctgcctcagcctcctaagtagttgggtctacaggcacctgccactacacacggctaatttttgtatttttagtagagatggggttttgccattttggccgggctggtcacgaactcctcatctcaaatgatccacctgcctcagtctgccaaagtgctgggattacaggtgtgagccactgtgcctggcccattttattattggtaaatatttgttttatttttatttgaaactattacaaatcatgctgctatgaacattactgtatacatctttttgtataatgcatatatatttctgatgggtatatagccagaagtggaattgcttgattatgaggcatgcattttttgaagactgacagacagttttctcaagtagcttcttcaatttagattccaaccaatattctctattttctaagagctccacattcttgtcaacacttcgtattatctttttcattttaaccattctagttgagtaatatgtagtgttatttcattgtaattttaattttcacttcactgatgtctagtgattctgtgcattaatttttttttctggacttttgaagtgttctgtatgggaaactattcctccatttagctagctattttgctggaaattattgtataaaatatcatctcataatttaacagtatattccttcttctcttcaaatttttattaaaataatttttcagtactcttgaagtcaacttttaatttgtccaacctgtctttgagctccccctgctgttttctatttaaactatatacctgttgattatgcataattttctttaaaatgatggattcttagccaataagctattttaagcagaagcattttttttgccaaagactaagggtataaaataaatttaaatgctaactcaggatataagaattattaaaattaatgcttgaaaactagtatgttacatatgggaaatctgtataccttcataatttcactgtgaatctcactcctctaaaaaatgaagtcttgaaaagttagtattttaaaatacttaccttacttgtaatgtgaaaccatttatattaatttagcaaatcaatgtttcaaattattaacaactagacaaactactgagccatatgttaggtatattgtaagcatgttgaagtcaacaacatgacttctacactttctactttctcacggttcccagaatatctattttgacataattattgaaaaaaaattaaaagcatttattccattgtcttgctacatctaaattcatggtgttatgtttctttagggcaatggagctgaaatgaataatggataccatgtagtgtttttatatatttcatctatgagctatgacagatatctccctacattccagcagaaaaaaaaatgtgcttctttcctaagcttgccagctataaaggcctattagacattcagagattatcaggaagcaaaaagcttcatagtcttaacaacgtaaatctgaagtcttagaatgagttcattagaatatagacattgaatatgaggtaagtctgagttgaaattctatctctgacaactgctggatctgtttttggtttccaatagtaaaatggcactaataatgatatatgcaaaatgtaaaatgcttagcacagtgcttggcacatagtagattctaagctgtagtttaaacagctattgtgctatgaataagccatacgttgacattttccctcttgagaatgtgctatttaagtgtagaaaacctgctttcccctgtccgtgtgaatttccttaacattcatcttggaaatgataccacatacccttatattgatgcactgcaagaggccaatctaatgtaggcataaaaagagtaatctggtaatctgctcttctcagcaccctctgctaataatgctgtttgaacaaattctagaaagactgttgatgccagagccaactcagaattaggcaggtgaatgttttcaacttctgctaataataacatcagttctgtactctcctctgggttctttttgctgtattaaagctgcagttcccttaggttagcttctatgcataacctgggaatgcatattttagctttttacttccctcccaaagaaaggagcagaagaggagaaccaaatagccaagatctagaagatgaaactgttgtatccattgtgtggattcagataagcctccacccaaaatatggttcaaatgttaagactaatgagcagccctacacttctctctctctcactttcacacacacacatacacaaacacacgcgcacgcacacacacacacacacacacacacacacacacacacatatacccctaccaagaaagtatgaaagtatgtattacttataaaattatgaggtttttctggggagagcagagcaggcctcccaagaaggtctgaagtagcttgagagagcagggggaaaatgactggtttgagattttatgacttttagtgggtgaggccatgctgagagttttgtgtgggtggactctggtgtggtttgaatttcccaccatcaccaaaggagagaacacatgggctttcttaacagttttcccaaatgtaggacagaggggaagagagaggtataacactttaaagctatcagcaatgacacatcaaaaaatggacatagattttttattacagaaattaaattgtatgagaacagaaatgaatcccggtgctacacagctgatgtttcctaggaatgagaactagggtaacttttttaaagcacgtgtttatattgattggtacatactagttagccaaatttaactgggttgagatggtggactttccttttgaacctcagttatgcaaattgtaagaattgtgtttccttcaaattactcaaaataatattgaatttcttacaaatgcaaaatgaattgtggcttaatgtgcatatgtatataacagatactttgttcaactatattatgaaatactatagtatgtaactttcttaaataaacaggatgacaaatcagtgttaggattcaaatgggccctatattactctgtatctctcataggccaagtgttaattctggtacacatgacatttagcacatgctattacatttattgattgcatatttttatctgttatcttttggttcattctacaaggattcttcaaaagaaatcaagtaatcctagaccccaatatataaaagaaaccaactcatcctagacccaatatataaaagtaaatgacattttgttcttgtcttaataagttcacagtatttcaggaaacatgggaatacagaataacagataagaaatattataagacttctagtagagaaatatgcttaaaatcatatgtatgttcctttacacctaagaacctttagatataaatgcattttaactgttctggagagttccaactccaaaatagcctttgttcatatcaagaaagtaaaccaccttctatttcaggtgggcttactcaccatacctggggccacattactgtcccagctcactgaaaggtcataatccaggatgaaaccaaacttgaaaattatagtgaaacacagtagaataatttagaagcatatactttgatgtttttagaaagtaaggaaataaaactttaattgaacttggaataaactcagttctgagcattccattctactctgcagttgtcatttatagacagctgtggatcataatacctatagactagatatcgttatctacttatttatattaatgacaggatatccctgggcaaacagcatcaccactgtactgtgtattcttggttgtcatgggaacctttgctgtgaaccagcagtgagagcacttccattgaataaagctgcctctggatagccatgagttgcatgaagttattttactaattttatttgccttttacttgaaagcataagtttctgaggatgtaattacagtttcccctatatttctacagaagtagttatagatgatggacctcctgaacttttatcactttgccatactctgtaaaattacctaagagctccagagcatgaaattaacactcaggaatattgtagcctaaccttttttgctactctgaataatactgaattgaagggtcttccacagcaagccctctttaaattatgctttctgatgctttacctaaggctatacacttgtctttagattcttctagattattttctcctaatacagaacttagcatttaaatgacaattttaaaaattgagatcaactcttcaaaagaaatcaagtaaaagcaatttcagcaaaaaaaaaaaaaaagccttctaatctcctacaaaacacctctatcctatcaagatattgtgattgagaattagaaatagtgtggaatcagatgttagtttgtcctttccttttcactggaatttctccatgctttaatttttatatcaagaaaaacaattcttgcaatattccctaaggagagttttacaaaaaaagagataaaacaaactacacacacacacacacacacacacacacacacacacacacacacacactaccttaaggaataaagaaattatctgagtggaaaataatggtgctttcaattttcctaattgaattaaaataattatctaagtctttttgatcttgtcccaaagtgaataaaatgtctttttttaaatttatgtttcattagatatatctccatcttttcagtattcaccccaagttttaattgggtagaagaatatggaagaaattcctattgctcagacaccatgtttaaagctttctgaatgtgatctaatacctccattggttggaggtaattaaacagagatctgttcttttaaacaactatttgagtgctttaaatctgaaagtcatgtcataaatgtcagacctctttctctttgctttaatcatctcagaaagacttatctgttaatggaacatctgcatataggtattttgttgaccacaggtgttccacataagtttaatctacctattagttatatgttcatgctattgaggacctttcaataataaactttactgagtgcttactctcttctaagagtaatgcactatgctaggagacaggagggatataaaggtaaagaaaccatggcatgaatctttagggagattataatttagtggagaacactagtgaaaggaggcaaaggaattaatagaacaagacagtttctctgagtctccaaaggcactgtaaaaattcctggggaaactgcaagcaagagcaaaatgttagctatcataaacattctcatgcatcttcaggttttatcttcatccataaatttacccattaaatttagacattctactatctattccacttgacattccaattagcagctcagcctcagcctatcaatatgaatgcacatcgcttccctgttctcttgctgtgccagtctttccccagtgtagttaggtagtgtctccaatcagtcaccatcaccatactgtgctgattttatattctgaatattttttaagctttttcctttttatcaattgactacactagtttagatcttcatcatattattgtacacaactgctgggttttttctgtctggaaagtctattttcctctttcctccccagctgcctctttcttctgcctctggatgcatttcctcattttcctgccttccaagatgtatttaatacattcctctgtgctctcatatgctgatacatgtctgtcgctgtatttgctgtgtaatatccaaattatttgtgcatgtctttgtttttctccaaaagttgcaagctccttaaggtcaggagctgttctttaatatatctactctacctagtgtagtcatgcttaatatttgttgaagtaaacaaatctgaaccccaaatgtattatgtaatctccatatcccagcacagataaaggatatgctcttgaattgttttattgggagaaaacagctgacagattaggctacacaacaactaaaaactaagaaatgactacatgataaattgtaatgaaaatcggaaggcagactgactgaggaatatatctctaacaagtattcaaagatataattttgttattgttaaaaagaatacaatgaatggagagagggtttggatttcacattcaggacttctgaagaccaagtataagagattcaaaagtgataatgtgaatctgattagaaaattcaattttggaatttaaataagaaaaaaattagttggtctagcaggtgaggctataatatggaaaaatgagaaagggatacagcactgaaagtgaaaatgtggaaagagagaagatcagaaggggagaaaaaaagaagaaataaagggttagagtttatgaactgtaccaaaagaaatgatacaatggccagtcctgtgagggtagtagagggatctctttattgtattttcttattttatttttattttagattcagggagtacacgtgcaggcttgttacatgggtaaattgcgtgaagctgaggtttgggcttgtaatgatcccactgcccacgtagtgacataggaccatagggagtttttcaacacttgctcacctccctcctcccacccttttggaatcctcagttgttcagtgtttccatatttgtgtccgtgttgcctccagtgtttagctcccacttataagtaagaacatgtggtatttggttttctgtttctgtttcaattcactgagaataatggcctccagttccatccatgttgctgcaaggaacatgatttcatctttttatggctgtatagtatttcctggtatatatgtagcacattttctttatccagcccaccattggtgggcatatgggttgattccatgtcattgctcttgtgaatagtgctgtgattcacatataagtgcaggtgtctttttggtagaatggtttattttcctttgggtatacactcagcagtgagattgcagggtcaaatggtggttctattattagttcttgagaaatctccaaactgttttccacagtggctgaactaatttgcattcctgccaacagtgtgcaagcgttcccttttctccacagtctcaccaacatctgttactttttgatttttttaatatactagccattctgagtggtgtgagatagtatctcattggttgagtgtggtttgctaatattttgtggaggacttttgcatctgttcatcagagagatattggcatgtagggtttttgttgttgtgtctttgccagattttggtatcagaaagatactggttttgaattaggagttcctcctccttgatttttttttttttttgaatactttcagtagtatctgtatcagctcttatttgtatgtctggtagaattcagctgtgaatccatttggttcagggctatttttggacattaggttttttattactgattcaatttcattacttgttattggtctgttcaggatttcagtttcttcctggtttaatcttgggaggttgtgtgtgtccagaaatttatgcatctcctctaggttttctagtttttgtgcatagagatgtacatagtagtctctgaggatcttttatgtttctatgggattggttgtgatgtcacttttgtcatttctgattgtgcatattcagatcttctctcttttcttgttaatctagctagcagtatatcaatctttttttatcctttccaagaacaaacttctcattttgtatatcctttgtatagttgttatgggtctcaatttcatttaattctgttctgattttagttatttcttttttttctgctagctctaggtttagttttgttcttgtttttctgttttttttttttttttaggtgcgattttaggttgttaatttcagatgtatcttcttgatgtagacattcagtgctagaaactttcctcttaacgctgccattgctgtactctagaggttttggtatgttgtatctctatttttgtttgtttcaaataacagtttgacttctgccttaattttttgtttattttagagtcattcagaaacaagttgattagtttcctgtatttgtgtggttttaagaattcctcttgctgttgatttctgttttttttccactgtggtctgagaagatgcttggtatgattctgattttttgaaatgtattaagacttgctttatgactatgtgttcaatcttggaatatatatcatgtgcagatgagaagaatgcatattctgtagttgttgggtggagtattctatagatgtctattaggtccaattggccaactatcaaatttattaaatacaaaattttttgttagttttttgcctgtctattgctttcactcgtgtgctgaagttccccactattattgggtggccatgaaagtcttttcataggtctataagcaattattttataaatatgtatcctccaatgttgaacatatatatatttaggatagttaagtcttcttattgaattgaacactttatcattatgtaatgcctttcttggtccttttttactgttgttgtttaatgtctattttttctgatattagaatagtgatccttgttctttttttgtttcctatttgcatgatagatctttctctatccatttacttgcagcctagcctatgggtgccattacaagtgaaatgggtatcttgaagttagacttgtttttagtctaatttgccactttttgccttttaaatggagtgttaaaacactatgacaggaataaaaccttacatatcaatattaactttgcatggccaaagttaatattttatgttaaaacactatggcaagaataaaacctcacatatcaatattaattttgactatgcaaaagttaatattgatatgtgaggttttattcttgccatagtgttattatctggttgctttgtagtattgattcagtcactgcttagggcctgtgggctatctgcttgcatgtgctttcatggtaacaaggatcatcctttccttttgttttcatgtttagaactctcttaagtatctcttgtaggtctagtgtggtggtgatggattcttttagcaattgcttatctgagaaagaatttatttctctttcatttatgaagtatagttggtgggatatgaaattattggttggcattttttttctttaaaaatgctaaaaatagtcccccaatctcttctggcttgtatggtttctgctgagaagcctgctgttagtctgatgggtttccctttatagatgatatgactgttttctctagctgccgttaagtttttttctttcacgttgaccttggatagtctgatgattgtgtgccttgaagatggtcatattatatagtattcttccaggaattctctggatttcttgtatgtgcatgttgacttctctggcaagattgaggaaatttccctgaattatatcctcaaatatgtgttccaagttgcttagtttctcttatctcagaaatgccaatgtcactttacataaccccatatttattgaaggttttattaattgtttaaaattatttttttctttatttttgcctgcctgggttgattcagaaagctagtcttcgagccctgaaattcattcttctgcttggtatagtctgttgttaaggcttccaactgtattttgaaattcccatagttaatttttcaattccagaagttgtgtttggttctttcttaatatagctatgttgtctttcaaatcttggatcatttttctggcttctttgtgttggatttcaactttctcttggatctcattgagtttctttgccatctagattctgaattctatatctgtcatttcagacatttcattctggttagggttcattgcttgggagctagtgagattctctggaggtggtaaaacactctgacattttgtattgccagagttcttgtgctggttccttctcatctgagagagctgatgcttttttcttttcttttttgaatttgctattgtttggatggagcttgttgattttaaattcttttttcccttgtgggtatgactgtggtgtaaaatgtgtatgggtggatcagcttcatttctgagtgctttcagggcgccaaggctctgtatgggttccttggttgcagataagtttgtgcggtggctgagacgttgcttcttgtagtgatgtaattttgttttgtagtgtaattcaggctgcagcccagtaggtggcacttaagagtgagcgccagaaggtaggggcaagggcagaagcaatggaaaagtctgcaaagtgccctccttcagcgcgtttgccttcagtgggagtggaattgctggagaagccccaaaagtggtctctttcagcccacactctctcggttccgctggggagagccaccttcgagtccgcaacagtacactgaagagggatgagagaggtgagcgatgaccccttctcgacaaccattccctggctttggtggcgcccccttcagtggctagcgcagtgctcctgtttcctttgacccaacctttgacccaagaggggctttagccggctacatccccctcccttaggggccgactgaaccgagggctagatttctaggggagtgggtcccttcccttaccacttttcagagctggtgggttactgtcccccaactgaacaaggaagccgactggggaacccagtagttgatatgtaagggatgctgggaagtgctgggtaaagaagggtgagtccctggcgagggctccacccccaggcctgtgcccacggacctaggtgaggacaggcactccagcctttgggcccaaatgttgcatttcccaagaccaacctagcctaccatgccccctaccatcctgtgcctataaaaaccccaagaccctagcgggtagagacacaagcagctgaaagtggagaggacatcgaggggagcacgctggtggaagagcacaccaacagatgctgccacctggcaggccgtccagcagaggaatgacgcggagtttggtcgtggcagtcataggagagcccgggctgctgagcggctggactccagggggaaaccatctcccttctggctcccccatctgctgatagctacttccactcagtaaaaccttgtactcattctccaagcccaggtgtgattcaattcttccctcacgccaaggcaagaacccgggatacagaaagccctcgtccttgtgataaggtggagggtctaattgagctggttaacacaagctgcctatagacggcaaaactgaaagagcccatggtagcacatgcccactggggctttgggagctgtaaacatccacccctagatgctgccgtgggatcgacccccacaacctgcatgctcccctagaggtacgagcagcagggcactgaagaagcgagccacttctccagttgcacaccttgcaagggggacaagggaacctttctcatttcgtagcaacacacgcagactggttccaggtctcaaagctgcccctagctgcatgtcttgccacccagaagaaacctggcttcgggaactctcctgcccctgcagtcttctaatgctttatgtctcttctctatcgcatccaagcattctctcctagactatctgctcagaaggtgtccacttactattctggcgtttctctgttggggagccacacactacctgcttctgctcagccatcttgatccctttcatgtctctatttatgaaggatgaaaatggaatggagacatggagattgaggattgatgatgaggcttgttgaaatttgatgataatttcactaagaaacttagaaacagggccagggggtaataaatgagagacacaaagagaatggagtaagtagatatgatggacttgcaaagaaaaaaccttgttgaagagcagacgtgagctaatggactaagagaagcatgcaagtggggagactacttctgatagtaaacattttggaagagtgtgccatcaggagaaagcccgacttcagtgtggtcaaggagctgagcaagttatatccagaagtgatcaaggatatttgtgagtttgcttacaatatcataaaggcaggacaagactcaaggaagattcctagggaggaaactggtggggaagtcaaggccaaactgggctggataaggtagaaagagcatattgatgaaaataacagccttaggtgggaattgtagggggtaacttgaaggggatttgaatacaggagcctgtgttaaaaactagctttttcttttcttgctttttttcttagaaatgtatagaacacatccatttattccaacactccaagtgaggaataaggtttgggctcagcttgtagtccgcaccaatcactgagtattattttgaggggcatgtttacggggaaggtacgttgctggtgggattgtttcaaagtcttaatgcaagtgcctcaggtctattgctagacatttagaattttcttggttttttgaaagagaaagattagggatagttaatagtagtttaaaagactgtgcaaccttagtaacatttctttgcaataattaattaaaatcacaaggaaaatttttgcaaaagtttgggcatataaaataaatgaaagttatgactaacagttcaactttctcctgatgtctcacttttgtgagaactgatgtagaccagaaaataaatttctaggtgttttttgtttgtttgtttgttttgttttgttttgtttgcttaggttgacagatctaattttcatgtcaaattaggacactgactttccctaacagatgttcaggagctgaatttgtatcctaattctagtcttgctagtatttatttttgagacctgcaatccatcattatactaacatggcaatgcctaggaagtttaatggctatacgacttctagaaagtgcctttattacatatctgacacattgcaaattcacaagtggagtacaaacaatttcagcagcttagatgacattttccttcctgccagtggtctgaactcaccaggtagcaacacccaaagcattacattctgtctccctgagttgcattgtatttttgatatcacagcataaactgtcaaaggaagtatttctctaattttaattggggttactagggtcaaagccaagtttccaaagctcattttgtttttatcttattatcatgcatttatagtaagccatttattttttgaagcaatccttattataacttggaaaaaaactatttcgtaatgtggtcagatgtgattagatcactgttttatgctcagacgtatgttccaccttttcccataatgctgtgacatttggggtttgtatagcttcatgaatcgaacttaaacagtaatgcattttcacaaataaatagaatcactcttcctacctattatgatggatcttaaaatatcctgccacatctctctcgttattcattcagtttctgatcttagtaatttacctatacattaaaacattgtaattatgtatttaaatcaccaggacacctatcatttggtctctaaaactgagttgctggttgttagagaaaaatgtatttaacttgtatttatgaatataactggatgagattctggttatttaataggcagtttaacttgagaaacagagtagatgggaaaaatgagaacttactgtgctttaacaactttacattaatttgttggttcattgtgagctagtttattacagtatattgaactgtttaccaaatagtaaactcgattccagtgtttagaacatgcttttttaaaatgacattcttaaccattttgccttattgcaaggcatttacgtatatacattgagaagctgtatctgatcatgtttctgcagagatgtgttatgaactgctttagtacacggatttttgaatcttaacaaaggattttggccacctgcaaaataagaggttttcattctttttagaatagtcttttttctgggtccccagtgtatattttgccaaaatgcctaaaatattgcaataaaaaaactcagagtttggtaccaatctgacaattaatttttttaagcctttaaaagtatataaacaattttagccaatggacacctctcactgaattgaccatatagatcatattagtccattttcacactgctgataaagacacccttgacactaggaagaaaaagaggtttaagggactcagttccacatggctggggagacctcacaatcatggcaaaaggcaaggaggagcaagtcgcgtcttatatggatggtggcaggcaaaaagagagagcttgtgcaggggaactcctctttataaaaccatcagatcttgtgagacttattcactatcatgagaacagcacgagaaagacccaccccataattcgattgcctcccaggacacatgggaattgtgggagctacaatccaagatgagatttgggtggggacacagcctaaacatataatagacctatcagttccctacactaataaacttccctggtattatttccacagcacatgtaccctggaaaattagctccaggtgatgagaaattcagttgagggcagtaaaaaagaaaccaggtattctcacactaatttgagggtttaatctcactgggcctcctgtttgtttttagtgcattggaggaaaattagattttctgagtaaatagaaatgagcaatgttcctatgtatatacacttaactcttcaaaaagaacaacataggtctgtactggcacaagtaaaatgttgtagaaattgggtcaggtgccaagtgtgagcaacctcactctccctaatcagacagcatttcttatattatttctggattaatataagtaggtaatcttgaataaattctctagtgaatgttctacatcatttattgtcagtgaatgtacagatgggatagtcccagtaaatttttttagaaaaccaaaccatgttcaggatcatggatacttgtattcaaggttttcatgggcattcaaggaagaaagaggtgatgcaacatgccgtaagccagattctctagaaaacagacttggaggcagagatttaggcccaagaaatttgtttgggggtggggttctcttaagatcaacacctgtgtgcagtagatttctctctctttggataaaggcaattccaggagagagacttagctgagaagactcccagctgctgggggaatgaatgcctcaatcctgaatgggtatctgggttgcatatttgagcaaaacatcctaactttagtaaataaagctacagctttttcttatttctcctatctgcttcttgcctgggcaacctaaaatttatccattatccctgctatctcaccaggaagagtatagcgataaagagcaatttctatatcttatacattatatttaactataacatttattgttattagatagttagattaagtaagaaataaggtattcatgattcttttgaatctgtgtgaatatacatatagttaaatagtgacattgaaagtatggtgaatttttatatcatctttctggagaaatactgaggaaaatacttgaattttgcataaccaaggcatcagttactattcacaatgagactacagagaaagctttccaaaatgtttaaatgaaatatgctttcaatgttatgtggttttcctgtgatgtagctacttaattagcattgtatcaatcaccactgacatcaaatatgataacttgctttactggaaagtcactgctcaatctcatgaatgaaattgatgaggtagaaggtaatggtgcattgccaagaaaacaagaaagaagggagctaaaaattgagagttacctactttgcagtatctgctttatatatggtatctgatttcagtttatctgaaccctcccctggaagtagctattatcaactttatgttatttacttactcattttattctttttaaaaagaataatgagatgttttaaacatagagaaaagtgcacagggcaatataaaatcacatacataatcatctcccaagagtaactaatgtcattataggtaaagtttgcttcatatcattttaaatataaatattgcagatatgcttgaaatatatgttaggccatatgtgttcaagctgaggaaaggtaggttcagagagaaataatcttggccaatctcactctgctagtaagtagggctaagatttgatcgtctatacgtggatcgtggaactcatgttctttccctccactatgtatacttcctctgtactccctgaagacttaatctggatagagatacattgcctagagtttctctatagtgggagaaatgagccttttactttcgtggtaccacgtcagttgccaattgattctggcacataaaaatgtattatatctttacctgtttaattattttctgtaccacatcaaaggaacaagataaatttggttataatagtttattttactttaatttactattattagtcattgcagtacacaaatgcagatgtctgaagggatgcacaaagatgacaaatgaggcatgtaacatataaagaaatactacatttctaagtggtttacattatgtgtatgaacatgaattacctgcatggattatttttaagttcagaaactgtttttagttggttttctttcttttctatagctgttatttatgtctccagcttcatcttcaaagtggagatcataatatttatctcataagactcttaaaaaatgagataaaagcatttgatgaaagcatatgaaagcatttgactgagcaattagtataaagaagctacttagtacttatttgctatggtcacctgaaaagaaaagctattttgcatgcagtggtagggttgagaaacagccaatatattaaatattttaaaatatttttgtttaagttcaaccacctactttttagaaaatcacttagcatatgaaatttattttaagaggatacttactccacagttgctttagaagaaagaaaaagaaaatcagtttgtaaaatgagataattgtaagggtatctcatctttgtagccatatgagagagtccaaagagctaagcaaatatttgcgaaatgatatttttactatactggaagtaataaacaattaaaatgttgttattaaggcagtgctgatattataattttactatctctagaggaataccagagatcttattaaacacatgcttttttaaagttgaaatcttagataactattatcattactatatgtgtaagaaaacaacggcatggagaaagatgtgctctatagaaaactggtaggttattaaaatataaagaaatagggagaaaactgaaaattgcatgatattgtcaagtctcccttgggactcacccacacaacagttctttcattgcaagtttcttttttccttaatgagtcattttgagttctttttaatgtgggcacaaggaaacaaataaggattcttccatgcagctaaggcaccccaaatcttattaattcaaatgttgagagcattgaagccataaagacaataagaatactgaaacaccatgtatctgctttcatttaaatagccaaacaattctgtattttccaagtgggcttccttaatatacatattttaaaccttgtaaggtaattctccagagaaatatggaggtctaaaagacaaagtaattccatttatcaccttaaatctcatttaattagggaataattctgatatatcaagaaagaaactaattactgtcttctagatgcttgtgcttttgtaagaaacaaaagagctcaagcaagtagaagcctcaggaagagagcagtattacagagggaccacagcaacaatgtttttttttgttttttttgttttttttttttgagatggagtctcactctgtcgccaggctagagtgcagtggtgtgatcttggctcactgcaacctctgcctccagggttcaagcgattctcctgcctcagcctcctgagtactaccacactcagctaatttttgtatttttagtagagatggggtttcaccatattgtccaggatggtctctatctcttgaccgcgtgatccgccctcctcagcctcccaaagtgctgggattacaggcatgagccgtcacgcctggccaacaatccttattaatattaaaatttaaaaattggcttgaactggagaacacttcaaagctcatttaccacagaactttgtcatttttctccttatttgactcatctcagttggaaagcacagatgttttatgcgtctgccttgctcccactctccctaaaattttacttaccagctaaaccgccaatcctaatacatccaacaatattttaccatgaaaatacattcaatttttgtatttagatgcatacaagtctcctgaaattgtgaaatattccaactgtacttggaaagctctctgaagatccccccctcaaaaaaaaaaaaagaagattatctctagtggttatattttttgaaaggtttattgttctattgaatatatatctagttctttttcataaaaatgaatatcctggctttaagtaactgtttgctaagcacagtgtgcacagctatgcacacactgatatcaccattgccaattttattaaaagaaccacaatacagagcaaagagaaaaagagaagtgtccctattaatggtatttcaaatgcgtatttaaacagcttatctactccaaactaatttctgatagattaaatagctgtattccaaatcttacaagatgcacatctctcctctatttctttctcggcttgcttcagctgaatagctcaaattgtttggcactggtaaagcatgaaaatgtgagataaaaaaggaaacgaagctacagcctgagtggcctacaggccttagaaatggcaacactttaaaattcattatattttacattgcttcaacagttacacattttttttttttttttttttttggctcttgatgatgtcagaagatttatctgggatgtctgtctccacgggtaaatagtgaccggggtgaaaactgagggaactagggagcacctagaccccaagccttagtagtcagctctggaatgctccctgcagtgtggggtgtgagtgtggtgtctctgtgtctctgtgtacacactgtgtgtctgatgtgcagaggggaaggcagggaagaaatactatggcagacagtcacttgtggtagctctctaaagggatctggcacttcctgccatttcatggaaaagaggaatgagaaggaaataagcatttgttacatgcgggatctcactggatgctttcagtgctagaagggagctatttctcctcctaacgtctgtaactcaccagatttcactaattcagaggttgctttgaaactcagagtcaaattcatagccagggactaagtcttcatgatgtgcctttttgttttagcctcctttccggcatgttttttgtgttgctctccttcctgattactttttattagtgctatcttagtttatgtatttttataaactgccttaaatgctttctggaaccactgtgcatttaatcaaatagactaataactaactaggaaaatgatagggctgatagcatcgtctgacccatgaggaagctgaatttaagtagcttgtccaaggtcactcagcaagtcccttgtgctgtgagtctggttcttggctttcagtcagtattttcaagttttacctacttatttcctcttaactgaacacgaaaaaaacctcaaatgcttatttctttagctatttctatttctctgcagttaatgtcctatcaacttgaaattcctcccctgcctttcactcccagtagaagtttcgctcacctttcccaggatgcttgaaataccttctcatgaagcatttcttatcctgaaaaagcatcattgttacatctcttcttagacgctcctttgccttctgttttcaatctagaaatttgtttctcccccatctccatactgactaggattttgtttgcttgtttcagtttagatcacaggtgttaaaaagatgatcttacatatttaaatgatggacatatgattcctattatcttctacttctatgcattcctgatagacaactcttaggctggaaactaaaacaagaaggcctattaactatttttgcaaaataaaattgtattcttaaagttaagttcttgatgcagggagaaaacattttatgattttcattttacttcccacaataatacaagcatgtcaagtattgacctacaataaatgcttaataaaaacctagtatttttcagtcactttaacagggcattgtatatttaatgcattaacgctccataggccatgtctcctatgtactttgtatgctcagaaagggaagtaatgtacactggtggttaagaacatattaacctgagtacatctttaaacctcagctccactccttgcatgttgtatgacattggcgagtcatttaacagctatgggtctacatttcttcacctgtaaaatggggataataataatgtctatttaataaatgtattgtgatagttaactgaaataaaacatgtataaagcatgcaatagggcacatgggaagtattttataagtgttgtatgttattattaacctgtaaagaattcatacaagaaggcacagaaaaacatcaattgcaactaagatgaaaagtttgttgctgttagagcaggagtagttaagatggtatgtatttcaaatatccaaaagcttcttctatttctggagagcaaccatgggaagtctattgtggcattagatagtgccacagagaaaagacaacaggatggtgaggacaggagttgggagggtggagccaaggaatcaaataatgtggtttcctagatgacattcttttcagaagcccagaggtgccacatctattacaaagtctctaaccaaaccatatccatgaacctatacaagataaattttaacagagtgcagattgtctttcactctacatcaaactatagagtccagaaaaaatattttatatcatgatagtgataataattgaaggaatcagaaggagttgatcattctctacaagcttgttgtcatgaggagggaggtgaaaagcattaaaaaaaagcttaaacccttttcccaatatttcaaagtagctttgatggtatttagatagcaaactcattttaaagagaataggattttcacaaaacggaaaaatcaagcagctggcatagtaagttatctgaatttgatctgaattgacgtcagggagctgggaatgcccctggcaatcctgcattctctctctttgtgcagtattttgacagtagtgagaatgtctgagtgttaatcattttctgacagtgtaggctctaatcttatgcaaaatgaaagcatttagagattttaccttcttggttccaatcagggcatttcttctagaaaaactattctgcagtaagattgtgtataacttattttacatttgtatatgtttatatatatttatatttatataataaacctaaaaatatgtaactgctaagtttggtagtagcctttcttcaaagcatcattcttgagaagagagtttattttgtaaaaccttactggtagagacataaatctaaaaaacaaaattcaatccagacttttgtatccaaatatgaatgttaatttcctgggtatatctttttttaaaaacttgcagtgtgggtatataagcagggccagatgtctctgtgttaatcatttctactctttaataaataacggtggcgtacagtgaaaataaagcccagatggctgacacattgcacaaatcactggatgcactgtatattcatttcatagtttcctgaatactaatagatgatagagtcatcatctttttatctgttcctcagtcaaataacaagtaactacttactgtgtcttctaaaagccactgtgctagtggctaggtaggttataaaaacccaccagatattgcagatagtaccacaatataatttgctttaatctctatgaccttcagaatctattacatcctagtcttccctaggagactggggtttcttggaattattttaaaaaagtgatccaaaactggatctgattttgccatggggattgcttaactaattggtttattagcttgagtctcatgcatcatggtggatattactggttgtcaagttgtggttggtgaatcgtagacttttagaactctcagagaaattcagagttgacccacattacattttacagatgagaaaatgtgaaacaaatgactaaatggtttcactagagccagacagttactgtcagaattgaagcttaaactacaggctgctaacttgtagtctgcagcttttgctagtatgtatgttactttgtctcagaaatgtagtgaaattaaatgtagtgagattaaaatcggtatcacaggaatgaaggtgcagtaactttgggtttgctgctgccattgactcagggtgggatgaaagaaggggaacggacatcattgcacctgcttcatttgtttgttctagaaggaaaataaggaaatgaggtctggctccacacagtgtttcagtgggggctttaactggtctagattatctagaatttttcaatatacagaacttaataggcacagacactcaaatgataggggagtcaagtattcacaaagatatgacatttacagagccagtctgcaaagataaagatatgctaagtggttgtctgtagacaattatagtccattacaagttgagcataaaaacataagcattattcatcagatactgaatcaccagttagtgctggtatttagatgaaaacatttggcttggaggggaagcccctcaaaaaccatagttttgacttgtttctaagaacctgcctgtcatggaaaagcctagaccctagtggaattccccagggatgttttacatagttgggattctcagtagttgatgatattgggaagcagaacataaccagaggagctgggagtcagccctgcccaggtggggcccaagcaaaaaccatactctgcctttccccaagtcacaataaattgtgttctgctaagttgtagttacactgtctcttcaaacagagaccataataatctttgctgcatttattcagttttatgtttatgctagtgatgtttgtcacttagttaaaattagctttaatatggaagaagagggtatacctctttctggaaatgtaacactcagccttaaaggtaaagggagcagcaaaggtgtccctaaaaagcaacttgcatcctgagcactgtgtggatagaggccactgttgccagacatccagccttagcaggttgcagccttagcaggttgtgctgtctttgtatgtggtcattttggtaccatccagaacccccacttactctcctgctcctccaccaccacctccagtccctggttgcaatgagccacacaaaacagaggaaagtaaacgggcattaccttagtatcagcaatgctgggatatagttctgctggtagctcctcctaaaaatacacccctaaaaaataaaattgtaagaaaaaaagagttaaaaataaaaagtttcagtctccttgccctgggcaggtccttggaactgtagaggattttaaaggctatgaaaattattttttatggaattccagagagggggatgggctcaagtttatatgtgagatacatatttacttatttaatagatttgaaaatttatttctatgtttattagtcagggttcttcaaaggacagaacctatatgatatatgcatacatagaaagagatttattttaaggaatttactcccacagctacagagactgagaagttccaagatctgcagccaataagctggagacccaggagagctgctggtataagttccagtctgaaagctggcaggcttgatacccaaaaggagcaaatgtttcagttcatgtccaaaggcaggaaaaaaccaacctcccagctcaggcaggcaggaggaatcctctcttacttgtggaaggttcagcctttatgttctatgcaggccttcagctgattggatgagggccatccaaatgtaggagagtaaccgctttcctcagtctaccagttcaaatgttactcttatccaaaaacaccctcacacacataccccagatgatgttaattaaatatctgggcacccagtgacccagtcaaattgacacataaaatcaatcatcccaccatgtatatttattcatatgtaaaatagtagatttatgtaggaaatagaaaaatgatggttattattagagaggagcataagaaggaaatttgtgatttgaagatttagagtccattattgctaatgaccattaagcaagaatcaaaaaattttgccctgttatgataatgatgtgtacaccattctaaaaataatccttatttactaaggcatcacaataacttctatgggtccatttcagacacaacaagggcgaatcacctttttccttttatttctttgacttctgttgaatattttttatgaaaaatcttgaatttctaagggcatattcttttatcactacagggatgattttgcctgaatatctgaaatagcattgcaaaatgattttctttagcactttacaactgtaaaagaaggtcattttaaaggcagtatttaaaagaacaatgccacaataagtggctcttctcattgcccttacattcttttaaaaagaagagaccagtagacaatggttaaaccagcatgtttcaacaaacacatcatcacttaattaattgaagcaactttccaaaagtattaaggaattaaaatatgtaatgctctagaataggagaagcctaataagccaaataagttcaactatgaaaaaatatctgtcattttgttaattcacaagctggagagggtatgaatgttaaggggatgttgtagctagcctagagacttactcttaggtctaaggcaggtacttaaaatgtgagagttgaaaagaaatttttttttattatttttcttttttcctgaagaagtgggttttgtaagcacaaaggatgtagagaaaaaccatgctttttgattcagactgcagtggggaaggtatgcaaattaacttataatttctatgccaaagatttttttttggctctttctctaaatattttactaatatcttacggcatacagattggtctcccaacttgcaggagacattttttggaggttgtatttttaatttttttttcaatactgaaaaattttataggggaaatgagaagagccagatgatgaatggcttcaacaaagggactgtggtcaataatgacagtgatgggaacaacgaaatgaccaaaggtcttgatttccaagaaaagtcaaatcatgaaggcttcatgttggaggagaccacagaagtgtggagactcaggcaggttccgggattttaaaactctaccgctggagcagcctttccttaccaccacccaaatgcacccatagagcagggaataggggtcagaaattatggagatttccacttgaagggttccatgggtctaattcaactcccattttagagatgaagcaggtgagtctcagagaagtgaatgatatattcaggacatatggctaaggggtgaccaactgcagactaggcttcttgactcgaacttttttttttttttggactacattgtattactccccagtctattaaaaagtttaactgccatattgaacaagcaagactcatacagcaaagtcagaaaacatttgcctttccctccactgtcattaaaatccaataaagagttaggtcttagcatgccaatgggactctaaaaagaaatcctctctaggattttttgtctccctttgacctcttttaaaggctgtatgtggggtataagctaacggtcagaatagctgcgcctttgcaagtcctaccagatgttgcagcaactccagagtgtaggaatatttgccatctattgttttgtccttggccttgttaggacttctactgcaaatagagacaaagagccttcaggaacattctgctgtgcaagtggtcaccaagttcatgtgcatgacactgccctggtcattgctgtcctggttactctgcaaacactaaagccgattggccttgacttaaaatccatttcaagggaggagaataacataaattgttttaatcagggcaagttttattgtaataaagtaaatgacacaaaggcaggaactacactgccctattggttattatcacctgtctggcacacagtaactgctcaataaatgaatgagtgaacagaaacctattaattggatcaagtaaaaagagacttattggaaagatacaaagtaatttaagaaaaatgtcatattggaaaataatgcctggcttcatggggtattcccatcctggcatattggacccattaacctctcagtgaatctcagtgacccaacatggccacatgccatgatgatgtgactacagtgcccatcgtgaatgaagggaagcagaagcactcttgagtggtctgggttggaccagaacctgggtgttgggtggtagtgggaaatagataagggaggtaatctgtgacattggcagatggcatttttattaaatctcagactattcagagagtacgtgggaacattatcttcattgtaatatgatcttcttgaaaggatagttattcaaataaaaatatatactttccatgtatatgaacaataatgttgcatttattctaatgttacatttattctaatgtaaactattctatcctttttgataactttgcaaactgaaaactattactgaacagtttgaattaaaaaaaaaagcttggagtactataatattcatgaacaaaaatcttggagaatttcttctttaatgaagttattgaaatgctcatgcctataaaatttttcaatattgaaaaaaaattaaaaatacaacctccaaaaaatgtctcctgtaagttgggagaccaagagaccaatctgtatgccgtaagatattagtaaaatgtttggagaaagagccaaaaaaaaatgcttggcatagaaattataagttaatgtgcatactctccccactgtagtctgaatttacaagatatatgccatgattattctctcagaagattttttatgagttcagtactgtcttgattaagcttatgactaaataaacttcttttcatgacattgtcgaagagtatcagttttcagacagtgagaaaaggacaagcagctggaatcagctgagaacccaacaatctattgtaaaaatacggtttattttaccactcggcatatgtattcatacacatatatgtatattcaactgagacaaaagtttcacaaaatcctgcttactcttactacatgtgatgatctctgatacatgtgatgatctctattctgtttgttttaaagtttgtcacaacacatgaaatttgtttcacaaccttcctgttggtcatgagctctgtttgaaatatgcagactcaaggcaaaaatgtaaatgggaaatttggaattattatccaggttggaaggattaaaaaatagaaaatacgtatgatttcacctttctttcttctgaggccagataaaggtaactagtctgaaatctagttatttatttatctggaattgtttagggttaaccatagctagtaagggtagactgtggatgtagtacagtagctacttaaaagctgttatgtcatgagcctcccaaccatgacggtgcttaggaactctccagggagcattgtaaagtatgcaaaagtcctggaaactctaggccaagtgatttagaatctctgagcatggggcctgagcatcagtatttttaagaaactccccaggtaattgtaatatgaagctaggacccaaaccatcaatagcaactctgagtagatgcctttgccttgtgcactgaatacttttgtcatgttaacaatgcttttttgtcatattttatgacgtgtttcttgtgtatcacccaaaagcaacagatatttttgaataacagaggttactatgagcatacagttatgcacatcattgaacctcaaattttaagatacttattactaaaatgttatactgtgatttattgaaaattttatgaagaattcattgacaggagcaggttatatgttaagtgctacttttctagttgaatgtggctcaggagaaatctagttaactaagtcaaatagatagtttttaatacttatatttatttaaatagtagacttccataatcctcagttattttatgtcttccaaaaccaaaaataatttctttaattttgtcatagattttaattgaaattggtgaacatatgcacacatacacaaaaactgtagatttagtgtctgtggtatgtaattgatgaactgttttctaaaaggattttgaacgtttagaaaactaattaagatatttaaattattgacaaatagaggatctttctgtacccaatttaaaaagaagatacaatgatttgtggttagtgtatccatttttcaaacataaacagaaacttcagaagttcttaaaaacaggttgtccttttagataatttctacatttcctctgaaatcttatttctgaattaagtctagatgtttacaatctatctgaaaaaagtaatgttgttataaacctcaaatccgtgctcatacaaattcttaccatttccaattagataatactctggcaagaattactaatgcctgaaaaaatagatgtaaatattcccatatgatggtaattattaaatgttatcaactaagtatagtgttttgttttaattttaacttttattttagatacagggggcacatgtgcaggtttgttacatgggtatattgtatgatgctgagatttggagtatggactctgtcacccagatagtgagcatagcatccaataagtagttttcccacccaaactctcctccctcccttccccttctagtagtctgcagtatctgttgttcccatgtttccgtccatgtgtactcggtgtttagctcccacttacaagtgagagcgtgtggtatttggttttatgttccagcattaatttgcttaggattatggcctccagttgcatccatgttgctgcagaggacatgattttgctcttttttatggctgcatagtatttcatggtgtatttgtaccacattttctttatccaaaccaccactgatagggtgggtttcatgtctttgctattgtgaacagtgtggagatgaacatatgagtgcatgtgtctttttggtggaatgatttgtattctttgggcatatacccagtaatgggattgctaggttgaatggtacctctgttttaagttctttgagaaatctccaaactacttttcacagtggctgaagtaatttacatgtccaccaacagcgtataagcagtcaatttcctccacaatcctgccagtatctgttgttttttaactttttaataatagcctaaatgtagtattttaaaatatctaagagtttcttacctgaacctagccaatgtattttttcatcttattaaattacatacacttttattttagccctcattgatttattaggtatataagtaagcatattttgtagagattctttaatttttttttttttttttttttattatactctaagttttagggtacatgtgcacattgtgcaggttagttaatattttatagcactaatatgtccttttgttttttaagaataaaatttataaattgttttataagagtaaaatcaatgtaatagctgctgctgctcagtacaattaaacaagttacagaaatcctttactcagtatcactaccaaattttttctaatattctcattttaattttttgtaggtggtttttacagttgcctttatatattctgtcaattgtgaatagaaattcaaattcttgaatttgataattgtgtcatttttgtgttccctagcttttatttgtagactgttggtcctattgttctttttcatgtgttactattatctctggatattttcttataaattattgaaacttatgagattcaattaccttccaaagtgatttattgttacgtgctgtaatgctattaataagtgtagtttgcaagcaatgtttcaaaattttgtctacttaaaatttagaacaggatatttattttgtaatttttggatagatagaaaatctcctttctgccatcatgaaactgataaatgagttatagggatgggaggagatggacatttgaccacatgcaatgcagttttccaaagtatataaccataatctatattaaaggtaaatgcagtgtcagatgggcattactttatgcaagattgtgttgctcatgaacttaccagccaaaggagactatctctcactaaggcttatgtaaaactgccaggagagaataattacagtgggagtaaatttgaacacatgcagtagaatgtctaaaagttaagcttctcagagaaaatgtacatatgcttggattttacaaatgatgtatttccaggtattcactaggcctgctaaaataagttagcattttttaaagataaatatgttactgaaatatatcctacataaagtaccaaattataggtttacagtttgatgaattcctgcaaagtgaacacatctatgtaatctccatcctgatcaggaaatagaacattgtcaattctcccagaagtccctggtaccataccccagtcccctcccaccacatcacataagattaggttttgtctgttttgtttttttaccattttgtgttcttggtgagagtgctgcttttccataagcaatttcactgtatccagaaacagaactcagttaaattttaaggccactattttcttcataaaatagagggaagggagaataggttggtgggaggaaactcgtgcttctgattctttccctagcctatgatcaacataatcatgccttaagaaccttgctttctgtctttgagtgacatgcttggaaaagtttttgaaaacatcagtttgtgttctttacatattcattgtataactctattttatatggtattaataataaaatggaaacaaacagaattgtggaggggaaaaaaagagaaattttaaagacaagcctgccctctaatttcctttttgccatgagtagtcagtgggaagactctgggagcttggggacattgaggcatacagcagtcaacaagcctgagccctacaacgactgagtctggaaagtttagattctgaaagcctaaaaaagcactgtgtaagaggctaagccaacctttttgttgttgttaatctttttactgggagacaagaatggaccttagggatagggtaaaaaactgagagcccccagcccctttaagatattttctctaaacctcttaaagttaactctgattaatttcttggttagaattcaagttatggttcctgctctgcaaaactaataggtagtttaaggtgggaaaagtaaaaattcttgccatctcctacattgacttgagagtgaaagtaagactacagatttgttatccccaagacagttgtagaaaactgagattatgctttataataccctatttcaagtggggttaatatataaccatggttcttagccttatttggggttagagacccctttgagaatctgaataaagctatatgtcttctctgaaaggtgtacctaggtacacataatttagccactggccttgtccgtttgcaggccccgtaagctaatgcacagttccctctgaggatccctcagctttattctaaagtctaaaattctctaacggttgccagtggaaataatccaggagtgatagaagtatggtccttattacagttatctaggaaggagaccacactgtcttcatcctttacccttccttggtttcaccttcttccttcatgacttgaagattcctttattttctcttacttccaactcaaaattatattggttcatgctggtttcctttgtttaacagaaatattccttttgcaaaatggtaaacacctttttagggggaaaaaaaacccaaccaacactgttcctacagttgtagatagtaattaagtcaaacccttagttggttttcatttttgaatttaatactgcaaaaaattaacttttttgcataaaactttttatgacttcagttattaatattttattattttgattaattttatgtaagtcaagatagtctaggttattctgcagtaatccaaaatctaagtggcttaatataacaaattttatttcttgttctcttcatacatacccaagagggattggcaagaggctctacttattgtagtaaacctgggacccaagatgattgatgctttatctcaactcaggcttcttcaccagggaaaaatgatgtaatgaatccgtcacaggttgcctgaactttcacctagaagtgacacataccacttttgcttaaaataattggtcaaagtatatcccatgttcatgtaggataccaaaggggaggctaagggcaatcttaccatgtgaccagaaaaaggaaagctagaagtatttggtagacacattcactcttttctgtactcctttccaaattctcctaactttttggagatttgattgatgttaagcagaaaaagagggtttgagtcttatttttggtgaaagaaaatattcttggttaactttgtcatataatatatctgaacttaaaataagtacacagtggcatataatgaacttaaaagaaataaaatactagcaggaatgtaaaaaacctgaacataacactgaattgctcttgttagtgttatgccacttagttccatctacagtctagcccttgtaataacacacacaccgtgattttagttaaataggaacatgcccctttctgtttcatttaaaattctagtcaacacaaattcttctagaaaaatgaattaagaatgagtactattcccagagtacattctggtttgtctataaattctaagctaagctttatatgggaactgtcaaaggcacagttgcaatgttgctgccttttttattcaggagaactgacttctgttgtcccacttggactgatatgttgagtgatgaaaagctgggcaaatctcctcagtcactttcttctgatagtttactttatggcttccttagtggtctgcatcattctttcagcctgaccatttgcttgagggtgatgaagagtaatgatgacaggttagatgagctctagcttcacaaatttcttaaatgcatctgaaacaaatgcagattcattgtcaggaataataacatctgggaatctggacattgaaaatcattggtacagggatgttcttgttgaagtagagacactataaggcattttgagatggtagccacaacaaacaagaaattctcctccttgaaaaataaaagaattattgatcaaatcttcctgatcattttttataggaaggaaaagtacctttggtggattatatggagtggcttggtgttgtctacagtcttctaaatgacataattaagtacaggctttagatataattattagtgtatatatcattttaaaattcccaggtgaattgtaaacattattgtaataatgtgataagttatgtgatttctctattctggccactcgaaattaagaattaaagctttgattagaaattagagtctaaactatatatttgagaggcattagtatagttgaaactatgagagtattttggtttactgagctagtttatgtgagaaagcaaaagacctgaaacagtcttttttcagtatgtattgtattctagacttttttctaggtcattctttctttccatattttctcttttttttttttttttttttcatgagaaagcagaatgattcaaactgggtataactatattaaaggccatgaacctagctttgtctgacaataaaagtcatgctcttattgctagattaaacttcctcctgtttatagtgtctgatgggattaaagagagaggatcttatgtaagtaagaaagtaatctttttcctacaatctgcttttagcccttactttcctcctatgttgagagcatttctagtccaaagttcttttttttaagtcattaagatgtattattcaatctcaagtaacttttaatccctttgtaaaaatattagctctttaattaggcttggtgtgcctagccagctgtctccagcataattttgggtaggcattagtatgttaatatggaactggcttataatcttaatttcaaagcatattggaaggcaagttttatgaatagtataaagagacttatatgacctgtcaaatcaattcataaaattcctattttgaaggggaaattaaaagtcaaggtaatggaaatgttatattcgtatattcgcaggagatgaatgacatggataggatgtctttgaaagttaatgagaaagctacttgccaggcaagttgttcaagagcaatgttagcaaatgaaatgggttgctgcctttggggaaatgatttatgatgatgaaaaccatctgggtttaggaggttggttgatgtgacatacctctcttccagcctttccactctctcttctttcctgtgcccagcataaaatcagtctttgcgtataaagagcgctatgcaagttggcttccagtcatacgaatatgtggtatgatttcaaataagattgtcattggatgctttggtcagcaagcatatttactttagatttgtatttactctttgtagttgaactggctaaactctaacaaagtatgcttcatttgactttaataaaatattatatttccaagaccgtatgtagtaatagcagaaggtgtgatttctctttttgcataaattggctcttcccttctctttctctgtgtttttcacatctccctactgtcatatatattctgacctgcctctggtagggctatttatgtcatatccataattgttatatattaaccatttgaatgtggaataaggcaagtacagtttaatttttttatataaaaaatatggaatatactgtaaatgagttctcttaatcacggagtagctacctctggaagctgtaactgttggtcttgggctgtaatatattatactacaaccttaaaaatgaagaaaacaaaaagacaacactctatgtgctgctagacaaaggccacagttaaagccaaactgcttgacactttatattcttcaggcctttttaacgaccttccctttgggtgatgcattttgtagctgttgtcacttgtacagcagagagggaaaaggaaatgaataatctgatttgaaggggtgtagagggatgtgagtcttaggaagatccttaggatttacagaagctataaagctatttgtgctgctttgtggtgctttgcaccctgtgtcagttaatagtttatctttaccccattttatgctctaagatatagatgatgttttaaaaatcattctcatagtcttctttcctcaagctccaccccaagttttctagctcctgaccagcactgttagcttttttgatttaatcttcacagtcttctcatttatgaaatacaaaatgaatgctatgtcaagacagacttggaaaaatcttttaaaatggcaatacaggctcacctgcaattaaagtcattccattccatttagtgtctttttctttttctttttgagacagggcctcactctattgcccaggctggagtgcagtggcaggatcatggctcactgtagccttgacttcctgggctcaagcagtcctcctgcctctgcctccctagtagctatgaccacagatgcatgccaccattcctggctatgtattttttaatttttagtagagacagggtctcaatatgtggcctaacctggtctcaaactgctgggcttaagcaatcctcccacctcagcctcccagagtgctgggattttgggatcccaggtatgagccattgcactcggctccatttagcttctgatgagtgtaaatattaactttgaggtcagttcacagtttgctgatattaggactgattttttttaagttatatttcatttaatagtggagcaccttaggaaaaaacaaatctctttatatatagaattaaatttgtgaacttttctgaagtacatttttatccttttaaatatgccacaacatctatcctgtaagtaaaataaatatttctaaatgtctaaagcagagaaatattataaattaattaaaatatttcctgaaaaacaaagtaaatcaatttctcaatttacattattcagataaaaatagctcaagaactagctaaacagtattagtgaaattgaaggtcaagagatgctagaaattagtcaactcaggtttatggaagatcttactatatactctgtaatattcaaaactatttctcggcttaattcactgatgaaattatggtattttggtagttggaattaccaactgtctgcaacagcatgaactgacaagaaaatagtgccctctatgagtaggagtacagaatgttatcttattaacaagaaccaggggacagtaggaatggacaacagcattggttagtggcacagaccaattcaaataatatattttgtgtgattttttttttccttaccagcagtttgttggtgaggcagaattaaatagggaagagaaatgcacattccctatctctgtccctgcagtttcattaaattctgaccaaattatgtgactcagcattctcagagaatagtctctgacaggtagcacttacaggagacagacccacaccttctagcatgtgattcttaaaactctgtgtgcagactggtgcccagctaaccacataaaatttaccaggggtgcttattaaaaatggaaattccaaaatcttacctccagagatgctatcttggtgggccctgagaacatcatgtttttgacgaagtcgcccaatgcctttctggcgtggtcaaaagcaagaagcacaatgcctttttgtgcttcttggttttgaccaagtcacccagatgattgtggtgcaatgcctttttgtgcttctgcctttagcgttggtttgcccagccagcaccagatcaggcagctctattagctgctgctatcagcacgtggatgttctctcctcttcgtaaatgagatctcctctactctcccaaaagtcccatattcttttgggactctttcttttgttagctcttgcttgtcaagaatggaatggggaaatcatttcctatggaggaagtttttctttggcttttggtaactgacagagtgaacagatttcttcgctgggtatgcactgtgccttctcccacctattccagagctgtcactcaggagcactgttcaaggccatcccctgccttccttgtgtagagggctttctgtgaccagcagacagtcaaagacatcgtatctatacacagatggcacattgatgaaaactactgatgtttgccacttattatttattcttttttcctaaatatttacaaaaattacttttctcttttgtatgccacatctgactatgtgtgttagtttttgttttttgtttgtttgtttgtttgttttttgagatggagtctcactctgtcaaccaggctggagtgcggtggcgtgatctcagctcactgcaaggtccgtctccttggttcatgccattctcctgcctcaacctcccaagtagctgggactacaggcacccgctaccacgccctgctaatttttttgtatttttagtagagacagagtttcactgtgttagccaggacggtctcgatctcctgacctcgtgatccacccacctctgcctcccaaagtgctgggattacaagcatgagccaccgcacctggccgtgtgttagtttttatatctatgttagtaccgcaaaaatgtctaagaaagcagacccttctaccaacactacaatgtctcatattgcaggaggcctcatagttaggaagacaactgttagcaaagcccttgtttctctcatgagccaccagtgtctggcatatctcaatgcactcttcatgatgctctaagctctaagttaggcctatggttgcattgaagctctaagttaggcctatgattaaagtcttctggctcataatgataaaagccattattgtaggcagttagaacctgttgaaggacagagacgtgatggattacagtctgagataatgtaagttgtttaaaaaagtgaaaataaaagaaaatcaaaactttgctttacctattcatttttaaaataaccaaggcataccccttttgctgtcttaagtttcagacaagggtgcaacttctacagtcattccttggtggctttacatgctttatttgccatgggccattaggtgctatgggtgttttcatccccactttggtgctttgtcaagacatcaagcatctccatgaatatactttaatctttcccttttttgtgttttgttttttaggtaagtacttttggtattcttcttccttaatgctgaaagaaaatgcagctgcctgatgtagaacaaatggcttttgaaagcaaaatccaaaagataaaaaataatgtgaacagtaaagaatgacaccataccagatactggtaagaattttaagtggcattcaaacacccctctctttttggagagaggactaacagtacaggaagatgcggggagggtggggagggattgttgccgtgcaagtaaaaagaaaattacagacagtgttcatgaaatattcatttacacctgcttattggttagatgaacagcctttggttctgagctggctcaccattcccaggctggaaattattcacttaaatgcagcttttaaacattttcttaaaatcctcaatggaaacagatgtgcacatgctgagggaacttttttttgatctttttctagaagagggttaaattagaaaaaaaaaccagtatttttaatatttaatttcatgtgtatagctatgaagctatatacttaaatgctttgtaacatatgatcatgaatatatgtataaacttcacccagaaaaatccataaagcttttgacaataaatgtgtataatctggataaatgaaataccagtgaactcaaacataatttatttcatgttttatgtcttctctttctcattttccatgtacaattcctgtgtacatatgaaataacatacaaaatacaattgtacgtatgcttcaatggcattttgcccaaattcatagtccttttttatatggccgtggatttcgagatttaaacatatatggtaaatagtatgtttctgttaacttcagcatagcccttttagtaacaagacattgtttactataaattgagattatctatccaatgtgagtaaatatattattaaaaatacattaacatttaagatgaacaaatagcaaaggttaaaaggtttcagagaccattacctgttactaaatcatttctctctcccatttactagtcttatctcattgagtttcctgctgtcctagaatgtcatccctctgtctctgctttatttagtttttgtctatattcaactcagaccctatatcatgtacaaagctttcctcaagtctttgaacacagactggtttattcctgccctaaaatcattttttaatagaatccatgtgttaattttctgaggctgccataacaaagtgccacagactgcaagcgtaaatagtaggaattgatttactgatagttctggaggctggaagtctgaagtcaagagagcagggttggtttcttctgaggcctctctcctcagcttgtagatggctgacttctctctattccttcacggggtctttcctctgtatgtgtctgtgtccttagctcctcttataacaacgtcacatttgattagggcccacacttatgacctcaacttaatcacctcctttaaaccctgtctccaaatatagtcatattctgaggtacgaggacttcaacgtacaaattttggaggtatatgtacgaggacttcaatgtatgaattttgggtataggattcaccccgtaacagcccatgttagtttctcacttcattattctctgattcttccatgtatattggttctatcttccctaacaagttcatcaaggataaggattgatcatatttcaagttttgtttacttcattcacagttcctagagggctggcatataatattaaatgctacatatttgttgtttgaaattactggaaaaagtagcataacaggaccaaatgagagcctctttttccaattattgctgactttagctcccttatctggacagaaaaaaacagtagcagaggtttgagtcaggcagtggtcaaatgaactgtctctgctttctttctgggaggcccaacagcattctcgtcagcaggagcattctggcgaaaggaaatgctgatctctgcaaatgggcaaaagtgtaaagagcattgaacccagcctcataccacagaaaacaatttgggcttgtggaaaataattacccagtgaagagtcttctgaactagaggcaggtttttggagggggaaatcataaacacatttgtggttgcaaggtagcagattgggtgagctgaaactaaaacaaattttggtttaagaaattgtattttaagttctgaagtcatacttaattcttaataattctaattgtacacacgctaatttaaatggaagatgtttacttcattaaaatttcaacactaaaatgctggttcagtttgttgtattactttcttcaggttttgttatattctatttttcataatttctagagccagcattcaaaagtaatttctgtgcttcaaaataggatcatcctaaattcaaattatatgtaaatgtcattgaatgcagatataaacatggtgccacaattttatagaaaattctaaaaaaacaaaacaaaacagaataaccatgttgctctcgtaccaaacgtgtctttgggtgggttactaagtccacctgagtctgagattctccatctgtaaaaaaggaatcagaatacctactttgggcagttgctgatattaaatttaaataagcaaagcagttagcccagtcatgtcaaaatagttgagcccaatgaatggtctttttctttatctctcttcaggttgaattttgcacagtagataatccatctatcacagaggtgtgcagatgtgactgattcattgattgaaacattcattgccccatttaaacaatgtttaggtattattatccactgtatcctggtttcatgctggatgttgggtaaataatgatgagaagaaacagacaactccaactttaatggagaaattgacattaaaagtctaaaaatatgtataaaattttaaaaaatcagtgttgtgtagtaaatatacacagtaccaggagattttataacagggagggtatgtgtaaaatgtcaggaaatatttctcctaggatgtaacaatgaggagagtttcagagtatgcatgtgtgcacatatgtgtatgtgcacatgtatggatatgtgttccaaaagtaatagtggttaaggtggtgatggtagtggtggtgtaggtggtgatggtggtaggagaagcaagagaatgaaataaataaaaagatgagtgtctgggaacagcatgtgcaaagtcctgatgtaggaaacagtactgaatggacagtacggtttaccaagggagggctggtgaggctgagatgaagagagctaacaggaagccagtaacttgagatgaggctagagaggagagcagaggccaactggagcaaaaccttatagacatattaggtcttctaccctaagaacaatgggaagccacctaattttaagagaaagcttaatggatgtgtgtgattcagtgcagggactgctaccgctcttaatcctcgaaatatcctgctaaccaggttggctttagtgggtggaaaagtgaggcccatacatattcaaatttgtattttgaaaagattttttttttgtcctccaatgcttttgccagaatatagaaattcaaagtatgtgtatttatagcaaatacgtagatgtttttcaccttataggtgtgtttttatcacattatttttgcacatatgattcctgcatgacccgagtgaaggggtgggttgcccctccacacctgtgggtgtttctcattaggtggaacgagagacttggaaaagaaaaagacacagagacaaagtatagagaaagaaataaggggacccagggaaccagcgttcagcgtatggaggatcccgccagcctctgagttcccttagtatttattgatcattcgtgggtgtttctctgagagggggatgtgtcagggtcacaaggcaatagtggggagagggtcagcagacaaacacgtgaacaaaggtctttgcatcatagacaaggtaaagaatcaagtgctgtgcttttagatatgcatacacataaacatctcaatgctttacaaagcagtattgctgcccgcatgtcccacctccagccttaaggcggtttttccctatctcagtagatggaacgtacaatcgggttttatagtgagacattccattgcccagggaggggcaggagacagatgccttcctcttgtctcaactgcaagaggcatgccttcctcttatactaatcctcctcagcacagaccctttacgggtgtcgggctgggggacggtcaggtctttcccttcccacgaggccatatttcagactatcacatggggagaaaccttgaacaatacctggctttcctaggcagaggtccctgcagccttccgcagtttttgtgtccctgggtacttgagattagggagtggtgatgactcttaaggagcatgctgccttcaagcatctgtttaacaaagcacatcttgcacaacccttaatccattcaaccctgagtttgacacagcacatatttcagagagcacggggttgggggtaaggtcacagattaacagaatctcaaggcagaagaatttttcttagtgcagaacaaaatggagtctcctatgtctacttctttctacacagacacagtgacaatctgatctctcttgcttttccccacacccgagatcttttaatattctaacatactcttatgttctaaatcagtgacacttagaaagaaatgttgacttgaacatccaagtacaggtgctaatttgacctagcagaaacattttttaaggaaatctctctgcactgagcacttgcattatctagcaatggaaaattcaaacaatagaatgattatcataaattcctttgaatacctttgttagcagagatgaaaccttggccacctggctttaagggaaagcttaatgagcatgtgattcagtgcggggactgttacctctcttaatcctagaaacatcatgggaaccaggtttgcatcagtaatgaatttttataatgtgaatctttgattttctttcgctggtaagaaaccttatttggagatgctatgtatgtgagtttaatctcattttccattccttcttgaagctttctaggttaaccacctgaaacagtggttactataatcagtaaagatttataaccaaagtataaggaattggggaatttccatatggtgtgtcctcacaaacaaacgtcatgtttcaatatgatatgaatgcatctccatccaaattattattttaactgtatatttttccctcagtcagcaatttatgtaacacatatatttcatttcatccaactcctaataagagacccctaaattaaccttgaactatgatttacaccttctcaatatacagtcaataattgaatttaatgactaaccaaggacattttagtcattgcaactgcttacaagattatatgtaaaggattcaggaataaatagaggggtctctcagtatgaagtttaaataaatacttaatgataaaagaaaaatttgtctgcagtttttttttttacaattaactttttacaagttattatccccttaggctcattccattctgctccctttgttttgaaacactgttatgacatactactgtcagtaatggaatgtcagaaaatagtacatatgaaagacacagttcattctactgttaaatattacatcattgaagggtttaaatcctaagacgtatctttgatttaccagcccagcccaacttcctatttgctctctgctccatttagtagatttcatgctggttgctggactaaacaagtcaaacacctgcaagggccctccatctgtggccagaaaagtgttgctggtggtatatttttgatgtttaggaagaaatattgatctgcttaactaagatggtcataagataatatggggttgtactcatctgattctcacaaaaccccagggtgctcagaactatactgatgtgttggagatgctacttaggaaattagaggaccagcatgcatgtcctttggaatgatgtatgccaccctatcatctgcttggccaacaacttgagccaagacacacctggggtatcttggtactacctagagaccctagctaattttgccagggtggattggtagaatccaaggaaatagttttgcaagtgacacaattggtggatgatataataagataatgaagactaaaataatttgaagaagggaaatggagataatttaggctaagttgttctatttgctattcttagaagtgttttcttcacatttagaagaagaacaattgattataaaatcactgctttgatgcattaatttgatcattctaaacaggtgatgaatattgtcttatgttatttgcctccattacttaatctgactatcatagaatagctaagaatacttcttaagaatgagagtttgcaactaccagtcacataggccagtatctgttaacaaaatgctagtaattttgttcattaaattttaaacattaaatctattattgcattaagacctattaaaatggacaataagtaagggccagatatatcatgagtagaaggagtccctttctactgagagcctatggaaaggacaactagattccagaaaaatctgttcaacttccaggatggcatactaggagaaataaattgggggtctaaagagtaataagcaggaaaaaaatctggttttctttgaggcaatgattagttgaagcctacacaaataaaccaattacaacattttgactgaactgagaataattacactggtagtcaactcctggggaaaaattatgaagttcaggctgtaagctgtctaggcttttattaacttgcattgttcttaactgattacaggcaaaaaggtcaaaacattttggcctacctaggtagccagatggtctagagataatttcttaattaccaaatgactgtgttttatagtgtcccttaggaaaccaagttttaaaactgtgtctaaagagaacctgatttaattttttgatgtttcttttatttttgcttgattatatattataatcattttgtaaaaaaaaatccaaacactacagaaatataacttagatgtttataatcttcgcttctctcttagataactatttctaagagtttttgtatacatatttagatttttgatacatgtaaatatatataatcttttttactaaaatggtaatttacaacatgcttttaaacaaacttttttttttacctaaaatttcttagctatttatgtcagtacatgttgctctatgaagttgtaaacagaacaaagcagcgtgctccccaagaggactcttagatatttgaaagtagcccataatggtaaagtaaattcattcctgactttgcttgaggaaactaacatcctctccatcctgccttgaggacaagtgtgttccttcatggctgacacatatcttggcagagcacatgtgctgcaacagcacacagtatggggtaggaacaggatttgagtgatttactaatcaagtgttggctagaagagaggagacttgtaccaccccgaccctgcatcatgcctcttgctctcctctttagggtgaatgtaaaggggaatctgcccagttggggtacagataaaccttttggttaccagactgttggggtttagatgtcaactctttataggaattgtctaggaaagtcagctgtccaggcttggagaccttaaggaagcatggaaagctgcagctccctttttccaggaaaaggcagtcacccgtcttcttggaagctgtatttcagggaggcctctccagatgggctgggggacactgccaactgttagcatattgtccagacgacccagcatgagctatctaggtcatgttcagacagtaccactcatggtgttctcttgcttaaatcattgttcctgagtagccttgaatagtaacaaatgtgatatcttgacatcatctggtggttgggtgacaactgtttaattttctaacacagttggtttctgcaatgccttttcccaagtaatttagtattgtcttatcctgctatgtcttccacaaagggaagatgataaaatctttttaattagcataatgtttgtctactttaattttacattaaaaatttgttatacttttattaaaatactttcacagtaaagttttaatccattttcctatggatttttcattttgtaatatttctttcccatttataatcatataacatatacatttaataaaagtatatacaatatatatcaagcatatatggtatatatactataattttgtctgttttctactttctttctacttatgtctattttctgtattttttccatatggacatcatttttcacatttaatgtcttcttaacattacagggcagttctaattgttagaaggcctccttatactgatggctagtttgactcattataaagtcagttattgttcttggttttatgtcttaacaaggcatcccctcctcgaaccttagaggaattgatatctgacttcacatgctctaggggatgccatgtaaaattttgtagaaatgtttagtattctggcatgtgtgtctctaactttgtcagatgattagagatctgtgattagttaacaaccacacaggactgaattagcttccttccgtaactaaaagaattgaacagattgagtaaattaagtggatgcctcattagctccacaaagtttattagaattagagtcaaaatctaatacagggctttggactactaatatctgctagctacctttgggatgatttcagtatcataggatcatctgaccaaacaagctgtctcaaattcctgttagagtgaaaccttggctggacattagcttcacctgggtaatattaaaatactgatacctggccccagcctggagagattttgattctattaaattgccagagttagggttcaaggcaaggtacatccagagttgacaaccactggatttgaagccaaaatgtatagaatgtgaaacaggtaagcactgttggaactaccgagatagagacaaacacattccaggcactagcctctgcttctgtcttttctgatgtaagaatatttcgcctctcagaaagttgcttcccaaatgaatacttttaaaaattaacctggttttttcagtacataagacagggtaaggagaaaaagttcacctggtttttaaaaacactattgtttaaactttaacagaattatcttctcaaaatacttagaaatggagtaaatgtttctgctttgataacactgaaaccaaagctagagagtacagttaaaagggccattaaaaacagtttttattctataaaaataaattaatcatcgaatattcattataaattcaatcatgaaggaaaatacacattaaattatttatactaagataaatataaacctctattggcaaacaacttcgtagttaatttttctaatttaccactttctgcatctcatgcaaattatgtcttcttgcattgccaataaaatatgagattggggaaggatgctgcaatatccatgagaaagtttcatgtaagtgcaagcaatcagatttcattgcagatccagagtagtaacactgacagaactatgtcagttaagctttctgcattatttttatgcgttgtcattttcttttggcagaggagagattgaggatttacctggtccagaaatcgttgtaggttaacaaggtaccaatctgggtttgtttttatccccttgcttaaccaatcgtacagttaattcccaaaatgtgttattttttaacatgcaaagcagttcaacaacgatagaaggtgtagggattccagccacagacagagcctgagagaacaaacaaagcagattcagaaagcaggcaagtagcgcctactttgtttcagtggtatgtcctctgcagttcaaaatccttcagtatctcttaattaattcatagactatttccagtgaggtttcactgagaattccttaatgtcaagagctctctctgtatcttaagcagttagtgtcattgaaatttacttatgcaatgattctttcaccaaatatgtattgaaggcttatgatgtgcaagacatgtcccaagttctggtaatacaatgatgaacaaaattaatagtttctttctacacagtttttggtttatcaaatttattacatgtttaataaatgttcattaagtgcataaatagtaaaagaatcaaagatgtgatttcagcactatgtatcaaaaccacagaatggctgagtgttctttttaaatccatgtatcatagtgtattagaaggcaaaataataagaaagcagatcagaagtcaatatggtccagtaacaagaataaggagtcagattagagtcacattaacggttcacattttcctagctgtgggactgtaggtcgttattttcttgtcttattttgtctttctgtttttctttctttcttttctttttctttttttttagacagagtttcactcttgttgcccaggctggaatgcaatggcacaaactcagctcactgcaaactccgtttcctgggttcaagcgattttcctgcctcagcctcccaaagtagctgggattacaagcgcccaccaccatgcccagccatttttattttgtatttttacttgagatggggtttcaccatgttggccaggctggtcttgagcttctgacctcaggtgatccacctgcctcggcctcccaaagtgctgggattacagacgtgaattctataggtctcatttgcaccatctgcaaatgtgaacaatggtattgtgttcatttacccattcagccaacttttcctgaacatctcttaagtatagggttcagagatatggtaggttgggtttcagatgaccaaaataaagtgaatattccaataaagtgagtcacacacattttggttttccagtacatacaaaagttatgtttacactatagtctattaagtattcaatagcatgtctagaagacaacgtgcataccttaattttaaaatattgccttgctaaaaagtgcttatgatcatctgagccttcagcaagtagtaatctttttgctggtgggaagtcttgccttgacgttgatggctactgattgatcagggtggcggttgctgaaggtcagagaagctgtagcaatttcttaaaaccaggcaacaataaagtttaccacatttattgacttttctcttcataaaagacttctctgcaacatgtaatatactgtttgataggattttaccgaatgtagaactttcaaaattggagacaatcctctgaaacccaactgctgctgtatcagctaagtttatataatattttaaatcttttattgtcatttcaacaatttttatagcatctttaccattagtagatttcatcttgagaaaccactttctttgctcatctataagaagtaactgctcatctctttgttgctgagattgcagcaattcagtcacatcttcaggctccacttccaatgcttgttctcttgctatttctaccatatctgcagttaattccttcacttgaacccttcaaagttatccatgagggttggaatcaacttttctcaaactcctggtaatgttgatattttgacctcctcccatgaatcatgaatgttcttaatggcatctagaatggtgactcctatccagatttttaattttctttatccatatacatcagaagaatcactgtagaaagtagccttcccaaatgtatttcttaaataataagacttgaaatactctttgaatcatggctgcagaaagaatgttgtgttaagcataaaaacaacatgaatcttgtgtattgtattagtctgttttcatgctgttgataaagaaatacccgagactgggaagaaaaagaggtttaatggactcagctccacatggctaggaaggactcacagtcatggcggagggcaaggaggagcaagtcacatcttacatggatggcagcaagcaaagagagagcttgtgcagggaaactcccatttttaaagccatcagatcttatgagactcatttactatcaggagaatagcacaggaaagagctgcccccataattgaatcacctcccactgggtttcccccacgacacatgggaattgttggagttataattcaggatgagatttggatggggacacagccaaaccatatcattccacccctggtacctcccaaatctcatatcctcacatttcaaaaccaatcatgcctccccaacagtctcccaaagtcttaactcatttcagcattatctcaaaagtccacagtcctacatctcatctgagacaaggggagtcccttctacctatgagcctgtaaaatcaaaagtaagttagttacttcctagatacaatgggggtacaggcattgggtaaataccattccaaatggaagaaattggccaaaacaaaggggccataggccccatgcaagtccaaaatccagcagggcagtcaaatcttaaagctccaaaatgatctcctttaactccatgtctcacatttgggtcatgttaacgcaaagggtgggttcccatggtcttgggcggctccacccctgtggctctgcagggtgcagcctccttcctggctgttttcacaggctggtgttgagtgtctgctgcttttccacacatggcgcaaactgtcagtggacctaccattctggcatctggaggatggtagccctcttctaacagctccactagacagtgccctagtagggactctgtgtgggggctccaaccccacatttcccttccacagtgccatagcagaggttctccatgagggccctgccactgcagcaaacttttgcctgagcatcctggcatttccatacatcctatgaaatctaggcagaggttcccaaacctcaattcttgacttctgtgcacctgcaggctcaacaccacatggaagttgccaagcttggggtttgcaccctctgaatccatggcctgagctgtaccttggccacttttagtcacagctgaagtggctgggacacagggcaccaagtccctagcctgtacacagcatggtgaccctgggcctgacccatgaaaccatttttttcctcctaggcctccaggcctgtgatgagaggggctgccatgaagacctcagacatgctctggagacattttcctcgttgtcttggggttaacaattggttccccgttacttgtgcagatttctgcagctggcttgaatttctccacagaaaatgggattttcttttctatcgcattgtcaggctgcaaattttccaaacttttgtgctctgcttcccttataaaactgaatgcctttaacggcacccaagtcacctcttgaatgctttgctgcttagaaatttcttccaccaaataccctaagtcacctccctcaagttcaaagttccacagatctctagggcaggggtaaaatgccagcagtctgtttgctaaaacataacaagagtcacttttgctccagttcccaaaaagttcctcatctccatctgagaccacctcagcctggaccttattgttcatatcactgtcagcatttttgtcaaagccactcaacatgtctctaggaagtttcaaactttcccacattttcctgtcttcttctaagccctcctaactgttccaacctctgcctgttatccagttccaaagtcacttccacactttcaggtatcttttcggcactgcaccactctactggtaccagtttactctattagtctgttttcatgctcctgataaagacatacctgagactggggagaaaaagaggtttaataggcttacaattccacagggctggggaggcctcacaatcatggcggaaggctaggaggagcaagtcacgtcttacatggatggcggcaggcaaagagagagcttatgcagggaaacttctgtttttaaaaccatcagattttgtaagactcatttactatcatgagaatgctgcaggaaagacctgtcccccataattcaatcacctcctaccaggtttctcccacgacatgtgggaattgtgggagttacaatcaagatgagatttgggtggcgacacagccaaaccatatcatgtatccatcagaactcttggatgaccaggtgcactgtcaatgagcagtaatatatttttaaaaatctttatataagagcagtagttctcaacagtgtgcttaaaatatctagtaaatcatgctgtcaacagatgtgctgccatctaggctttgctgtttcaggcacaagcacaggcagaatagatttggtgtaattctgaatggccccaggattattagactggtaaatgaacattggcttcaacttaaagccctcagctgcattagcccctaacaagaggatcagcctgtcttttgaatctttgaagccaaacattgacttattctttctagttgtgaaagtgctaaatggcatcttcttccaataaaagtttgttttgtctacatttgaaatttgttgtttaatgtagtttcaatgatcttctggataacttcctatagctttgatatcagcacttgctgcttcactttgcatttttgtgttgtggagatggcattttccttaaacctcatgagacagtctctgctggcttcaaccttttcttctgcagcttcctcatctctatcaatctttatagaattgaagagagttaaggccttgttctgaattaggcttttcttaagggaatgttgtggctggtttgatcttctatccagactactcaaactttctccacttcagcaacaaggctgtttcaatttcttatcatttgtattcactggagtagcactttttatttccttcaagaatattacttttgcattcacaacttggctgtttggtacaagaggcctagctttctgtctgtcttgacttttgacatgccttactaagcaagcttaatcttttctagctttttatttaaagtaagagatgtgctgctcttcacctcacttgaacacttagaggtcattgtattaattgacctaatctcaatattgctgtgtctcagggatggggaggactgaggagaaagagagagatagggaatggccagttggtggagcagtcagaacacccattaattgagtttgccatcttatataggcatggcttatggtactcctaaacaattacaatagtaacatcaacaatcagcaattacagatcaccataataggtattaaaataattttaaaagtttgaaatattgcaagaattatcaaaatgtgatacagagacatgaagtgagcacatgctgttagaaaaatggtacccatagacttgctctacacaaggttgccacaaaccattttgttaaaaaaaaaaaaaaagccatctctgcaaagcacaacaaaacaaagcacaataaaatgagatatgcctgtttcagtcactttgctatttaaaagagaaaatctgttaagccatagtccttgtcctcatgattcttacagtttggactggaagaaaatctttaggagtaaagacattaaatgtgatgaatgtttttgtgttggccttttacctatttattctcagaccacatattgccctttctctgccctttatagttggaggctacgctctgaaggctgtggtctcaagacttccatgtcctttgttagatagatgtagcacattggaggcactggtggacatttggggagaggcagaaagagagaagccagagtgttttactctctctacctgaggcagcacctcaggcagtagctgtgtctcctccatggcttcacccttagctaggtgaccctaatccttgcatacatcagccctcctttttagctctagtccaggggcggtagttgcttcctgttgtttctaacccctaagttgcctcacagtcccctatttggcatttcaactcttccatcaccagtgcaatgaatcagatctattaaatacactacttttaaaatgcatagagtgtttcttttagcttagtcggaagctgtttgataaagccttgataggagtggcagaggcggatcttatgttagaagtagtcaatgaaggtttactgagaaagtaaaatttaggctaaaacctcaagtgtgaatataaatgtatcaatggagaggggaagaatattctagatcagaagtgtccaatcttctgtcttccctgggccacaatggaagaattgtcttgggctacacagaaaatacactaacaatagctgatgaactaaaaaaaagaatcacaaacaaaaaatctcaatgttttaagaaagtttaccagtttgtgttgggccacattcaaggccgtcctgggcctcatggattggacaaggtttttctagatcatgtgcaatgggaaggaaaatgaggcatattttagaaactaaagatgtagacaactggaatgtgacatacaagagaaagaaggtcaagaatgtttgagggctgtcaagctcattggaagacattacagtggaatgacatgggcatttgtgttttttaaagtcagtggctgcattgtatagaattacttgggatgcaagcagggaaccatttagaagattattacagacagcggtgttggtatggagcagaatgatagcagaggcaatggaggaaagtgagcttatctgagagatagaggtaggaggtggagtctgcatgtcttggtaattgagagactctgtgaaacaagattgaggaaagggttaggattattttcaggattcaaaacagagcaactgggtagctgaggttctaatcacagtgagaaggaatattggagaaggaagagttccatggttgaacttcaggtatatgtcggttatccccagggagagctgtccaggagtcaggtgcgctgtatgtgtctggagctcaggaggcagatgcagaccaaagaaattgatggggagctatccatctacagatggtcatagaagttatttgagtcaataaaatcaactaaagggggtgcaagattaggagaacaagagagtcctgtctcaagcctaagaactgccaatatttgaagacaaagctgaaatgaaagacatgaacagagacttaagaagaaaaccaagaaagttaggtgctatggaagccaaaggaaaggagtgtttcagaaaggagggagtggccaatagcttcagaaatgttcattggtttagtgaaacacaagtcagttggtgacccaatgggagaaatttccatatagtaggagcataaaccagattgaagtgggttgaggtgtaagtacaaagggagaatcaagatagtgaatataaacaaaattatttcaagaaattatgctcagagtgaggaggaggtaagaagtatctggatagggaagtaggaattgagagggatcttattttgtacagtgaaaaataagtgcttatggaaaagatttggtaaagaggaggaaaagagtaagggaaaaatggatgaagctgcgtatcagagaatgtgagaaggacaaagaaccaaagcacaggtggaaggatttgcccgagttggtaacaggagggaaaatggaaatgatgactgtgggagtagatgtgtttgtcattttgatggctggacatggagaatgttcctttttgatggttactattttctctttgagtaggaatatcatctgctgtgtgtgggaagtggggactcaagtatttgagaagaaagaagaaggacgtttgctgtagtctttgcagaaaatgaaagtgatttgattaatagttgttagaatttaaaaatgtgtgcacagtgtttgggttaaagttgtttttaaaaaaccagccaccttgccttttattctttatgctgtgaaacctctttagagcactcagtcaccttttggccactagatggacacagtgtactcagtgctaaactgctgacccaccaggttccttttgttaccagccaatactgacagagtgattgagttgtgaacttattgttatgaattgaaacttattttagagaaaaaatcttaaataacacattccatcttacttatagttcataggtcagagaaagactgtggtgctacaaaaacattagccaatatattatttgctttcacgctaagtgtaatgtgtgtaacatgctatctctttgaaattttttgccttaaaaatgctaatcagttggcacaaggcgatcatttacatagtcagaatagagcttttggtttagcattttatcttaaaataaggcagaaatggcattgctctggatgtcagtatggtgcattataacccaagtggtggaaaaataactgctaaatggcaaacacatagaaactgaattctgctagtcagcttccatttggtagagatatgtgtgcccttgggtagctgcaatgttagctattattaatagttcaaatctttgcttcataaaagttctgcatatagtgttgtacaaattgaagtgattcaaggaaatcatagttctgtggagcttcctccctgttttgtagtggagattgggaatgggggtggaccataaagtaggtggttttttttttcctgccactcttaactaattacacaccctgccatatcccccaccaacataagacttcagactgagaaaacctacataatttaaccaatgttagaatataggcatttttaacgtgctgaaaacagtgttgttcttttggttcctaaactaaaatcatttgatacatttctctgtcctatgaaggaagccatgaatgctatgagtaaagatatttgtggcaggtaagaagagggagttaagtaagggagtttaatatgaaaaattcatataaaggctccaaggttaaataaggaatacttttgcacaatgggttcaaggttttactgggtagagcatttttaaagttttataacgacgttagaaggaatcgatttgggagaaaaactatatctgcttaatgtgagggagcactgtggaaaatttccagcacaaacttttcctgggcctcaacatttcttggtaatgaacctagatttggagtgatcaaataatttgctgtctcaagtagtaaaagggggactattactaacttcacaagaagacaggcataaacccagcaacatgtacaaagcaggatgatctcaggtaactcaggaagatgctggaacactctgggtgaagggcattaatgctgttcacagtggaacacaggactgctaatggtatttttatgcttttatgcatcaaaagcattgttctttgatttgtaatctctcacatatgtgaagcagggcctttcaatctggatttggggtcagaagacaacatgtggatgggaggcagaaaattataacagactcacctggggagcagttttttgttgttgttgatattccctagctgctgggaatggtggctcactcctgtaatcccagtgctttgggaggccaaggcgggaggatcacttgagcccagaagttcaagactagcctaggcaacttagcaagaccccatctctacaaaatttaaaaaaatattagctgggcatggtggcatacacctgtagtatcagctactcaggaggctgaaatgggaggatcgtgtgagtcctgaagtcaaggttgcagcgattgtgccactgcactctagcctggatgtccttccacctcccccgccaaaaagggatattccaaaactacaacattctactacattattctacattcttcctttttactctccatattgatacagaaacaaaacaaaacacatttgagacttaccactgcaaaagagtgttctttgaattgtggctgcaattatttctgttgcaaactttagtgtattattgttataatgatacttgaagtaatacccagatgtattgaaaattcaaaagacttcattgccagctcaacctgcactctcaagcactgcttactaagggagtaacaatgggaagagacaggtgtgagaacagaccccagagccagggaaatgaacatggagaagggaaataggcaaaatctcctcatcagtgtggttgagggaatattggggcatggcatggagagtcccacctcacttggcagccagagaatcttaaagcttattgtcaaaaaccttatgaaaggttagagaaggtaccattttattttacaaaatactttagcctttaccagctcaacatccgtgtgtcagcctgctttgaataaagaaatacacgtcttcttaaaatctgcccctgactacgatgagcttctttgtttcagcttattttgactaattaggctgaggttacaaaccaccctgatatttcagttgctacagccacagtcttatttcttgctctcattacttgttcttggctggatgatattgatatgttcgttttgttctggaaccaaccctaaatgagctgcccatcctgagaaggcagaagaaattgggagatggcaggggcacacagtgattttttaaaacttctgtttagaaatgccacagatctcttccatgcacatgccattggccaaagtgggttgcaagatcagcttggtgtcagtggggcaggaagtataatcctggcacaataatgggcttggaaagctgttaaacatttttacaataacacaatcagattctttcaaattaattacaaaagtacttaaagttttttacatacattctgtgcactgtcccaaagctatatctaatgttacttcctcattccgatgaattactattccttttcttcttagctgtgtttaaaagcccatacatctatcctgtgataatttgtacactgtattgtgcttggtttacttgtctctctccttccctcagtggtgggcccttggagggcaggagcaatgtgatattcatccatgagacccaagtgtgtgattggtgcacaatggacaccctaaaaagtgtttattgataattaatgaattaatagctaaatgagggagtgttttctttaccttccctacactcaccttttctccattccagcaagcaatcttgcacatggagtagaaatcacagtggaatcttgaagaataactagaaggttaccagatgagaaagtacagggaggtaaatcagggaagaacagctgatagattcagttgtagccatgttgagtgaaggtaagattcttggattttgcttcatgaactcgaaagtctacataacatcaatcttggccactgccaagtctgacccatctcacagcaccagaggattggggtagtaaactgcagatgtagcacccacaggctgaccagtctgaccctcattaggttccccaaaaatcaaatctctaatgcacctgcatggatgctgcaaaggaatgtgcactaaaggaatgtgaaagcgataactatttttcattatttctgatgagacattttagcaattatgttaaaatctgcacaaccaaaaagtctaaacagagcgtgaacctctgacattgactctggaaattacacacattttgttttactattttaaaaacacacatgaaccgaagagaaaagaggcagaaagactggctagaacacagcagaacttacccattaatgtaatggagtttgagcctttctcaatgatgcctgtggggagctccgtactagtaatatctcaaggatattgccattgttcaaacatttcagggattcccctcttgaacttaccttcaaaagagcctttgctacatgtttttgaaattcattgatgacaaatctccatctgttgaaggtttatctagttctatgaagctgccaaaagtcctttggcattaagcctgatgattaaagttgatgatccagttagcgaatgctattttgagtcaaaatgagaagtaactataaaattaagaggcagttttcttatgcacactggaagtgccctgtaatgataattcccaaagagaatgtcaaaaatgtctttaatcctaatagaattcactatatttttttcattgaaataaatatttaggaaacattggtttgaatttgcatatggtatacatgtttgaagaatcactcttgttactatataggtaacacttataagtgttaaaattatcaagttacttaagtacttataatgaatataaataaaatgatccattgatatttgtctatatatttttatacataaaagattgtatatgttatataatatatgtgtatacatatagcacaatgaccaaattaaattgtctttgcagctatttttaattaaaacattttcacattacgctttcttaaacaattgcctctgttatatcagaagccaaaactggcaaattatattagctcagttatttagttactggggactctatctttaaaccaaccatgggaattcatttatagctactcaacactcaggtatgtatgaccatggggcagacaaaagactgctttaaaaatcactgatgtgtatcatgctttttcttcttctttagtatttctagccatcaaaaagaaattatattgtgaggcagatggcagtaatatatttttcaaaagtgaattatatcctgtttccccatataggtaggtaaataaataaataaataaattctatataagcaacatgacataattcccagactatgaatttctgctaatctgaagcatttgattaagactggatttaaactatgcttacaagttgccggaaactactcaaaaaggctacattctgttaactgtgttatttttgtctgtattatgtcaaataattttgactaaatcattggtattatcaaggtcatgtagaagtcttcttaaattctgattaaataatcgactttctttacaactacagacaaattgcaacagaatctgtattttcaggcagttcagcctgcatagggtcaatttaataccatataaatgttgggaacagaattatcagaaacttcagatatgtcaccataagccagatgaacaatatatgtcagtaccattgggggagtatttgccagcataaactggatatgtttcttgaatgcatgaaaaatgtggtactgaatgattcttccttcactaaaattgacttatttatcttgatttaaatataggcatacattggtaaataaaacctaggttttttcataatatattagagaatttttgatacataacaaatgaggtaattccagatcgattggaattcaggtttagtgcttcgtaaagagttgaaaatagttcctggtaggtaagtaaattgtggtgggaaggacaggacattctctaaaagtgcttggttttagagatgttttggttaagagtttgaccaggtggtagcagatttactttttcctaactcagttttacttgaaaggccttcagattaaatacttacagaaccaggaagaaatgtatctgagttacagaacttgaatggggattgtcaaactggagaatgcttgccccatctgaaggagatagctggcaatatgtagggaggggaactctaggtatttttgtttgtttgtttgtttgtttttgaggcggactctcgctgtcacccaggctggagtgcagtggggcgatctcggctcactgcaagctccgcctcccaggttcatgccattctcctgcctcagcctccggagtagctgggactacaggcacctgacatcacgcccggctaattttttgtgtttttagtagagacggggtttcaccgtgttagccaggatggtctcgttctcctgacctcgtgatccgcccgcctcggcctcccaaagtgctgagattacaggcgtgagccaccgcgcccgactgggaactgaaggttttaaacctcctaaacattcaaaagaagcccaaatctcaactttaatgtgacattttctgtgtgctttaaatgttggatcaaaaggaaaaacaaaattaaaaatatgttggacaaactcaggcctgctgtccatatttgatccaaggaggaccaatttacccactctatcctacacctttcaggtcatagcattttcctttgttatctttcggcattaatgtcatattccaatttttccatatctatgagcaaggcccaaggtctgtagccaagcccagggtttgcatgtgatatctttagaaaaaccccagagaagctttctcttgttttctcactatgctgtaagtatgaatagcccaaagcaaaaaagacaagtaccctgactatcatgatcttctaagtattcatggagctcgctaaaattatagttccctgtgaagagcgtgtcgttgcagaaaagcactggagagtgggcttagataccttcctgtttgatctcaatagtttaatgtttactagctcactgagaagagactgccaccttagtgttaccctcttgtaccaccctaaacaagtcatttatttctcttgttttctctctttaaaaaaatttccatatgaaattctgtgattttttttcccctcattacctattttctatcatcattgtatccaaaaggtcaagagagagaaaaggccacttctccattgactggttatctcttagactgtatgacagcaaaaatataagcaagggttaaatttcaaatgcatccactctgctcatacacatttgtgatttaaaaaacacacttcattgaataatttaaaatatggttgtaccatctgttcttgtggggattaacattgttcatgatggcaaaataatcacgttaaataaattctagatactgcactcttattattaataatagcaatgatattgttagttcagatgacccggccttttctgtctccatataatcacactattgattttccagtattggaaaggagaacgagagagtacatgcttttatttctaaatggaacatgctgttcaggaattctgccatttcttttatggaaataaaaaataaagtgcaaacatatgccatctttgaaggtaacattatgtaagcctttgagtataacatttgctgtctttatctatttctttgtgtctattcataagaaaaatgatcagattgtcaaattcatattctagaaactacgcaatcaattttttttcaggcattctgtcgtctgcctggaatgagattagcaaaagagtcgttgtgtaaactgaattagtttacttcatgcgagcattgattttacattccctgaactcttataacattttatgtttgagccacacagtaggtactatctcacattgactgagaatttattgtgtttaagtcatttcttctaaaaagtattgtaagctttgtgaggacaggggccattttatttttctcttgtatctgttgaaatttcccactctgctgggtttttctaaggtcaaaataaattagaattaagtgattgactttttaatgttgtatagtggtgggaaaaggttaaaaagagttgcttttcgtagcaagatggtatgggccaatgacttctaccaacaactaattcggtgatataaatgatatactcttagcttgggcttttcctctgtgaacttctatggcaattgggtgtggacaaatgggtccttgaagatattttgaaaatttccccaacaagaacccagtgcttaatgaccctctactgccaggtaaccttcctaggttgctgcacctattccctctgcttttctttaaaatcacatacttttatatttcctaagagaaggtagaatgtaataggcatcattaatttttgcagaaagtctccaaaacatgttgttaaatcaccgctgtcttcttacctccaggcaaaaaggtaccaacttatttaaatatttgttcactcacattatgtgctcctgtgaattttctctgggtgtcactcttcacagtgagtatgagctctcatttaatctctttcaagggaaaatgagctcaaagaccctgatgttgcaacttgacctccttgagtttgtattaagctgttaacttgctgatttgtccctagtttatctattatgaaaacttggatgttgtcaaaccacattttcattccccagtctgtgttcactatttgatgttccccacaagttacactgccttggtctcaactaaattggttttctatattacaaagtcaatttaatatctgaatgatcttccaagatactgcctataatttcttttacttctctctcacaaagccttatctttcattaataaaaaatggtcccaaagcccattgttatcatttgcatttcccactttacacaaaactagccataatctcactatcacttgtctggtaactcaggaatatgctgtataaatagtgtattttttattttggtaaaatatttgcaaaagtatcttgtggtagctataatggatgtgtgaattggataaaaatactattaagtgtgttttttcctagttgaacaacatagataaagaatactgagtaaagactaaatatttgcctggatggaagaccgttcatccaatcaaacaaatatacagaaacataaagagatagtaaatacactggaatgcaaagtcagagtcaatagttatttaagcttgctaataaaaatgactgcaatttcaagtgcacagttaattagaattggatggtagaggcccaagggtgatggcatgtaaatgaagaatatgtgaggaattctgtcttaagccttattcatagatgtacagcagagaaattaagctgactgacattctgtgccctgcaatcgtcatatcacacctggggtgtgggattcatttcagataccacaggttaagaggaaatcaacaaggagcaatcagtccagaagggtgttgccaggatggtgaagcatctgggaatcatgatgtcttcggaactgccaaaagaaccgagactgatgtggcctggaaaagggagagaataaaaactcctgtttagataatctgaggttttcatattaaaaagattcagggccaggtgcagtggctcacgcctgtaatcgcagcactttgggaggccaaggcaggtgtatcgctggagtccaggagttcaggaccagcctgggcaacatggtgaatcactgtctctcctaaaaatttttaaaaaattagcttgtgcagtggcccatacctgtaattccagctactcaggaggctgagctgggaggattgctggagcccaggctgtggaggctgcaatgagccgagatcacactactgcacttctgcctgggtgacagagtgagaccctgcttctaaataaataaataagactcaggcttgtttttgaatgactatgatcaaagaatagcacttttagaaaggtgaaatttagtttgatacaaagaacttttcaatatttaaatcttcaaacttttcaatatttaaattttcgatatttaaatctgctcaaagataagcatttaaatctgctcaaagataagcataccatgaagcagggctcctcatgccagaaccagatatttgtttttccttcaaggctgttcatgcattaggggaagactgaatttcccatggcttctaatgaaccttttaactatgaggatctgttacatgaaaattttttttttcaagatggagtttcgcatttgttgcccaggctggagtgcagtggtgcaacctcggctcaccacaacctccgcctcccaggttcaagcaattctcctgcctcagcctcctgaatagctggcattagaggcatacaccactatgcacagctaattttgtattttcagtagagatggggtttccccatgttggtcaggatggtcttgaactcccaacctcagatgatctgcccgcctcagcctccccaagtgctgggattataggtgtgagccaccgcgaccagtgttacatgaaaaattcttagaatagtgcttgatggcaccaagtaaatgttcaatagatattagttgtaattgttatcagtagtgactattctatgcatttgtaactgattattttttggatgggaataagtaaaggtgtttaaaatgttagcaccggtttctgttgctaaataattaaggtagttagtaaggtcttaggctacttgtaactaatttactcttaatttgtcaccactttatgttttccattattgcctttacattctatgttacctagatttgggattaattcatcaaatttaatatgaaaactttaagtgactgctaaatcacaattgcatatattaaattatctagtgataacgtagcaatagtctatcaagaaaggaatgaatcatgaccgaaaaaatgaatctctttcattaattaagagagatgtttcagtttagaaacttacagaatcttaatggttaagctctaggtgacgttagcttcattggattattttctcaggtgacagatttgctacatcttaggatggcagctaatatctattgaaggtattcattcattcactcacttcctaatttatttaacaagcagtgtaccaaccactgcccatgcctgcacctagctgcttacctctacagagtgttttctacccttttatccctttttgagtcagtcatcacaggaagaccagcctctcagtcatcctatgtcccctatatcccaaccccaagggctccatggcagcaaagcagtccctcttctcaccccatccctgaactccttgggctccttccctgctgtattttcctctgtatcagttatcatttctcttatatattttacttactatgtccatttacctatctctactggaatgtcagctccataaaggcaggaatatttgcatgtgttctatttgctactgggtacccagagcctagaatagtaacttgataaatatttgttgaatgagtgaataaggcctaagtgtcatggaaactgataccagaaaggtgttatttcttccccagggttaccgaagccatttatggcagcgcagcattgtgacccaaagtcacttggctctgaaaccaacatccccattcttttttttttttttttttttgacagagtcttgctctgtcacccaggttggagtgcagtggcacgatcttcactcactgcaacctctggctcccagggttcaagcaattctcctgcctcagcctccgaggtagctgggattacaggtgtgtgccaccatgcacagctaatttttgtatttttggtagagacgaggtttcaccatggtggtcaagctggtctcgaattcctgacctcaagtaatccacccacgtcggcttcccaaagtgctgggattacagatgtgagccactgcacccagccccaacatattcattcttgatctctccctgcaagcaaataactttgaaattatgctgaataaactcagggatctagagatatttgacaatgacaatgatatttcactgctgtatggatttaaatacaaggagacaacttttgtatcatttacatttaggagaacattcaggtcaatatttgcctgcctaatttatctccatgtggatcacttttgtttcttttctagatgtattcaatctgatttagtttattatgagtttctctattatttgtttttttttccttggatcattgatgcagaccctagaagaggtggagtacagaaatagatttggagaagcaataatgagtaagcctcagtctttgcctctgagatgcattcagaagtggttgaggcaacattgtaagtgtgcagttccagagccagaagataaccagataatttataatccaagcaataatattgcaaaagtaaaaggaggcactatttaatcatcattccagggcaatagctgtatactattcagacaaactgaagagtaaagtcccctagtttaaaaactcgacaaacgtaaaatatgcttgcacatctttttagtaataaatatttaccttgcatctactattttcagagacacatactaggcactgtagcaatatatatagaacagtgtacagggcactgtggtgaatttaaagacaagtcatatatcttcctatcttgtggttcagaattcactttaggacagagaacattaaaaatacaataaaaagcagtaaatgatggtgcaagctgaattaagcttgatgtgatgttagccagccacaaggtttccaacagaattactgatatgatttggctgtgtacccacccatatctcatcttgaatcctagttcccattgaattatagttcatttctataattcctatagttccaattttatagttcagccaacaatccccatgtgttgtgggagggacccggtgggaggtaactgaatcataggagcagtttcccccatgcagctgtcgtgatagtgagtttctcatgagatctgctggttttataagcttctagtgtttcccctgctggcactcattctctctcctgccaccctgtgaagaggtgccttctgccatgattgtaagtttcctgaggcttccccagccatgcaaaactgtgagtcaattaaacctcttttctttataaattacccagtctcaggcatttcttcatagcagcatgagaacagactaatacgctgatgctgtaccacttttatttctatctcataatattgtcaattgaaatcagtcctgtcttgatgcatgaattgcacatcaaatgaattgtatgctttttttttttcctagataggagttatgccatctacttcttgtgtgtatacatagtacatgctcaattaatgctggctggctggttggggtagaaaaatgaattgatagatttaaaaaagtcatctggcaaccaaatatagagccttgtttgccaaagacccctcctctttgctgaactagctagttgacagagtaagaacttgcagcatgattattttttatcttacaactttataatgatacatttggttatttggaaataagtttaaagtgttttaattctttccactggttcctactgttggaaattcttttgcagctgaatattggcaaccgtttgtatcttggcaagtagactatgctttttaaggatgaaagtgtgggaagtagtataggacatctgtcgaagaagtcatgttgtcaaagcctgttgtgtatattaaactcatttgtttccatttctatacattctaaagcaaaatgccactccatttaacattcaaacagcttataaagagcttggaaatatgaattgtgtgggcctacctgaaatttcaatgaatgagcatcattttattcagttggttttgttgctgctttagctcagcctaaactttggatatataataggtttgttgagataagattaccagtagctaagggcttttgttggatgggagaattgaaaccagcataatttccggtacctgttaaatggcacttggaccaggcctaatttactgtccttgtatttaacaaagcagaacaaacaaaacttacttagatacctgattcactaacttcctcttctaaggtatccgtccatgtggttttctcctttacttaagtaggtttaataaacttgcctttatgtgaccaacgggtttctgttgggttttggaggcaatgacagttaatagtaaaataatattttgagagaaaccgctctcaaagaggctccattagctggagaataaagcatttttaaaaagatgagaccttatgcttcattcatctcaaacttacctgcttataaaaacaaaacagttgattgatttgatcaaaagttatccttgttataaaattaagtgggcctgctgactagctgatttatgggattttatgttctttaacttcgaagaagacatacaattcagtctcaacagtttttacaatctgagagattaggtcatgctaataaaatttctgagaaactacttatccatctgaatgttaacatcttttactagaatagtatgtttgtttcagttgatgaagacttttgtttggatgtaagctttcaactcatttagataaataccaaggaagtttttcaatatcattattttaatggattcatgatattcacattgattggctattccttattttaagtagttgggcattaaagatatttacatctttttattattttgtaagacactgtgatgaccttcatgatagttaaatcttcatttgcactgttatttccttctgactgtagccattgtgtgtaagactgcaaagtgtaatatatgcagtgtttaagagtagattaacaagaaaagctaatgtatgaacataagtagctgacccttaatagaagagtgtttaattaattttgaatttgccagtacactctcaaaacacagagcttgattaaataatggcattatactgagcttattcaagtatttggataacttttctttactgaactgaaactgatagcccaggcaggcacatctccaacacctctaattaaaatccacattcatcccttgcttcctgagaaaagatgttgctctcatgttcctttgggcactctttgcaaagtatttctgtttgattgcatatgatgaatagctccactacttccaatgtatttcagttgtcaaatatttataattattattcttgggaaagtaactgagaagggagttcaggaaagacttggacagttctttggagcatcaggaccttacaatttcagctatcttgttcaataagcaaatgttgttttaggttcctggattacaaggtcaaagaaggcagaattcctgccctcaagaaaagtcatggggaagagttgtaaatgcatgaacagctatgaaacagtgtggtaaagtcatgtgagttggcaaaatagatgagaggcttctaagtaaaactgaggaatgaagaatgttttttggaagagattacgcttaaaaggaattagccagccagagaagaaagagaaaaatgttcttgccagagtacctatcatttgggaagccccagtgggccagaagaacagactgtgtacaggaaagacactaccaagtgttatttgtggctgatacaggagaggaagggagagcaaaacaatagagcatctctgtgctgagtattggaatttaaattttgaacttcattactaaataatgtggaactattggataatttcaagcaaaggactcacatgttcatgtccttgcatgagtttgctaagatttccattttaagataatcttggtaggtaagtgaaggatagatttgaggaggaaaaaatggaaatattaactctaggcaaaacatagggggaaagataattgagagagattaaagaatgtgtagagaggtagaagatatagtctggtctctggaatcagatgaattggttcctaactctgactccaccacttaacactctatgtgaccttgggtatatatcttatccctcagtgtcttgtttttctcatctgaaaaatgagtataataatagggcccaactcatattttatgagaattagtcaacctgccaaccacagtgcctagcacattgaatgcatctgatcagtgttagctattatctattgactattaatattattgttactatcaatagtattcatgtctctagggtttgtgacctgattagcagttattgtctggttattggctgaatggtggccagtactagggaatataagaagaaatgtggggagagggagtggaggaggggaggaacacagttgatttgaattacattataaatgctcaaatgaactagctatggaacttacaagtggaattttctcatgtgcagctgatggtaacagcagaaaaatgtgaactctgaataaagaggtgggagtttttcagcacataaagaatatttaaagccaattcattggatgcattgaccagtaagtgtagagatcaaaatcaagaacaactccaagaattgagagcagatgcaaaccccaatttttgtgggtctccagtccaggtatgagcagaaaacacgagggttggggagggaaggagtcttccaagccataagccaggggaaatcgttcagtcaattcttatgctctgatgtggtcattaacagatgataacctcatcctaaagatgagacttctttaggaacatcctaaagatgagacttctttaggaacatcctaaagatgagacttctttaggaacatcctaaagatgagacttctttaggaacatcctaaagatgagacttctttaggaacatcctaaagatgagacttctttaggaacatcctaaagatgagacttctttaggaacatcctaaagatgagacttctttaggaacatcctaaagatgagacttctttaggaacatcctaaagatgagacttctttaggaacatcctaaagatgagacttctttaggaacatcctaaagaagttcctccagcatttaaaattgctaaacgtaggccagggtagagttaaaggctgaaagaaccttaattaatatgtattattccagttattagaagaaaagtcctatggattgaaattgctgcttgctggcaattacttttaattgctgtgcagggcattattaacgttgcaacgtctagcatagtgatgaaaattgatgttccagatgctttcatgtgagttctccttttcttttaatgttctcaagagcatagaatcatggggatgataagtgagatttttgctagactctatacctgtcttccatagaaatcccagtatgcaaaaacaaacaaaacatagatgggtaatcatggccattccttaataagatttgagccttatttggaggtaggcctggtatggatggtagctctaatctttagatgaaattaaactctccaatgtgttcttattttcctaaagatcaagtccccaactacctctctccagccccagagaaagggaattgttgacgatagaaagattccattttcttcccttaagggccacctcctgctagttggccagagttctcacagactctgaattcttggcaggctggagtttaacagtaatcctctctcatccaaatttaagtacaggtaatccccaggagcccctgccaggcttttggtaaataattacctgggtacaagcaaaaatgcccctgctaagaaaactctggaattttacccatcataggacacataggtctctaccatagaggtttatatcttattcttcaatttctgattgttacccctcctaggaaattcttatgtgaagcaaatcttattctcttctactgggcaatctcctaaattagctggcatgtgaaaatgcttcattgagcttttgttcttcagactctcaaatgaaggagtatgtccaaagagcctctttatgcaaaatctacaaattacaccccagtcatacatcacaattagttggcagtcattaggcattacatccatattgtaaaattagtgatgtttctcccaaattatgaaatattattcccattaagaaaaatatactgaagagtaaaaacataacagaatttttgctatatttattctcttcataattatgcaaattaataaaaattatttactatttactaactttgcattgagtgttctctcattctgatgagactccagacttctgccttttgtacacctgtgcaaagcctttctaagctgtttatttatgtcccaatatatatttcagttcagaaaggctgttcttacttttgcgacaccttaatagtagttttatttcatcaaggaactgtatgcaatcactggatatttcagagagctgcctaccttattttcatactataaagaaataaacttgaataacaatggatagtcttggcaggagtgtggaggagttgacatcttccaacatgactgtgggaatatgaactgccatagcctattaaagggaaaaatgttcacaatttgtaagctagcaatccattttcagaaatacaagcaccaatcagtaagaatatattagcaaatgtgtttattgtttatatgagtccaaaattatatgtccgtcaataaaggactcattgaataaataatggtacatttatgccatggaatcttatataactattgaaaagaactcactaggtctctgtgcattcacaaaaataattttttcatgattgacttaatattaataaaggattatacatagtatgagcccactttattcaaaaaggaaggagaatccctatacatgtgtgagggtttgtgtattgtgtgtggtatatttatatttgtataaataaaaagtttgctgtcttttccctcccattaatcctaccaaggaagggaaaagacagcaatcttttttatcttcacatttctgtgtcatttggcatgttaaaaaaatagcatgtataattttgtaattgaaacctaaaatataagaaagaaaattattgaatagaaatggtaaatactatgcagccataaaaaagaatgagagcgtgtcttttgcagggacatggatggaactggaggctattatccttagcaaactaacacaagaacagaaaaccaaatgccacatgatctcacttacaagtgggagataaatgatgagaactcatgaacacaaggaaggacacagaccctggggtctacttgagggtgaaggtgggaggagggagagaagcagaaaaggtaactattgggtactgggtttaatatctggatgatgaaataatctgtacaacaaacccccatggcacaagtttacctatgtaacaaaccttcacatctacccccaaacctaaaatacaagatttaaaaaaaaggaaaattatctactctttcaaacttaaaatttctggattttaacagtgtctgctgtttaaacccaaacagtgtctgaatttggctactgaagaataaaatgtagccctttttcagcacactgtatgtttacccaggtcccaggatgcttaaataaactggcgtgtctattcaaatcctggataagaaataatttttcaaaataaaaattatctcacagaatactctgaacacctgctactctcattaccctgaacacttgtggttttgttgctataactctagcaaatggcataaaggctagaaaaactgtgggataaagatacagcatttctctaagaccctgctgccttcagtagaattatttaatatcctttctaatttctccaacttatttttcactgttatgaaaaaacagcttacaaagaattagtaacattcactatcaatgattccatagatcttcgttcaaagtgcaggtagaaggtgcatttctcaaagagtgttttaaacgaggaaaaaaaatgtgtatcatcatcaacgttttagtgaataaagacattgcttaccgtttttatgttcctgagaggctaagttcagttctatcatgaatagtaatttatgaataagaacccacaatttttttaccagagaattggaaaaccgcccataacatttccatatacccatctcattttctaagtatctataacagtttagtgaacaatattccctcttcgaaaatatagcaaataattatttccttcctatcagatatgcatgctttgtttacaggtaaataactctgattaccaaactactattacattaggttgatgttcttttcaacgttagacaaaaatggataaaaccttgctgcctactcagagatttggtctgagtggaaataggcttttgtggagctacagaatttctgctttatctactcagccaataattggtcagagcatgagcctggttagaaataagcaaaaagcttcttgtatccatgaacagaatgaacagaaaacaaggtagtacatttagcctccgagaaacacgcgtttacttttgaagcaaagaagcaccgggcaaccagtgagcagcatatgtctgaaatctattatctgacatgttctttccagccttcccaggaatgctggtctgactactcagatttgcttttacttcttgccttttggatataatgagtttgccaagcagctgtgagtacctgactctggggaaggtggctagattccgaagcgcttatgttcatggatcaccatacgcgatcaacatgccaattgatattaagccacagaggagacggtaactgctttcctttcctctagttgtttgtcagtgaaaatgtgttttgttgccctttggtaactgctttggatgtctgctgaaatgggagggtcagggtgagaagttagtttttattcaacacactggatagttgggaaaaaaattaaccagagaggaaagctggaaatagtttagctatttagcaaaagctgatctggtttcaaggtctgtagattttaagaatttgagagattgtcagtgcttgtattgccatcaaaatcacccatgatgagaatttgaaagaggatttagccaaataatggatatatttattgatggctatatggctgtttataccagatgcccagtaactcataatctacatgtgacattccttaatgcatcataacacattaatgcaataaatgagttataattctacaaaaacatttgttttcctgtagttgctagggagggaagaacaaggttatgtatttttcctataaaaaagttgtcattttagatctgtgttctacccccgacccaccctttttatgtagtatcagaatagcgatgatatagttaactaatatgtccaaaagtcacccctcaattttggttttatacaacgtcattttcttcagcaattaacaatgaacttcagaagcatttataaagatgttccattctctctgtgaaaattccatttctccctaattttatgaatccacataatgaaaatccaaaattctaaaagcaatgtattttacttggaaactgtcattactatcttactcttctacttttctttttctaattatatctacacaaactcacaaagcatgcattttgccagatttcaccttattataaacatgaagggatgtttaagtgattaaaaagtttctaaaccttcagaaagctttctgatttttgtgagacaatattttattcttttctccagagtatcaaggcttttctgtccagctctatcactatttgactttatgaccggctagcagcaccaagcaactattttaaaatacattcagaaaagtgtgtcctaagacacccaacatggctcagttgctgtcagttacctcattcccttctttagttggtgggacgatactacaaatccatacaagttgcaaaatccacatgaatatctaatgtccctgttcatattaccttaatttttctgctttaaagtaatcaactttttgtacaagtcagtcaaattatgtttttatgtatattgtgtatatgcatagacccagaaaatttcagacatatacctatttaggcttaaaattgggcatcacagtgtattttacaagaaaatatatttgaaaggcattttacaataattagtatttaattgtataggtcttgggatttgtaaaaataccagatccatcttttctttcagtagaatacattacttacctatggctagtaaatcaattaaataaattttatataaaaagttaacttattacatctggagctttcattctacgaaaggataaatatgacaacaaacatgtaatgaaaacaatagttagaggggtggatgaatgaatggaagaacatccaaatcatagaggttgtctttttattctgttactcattttcttaagttgtaaattttaaaacctcaacttcttttgaatctgttgagaaaacaatacacttggaatggtgagtcatcatcttagattcactaaaatctacctaagttttgaatggttctttttcagaatgcttgctgggactaagatttatctaaagtagcatgtttatgtttattttcatatcatctcggttgtggtttttggcagaaagaaaattgttttctaattacttaaaaaaatctgaggaaggaaggatggaagggagggagggaaagacatctaaagaagagtagctatgagttgatatttcagcctacccaaagaagcagagattgcgggacaaaaaataaaagataaaaaaaattggcttttcacgaaaatccatagagaaaatgaagtaggaaatcaaatgcataagtgcaaaacatagctcgatttaaagctaagtatatccttataaaataatgacttcttgaaagaacagcatgtttttcttggaaaacagggaaataattcccaaattattagaaaatcacctagattagacacatgaccacatgatcatttaattggtctcaatttttatttcaagagcagcaatgaagacatcaagaaagcagttaacatactaaatcttaagtaaactcaatgttgacgagaatgacaaccctaccatctgtgattataattactttctatatttgcgatttaaaaatgttttccttttaatttttggtagcctctgtaaattgtactgtcccactttttcttttgtaagaaatataattttctttcaattttatgaagcttttatgtctcaattttagtatagcaatttcttttttttttttttttttgagacagggtctgtgtctgttggccagactggagtgcagtagcaatcatagatcagggcagcctagaactcctgggctcaaatgatccacttcagcttaccaagtagttgaggtcactgtgccaggctaatttttttgtttgtttttagagagactgggtcttgctgtgttgcccaggctcttctcaaacagttggcctcaaatgaccctcctgccttggcctcccaaagtgctgggattacaggcatgagcaatcaagcctggcccttcatacagagatttaaaaatcagatttaatctggctcttctaacccatcctcacccaattggactgtaaagtttttgagtgtgtggatcacgtcttggttgttgttacttccccagtgtccagcatagagcccagaacaggttaaataataaatgtttgtttaataaataaatgattagaaaatgcatggtacatattttggcataggggcgtgtgtgtgtgtgtgtgtgtgtgtgtgtgtgtgtgtgtgtgtgtgtataaaatcacttccctgtatgccacagtatggagtctttggcaagatttttgcttctgttattcatttggatcaattaaattccctttccttgtttccctgtagaaactgcatgtagcactgactttagattactggcttaagtggttggggatcatgcattttgtcattaccaggtcagcaaaggagaacctgaaataattcacttctgtattcataaaagtatatatttgtatatatgtaatgtgtgtgtgtgtgtgtgtgtgtgtgtgtgtgtgtgtgtgtgtgtgtgtgtatagcttcaagttgtagaaaggaggagaaaaagtcactgtgggaggtggcagaggggaatttcctagagggaaacaatactgcaactgtaagaaaatgtaagaaatttgatagaagcacaaaatttcataaaatcagttataaaaattatgacatataagccccagttctgttgtcttgctataatgtaaaagtcacatttttttttaatcaaaatggaaaataaaaactagtagcagtgaatgtggtgagacagtagccactggcaccccaaggcaatggaaagcaagtgcccttgagcactacttttcacagccgggtgtcatgttttacctcacccagccgccttcttccctgcattttggtggcttgacaccattactgtcggggcagggtggggtggtaggggggtgcttgtgggagtgctggtgagggtccttcccttgctgcctgctctgtgctccctctttctggtgatgcagctgttctggtatactctctggcctctgtttttctaaatcctttaggtaggcttgctctccctattatcgctgggatcagaaaaaaagcagggtacgaagatccagaagacaggaaggaatacagtaagtgtgagtgaaggtaaaccagcctgctctcttcttgtggaacgatcacaaggtcatgcacttagatttatgaccaatcatcaagctattaatttactcaaatggtgtattaatttgttaggacggtcataagaaaatactacagatttggtggcttaaacagcagaaatttgttttctcacaattccaaaagctgtgaaatccaaggtcaaggtgtcagcaggtctggcttctccttaggactctggttgtcttgcagatggccaccttctcactgtgttatctcatggcctttcctctgtgcgcaggcatcgctgggatctctgtatgtgtcaaaatttcctgcttttataaggacatcagtcagactggattaaggcccaccctaaaggcttatttaaattttaatctcctctttagtggtcctatctccaaatatagtctcattctgagatactggtatttagggcttcagcatacaaattttggggtagacacaattcagcccataacaaattgtgctcatgaaatgatttactaataatgattgtggagagagatagtaatccgactgtgaatcctgaataattagtggcttcatgttcataaaagtggactcaataatgggcatgaacctgcacgagggaggcattgcggagaagaatacgtcccattttctgtaccaaagaaaaacaagtacacattgcaaacaataaatctttatcaaattcaaccaccttattttgaactctataatcattcaaacgtggcctagactaacatttgcttttttatagcttttatcaagaggagtggaggtattaaaattattattgaggggtgtagtgattttcaactgacgcaattctaccctccacctctcatgcaggggacatttggcaatgtctagggactttttttattgtaataagtgggaagtagctgatgatttcaagtaggtaaagaatagggatgttaaatctcctataatacacacgacagcctctcacaacaaaaaattatttgacccagaatgtcagtagtgctaaggtggaaaaaaccttatgtgaatcaattaaatcagggagaacttcagagcttttttaagacctttatttatatctagatgattgatattttttaggtattcatgaaaatactttcttttacctttcttgtggtaagcacaagataacactttcttgcctggttaaaaatggacaactgctacacttttaaaataatataaagcattcagtaattcaaaccatcctgtcttctgatttgtctgaattagtgtggctttactgcattttcagggcttattattctttcagtagggagactactaagatttcattaaagatagctgaataaatgatcaaatacattattgtagctccagactaggtaataaacattgagatatgcttttcaagtagtggtgaaaatactaggcaaaattacacatacacttacatatattaagcgaccatcctgttggcctggtatgtgaagctctgctgaactcttgcctaaatgcatggacccatcgattgtgaatgtgtgactacttgtgtgttttcatcataaccagctcatcctaatagcaaatgatatggtttggctgtgtccccacccacatctcatctttaattatagttcccttaatctccacatgctgtgggagggaccctagtagcaggtaattgaatcatgggggcagtttccccatgctgctctcgtgatagtgagtgagtactctgaaatctgatggttttataagcatctggcatttcccctgttggcactctttctccttcctgctgccctgtgaagaagatgcctttcttcccctttgctttccaccatgattgtaagtttccagagaccttcccagccatgtggaactgtgagtcagttaaccatcctttctatataaattacccagtattggatatttttcatagcagcatgagaacagacgaatacagcaaagaacacgttttatgaaggaaaaactttgaaaacaaagggactactttctttgatgagaggcccttcctttcactttaaacaaaacttcaaattatcctcagaatttgttctaattctccctacttctgggtaaaaattattagcagtaacagatttaacttgaatgtatatctccagttccccattctcttctctatgtagtgctgccaaactcaatagatttgaaacaaaaattacccagggaccttccccatctcccatgtccttttttcttatggcccagacctggaagtcctcctaagtgcttcctctccctcagcctaaccactctaccactatccagttgcaggtacactcttcctccttcacctcaccctttgatgccatctccactgctaccatcttgggtccaaccctcatgttatcttgcctgaaaaccgctaactttataactagtctctgttctatcaacatcctcttcctgactgtcatccacagatccactttctaaaatgccatcatgacgcttccatgcttataccactagcttttcagtggctaccaaaaaaaaaaaaaaaggttacattcccagccatcatgatctattcccttccacatctctgcatccttgtaaattgcccttgtcacccatgtatactgtgtattttaggtataaataactactagctatacctattttttgcctagagttccattctctcctcattttgtgatgaatcccatcattccacagatctttcctagaagacctttcataattttctatttccaaatggaagtgcctccttaactagctgtttttcttttcttctgtgtctgttactgcactatcataataaatcttaatttatatattttctatctttcctcctccctaagagtggcatgatggaaagagttgtttcagaaaaaatttggcaatggaatgctgcattaattggaatggaaaagaatgaatccctacaccaacagaaggaagcagtgtgaaatcctgacagggacaatttcattacaattacaaaatacataaatatgtgattacaattgtgagaactgctcaaaaggaaacaaggacccagtgagagtataaaaataagtacctaacatagtctgagtgtttggagaatgcttccctggggatgatgaggcctgaggatgagtaacaacatactctgctgagaaccacatgaatgaagccctgatgtgttaaactaaaaggataaggtgtctgaagtgtaatgaggcagagaggagagtggcaaaaataaactggagaagatgagtaggggagactactgttttcttacatgctaattaacccaataattctttatttcattttggagagaaacaagtgattatttattaatttattcattggcaatgcaatttaaaaacatattctttgtgtcttatttatcattgaggtttttaaaacattgaaataaacaataggtaatattttccaactgagatttaaaaaagaaaaaggtcagttttcaaatctattcccaactgctagagtttaataaaaactgtcataaatgttgacctttgttctgcaatcagttcagcatttatccatcacccaaccatgcagcctctcgcttgccaaaaggagtggaatgagaattgttagagtacttggaatgtttactgtcagcaaagtacaagacactacacaatcttgatgacctttatatgatagtcccatttctatatccaataagagacattaaattacttaataattctttggaactttctttttagtttttcatggctttgctcttaagttgaagaaaattattacatggatgaactacaaacggaaagcttctgttatcaccttttatcgtactttgtaaactatgataaatgaagtggcgaatgctgacaaagcattccaggctcaggatggcacctttcaaaggcaaaagaaggtgaacaatctactaacagcctttgaaacaatagtcaggactttggacttggcccataatgttgtgtttcatattgccctaagaaggttgctctaggaaggaaaatagtttagtggtgatggagagaagggcccctaagggaagaaatttgatgagaaggatgttacaggtgtctaaggaaaaggtaatcagctcctcagacaagatggaatgtgcattgaatttgaaaagatggtcagtgcttcattcatgtggttctcagtagagcatgttgttactcatcctcaggcctcatcatccccagggaaatattctccaaacgctcagactatgttaggtgcctatttttgtactcttactgggttcttgtctccttttgagcagttgtcacaattgcaattacatatttatgtattttattggcctaagggcttcctcccacgttcaatcataggaccatggaaacaaggttgaagcctatgttttaaaccattatgtgtctggtgctttgtctgggtcctggtacataatagatattcaataaattcttgtaaaattcattttttttcaactgagagtacaaaagtaatcagacagtaaatatatgtgtacccttttggagaaacattaaattcattccattagcaggcaatgagttctttatttaaaaaaaagttctttcagcaacttccaaatgtacatctcaagctctgaccactcctcccctttagactcctactaactgcttggaaattatttcagttgttctcatggccaaaattgaactcatcatcttactcttaccatctggtctttttcttctatttctttgttggattgattactacagagttatctaaactagaaacacaggagtcaccttagtcatcttcctttatcttaacactgtctctcatcatcaagtcttcttttacctataatgttcttatatgagtcccttccactctgtctttattaatattgccaactgatgtgaactactgtaagagcctctgaagtgatctccacattgctggttttcatataatccaccccaaaggtctttgtgtttgttggttggttttcattgctatagcaatattcacatttctgcagtactagtaaattacactaaaacgtactgtgttttataattgacctcgagtataaacatacaaattctactgctctgatgtttctttctaagcaatggttgaatcaaaaaacaatgaatttgcctaattttcatgatgaaaacgttcaaaattctcctaagatttcttgaaatccaagcttgtgattgtatgagaattcacaataaaccagctcacaaaatgtataaacttcagtttgtcatagtctatgaggaattactgaagcatacggcatttactcattgatttttaattcaggcaaaagttagaaatacacaaacacatacgcgtacggaggtctcaaagtcagttgtgcgataataaattatttaactcacccttatgataggtaaacagttttcctaaatcgccctcctgccccctgctaccctgactgaaaatatgtgctctggtttgtgctgttatttttgaacaatgtatgccggtatccgatgtaagatgattcatatgatactggtgttaccatggcaatccatcatgtatatagcaagaacactgtgaataccagcagctctttgttctcttcaagtttccattttcttttcttgtttttttttttttttttcttgtgcagtaatccagtggctatgacatcaagagtaacacaatctaattttctccttctgttgcttgtggtaggattcatactctgctagcaagggagttcttggccattttgatttgcaagagattttgcttctccctgatgtttcatttcgtcagcaaagtcttccctctggggaaaaacccacttgaattctaaggctgatagatgctgggaatcccatatgatgagtcctgtggaagcaggacattccagccctggggttgctgttgtctctgacttcagtatatgttcaaagtcatctcaaaataaagtaggaagatgagtgttaacctgcacatcactggcagtttttaaaggtaaattgccatttttacttaccacactggattctccaagtcagactaggatttgggttacaatggggatcattggggttaaattacttaagggataatgagatttacacagacccattaatctttctaagctattgagaaattttacacgtactgtgactgaggagaacctgatactgtaaaagagcaattcagtacagtttcaccatccaaggacttaccgatgcaaattcaaatacacgtgctaagtaaaatgggagagatagagcaagggagatataaaaattccaatagagcaattccagatgccccatctgccaccacgtgcaatggatctatgttcactagtaagtgtgattgaggtaggagatgtggatctaccactcttcccatctcagttcctttggtgaactgttgagtgtgaacattttgccttacattgggtgattcaaggggttctccacggtaaaagtgactatgtcagattcttgccacataatctaagagatgactccactgaagtttgtgttactctaccatcaaaagatgtatctatgtttacagacattcttttattcaatttgaaaagaaatttcaatgtcaataataaatattagcctcatttgtgaattaaacagatgttaagattgcatgcacgtcagtaaaaaaactgttgtacaggaaactctatgcacaggagcctcctaccatgtcatccagctcagctacctttttctattcagctttctgcaagtatttattttatataatgcacatgtaactataaggatacaaacatggatcatacaaagaacctgccctcatggagcttaaaatctaaagacagatgataagtgctaaacataaataactgtccacaacattaagatatcagtaaattcattcattcatttaattcactcatacattcacttgtgcagcaaacatttactgaataggaactgatttcaaaattttcagctaggaatgcaaaactgagagagaaaaattcttagccttcaaaaaaatcaaagtcgaactgctcagacaaaaattcaaagggaaaaataaattataactacataaggactttaatagtcctctaggagtacattagaccaaacacctaccaccagctgggctattcagggattatcttacaaataaggtcatgaaagaggatgaagtactctcctgaaaggcagtgcctaaaaagagggtggctggcagagaatgaactcacattacatagcactttgcagtttgcaaagtagatagtcatatattgtttcctttgactatcacatcaactgataagaaaactgagacccagcagattcaaaggtcttactgaagaccataaagttagttaaatgtggccaggtgcagtgagtgactcacacccataatcctagcagtctgggaggccaaggtgggcagatcatttgaggccaggagtttgagaccagcctggccaacgtggtaaaacctctactaaaaatccaaaaataaaaattagccaagtgtggtggcatgcacctgtaatcccagctactcttgtgtctgaggcacgagaattggttgaacctgggaggcgaaggctgcagtgagctgagatcgtgccactgcactccaccctgggagacagagtaagactctgtctcaaaaaaacaaaaaaaaaattgttaggtaaatcctggagttgggacccaggcaccagtcatctgttctctaaatattgtcccatgtgttctgttaagtaccatggagaaagcaggagtaaaatattttggcagctctgagaagggagaatttactttcaactgggagtatcagagaatgctttgtagataaaatgacatttggtcttgcagcttgcattcagttatgcagagttgaagatgaagggcatttcaggctgggagaacaatctcacaaaggtgtggatgtaggaaaatacatgaacgtttatagaaaaaaaattgagtgtggtcagaatttattgaacttgagaggcaatcatgtagataggagataaaacaggaaaaggagaatgagactatatttttagggtcatgaaaattaagcaaaggaatattttctaaactaaggtgagctattaaagattttgaagagagggagtcctatgatcatagctttgcttatgaaagaatgaagtggcagcaatgaagacacaccttggaataccagaagactagagtaaggagactaatgaggggacttatagcaatcatttgctttgcaggtaataaggtggtaactaatacaagatgatggattacaatattaaattttgtattcttttaagttctatgtttctgcaatggctaaatgcaaacctatcaggaaaagtaaagcgttttgttgttattgttgttgtttttgcttttcaaaaagtgcaggtaattagggcctaacgtggaatggtccatgctaggaataaagtagatagcggcgaatgtttgctagagacattgtgatggactgatctgccctactattacatcctcagcaataaatatgaatgtttaagtggtacaattgccagaaatcagccaaagtttggcataattgttagagatttgttggctgtggatagaactacataattttggaattgtagaggagaacagagaagaaaccaacaaaaaatagtactagtactctgtcactggaaagaagtatgtttaaggccacacagtgaaagttagccatgagcttgagtgctctatcatttttcattatgttgtttgtttattaaaaaaaaaaaaggtaacagctttttctttttaaccaaacatttcttactggaagttcaataggtgtacagttgttttgtttggctagacatggatatttgtgtgttattccctttcagtagttctgaaaaccattttatctttagatacattattttcccaggagcttgggtattttattgaagctgtttcaaatgcatttaatgtcctttgtaatggatttctttatctcttccccaatgctcttggctggagatgttactttttatttgccttatcggtgtgagcacctcattgctataatcaatagatatagtactttagcattctgtacattttaatatgatatataccaaatataatgtataaatgaaaagttatagataatttttgcttaagttttcttttatagagaattgttaacaaaggatatacagccaatatgttaaaataatacctagaaattaaaaaggagtaaagtagaatagtttatctgttgtactaagacttcatacacaatatttcgaaaagtgggaatatctcttgggtgaaatacttcatatatgtattgtatgtacatacatgcaatatgtacacacagaattatataaaatatatgtatatgtatacatctatatgtacagaacatataattttattagcatttcttgtaatggcattttattataaatccaatgacctcaattattctatgggtaagtgctaagtatgtcaagagagctggcatagaaaatggaaaaagcactacaccccttagcttgcaagtagatgtgaattttctgcctttgactttgttgaatctgtgatgaatcatatgtttactctgattaacataaaacatctggatgatctaactttggggacacattgcttcatatgcactgaatgcctgaaaattggtagaattttagattctttttctttataaatgatactacccgaattcctgcaatacctagagagttacaagtgcttagctctgaccttttattccattcaattgaagttgtccacctttagtttattacacatatgactcttagtagagcaaacatctggattattgtcaacagttctcaaacacaccatttggatttcactatcagactacgaacgaacccccatggaaaaaaattcaggcatacaggctacacccagatcctgaatagcccctggttttctggttactattttctcaggccagatccaagaagtcctctttgggcttgtctctgggattctctgataaaattggctttagattgagactgacgtgaagatagagctggtcattgaaagacagaaacagatgtgaatgaaataattctcctttgagacataaaaaaatgtaagatataccaagaaaggggaatttgagttgttcattttctgacaactgtgaaattgttgacccggacaagagagtagggagattaacaatgtgatcatgttcagggcccactgtgccactgaattaagacaatgttggcattctcctcagtcatcttccgaaaatagagatttagagttaggaaaggaatagcctatcccattaactacgtcactcatctcatgcaggtgacctctcatttatgtatttctcaggatatagaccaacgctggagtatagaaatattatgagacacttcgtaattttaggtcttctggtaccacatttaaaaggtaaaaagaaataggtaaaatttatttcaaggatatattttatttaactcactgtatcagattattttaacttgtaaacaatatatataattattaatgagatatttaacattctttcctcatactttgtctttgaaatcctgtatgtattttttacttacatcacatattaatttggatgcccaattgtcctcaattatactggatctttattggacatttagatctcataagatttacaattagaaatatagattcacttcccaagttgttccaaatatagtattattaaatcaactatcagtcttttaattcataaatattaagtaagactaaaaatttagtcctttagtcatactaaccccctttcaagtgcccaacagcctcttgtggccattggctgccgtattagacagttcatatttagattatctgggtttgaactcagagtctgccactcactgactgtattggcaagttgttgccaacctgggcaagttttttctctttttatgcttcagtttcctcacctgagcacacctttttccttgaagaagctctcctgaagaaaatcccgtatttttcttcaggacattgctatttttccacttaaactcagaaccttagagtgatcactgaatcctcctctccctcatcagctttatctgccagaaggtcaagtcctctgagatgtacactgtaaaatctcatgctttcctgtgacttcatttccactgccactaccctctccttttgcatggatagctgcaatgatctcctatttaattagcctcagtctccagactctagccatcactccacattatgccctctggatgctgctactgagttcattttctgaaaatggtatctttatcatactctccacagttcaaactatttcttcactgcccgtcacttccagcataaatccatgtcctctgtgaaaccttttttgacaacttccatgccagatccaaatgacaactcccttccttgtgctgtcatggccctccacacagacttctgccatagccccagagtcctagtccacatataggagtacatgggctctaagccctacacagactattttgttgttgttatttttgttttgttttgttgtttgttcgatatcttgatatctctgtaacagagcacagtggtttcttgacagtttctcattttctgtatgagctagtgaatgacattcctttgtctggcattccaggccttcagaattagctccacttgactcttctggctccttctcttgcttttcatccacacagatcctctggtatagacaaactggtgtattactgtctcacaaatatgtccccaatgtttgtgtctccatgccttggctcgcatcctctcctcttctgaagtgtccctgcattcttcttgatctgcccaaattctaccctttcttcaaggtccagtccctccctcttccatgatgaagactgcggagcatgatgcaattcactgtgtttcaaattcaggattgggtggcctgatggaaggaggccaggcttggggtccaagtggatctgtttcttctgttttccgccaagttgcctaccctctctgaggttcacattccatatctttgaaatcacagtaacaaaacataaggtgcagaactatcttgagtattaagaataacgtgtgcactggcattcagtgagggttcagatggagcacgtgaactctgttactttcagtacagtcataggatatgtaatcatgtagcttctaaaatgtctttcattgtaagattttgttgtcatttggattgctatacaattcatgcttgatttctaaactagactgcaagtgtctggactgaaacaaatgcataatagaattctgagcagatatgcacagatatatatatgtgtgtgtgtatgtgtatatttgtgtgtgtgcacatgtatttgtagatatcaagggagagaggcactttcatgtgtattgattcattcagtccccacaagaaagcatcattctaggaggaagttgaaaatgtccctattttatctatgaagactctagacttgaagagtttgagtccttcccaaatcagtccaactcttaaagtgatagaagcaaaaaattcacagtgtttacacatcttttccaaagctgtttgatgttattatttcccgcatatcacatctgtgagattatctgcctagatcaatatatgtgctaaccatctgtcaatctttatctacatgcaattgtacccaggttcagggattgtgggagggagaaaggttaggtggttgtaagaaggacactgcatagtatggtaggcaaatacagaatacctgcaacaagacaaccatggcatttcttttttttttttttttttttttttgagatggagtctcactcagtcacccaggctggagtgtagtggcgcgatctcggctcactgcaagctctgcctcccgggttcacgccattctcctgcctcagcttcctgagtagctgggactacaggcccccaccactacgcccggctaatttttttgtatttttagtagagacggggtttcaccgtgttagccaggatggtctcgatctcctgacctcgtgatccgcccaccttggcctcccaaagtgctgggattacaggcgtgagccaccgcgcccagccaaccatggcattttttgttaggtcactcagcattggtatcaagaataacaaatgacacttgagtttctttttcctgaaaaagggcaggaagagtctaatagcaagtgcaattgccacaggcaacagtgttataactggaaaatcctaaaatgtagataattttcctccaaatgctttctaacaaaagatagacaagtttaaatttggctgatttcatatctaccataatatagtaccagcaatgccaagatacagaaaactgcctaagaaaaacagagttcagaagacttcggataaattatcatcttaagcttaaccttatacctataaaaaattcagggatatcagttatgacttctcattgagtagtctcatgttagaccaaaatagtttcccatattttggtgaaggaccagaataacttaccagtaaatgaaacaatcattttctttttgctttatactcattctgcatgtgatttgtataggggatcaagtcaaagattgccagtacaaagtaacaacctctcattgtattgcttaagttaatcattaatattttccatggatcaataccctgtagaagcatgagatgcagcagtgatcttcaatttcatgtgcttgccaagtaagaacagccatgggccagattgttgggagccgtgccatgagctacagaccctcagctcccctctataatcagttcttcccccactccagtgctcccaacttgccctaagcagagcgtaattgtggatgtgtaactaccgcagaggggagtatgctttttatgttgttcaattcttcactttctcttctgcaattgaaagttgagctgttagatttcctgaaatgaaatggtgacaagagaaagtaacagaagtagcctttataagtgcctgacttctgggtaacagaagtgacttaaaaaaaataaaagtacaaaacgttgcatttaatgtaaaagatgactgcattagtacaacccttgaaaacattcaagttcttttcagaataaccaccattaaggagttgacaaatattttatgctttaaagtatcctataaaagttcatcacagaaataaaaagcctcctgttcttatccttctcaacaaagccctcttgtatatagatattgagtctggcttacctctgtatcctgttgtgctgataaaccaagaaccttgcaaaaatagatgcacgataattgatatttaataagtgagcgaatccattaatgaaaagagtgctatttcagagagcagtgttcatttagatagatggtcccagcgtcattaagtaaaaggatagagaatacttgcaatacatttggcgtagtgttaagaattttttaaaatgttttaaatgtgatcttttttatgggctgaattgtgtcctctcaaaatgttgaagtcctaacccctggtacctcagaatgtaaccatggagataaggtctttaaagaggtgattaaattaaaatgaggtctttagagtggcccctaatccaatctgaatgatacctttataaagggagggaatttggactcacaaagagacattagacacatgcacacagagacaaccatgtaaacacatggtaagaaggcagccatctgaaagccaaggagacaggtctcagagaaactaaacctgttgacgcctttgatcttggacttccaaactgtagaacactgacaaaacgtattactgtcgtgtaagccacccaatctgtggtattttgttatggaagccctggaaaattaatacagtcttttttatttgctacctttgaaagccctcttgtcaaatgacggtaaagaatagaagacaataaagtgtcagtaataaagggtgacgagaagaaacaactagagatgtgagaggaccaatttaggaaatggaaaggagaggaaaaaatcaacaaagttgagaatgctaattacaaagtgcccacagaggagggcaaaaccagcaaaccattccctttgtcaaaatcttgaaagatggcaattgaggaaccaagaatcttaaaaaggggggaaggtggatgagaaatctgcatatgaaggggagtcctccataggttctcctctcaccctgctcagctaggagaccagtgccactttatcctcattagaatggaaatttatgctataaaaataaataagagaagtcttaacctggggatactaggcacattggaaggtgagagagtaaatgaaagtctatcaactgaatagtgaagttctgacttctctagtagcacctgggaataagaactctgtcagttagccttataatgccaagagaggagatagaaaaattgtttttctataaaaattgtctaaaaaaatatctgcactcccatgtttattgtagcactattcacaatagctaagatttggaagcaacctaagtgtcccatcgacagacaaatggatgcaaaaaaacatgcagtacctataaacaatggagtactattcagccataaaaaaagaatgagattgtgtaatttgcaacagcatagttggaactggaagacattatgttaaataagccaggtacagaaagataaactgcatatgtcctcactaatttttggtaactaaaataaaaatacttgaacttgccaggttcaggggctcacgcctgcaatcctagcactttgggaggctgaggcaggcagattgcttgaggccaggagttcaagaccagtatggccaacataatgaaaccccatctctactaaaaatataaaaattagccagtcatggtggtgcatgcctgtaatctcagctacatgggaagctgaggcacaagaatcacttgaacctgggaggcagaggttgtgatgagatcgtgccactgcactccagcctgggtgatggagtgagactgtctcaagaaaaaaacaaaacaaacaaacaaacaaaacacttgaactcgtggagatagagagtaggatgccatttatcaaagagtgggaagggtagtggggaggaagaataagatctagtatttgatagcataagagggtgactacagtcaacaataatttattgcatatttaaaagcaactaaaagaatataattggaatgtttgtaacacaaagaaatgataaatgcttgagatgatggctcctccatttatcctgatgtgattattacacactgtatgcctgtattaaaatatttcatgtgacccataaattcatatacttactatgtactcataagaattaaaattaaaaataaaaataaccaagaagaattcttcttcagaaaaatggaattaccacccagagaaaagacctatagtactggcattagatggttgcccaataaagaagccaagggtctttattcctcaattaccccatgtattaggccattattgcgttgctataaagaaatacctgagagactgggtactttataaggaaaacatgtttaattggttcacagttctgcaggatgtacaagcatggtgctggcatctgctcagcttctggggaggcctcagggaacttgtagttgtttcagaagacaaaaggggagtaggtgtctcaaatggtgagagcaggagtaagggggttgtgggagttagcacacacttttaaacaactagatctcagagagctcattcactcactcaccaagccataagggatctgcccacatgacccagacaccacgcaccagggcccatctccaacactggggattacatcccaatatgagatttggaggggacacccaaactgtatcattccgcccttggccccctaaatctcatgtccttcttacatggcaaaatggaatcatctcttctcaacagtctcccagagtcataactcattccagcattaactcaaaagtcccaagtccaaatacaaaatcttgtctggaaatgagttcctcccacttatgagcctgtaaaattaaaacaagttatttacttccaagccaaggtacaatagaggtacaggcattgggtaaacattcccattctttttttttttttttgaaatggagtctcgcttagtcacccaggctggagtgcaatggtgcaatcttggctcactgcaacctctgcctcctgggttcaagcgattctcctgtctcagcctcctgagtagctgggattacaggcacccgctgtcatgcccagctaatttttgtatttttgtagagatggggattttcatcacattggccaggcttgtcttgaactcctgacctcaggtgattcacctgtctcagccgcccaaagtgctgggattacaggcatgagccatcatgcctggccaacatttccattctaaaaggaagaaatcagccaaaagaaatgacttcaggccccacccaagtctgaaacacaacaggacagtcattaaatcttaaagttctaaaataatctcctttgactccatgtcccacatccaggtcacactgatgtaagggtagactccaaggccttgggcagctctgcctctacagcttttgcaaggtgaagcctccatgactgctctcatgggttggagttgagtgcctacggctttcccaggtataggatgcaagctgccagtggatctacattctgggacccacagaacaatggcttccttcccacagttccactaggcaatgccccaggggggattctttgtgggcagggcttcaatcccatattcccttctgcactaccttagtagaggttttctgtgaggactctgtccctgtagcatgcttctgcctggacacccaggctttctgatacatcctctgaaatctaggcagagactaggatcactctttccattctttctatctgaaggcttaataccacaaggaagccacaaaggcttacagcttacatgctccagagtggcaacctgagccatacctgaggctctttgagccacggctggactggatggaccatgatgcaaggagcagcctcctgaggtagacagtgtagtggtgccctgtgcttatcccctaaaccatttagtcctcctgtaccactgggactgtggtgggaggagctgcctagaagatctctgaaatgctgtaaaggcctttttcccattattttggctattagcacttgttctcttttagttatgcaaatttccctagcaaatgattgcttgcagcctgcttgaattcctccccaaaaatggccttttattttctatcacatagctaggttgcaaattttccacacttgtaagctctgcttcccttttaagtaaaaattccaagtttaggttatttctttgcttctgcatctgagcataggttattagaagcagccaggtcacatctcaattgcttcagtgcttagaaatgtcttctgccagataccctaagtcattaactcttaagttcaaactttcacaggtccctgggcatgaatataatgtagccaagttctttgctaaggtataacatgggtgacctttgctccagttctcaataagttcctcacttacacctaatactttgtcagcacggactttactttgcagatcactatcagcattttggtcatgaccatttaatcagtctctaccaagtttcaaacttttcctcatctccctgccttctcctgagccctcccaattcttccaacctctgtctcttacccagttccaatgtcattttgacattttcaggtatctttatagcaatgccccactccttggtaccagtcttctatattaggctgttgtggcattgcaataaagaaatatctgagactgggtaatttatgaagaaatagaaaattaactggcttgcagttctgcaggctgtacaagcataatgccagcatttgctaagcttctggagaggcctcagggagctttcaatcatggtggaagctgaagagagagcagctatctcacgtggcaatagggggagcaagagagagagcgggaaggaaggtgttacacacctttaaacaaagagattttatgagaacttgctcacaaagctataagggaaccactcccatgactcagacacctcccaccaggccccacctccaacactgaggattacatctcaacatgagaattggaggggacattcaaggaacaccaccctataatgaaccccaagactctacaagtccagttaaatcattcaaggctcccagtcagtattttagtgtctccctgttgaatatgaatagatagccaagtctccacaaaactctgaggaaattcttcaacaaaaagcctaatgcaaacaaatgaaaataatgatgatgattaggttgatataaaaagagtttaagaaacaaatagacgtttcagaaaaaataaacttcgtagccctagacagatgacaagttatcacattaatgaaacaaaaggatactatacaaaattatcaagtaagaacaaaagagagttagaatttaaaacaatgaaagaagatgctaataaataaaatcagagatgaaaagggagatgttgctgggcacaatggctcacacctgtaatcccagcactttgggaggccaaggcaggcagatcatgaggtcaggagtttgagaccagcctgaccaatacggtgaaatcccatctctactaaaaatacaagaattagccagcgtggtggcacgtgcctgtaatcccagctactcagaaggctgaggcaggagaattgcttgaacctgggaggcggaggttgcagtgagccaagattgtgccactgcactccagcctggatgacagagcaagactctatggggggggggggggggaaggaaagataaggaaagataagggagacgttacaagcaataccacagaaattcaaaggatcattagatgctactaggagcaactatatgcaaataaattggaaaacctaaaaaaatgataaattcctagacaaatacaacctaccaagatttaaccatgacgaaatccaaaacctgaacagaccaataccatcaagattgaagccataatgaaaagtctcccagtaaagaaaagcccaggatctgatggctttactgcttaattttgccaaacatttaaagaagtaatatcaatcctactcaaactattctgaaaaatagaggaggagggagtacttccacacttattgcacaaggccagtattaccctcataccgaaacagaccaaaggcacattgcaaacagaaaactacaggccaatactcccaatgaacatttatgcagaaatcctcaacaaaatactagcaagccaaattcagcaacacattaaaaagattagtcatcgtgaccaagtgggatttttcccaaggaagcaaggatggttcaacataatgtaaatcagtcagtgtgatacatcatatcaatgaaggacaaaaacatatgatcatttcaatttatgctgggaaagcatttgataaaattcaacatcccttcatgataaaaactcaaaaaactgaggatagaaggaacatacctgaacacaaggaaagccatatatgacagacccacagctagtatcatatcgaatggggaaaaattgaaagtttttcctccaagatctgtaacatgacagggatgtccattaccccttgagcaatcagacaggagaatgaaaggatattcaaattggaaaggaagaagtcaagttattcttgtttgcagatgatattattttatatttggaaaaacctaaagacttcaccaaaacactactagaactggtaaacagattcaataaagttgcaagacacaaattcaacatataaaaatcagtagcatttctatatgccaatggtgaacaatctgaaaaagaaatcaagaatgtaatcccatttataatagctacaaataaaatacctaggaattaacttactgaaagaagtgaaagagttctacaatgaaaactataaaacacggatgaaagaaattaaagagaacacaaaaaatggaaagatatttcatgttcatggattggaagaatcaatattgttaaaatgtacatagtacccaaagcaatcttcagattcaatgcaatctctatcaaaataccaatgacattcttcacagatatagaaaaatatcttaaaattcatgtataaccacaaaagacccagaatactcaaagctatactgagcaaaaagaacaaaactggaggaatcatattacctgacttcaaataacactacagagctatagtaaccaaaacaggatggttctggcatgaaaacccaggaacaaattcatacatgtacagtgaactcatttttgacaaaggtgccaagaacatacattgagaaaggacagtctcttcaataaatggttctgggaaaactggatatctatatgcagaagaatgaaactagacttctatctcttgccgtatacaaaaatcaaatcaaaatggaataaagacttaaatctaagacttcaaactataaaactattgaaagaaaacattggggaaactctccaggacattggcctgagcaaagatttttttttttttttttagacagagtctcactctgttgcccagactggaggctgaagtgcagtggtgtgatctcagctcacagcagcctctgcctcctgggttcaagtgattcttgtgcctcagcctcctgagtagctgggactataggtgcacaccaccatgctgggctaatttttgtatttttagttgagacagggttttgccatgttggccaggttggtctccaactcctgacctcaagtgatatacctgcctaggcctcccaaagtgcatggattgcaggtgtgagccactgcgcctggcctgagcaaagattttttgagtaataccccacaagcacaagcaaccaaagcgaaaatagacaaatgggatcacatcaagttaaaaatacctgcgtagcaaaggaaacagtcaacaaggtgaggagacaacccacagaatgggagaaaatattagcaaactatccatctgacaagggattaatatccagaatatattaggagctcaactccgtaggaaaaaaaatctgataatccaattaaaaatgggcaaaacacctgaatagacatttctgaaaagaagacatacaaatggcaaacagtcatatgaaaaggtgtgcaatgtcattggtcatcagggaaatgcaaatcaaaactgcagttaaatattatctcaccccagttaaaatggcttttatccaaaagacaggcagtaacaaatgctgacaaggatgtagagaaaagagaacactcctacacttttggtgggaatgtaaattagtacaaccactacggagaacaatttggaggttcctcgaaaaagctaaaaatagaactcccatatgatccagcaatcccacttctaggtaggtatacacccaaaagaaaggaaatcaatatatctgcacttccatatttattgtagcactattcacagtagccaagatttggaagcaacctaagtttccctcaatagacgaatgaataaagaaaatgtggtacatatacacaatggagtactgttcggccatagaaagaaatgagatcctgtcatttgcaacaacatggatgtaactggaggatgttatgttaaatgaaattatccaggcacagaaagatcatcttcacgtattctcactatttaagggagctggaaattaaaagaattgagatcctggagatagagattagagtgatggttaccagaggctaggaggtgtagtggatgggaggaagtaagaagtggggatgtttaatgggtacaaaaatataattagatagaacaaataagatctggtatttgatagctcaacagggtgactacagtcaacagtagtttatcatacatctcaaaataactaagagaatataattgaattgtttgtaacttaaagggtaaatgtttgcagtaatagattccctgtttaccctgatattattatgcattgcttgcctgtatgaaaatatctcgtgggccccataaatcaatcaatctatctatctatctgtctgtctgtctgtctgtctgtctgtctgtctacctacctacctattatgtaccaacagaaatttaaaatttaaaaaattatgttttggagacgtctagaaaaattggtgataatgtcacataatcaaataaagaaggtaatatataactccagaaaaaacaaaaagttgttccataaataaaacataattatggcacatcatttggtttatcagtaaacgttactttgcagggatgatacaatagaacactgaatgtttatttagccaataattgttatataactgtaatgggaggatagaaagagggaagtagagaggtgaaatggtgaaagagtgtgaaatcttcatcattcataatagaaagtcagttagaaatatggaatttaaaaaaaaatagtttgagagccttatgaagagggtggcacaaaagactcctgcaacttgttctaagccctgtgcatacaatttggggtgtgtgggttagtttaataattattttgtaaatataaaaggaaccaaagcaaccaaatttctggatataaatgtcctgtgttgattatcatgataataggtagacatcttggattggaattttttaacatttgaatggaataccccatttcccctttaatctttgataggtttaacatggtcactaactgtagagtagggacttgtcgtgctctttattggcagaagtgtgactggctacccctgaccgttcgggagaggagacatgtacacctggccaatcagaccagcagattcactgctggtgatgagtgaagttgcagatgtcagggacagcttgtgctgttcaggttaaattatctcacttcagctctcactctaaagatgatttataactagtattcttcactttcagtcttttcactagcaagcaggatacttatggaaaataattaggatgaaaagaggtcactctatcacaatagtgagtttttgaattcacactttaaacgagatgatcctccttaggaaaagcaaaataaaacgaatttccatgccattgttgattctacttgagttaaatactaacataaaaagttggttttctgtgcatagcctggagaatcttgtctctcagaattatcatgccccaggccattccttgcagattttgaattccctttgtctcaaaaacatccagaaaatctttttgaccttcgggtggttggcagaacatgtgttgtgagggcacctcagtttagaagaaaagccctgaacttagttcaaaagaagggctttccagcatgctattcattcagcttaggactgccaggcttcctgaaagacaggtgtgtcagaaacaaagtaaataaacagaaactcacaatgtccagacctttctctccagagcagcacagttcccttgctgagcggcaacagccaaggctttaagctgttccctctcccttttctgttaattgagaaaaccaattgctgcaagagcaacatcagcagagctaaatgtaaatggagtttaatagaaagagacaaataacccactgagaacccctaacatttcagtgtaataccccagagttccacaccataaacttggtattccagtataaagctcatctctcaattgcacgccaccctcccccatcttattcactctcttgcattattaaaggagtgatctcccccatgggatcaaaatagatagatagatagatagatagatagatagatagatagatagtctctaatatatgtattagaaacagagtctgtgttgcccaggctggagtgcagtggcatgaccataggtcactgtaaccttgaacgtttgggctccagcgatctacaggtgtgcaggtctacaggtgtgcaccaccatgtccagctaatttttaaaatttttgtagagacaggatatctctatgttgcccaggctggtcttgaactcctcttctcaaatgattctcctgccttggccacccaaagggctgagaatacaggtgtgagctaccatgcccagccataaacatgaaatttacttatgttttatgtataccatgtgcacatagcctgaaggtaattttacacaatattttaaataattttgtgcatgaaacaaagtttgtgtacactgaaccatcagcaaaggagtcactatctcatgtcagtgaccaaaaagttttagactttggagcattttggatttcagagcatcttgaattttaggtttttggatggggatgctcaacctgtatatatgcatacatgcatatttatgtaacatacataatggtacctaaaacttagcaaatactcatatgttagctattatttttgttggtattactatgaataataactattagcattttctctcatatctaaaatgcagttggtaaatgctaaactcataggaatgttgtaaagatttatttttttattttttttattattatactttaagttttagggtacatgtgcacattgtgcaggttagttacatacgtatacatgtgccatgctggtgtgctgcacccactaactcgtcatctagcattaagtatatctcccaatgctatccctcccccctccccccaccccacagcagtccccagagtgtgatgttccccttcctgtgtccatgtgatctcattgttcaattcccacctatgagtgagaatatgcggtgtttggttttttgttcttgcaatagtttactgagaatgatgatttccaatttcatccatgtccctacaaaggacatgaactcatcattttttatggccgcatagtattccatggtgcatatgtgccacattttcttaatccagtctatcgttgttggacatttgggttggttccaagtctttgctattgtgaataatgccgcaataaacatacatgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgacttttgaatgattgccattctacctggtgtgagatggtatctcattgtggttttgatttgcgtttctctgatggccagtgatggtgagcattttttcatgtgttttttggctgcataaatgtcttcttttgagaagtgtctgttcatgtccttcgcccactttttgatggggttatttgtttttttcttgtaaatttgtttgagttcattgtagattctggatattagccatttgtcagatgagtaggttgcgaaaattttctcccattttctaggttgcctgttcactctgatggtagtttcttttgctgtgcagaagctctttagtttaattagatcccatttatcaattttggcttttgttgccattgcttttggtgttttagacgtgaagtccttgcccatgcctgtgtcctgaatggtaatgcctaggttttcttctagggtttttatggttttaggtctaacatgtaagtctttaatccatcttgaattaatttttgtataaggtgtaaggaagggatccagtttcagctttctaaatatggctagccagttttcccagaaccgtttattaaatagggaatcctttccccattgcttgtttttctcaggtttgtcaaagatcagatagttgtagatatgcggcgttatttctgagggctctgttctgttccattgatctatatctctgttttggtaccagtaccatgctgttttggttactgtagccttgtagtatagtttgaagtcaggtagcgtgatgcctccagctttgttcttttggcttaggtttgacttggtgatgcaggctcttttttggttccatatgaactttaaagtagttttttccaattctgtgaagaaagtcatgggtagcttgatggggatggcattgaatctttaaattaccttgggcaatatggccattttcacgatattgattcttcctacccatgagcatggaatgttcttccatttgtttgtatcctcttttatttcattgagcagtggtttgcagttctccttgaagaagtccttcatgtcgcttgtaagttggattcctaggtgttttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagatatacaatcatgtagtctgcaaacagggacaatttgacttcctcttttcctaattgaataccctttatttccttctcctgcctaattgccctggccagaacttccaacactatgttaaataggagtggtgagagagagcatccctgtcttgtgccagttttcaaagggaatgcttccagtttttgcccattcagtatgatattggctgtgggtttgtcatagatagctcttattattttgaaatatgtcccatcaatacctaatttattgagagtttttagcatgtagggttgttgaattttgtcaaaggccttttctgcatctattgagataatcatgtggtttttgtctttggctctgtttatatgctggattacatttactgatttgtgtatattgaaccagccttgcatcccagggatgaagcccacttgatcatggtggataagctttttgatgtgctgctggatttggtttgccagtattttattgaggatttttgcatcaatgttcatcaaggatattggtctaaaattctcttttttggttgtgtctctgcccggctttggtattagaatgatgctggcctcataaaatgagttagggaggattccctctttttctattgattggaatagtttcagaaggaatggtaccagttcctccttgtacctctggtagaatttggctgtgaatccatctggtcctggactctttttgttggtaagctattgattattgccacaatttcagatcctgttattggtctattcagagattcaacttcttcctggtttagtcttgggagggtgtatgtgtcaaggaatttatccatttcttctagattttctagtttatttgcatagaggtgtttgtagtattctctgatggtagtttgtatttctgtgggatcgttggtgatatcccctttatcattttttattgcatctatttgattcttctctctttttttctttattagtcttgctagcggtctatcaattttgttgatcctttcaaaaaaccagctcctggattcattaattttttgaagggttttttgtgtctctatttccttcagttctgctctgattttagttatttcttaccttctgctagcttttgaatgtgtttgctcttgcttttctagttcttttacttgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacatctttatttctgccttcatttcattatgtacccagtagtcattcaggagcaggttgttcggtttccatgtagttgagcggttttgagtgagattcttaatcctgagttctaatttgattgcactgtggtctgagagatagtttgttataatttctgttcttttacatttgctgaggaaagctttacttccaagtaaatggtcaattttggaataggtgtggtgtggtgctgaaaaaaatgtatattctgttgatttggagtggagagttctgtagatgtctattaggtctgcttggtgcagagctgagttcaattcctgggtatccttgttgactttctgtctcgttgatctgtctaatgttgacagtggggtgttaaagtctcccattattaatgtgtggaagtctaagtctctttgtaggtcactcaggacttgctttatgaatctgggtgctcctgcaggtgcatatatatttaggatagttagctcttcttgttgaattgatccctttaccattatgtaatggccttctttgtctcttttgatctttgttggtttaaagtctgttttatcagagaccaggattgcaacccctgcctttttttgttttccatttgcttggtagatcttcctccatccttttattttgagcctatgtgtgtctctgcatgtgagatgggtttcctgaatacagcacactgatgggtgttgactctttatccaatttgccagtctgtgtcttttaattggagcatttagtccatttacatttaaagttaatagtgttatgtgtgaatttgatcctgtcattttgatgttagctggttattttgctcgttagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctgtaaaggattttatttctccttcacttatgaagcttagtttggctggatatgaaattctgggttgagaattcttttctttaagaatgttgaatattggcccccactctcttctggcttgtagggtttctgccgagagatctgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctgtgtatttcctgaatctgaacgttggcctgccttgctagattggggaaattctcctggataatatcctgcagagtgttttccaacttggttccattctccccatcactttcaggtacaccagtcagacgtagacttggtctattcacatagtcccatatttcttggaggctttgctcgtttctttttattcttttttctctaaactttccttctcacttcatttcattcatttcatcttccattgctgataccctttcttccagttgatcgcatcagctcctgaggcttctgcattcttcaggtagttcttgagccttggttttcagctccatcagctcctttaagcacttctctgtattggttattctagttatacattcttctaaattttttttaaagttttcaacttctttgcctttggtttgaatgtcctcccgtagctcagagtaatttgatcgtctgaagccttcttctctcagctcgtcaaagtcattctccatccagctttgttctgttgctggtgaggagctgcgttcctttagaggaggagaggcgctctgatttttagagtttccagtttttctgttctgttttttccccatctttgtggttttatctacttttggtctttgatgatggtgatgtacagatgggtttttggtgtggatgtcctttctgtttgttagttttccttctaacagacaggaccctcagctgcaggtctgttggagtaccctgcagtgtgaggtgtcagcctgcccctgctggagcctcccagttaggctgctcgggggtcaggggtcagagacccacttgaggaggcagtctgccagttctcagatctccagctgcgtgctgggagaaccactgctctcttgaaagctgtcagacagggacatttaagtctgcagaggttactgctgtctttttgtttgtctgtgccctgccctgcccccagagttggagcctacagaagcacgcaggcctccttgagctgtggtgggctccacccagttggagcttcccggctgctttgtttacctaagcaagcctggacaatggtgggcgcccctcccccagcctcgccgctgccttgcagtttgatctcagactgctgtgctagcaatcagcgagactccgtggggtaggaccctcccagccaggtgcgggatataatctcgtggtgtgctgttttttaagcccgtcggaaaagcgcagtattcgggtgggagtgacccgattctccaggtgccatccgtcacccctttctttgattaggaaagggaactccctgaccccttgcacttcccgagtgaggcaatgcctcgccctgcttcggcttgtgcacggtgcgcgcacccactgacctgcgcctactgtctggcactccctagtgagatgaacccagtacctcagatggaaatgcagaaatcacctgtcttctgcgtcgctcaggctgggagctgtagaccggagctgttcctattcggccatcttggctcctcctgttgtaaagattcataaagttgatagattttaaatccttggaactgtgccttgtatatggtgaagaatagaaaagtgccatctttcattattttcaccaatagtaataaagcacaattgtatagtaaacttgtaatatagtatatgctcaataaattgttaattaacttttgtgttcatttcctagtgcatatatatcactaagggaattgatactaatgtcattgcatgcattaatggtaacattaattatcttcttacacattgggcaaaaaaagaaaataccaggctgtcagaacatcttggcccagaaacctcccttcagcaaaaagacaaaaatgtgagtgaagagaatatgcctttgagaattgagagggttgcattttgcctattatgtatagagatttgccaatttccctttcacaaactatgacagtgacactgattctggatgagcaacctgcataatgcttcaggggcacatctcttcttctaaggctgcaggcttgccgatgagacagaacacagcctcaattccatctgctgtcatttatctgccaatatagatagcagatctctgtgggtcttggactgctcaaacgacacagtatattttagcaactgaaggggaaccacttgagatcactaaaggtggaaaacacctgatgacaccttcaatcgaaagaaatgagtatccaaaatctgaaacattaggccccacagtacaatggctctagtgacagataaaaaatactatttctaacccttatagaatgaacttgttttcaagagctcaaagaaaacttttatcacatttatcttccacttttaattaaaaagattatttctgaaatgctaaaacttttgttttattcatgttttagaggaaaggagaggaagagaaaccacctgttactttcttgatgctgtacctggcacctgcccttgattgaagatgagttttgcatggtgtctgaaccaaaaataacaagtcctttaaaaattattgtcctaaaaaccagcagatcaaactactttcttttttctcagaggattcacaaagtatattgtttggaaaggcaaagtcagtgaagaaaaaagaggaacgtccctaaatattggtgttgtcatttataatgtaagacttcactagaatgagattatctcaggtgtgaatggagaaaggtaggatgcatgcagtgtggaagcagccagattcaacacactaaaatcattaacacatatgtttgtgtagttgtgtgtaattttgagggggagaagaggaattttgcctttaattctcactccaaccacttgaccaataattgggaatcatctcttttatcccctatttttgccccttgttctatatgttatttttttgagatgttctttatcataaagtgcctttacgtaggcagtatataagcagtatgcaaaattgagtccccatctctggcattgatctcaaagtcctttttttgttgtcaaatacctttgaatctgtgtcttcaaactctgcttgggttcactcaaatcagtatatttctttccatatgtaggtcttttgatttttgtcctaggttgactctttcctgagttcccttttacatcagaaattaacattttcctaattatccagtctagaaattttagtcatcattactttttcttttcattcatttttaatatccaatccatcctcaggttcaattaatcctttcttcaaactctacttcccctgtctttcattcttcagctgagttcacatcacataggtcctcatccattcatgccaggacttcgacagcagatactaacaggcatcaacctccagactcgttaaattaatcctacacactatttccaggtgacttactgaaagtcttcatttgatcctgtcactctccctttcaggactcttccagcaggtcacaactcacatatctgcaggagccaggagctattcaaatggagaaggcagggggatcctgggcaaggagggtatagatatatcctcacctgcatgcgcagtgacttctgagctcctcacagttgttatcatgtgaaaatataggccagggttggcaggctttctgatttttcaagagaacacagaaattagacttttaaaaagttgattcaataaatatgacaaggtatattagggttctctggaagaacagaattaatggaatatatatatatatatatatagacacacacacatatatataaagggtagtttattaagtattaactcacgtaatcacaacgttccacaataggccatctgtaggctgagaagcaaggagagccagtccaagttccaaaactgaagaacttggagtccaatatttcagagaaggaagcatccagcatgggagaaagatgtaggctgggaggctaggccagtctttcttttcacatgtttctgcctgcttatattctagcagcgctggcagctaattagattgtgcccacccagattaagagtgggtctgcacactgactcaaatgttaatcttctttggcaacaccctcacagacacacccaggatcaatactttgtatccttccatccactcaagttcacactcaggattatcacagaaggcatactatgttctgagctttcttctctgtactgtaaaaaaaaatacagcagtgaatgaaacagacaaaaattctacccttgtggagtttatattccagctgggagtgaaagatgaaaataatttatatattatatatatatgtaatatatagaaatatatatttatttatatatctatatttaaaaatatgtatggggaagattttgtgataaataccatgaagaaaagtgtattagagaagaggttaacgaatgtgtgtgtggtgggtggtggaattttaagtggtgttaggaaagacctcattcagaaggtagcatgtgagcaaacatgaaggaggtacaaaaagtcctcctgccatcatggagggacagtaagaaggtcctggtggctggagtgaagtagcaaagtggagaataagggaaaaagttggagatgaaacagaaggggactcagagctctattcatcttactagtggctttgccttattaaacaaagacctttaaacagatgttaacaagatccctctgactcctaatttggagatgactttaggggaataagggaagaaagagagatcagtgagaagcagaattctttttttcagggtctttctcattgttgttctcactaccatcatcctttggacagacaggtactctttttaagtcaatttgatctaaatgtgggttttaaaaaaatccttttctttgtttaacagctgagacaaagcaggaattttaaagcaacactttactgacaaactatgtagaatcaaagtaacatgaaactagataatttgttctatcataggagatatcttattcaaatgaagtcccctaggagaaactcttcttctgactccctcttcacactggacagcagaggccatctttaactttcccacaagagagggctccacaagacatagtcattactcaagagattgagaatcaagacagagaagtttagtctcctcctatgcttacttaaggctcacctccttaactctgatttcctctctgggaaatctctattcctctggtgactgtatactgggatttagtacaacatttagggaagtgcaacctactcaaaatatccaaatatagcaccataattctaacactctaataagaggcacatccacgtattttcaagggtggggaaagatcattaaataacagtatgagttatattatgttctcagtaaatattagttaccttttcttcctcttggagtgacttttaccaccctctgtaactcatctagccttatctaatgggaggccattttattttgggatggcatgactacataatttcaagctatttcttatgttatttgccgcctcttaaatatcttccccttacctccttctcatacaaaccttaaagttcttcataagtcacaacaacttataaggtcttttacctaactgaaccgatgtcttctctttgctgtacatttacatgtctataacaatcatttttcatttaaatatgaaactcttggatataaaaatattaacttgaaaaatagtaaccctgatttgctctttatactttaacaccttttgtttctttgtttataaatccactgtgcaaagctgtttatgcagcagaaatttagtaaacattctgtgaatgtctgaaacatccattcatcaatccactcacacaaaaacattaacatatactttgtcatgcattgttagatgttcaagcatgaaaatcaaacagtagtgaagaataatttattgtaaatattatttttcagggaagagaacactttagaaataacttcttgagaaattggtttgggaaaatagtatatccaaaattagagagcgccatcttgtgggcaagtgagtatctcacacaaataataactattataagttgcaaaaatagaatttcttctctttttttcttacaattcaaatctcctttttactgtaaatatttgtattgatgcataataattatacatatttaggaggtacatgtgatattttgattcatgcatacaatgtgtgatgatcaaatcagggtatttaagataaccatcacctcaaacgattattattttttgtgttgggaacacttcagctcttccagatattttgaaatatacaataaattattgttagctatagtcacctttctgtgttatcgaacactagaacttatttcttctatctaactatatgcttgtacccattaactaacctcttttcatcccacctctctcttcccagcctctggtaaccatcattctactctctacctccaagagatccactgttttagctcccacatatgagtgacaacatgccatatctgtctttctgtgcctggctcatttcacttattgtaatgacctccagttccatcaaggacacttaggttgattccatatcttggctattgtgaatagtgctgcaataaacatgggggtgcaggtgtacttttaatatactgatttcctttcctttgaataaattcctagtggtgggattgctggatcatatgatagttttatttttagttttttgagaaacttccatactgttttctattatggctgtactaatatacattcccatcgtcagtgtataggagttctcttttcccagcacccttcccagcatcaaataaaatcttttaaagaggctctgtctgtcctagctgaagaactgaaaatatatattaaaattttatataattaatgatattttaaacaatccttagaaactaattgtaatatttacaatttacttttaaatttcttgaatagctaaaaatgaaggctcagcaaagaaattactaaatatcataaacatgacatacttttcataagaaagcttataaaactgttaatgaaaaaggagacagaattcttagagattatctctttaaggggtctatcactttttgggtatctcagggtgctttgaaaatttgactagatcaaatctctcttgaaaaatgtaaatgtacacacaatttttcatatagtttcaggggcttcaccaactcccctgcggttgactcatgaacccattcatgaacttcatattttaaatacttacattttacataatatacaattaaagtctagaaggtttgggggtaaaagctaaaatttgattccattatctcttcatccccaaaacctcatgctcacacaattttataagattgatatagatagatcaaatcatgatgaaatatatttgctacatcgtttgagttcctaagctaaatcttaaaacttatagtttctaggctattaatgttccttacatcaacaaaaataaatatttaatattaggttcatgtcattcatggtatatctgtcacaaatacccttgatgtccattctatccaaaataaaagatgttattatggatttccttctttttcagggctgggtagaattctagtgtgtgagtgtgtgtgtgtgtgtgtgtgtaccacattttctttatccattcattgttgatgaacacttaggttgattctgtatctttgctattgtaaataatgctataatgaacatgggagtgcaaatatctttttgacacactgatttcacttcctttggatatatacctagtagtgaaactgctggataatatggtagtactatttttagcttttaaagaacctcgatgctgttttccataatggctatgtgaatatacattcccaccaacagtgtaaacatcttcccttttctccacatccttgccatctttcatcttttttgtactaacaggtatgagttgatatctcattgtggttttagtttgcatttccttgattattaagtgatgttgaacatttttttcatatacctgttggccattggtatggcttcttttgagaaacatctgtttagatccttttcttgttttttaatcaagttatttgttttcatactattgacctttttgagttccttatatattttggaaatcctgtcatttgggatcacatggatgaatctggatgacgttatgttaagtgaaataagtcaggcacagaatgacaaccaccacatgatctcatttaaatgtgaaagctaaaaatgtcaaactcatagaaacagaataaaatggttgttaaccagggctgatgggtgggggctgaagactggggcaatgttagtcaaaggacacaaaatttcagttaaacaggaggaataagttccagagatctattgtacctcagggtgactatagttaacaacaatacattgcatacttgaaaatagctaaaagagtagatttttagtgatcttgccacaaaaaaagataagtttgtgaggtaatgtatatattaattagcttgatttagccacttcacaatgtatacatctatgtaaataaaatgttttacatcataaatatatacattcttatttgtcaatttttaaatatatatataccttttagaattacagcttagccttgggttaatgaagtcatgacagtacgaggtttataaaactgaacaaagaatcctaaccatacgccaccctaactatggaaatacaatggaactattagttttctgtttcctctttctttctcattgagaaatcatgtcccttcataaaatccatttctctgtgtcagatcattggagctctttttttctccattattatttataatagttagtcttattcatctcttgctagtatgaaccttagtaacctaggttagtatttcccaaagtaggttttgtggaatgctaatatcaacaggtactacctgcaaaatggttgcatggtcaaataagctgagcttcataaaattaaactgatatattactggaagctaaataaatattgtaaatatccaggaaggagatacataggcaaaatattccaaactttattaaatagttaactttttgtttgcttacagagtaatggggttgggtgctccacagagaacattatggcacatgctgaactagagataaaaaagatagatttaaaaatatatgcagattgcttggacaaatttcagcaggatagtgagaaattgatttctagtgtagaatattctgggaaatgagatttttttacattacgtgatcctaattcaaatattatgattaattttaagtaagcaggcaatttgatgtaatggagaaagcactcacctgaaacagagttaacatgttttattccttggtacagtcatgctggtttttaagtgtttagcaattcattttacctctccagctaaggtaaaggaattcttgtaggagtaatagaagccctgtgattagtataaaacttagattaagatgctttgtgcagcaattcccatggcatatttctttttgtcttttctctttctctttctttccctccctccctccctccctcccttcctcctgcgctgccctgcccttcttttctttttctttctttctttcttgacaaggtcctgctttgtgccccaggctggagtacctgggctcaagctatcctcccacctcagcctcccagaaatcctgggattgcagacatgagccaccatgcccaggcccaagtcatattctaaaacatggcttactctgatattaactgccgtctacaggggaatggtctaattactctgcaaatgctctccaccttctagaatagtcacattccaattagtatatttaaagctcttagaagtcacgtaataaaaagaaatattttctttaagattttgaagccatatttacaaattatttgactctctagtctttttcttgtttttattattcaactggactcttaacatctcaaaaactagtattcaatgtaacagtttggaaaatgttcttataccttttctacttttaatagataaaattgtttttaattcatgccaacagagatgaaccaacaatctaaaagaatggactcctaatcaattgtagtgaatggaccatatgttcatattatctgtaattaaatggaggaatttaaaaggaaaggtgtgagaatggaagagaaggctgcctccccacatcctatccaaggctcctgtttctacccgcacaccctaccacagaaatacccaagatttattttctagagaaatgttctcagaaagggtcaggactctgagagagaagatgtagcaccctgcagggatgaggtgtggggctgaaacaaggaatgaagggaatgtctgtggtgcagatctggttccctgagatactccgagatagatagagattgggatgcagggtgtttgtggggaaatgttctcagtgtgagcaccacaggaagaagagtaggaacagggttaaaggctcaatggaggcctcttctggttcagttggggtttctaaaacttagaggaaggggttaggactctatactatctccttcccgtttatcaaatagccattgtctgcagactgctctgtataaatgggtataatcttgggcaagagcagtataccctctactggagaaacacatgctgaggggattctgggcagtgcatttcaacatccagaagagtcagcatcatgaatgctgaaaccttgcctcctaccccaccctctacctaaaatgaaagtaatcagattaatgataaattacttaaaaaaatagatgctggagtacaatagagtaatggcttcaatattttgaaggaatttacatttcaacatagactcctttagcaagtcaaactatgaactagtgtaaagacagaataaagccatctttagtgatgcaagatccaaaaaatgtaaaatattaatactattcacttcatttgccacttgagcttctataaaatgtgacccacaaaaagcaggaagctatcaaaaaggaaatcatgagatccaataatcaacacgggaaataacagaaagaatgcttaggatgtcagatttctagcgggcctagaaagcaactagctgagaagtacagattgaagcaagagtacaaggtgttgaggaggaggctgaaaagagaaaatgaaattgatagattatccaatttgctagagcatctgagaggggtggcagatatgagtaccatttggaaaagaaccaaagcaattattaactactagcaaaacagaagttgagccgtaaagcaaatatgtatatattacatacatagtaaataagatttatatatagtaaaaatatgtaaacagtgattgttaatttaactaaaaattgtgatgtaactaggtgaaaaaagggaactggagatcagtataagataattaaatgtttattatgataagaaatgaatagataatggctaaaaaaatgaaaatcaagaaaaaaaaacccagtataagcatattacttagaattatagagttaattaccagcagaaacaaaatgacttgagaaagagcattcacaatgaatatatatagtatagttttgcagactgttttttgaataaggttttcagtataattttaaaattatatgtgcataatttctctatttatcctgatgggtgagttaaattgccctgacaacctctaaatcttgtaacaacaaagatgatagtgattgttgtttcccatactacatatcatcgacagggagctctgctgcacagcctcctcactctggtacagaaactgacagagttaccatcatggactttgttgatccttctggcagaaggagaaaggggaagagatggagagtctcacaccagcgaatcaacgcttggctgctgattggccagaattagtcacgtggctccattcaactacaagagggttattaagtgcatctacatgtgtcctgagggtggagagctacaaagagagagccagtatcgctaatggttgcctcaatttctctcataataattgttaagtaaaaataaaatagggcttggcgcagtggctcacgcctataatcctagcactttgggaggcccaggtgggaggattgctcgagtccaggagttcatgaccagcctgggtaacttggcaagacaccgtctcctcaaaaaataaaaaaaactaaaaaaataaaaaaatagccaggtgtggtggcatgggcctgtagtctcagctacttggaaagctgaggcaggaggattgcttgagtccaggaagttgagactgcagtgagccgtgtttgcaccactcgctcttcagtttgggtgacagagggagaccctatctcaaaacaaatacaaaaacaaaaacaaaaatggtttacttctagctaaaaatttaattaaaaattaaaaattcctatggataatcagcatgtaaatatttgtgtgataaatatgtaggtatataagcaaaatatgtatataaacaaatatacatatggattatatatgtataatttatatttttatatttggttttttcatatgtgtattattgagtccttaaacaaatgttttttgaatagcttctatttaccaggcattgttccaggttctgggtattcaatagtgaacaaaacagacacccctatttctgtgtagcttatatggagtggtagggacagagagactcagtaagcatagtaaataaatacattgtgtagcgtcttagaaggctctcagtgctagggaacaaatagtgcaatagcaggggagttcaatacagaggctgagaatatggttagaatttgcaatagggaaatcaggttagaaagggccctttgaggcaaggattgaaggggagtggggatagattcgtgggcaaatgggcagggaatgcaaatatcctgagactggagcaggcttgcgatttttccaggaatggctggaaggctagtgaggctgcagtgaggggacataagtgagatcgtgaatggggacataatagggggcatcatgtgaatatatgggatgtagagaccgtgctaaagactgccatactctcagttaattgattgaactctgagtgaaacacttgaatttacaccgggaaataaattgcccagcatctagaagatgattaatatttcatgtaaaccaacttggtcacactatgaagatggaaatgtaaaacttgttacttttctatccattattaattgcttaaagctcttccatgctttagataccgcactaagcatttatgtttcagcaaagtattggcataaaataaagcttacaggatggtgtgaaggcaatattttttgagtgtctacagcatgccacaaaatgacttcaatgcttagaataattgaattacataaatataatgtccccattttataggcgaaaatactgaggctcaacagacataaaatggcttgagttaccaggctacagtagaactaggatttcagtccaggtcagtctgaccccaaaaccttttcttttttcattgtttggatttagcacccccaaaaatgtcttgtaatgcagatttcctgggtccagggaattgtttaagtttttgttctaaaaactttcttatgaagcagattacatatggaaaatgaccctatggactatgagaattggcctttagagaatgtcactgccagccctgttggtatctataagaaccaataagcattatttacagagagtgatatacacagtgataattaagaaataactatatttatgatgacaattttgccaaatttactagaaaaaaataaaatatcctctgatttgagatttattgttcttttcttttgcaggtaagtttggaaattttttttgcttgtggaatagaggtatggtatcacttttttctgaattttattttaattgcttttaacattgagcacctttcataagtaatatgtttcaccacccattcggttgttgttgttgtatatatttggaaagtaacattgtgggtttgcgttatttgattcagaaattttacatatgtgattccatatggtaaatctatgcagtgtttgtatttgggtttgtgtttaaattatttctgtgtcaagtataaggaagaggattgtagtgcggggtctgtgtcagggaaatgggggactgtaaagaacagaggaaagaatatgcatgtaatgagaggttgaaaggctgagaagggcagctccaggcatgtaatctacaatggccatgaatgcatgtcatgaggaaaagatgccttttcaggaacaaaataatcaactgaaaactgttttcattcacttttctaagcccctagttttttgttttctcctattattgtgcaaaatttctggccagactattgctgacatgtacctttgaataaaaaaaatggctgtaactattctgaaacatgttaagttagaaagcaataaaatagatccacttcctggaaaaaagctcttattaactatatgtcaactatttcagataaggagtaggaagtttcagtaaagcttctagatacacaaaagagaggataaaatattagagggacttagaaagacgtgatatttgcactgaggaaagaaggtagcctgtaagttgaccacataggaccacggctttattattgtgcaccgtgctttcattagtatataaaagaggtgattgtgtgagatttaaatcaagcatgaacttaaactaaattccatattaattataaacggtatgtttactttattcaaaaaaagatatatgtttctcaaaataattgcaaatattattattaattatataaaaataaagaggaatgaggatactaatctactcacctaagttctagctaagagatgaggtagcaaaggaggaagaagttcttcagttcctggtcttgatgggtaaagcgatttgatctcattatattctctccaatataatcatattaatatcgaagtcatcagaacggagttgatattatcaagctaagtaaatattagaaaaataaaaattaacaaatggtttcactaaaactgcaaagtttgtacctggaccacaaagctaatggactggcctacaatggtctttgttttaactagtattccgggggttgatggaaagggagtggaattaaagggcattgtaaaatgtcatggcatccaatctaattatcagagctctagctccagggtcagcaaactttttctgtgacaagccagatagtaaatattttagccttttggggccacaagaactctgtagtaactactcaactctgctgttgcagagcaaatgcagttatctgtagacaatctgtaatgaatgagcataatatgttccaataaactttatttacaaaatgaaaaaaagtagtgggcaggatttgctctgtggtagttttccaacccctacctagctccctttgaaataaaaaaaaaattaagtaaactttagagattttggaacaagatgtatgttggcccccttcagatacagataaacacttggtctaagaatgaaatgttgttcaactggagttcagaaacaagatatgaacttctcaaaagctttgatgaatttaaacactagagggcacaaaaggacatttttaagtcaaggacctcttgtaaacagaacactacaattatgagaaactgcctgaagtagagcgatgtgacctcaatgtgcataatttgtttgaaatgtcagcctgtagctcttgtgacctcactgaccacaaaaacttgaagtggttgaccaccttcatgttgctgtaataatagccacatgtctttcttctttttttcctacttctttctcacttctttctctctcttttttttttttttttttgattgcttttggccctttcataaaatatggccaaaattgaggatttatatgatgggattttttttcatttcctaatagtttttttaattgctttagattctaattttcatgtggtgagtcctatttgtagtaaataagttattttgaattatgttgtgtcaatcttttataaaatcataataaaataatgcatgttatttatgcatatgatttatgcatataataatgtatattgacagatgtcatctgttacattgatttatgaactaatttgaaagttttatttcagaaaaatgcttaaaaatcagcagaagcttgaagcctcaaaattactcctaccctttaacacatggacacaaagatggtaacagtagacactgaggattccaaaagccaggaggggaaaggggaataagggaggaaactctacctactgggtacaatgctgaccacctgggtgatgggatcagcactgccccaaacctcagcatcacgcaatatactcatgtaacaaacctgtacatgtagcccctaaatctaaaataaacattgatatttttaaaatcctacctcttaatttagtaattctgcttgtagatatttggattgtggaagtaatttgggatattaaaatatttatattcaaagatattcaccgtaaaaatacctataatattgagaacctaggtatattctatgtatttcacatgaactaatgtttaaataaattttcatattagacccagccaatagaatcttgtcaaccattaaatatattttcaaatgacattaagtgatagagaaaatggcttatagtaaaccatgaatgcaaagcagaatccaaaaattatgtacatcaaatctcaattgaatgttaaaattagatgcgtaaatatatgtatatacatataaaaataaagaaaatgagccagatttacaagttgcctctcggtatagatgatttttaaaaaaatttaattttctgaattttccaaatttctatcatgaatattcatcattcatatggtcataaaaaataagtattattcaaacagaaaactatttttgcattctgacagcacttttttaggtgtgattcttagatcagtggtgctaaaagtcagaaggttataaggaaattatttatgtatcaggcaatcaatttaaatgaattattgattgttacgcagacacatcattagagtcacttttttagccctgggatgggatgatttgtctcaggtttgggtgttgtggcttagttgccgtgcactaggcagtgaagaccaggaaggaacaagggcctgctggagaggcctgcagtgctgatattgaacatggacttccctgtaagctccctggactgtggtaaagcaggacacatcacacacacacacacacacacacaaacacacacacgtggacacacacactcatgctcctctatcctttttctcttctaaatctgctttctgcccttgcctttccctataaatggatgtgtgtggagaggagctggagagacagcaggggtctgaaggatgctaacttggactttttcctgagcaaagaattccttaagaatgacctggtataaaaattttgaagaaatctcataaataatatgggcaaaaatgtgacagcaatgtggcacaatgcaaaagcttgtcactagtttcagcccagcttttcctcgtgattgttttgagtagcatgaattatcctctaaaatgttggtttttattcctttttcattttgtacaaacatacctaaaagggtgaacatagtataagcaaagacacaacgttggaactataaggaataattttttcttaattcactatgtatttttctaacacttttcttggagcttttaatccttagaacctaggagatggaggactatacactcgggtttacttttctttcattttcttcttctgaattcttttttttaacttttaagttcaggggtacatgtgcaggtttgttatataggtaaacttgggtcacaggggcttcttgtacacattattttgtcacccaagtattaagcctactacctattagttttcctgatcctctccctcctcccaccttctaccctctggtaggccctagtgtgtgttgttcccctctttgtgtccatgtgttcacatcaattagctcccactaataagtgagaacatatggtatttggttttctgttcttgcattagtttgctaaagataatggcctccagctgtatccatgttcctgcaaaggacatgatctcattcttttttatggctgcagagtattccatggtgtgtatgcaccacatttttttttatccagtctatcattgatgggcgtttaggttaattctatgtctttgctattgtgaatagtgctgcaatgatcatacacatgcctgtgtcattataatagaataatttctattcctttgggtatacacccagtaatgggattgctgggtcaaatggtatttcttttttaggtctttgaggaattgccacactgtcttctacaattgttgaactaatttacactcccaccaacagtgtataagttgactttttaatactagccattctgactggtgtgagatggtatttcattgtggttttgatttgcatttctctaatgatgagtgatgttgaagactttttcatatgattgttggctgcatgtatgtcttttgaaaagtgcctgttcatgtcctttgcccactttttaatggggttgttttttcttgtaaatttgtttaagttccttatagatgctagatattagacctttgttgaatagtttgcaaaaattttctcccattttataggctcactctgttgacagcttcctttcctgtgcaagagctctttagtttaattagatctcatttgtcaatttttgcctttgttgcaattggttttggtgtctttgtcatgacatattttttttttttttttgagatgggtgtctcactctgtcacccaggctggagtgcagtggcatgatctcagctcactgcaacctcctcctcctgggttcacgccgttctcctacctcagtctcctgagtagctgggactacaggcgcccgccaccacgcccagctgattttttgtatttttagtagagacagggtttcactgtgttagccatgatggtctcgatctcctgacctcgtgatctgcctgcctcagcctcccaaagtgctgggattacaggtgtgagccaccacacctggcctgtcaggacatcttcacctgttcctgtgtccaagatggtattgcctaggttgtcttctgggatttttatagctttgggttttacatttaactatttaatacatcttgagttaagttttgtatatggtataaagaaggggtccaatcttctgcatatagttagccagctatctcagcatcatttattgaatagggaatcttttctccaatgcttgtttttgttaggtttgtcacagatcagatagttgtaggtatatggtcttattcctaggttctctatcctgttccatttgtctatgtgtctgtttttgtaccagtaccatgccgttttggttactgtggccctgtagtatagtttgaagttgggtggcatgatgcctctagctttgttctttttgctgaggattgccttagctattcgggctcttttttggttccatatgaattttaaaatagttttttctagttctgtgaagaatctcagtggtaatttattaaaaatagcactgaatctataaattgcttcaggcagtatggccattttaacaatatggattctttctgtccatgatcatggaatgtttttctatttttttgtgtcgtctctcatttgtttgagcagtgttatgtagttctccttgtagagatttttcacctccctggttatctgtattcctaggtattttattctttttgtggtgattgtgaatgggattgcattcctgatttggctctcagcttgactattgttggtgtgtaggaatgctagttatttttgcacattaatttcatatcctgaaactttgctgaagttgtttatcagtttaagaagcttttgggctgagattatgtggttttctagatataggatcgtgtaatctgcaaactgggatagtttgacttcctctcttcctgtttgaatgtgctttatttctttctcttatctaactgccctagccaggacttccaaaatgttgaataggaaaggcgagagagggcatccttgtcttgtgcccattttcaatggtaatacttccagcttctgcccattcagtatgatgttgactgtgggtatatcattgatggctcttattttttgagggctgttccttcaatacctagtttattgagagtttttaacatgaagcgatcttgaattttatcaaaggcattttccacatcttttgagataatcatgtgttttttgtctttagttctgtttatgtgatgaatcacatttattgatttgcatatgttgaaccaaccttgcatctcaaggatgaagcctacttgattgtggtggataagctttttgatgtgatactggatttggtttgccagtattttatggaggattcttgcatcaatgttcatcaagaatattggtctgagttttaaatttttgttatatttctaccaggtatttgtctcaggaagatgctggccttgtagaatgagttagggaggagtccatccttctcagttttggggaatagtttcagcaggaatggtaccatctcttctttgtacatctggtagaattcagctgtgaatcagtctggtcctggggtttttttggttggtaggctatttattactgactcaatttcagtgctttttattagtccattcagggattcagcttcttcctgattcagtcttgggagagtatgtatgtccaggaatttatccatttcttctagtttttctagtttatgtgcataaaggtgttcataatactctctgatggttgtttgtatttctgtggggtcagtggtaatatcccccttatcatttctgattgtgtttatttgaatcttctctcttttcttctttattaatctagctggtggtctatgtagtttattaattttttcaaaaaaagaacaactcctggattcactgatcttttgaatggttttctgtgtctcaatattcttcagttcagctctgattttggttatttcttgtcatctgctggctttggaatttatttgctcttggttctctagttcttttagttgtgatgttaggctgttgacttgagatctttctaactttttgatttgggcatttcatgctataaatgtctgtcctaacactgccttagctattttccagaggttctggtatgttgtatctttgttctcatttgtttcaaaaaccttattgatttctgcttttatttcattatttacccaaaaggcattcaggatttcaggagaaaaggcattcaatttccatgtaattgcatggttttgagtgaatttcttagccttagcttctaatttgattgcactctggtctgagagattgttcattattatttcagttcttttgcatttgctgagtagtgttttacttctgattatgtgatcaattttagagtatgtggcatgtggcaatgagaagaatgtatattctgttgttttggggtggagacttctgtagatatctatcagatccatttgttccagtgctaagttcaagtcctgaatatcttaatttcctgtcttgatgatatatctaatattttcagtgatatgttaaagtctcctgctattattgtgtgggagtctaggtctctttggaggtctctaagaacttgctttatgaatctgagtgtttctctctgttgggtgtgtatatatttaggataattagatcttcttgttgaattgaaccctttaccatgatgtaatgcccttctttgtcttttttatctttgttggtttaaagtcttttttgtcagaaactaggattgcaacccctgcttttttctgtttttcatttgcttggtagattttcctccatccctttattttgagcctatgtgtatcattgcatgtgagatgggtctcttgaagacagcataccagtgagtctcgattctttatccagcttgccactctgtgtcttttaattgaggcatttagtccatttacatttaaggttaatattgttatgtgtgaatttgattctgtcatcatgatgttagctggttattttgcagacttgtttatatggttgttttatagagtcattggtctgtacacttcagtgtgtttttgtagtgtctggtaatggtctttcctttctatatttagtgtttctttcaggagttcttgtaaggcatgtctggtggtaacaaattccctcagtatttgcttgtctgaacaggatattatttccccttcacttatgatgcttagtttggccagatatgaaattgttggttggaatttctttttaagaattgtgaatattggccctcaatcttttctggcttgtagagtttctgctgagaggtccacagttagtctgatgggcttccttttgtaggtgaccttacctttctagctgcctttaacatgttttctttgatttcaaccttggagaatctaatgattgtgtgtcttggggatgaccttcttgtgaagtaccttaccaggagtttctgcatttcctgaatttaaatgttggcctctctaactaggttagggaagttctcatggataacactctgaaatatgttttccaagttggcttcattctcctcatgtatttcagggacaccaatgagtcgtagattcagtctctttacataatctcatatttctcggttttgttcattccttttcattctgttttctctattcttgtctgactgtcttattttagaaagccagttttcaagctctgagatttctgagattttttcctccacttaggctgttctgttattagtacttgtaattacattatgaaattctaataatgttttcagttctatcaggttggtgacattcttgtctatactggctgtttgtctgtcagttcctgcattgttttatcatgatttttagcttccttccgttgggtttcaacatactcctgtacttcaatgatcttcattccaatccatattttgaattctatttctgtcatttcagccatctcagcctggtttagaagcttgctttagaagggacacggttgtttggaggaaaaaaggcactctggccttttgagttttcagggttcttgtgctgattctttctcatctttgtggacttttctacctttaatgtttgaggttgctgacatttgaatgttttttttttccttttatcctatttgatgaccttgagggtttgattgtggtattaggtggattcagctgattggcttcatttctggaagattttaggggtccaacactcagctcccaacttctggactgtgtgcactaactctgggggacttgtatgaggcccaaactttgtcttctcattcttcaagttttggaatccactcagctaggggtgctgagatgggacagctgcagtgaagtgctagtgggtgtgggggtgcctgcctccttgcagatgttcaccagagtggcagaggcaatgcagcttacagaggtgggcaggaggcccttgctggagcctgtgtgcacagtcacactggaggtggtgttggctgggggtagggtggtggcaggcacaggtctgaatgccttctctgtgccccacaagcaggagtgatagctcagggtaggggaggattcactgttctctgtacagcccacgtgtttacttttcaaataatttgatgaactgagtgaaaatattgaatttagactagctgatttcattaaactatgcttaaaacttcaatttatacaatttttttcttcattttaaaactttgaaccaaattggcttgtaacataaactaatagattcaattagttatttggaattattttcaaagatgtgtccaacattctagagtttaaagtttatatcctcaaattacaattgcttgtaaagtttactggtttatttcctcaaatgatcattgctggtttatgtatatgaaatattctcaaacatatcaaggtacagataaagctatgagacacgtaagcttcttctgttgtccattgggtaggtagagaaatggatgacttggcttatttaagctaattactaaaggaaatagagaagccttgagtcctttctggaacaaaacagaattaaatattcattacatgagggaaagcataatttagaacaaaataatgaaatttccctggagtctgtcttctaagaggtttgatggattcatttaacatacatttatttcactcctactgtgctgggcagtcccagggttatacagccccaggaggttcagagtccagtagaacatgagcatataccactctttttctttacaatactcctttagagaaaagaagactgcagtttgcattttgccctgggtaagaaacaaattagagatgtaaagaaactttgctaagcactacagatgcctttgacgtgtttattcccgttgactcataactgtgtctcaccagataacctatagtatattcataccgaaacttatctttttctaatactttagttattagtttttaggtaacctgaagaagaatgaatatgagcttttcatatctatagtaggttcacttccaatccagagaaaccatggacagacctttttttcagctaaacaaagtgtggtagtttaacatcgcagtaagatcaaaaaccaccttaactgagtatgaaaaatatttgatgatacagtagtcttcaaactaagtttaaaagatgcaaatagtacatatatgccagtacatatgccagtgtcttgaatactgggaaaaaggaggattcgagtgggggaaagttcacgacattgtctctctgcctctaatctttcctgctcaagtccttgcaagtagaatcaaaatatcaattgttctgaaattaattctgcttttattatttcactcccttgttcagagaaacttggtaagttttcacttctaaatggaacaaaggtcccactcctaacgtatcattcaagttccttcacagtccagtctcaacctttctttcctttcttttcctaactatcattgttcataatacagtaatataccctcccaggagtattcaatcttttggcttccctgggccacattggaagaattgtcttgggccccatataaaatacaccaatatgatagctgatgagcaaaaacaaaacaaaaagtctcatgatgttttaagatagtttatgaatttgtgttgggccacattcaaagccatcctgggccatgtagcccacaagccacgggttggacaagcttacaggtctaaactctgataatttcactacaccttggatattcatacttctggtgagcagaggctgcttacactttttataggccaatatcaatcataacgtttaagtgtttaataagtatcaatatttatctcatatggctctcagaacagtgaattaattcacttagcaaatatatattgaaccattaccactatctggccctattctagttgttggccaaacagcagtgaatcaacatgtctctcctctgaaagaatttaattttttgtggggaggatagtacaaaatatatgaaatacataaacacattcaaaatgtgtgtcgtgatggttagttctatgaaaaaaattagtgcagagtaaagaaatagtaatacgagtgtgattttagattaaaaagtcagaataggtatccctgtctgttaaactgacatttaaatcttaacaaaatgagtgaattatgcatttttccaaaggaagagtgtttcaagaaaaagaaatagcaagtgcaaagctccttaggaggaggcacattgtgtttaaggaacaggaagaagttgagtattgtgggaactgagtaagcaagaaagagaatagaaaaggaggccataaagagaggagagggcttttgaaaaccatggaaaagagtttggattttatcccaaatggagagggaaactagtaaagggttttgagcagagaaatggcatacattttcaaaggatcactctgggtgctctgtgaagaatagagtaggagcaagagtagaagcagggaaaatggttatgacgccactgcaatagccttggaaggagacagtagtgacttggacccgggtgatggcagtggagatggcgagaagtgatcagattctggcaatgttttgaaaccagagctaattgtgtttgatgacggatttttacatagagtgagagaaaaagagatgagtcaaagataattcaagggtttttggcctgaacaaattggaaatgtgtgtttttatttattgagcttgaggagttcaagggaggagtaggtttagtggtggggtggttctgtttgagcattttgagtttgatagtcctgtttgtggaaaatgcttggagtgctgccccatttccctccacccactatagagttcacctgaggctatggcagactcagtcagtttcccatctcaggcacctgggggctttctgcagtacaaaggagcctgctgagaccgtttacagaattttttaacattcccagtggcaacactccaacattgagggtccagagttggtgctcatataccccaggttccacattctccagtgggacagtcctgaggcatgtgtatatatggtcccacaaaaggtccctggggagattgggccccatctgcccctgcttattaatacacactgtattaacttttcttcctttgctatcccacttctccatcacctaactttgatttcctagaatcgccttcctgcctcttctccaaataaactacgcactccaatattttgcagtctccctggaaggaattaaacctaagactattaaatacccatatgtcaatctccaagaaggagattgatatactattctgaaaaccaggcaaaatgtcagggatggagatacagttgggaggcgttagtctttttcacaagcctattcaaaagcccattgcacaagcactagatatgtgtagattcctacacagacttgttaccgtccttgtctgcctcatgtcatctcttccacatgaatacaatgatactcatcaatgaatgctctgaactttcagcaaaggccacagtagaatttctagatagtagtagattgagaagtgatgacaatttgattggaagctaagggatcttggggacttgtcttgaatttgcatttacatagaaagcacatcgtttttatgtttgacacatatttatttgtggtgggtttggaaaaccttgtagcggttatggaggggcaccccaacccatcctttggtgttgccattgctttttaattatgatttgtgctaagccacacattctcattttacctagctcagggttctaagcatgtttttcatgatggtttggttaggaaagtgagtagcaatgaatgagctcctcaataaatacatagcacagacactgacaggcaaagtgaagtttgtaatcacttcccaatcaattgttcaactgaatgtgagaagaaatcattttctctcctgttttgagtcagaatatcacataaagcacaactcttcctgcatacattgtatcatattccacagtaatttacttttttgcaagaagtatccaaaatttggtttttcctgctgagcagttatccagataattgcaaatcagtggaatcatttacatgaataaagatttttattctaattaacgtgctaaatcaagcacaccaaatgtctctaattcttatattactcaaatggcaatatttttgtcagtgactatcatatgaaatttcaggtgcctaatgcattttcaaatggcactcataagcatactaacgttttataaataaatgtctccatatttttaagatgaatggacaatttttgatttttaatgtagtccccaattttcaatttttcaattttcatttaccgaatggagaaacagcattcatcagagcaaaagagcaagtttcacaagtcatgggaacaaacatagatgctaatttcctattttaggaagttctttttaaagtattatcattaagaagcacaactctgtggaatatttatgtgcacatttaataatagagaattcggatgtcaagtctgtgtgttactcatacccatacatgcatcctcaaaaagccttggaagttaatcctcagctgatgaaagctaagcaattgctctggaaggatacttgaagtttttggctcttggggtgaaggtacagtcacgaaaacctctcttcacaagagggcgctgtgcaaacagctagctcctcgtgaaggaaaattgccttgcagactggcacgaagtggatttctttacatctattaagtgctctgctcttcataaaggaaaatttccttgcaaactggcacgaagtggatttctttacatctactaagagctctgcttctttctctctctcttgctttttccttgccatgcctcttcttaggctctgtaaggcagacttcttgtcttctctagttatgcttctgcaaactgcatcatgctgattctattaatgatttgattttaaataataccatcataggtgttaaatgatgtgtatgcctatctggcttctcaggacttctctctcactactttacatctcaccaatgtgtaaaatatctatgagacatctttaatttaatatgattcaaaagtctttactcttgacctttgtttgaagtctaatcaactaaaaacctaaaattcctggtgggaaaaaaagaaacttgactactctagttttttaataacatgtatttcatttattctgattataaaagtcatctttatttattgtagaaaatataaacattatggaaaataaaatttaaaaacatctatcattctattacccagaaataacttgatcaacattttggtgcatattttaatgaatagatttttaaatgagaaatgcttttcaggagtaattagattctacttagtattgacaattttataatatgcttttaaacaaagtattaacattaacttttttggaaaatgccactttctgctacttatagctgtattggctattttctcagaacttctgctgtaatgagtttatactagagttgcaaatacacgttctttgaatgtacttgaggagtcgatagtctgaatctgagattttccacagctcttggagcacctgagaacacactagcttcttccacgattctgcagtacttgctccttcctgataggatgcctttgtaagcgtacaactccaaacatgggctgagtgttcagtaatcatttgtgttgagttcttcagtttcatggagactaaaattaggttttctctgtcactcttgtaatgtcatctgaccttgacctgcatttcaaattgctgagaagttagcaagctgacttttacactaggcacatcagaaataattgattaaaaatagagttattgaagttgaatttttttcatttatagaaaagtacaatgtcttgttcatgacaaacaaggcctaacatttatataatgttcatttaaaatatatcaaaagaaaacaaaataataaaacccacagaaaacccaaaaacaactcacctattaaaacatctcttgatttataaatattatagtttagtttgtacaatatcagtaactgtggaaagctcccaattatctcattcccaagtgcttgactgactcataacttaccaacaattttcttatttcagagaatcccaaaaacatattacctaggactaacctggaataaaacttcatggttgatagcttttatcaattaaatgggtattgatttggataactcataatcttgagcatatctttagatttactttttatcctgaatttatttttgttagtaagatttagaaattcagatttattttgtgctttatatgacatagaaaaaaacaaattgtctttcctgtacaaagtccacccttcaaaatagactccagaagaaaacatagagacttataacttaggttaaacataggcacaatcctaaatagtattcagatgagtcttacctgaataattgctcacctaatatgataatcacctgttaagaagcagtttcttaaatgtcactgttggaatctaaacagtagatacacaggtgttcactgtaaacttgtttcaatttttctgtatttttgaaaatgttcataataccatcttggggggaaaaagcctctttttgacatggcaagaaccatattctactgaaacagatcttatatgctctatcaagtttatattttagacatccctaattcagctcattctggactattccaggactgattgccctactaaggcatgcttatttttttctttatgtgtataagaaggattcaaagggaccgtttgtcagttttaatgtgtgagcactactgatatgttttattgagaaaaagcttactgccacagatcacagagatatttttccgaggtaagattcttgctggtttgcaagttttgtaaggaggcaccaggacccatctctgtacccccagccacggagcccttatttagacccacactgggctgaaatagaaacttctgtacaaatgtatctctcctgtgctctttccactttaacagaatagaaagaattgactggttgagcccaaatatttcccccaggccagtgttacaaactggcgtttcaccaaaaataactcatttgatatgtttttaatgttgatgatctgaaaaatcatcttcttgtttttgtttgtttgtttgtttttagagatagggtcttactctgtcagccaggctggagtgctggagttcagtggcacactcacaactcactgcagcctcgattcccaggttcaggtgattctcccacctcggcctcccaagtagctaggaccccaggcatgcaccaccatgcctggctaacttttctcttttttgtagagatgggatctagccatgtttcccaggctggtctccaactcctgggctcaagagatctgtccgccttggcctcccaaagtgctgggattacaggcatgagcttcatacctggctaccttcttcttaattatatacattttttcttaaataagagctcatgttattttttatttctataaatattttatattccttctcttcttattgccctgatactttaaataaacctaagcccagtcaaattttgtattacccttgagtttcagtttttggttcattcagccctaagttctctttgggcatgaattgttttcaccattgactactagcaggcagctggcatagcctgggacatgtgaggtgatgctaaacatgcatttgtgagtagaaggaaggaagaaaggagggaaggaaggaaggaaggtaggtaggaaggaaggaaggaaggtaggtgggtgggcaagagagagggaggaagaaaaaaaggaagggaggctggttggtttgattagctgttgaacaaaattccatatagaaagtagcttactagtctatatcttttagctctgtttatttcaaagctttgtgtgtttttgttagggtcacttatagaatatttagaaaaatacttgctgcctcatgcatttcaccatccagtgcctggtgagacctaaaagcccatagttataattttgtttctttgaccaaagtttgttttattttcaaatataaattcaatcccttaagactcacctatagcatatatatcaaacaaaaacacgtcaaatttaactcagaattttgctggataaatgattttactggatatcatctgaccaatgaaataacaattgtgtgttctcaaatttacttctacatttttaaggtagtaagtttaattaaaaatctctaatataaaaatggcttattctctaaaatttagaggtaagctaaagttttcatcaaggccccattatttagcactttccaaacttgggaaggtcacttaactccactgaaccagtagaaataaaattagtggtaacactgaaagcaaaaaccagaaccagtccaattgtcttattaataatagcctaattgtgtaaatgtctgttataaatttcttagctggttctgagagatagctagtaaatggcaccctaagttttatatattctgttacaaaacaaaaacaaataacaacaataagctgttttcttttgctgttactcaaacatctggatttctattgtagcccctagcacattgttacctttggttggatggactgaaaagtgttgtgatttttctcctatgtagaatattcagagggaaagtgcagggcagtgcacaatgcatacaaacattgacaggatcacttttcctcaagctgaactatactctaggcctcctctctctctagttaccacagttgaacccactcagcccctacttgcagcctcagtcccaccccaggctcacaggccaattttgtcctggaattaggaattgaaagatctcaggtaagccagccacaatggagacaagatttagagataagcaaaactgacttggactcacatgtctgtcatatattacctctgtggtgttagccaagttccttaacctctatgagtctcagatttctcatctataaagtggtgataataatgtctgctcgtgagttggaagattaagtaacatgtagatcttatacctgacaccaattgtttttcctgtgaaagttcaaaacttctcttatgatttaattcttcaaggaaggtgacctgacctttttcattcctgtatttacttatattccaggcatgtattggttaagatatacattttgcaattaagagggacctcaattttaacctcagatctgctactcattggctgtatgatcataggggcaagttacttcaacttcgtaagtcttcgtttcctcagtggtgatacagaataaaaataacacaaagcacacagataaattattatgaggataatatatagtataccctaaaattctgtgcagagtcttcagaacactttcatgttagttaccctattcagtcctctcaaaagctctttgcaatggctctctctcaaatgagaaccaaatggataagacattataactcagcaaggtcaataaacaccacagaataaacaccaaataagtggttgatatcatcatagtaaaatgaggaattagaaaagttaacccgacattatggtgatgtttggttcacaaactcattcagtgcacaggaagtgtccaagtaaggaaggggtctgaggatgacaggtactcaggaatgggaaagtttatgactgttggctccaacaaatggataaccagatttagcaagatattgaacagtcacggaaaaaatccacagcaccaaaatttagcacatgagatttttatttagggattcttggtattgggggtcttttttctttctcccaagggagtgattttgtttctcagcctagcaatttcatcactgcttttgcttatttgtaagcataattctaaaaagttgtaagaagccatttctgtccttatttggtacgtggccaacaataagggtagcatgagttggagtcagtgttgcaactggtttcccaattaaacaacctgtctctaggatcccataagttttcaaaaaataagtagaaacatttctatatttaggagaagcttagggttttgagcaatcgagaaattctatcacctaatttttgtaaaatttcttgccacctaattttttttagatcttgtaaacaaagttcttagagggttttaatgctgcaaataaaacattaacatttcttcatatgattaaccttcaagatataacagctaatattttattcttacacacatgggatataaagatttcaaatagagaaaagtgttatctatcaaaactgaggactgatattctttttgaaactgataaagtggtatgcctatttaccatgctcatgaagtaaccaattggcaatttttagaacttaaagatgtttctaacagtataaaaatagttttcctacctctcccaaaagcttacaaacatcagtagtgtgtgcctaaaattttgtccagttttcagaatgtttttatataaattgccttattcagccctctccaaaactctttgcaatggctctcaaatgagaaccaaatgggtaagacactgaaactcagcaaggtcaggcaacaatcttcaaggtcacatggcaagttcatggcataactgtgactctaatctctaatcccctatacagtgctgccctgaaaacttgcccaatggtattttgattaaaaaaattaattaatcaatcaaataggaaaaagaaactaaataagccctacctaaattacctgttctgaaatttctgcccctatttaggcacatataagaatataatgtaaatgctccatcttatttttaagatgccctgaaaatattggtttgtccatttattaaacaaacataattgtggtttttatgtctctagactgtttgctaagcactgagtacccagagggaaagcagatgttatccatgttctcatagtgtttaggtctatcaggggagccagataccaaataagtcattactaatgtgatgacattgacaaagaggaagtacaaagtgcagtggagacctcacctggtatggggaggcagggaagacttccggaggaagtgaatttcaagatgtaatcctatatccaccactccttcactcaccagtcaatagctaagtaggatttttatttaagactgtattcatgagtagaatattaaatagaaagaatttttatgacttttaaaatcttcatatacagagaattgaacaagacaatcagtgacaccagaagacttttacacacttgttagaaaattgtgtcaaattatttatttcaaatgattagtctacattgatttcaagatttttaaagaatttgagtctagaaatattttttgaatagttagaaaaatctcttaggaacttgtcagtcatttagtagatattcaataaacataaaatttattttcttttccttccatttcttcctccatgatttctttccttcaatcccatttatccaagtaggctttatccaacaaagctttagaaggagctttgttagtttagtgaatagaaaagcttgacttagttgttttccaaattgctaaaaaaaatcctaaaattaatgtagatggaaaccttaagtgtctagtaaaacattttgattcacaatcatagtcatattgattttttatcattatatttaagcatgcctcttattgattgttttagtctatatcctgattttagctctttaattacagtttgtgtctgtttgtgtcctgggtcatatatgagtaatggatgcaattgtagaagcttaaaacacagagcatgctttcccagtgttcttaagaccatggggtaccttcaattctgttaatgttttactgttgccaagtcttaaaataattgtctcccatttcagaacatggaataattgacctttcaatcaagtagactcatataaggtttagaatgaatatttgaaagcaattcaaagaaaattttggtattattttgcaacacttccattttgagaaataacttatagttgattttgataagtaatgtaataaaaatcattttttacatttacttgtactgaatggatattagttttaaggagtacacaagccccgttatcaaactgccttttgtcacactcttttgcaatgtatcattctgaagatagaattacaacgacaccctcatcagaagtagatggtaaataacagtctgttatttgcttccacattaacttctgctggctttgagtctgtaaccagagactatttcaaaatacagcactatcctgaaacccactatctgcctgctctggtttcctgaagcaatgtctttcaacctaacgcaaccccactgatgtaactgcttatttctctgaagttcagctcaaccctcgtctcttccgtatgcctgttaactagagacttgatgcgcaagtaattgaatgcctatgtggattacgtttaacttatcccactctcaaatttgggagtttcatttttattcatagtagctatctcctataaaggaaattctgagtttctgtgtcagacaccgaaacccaaatttgccatttgtaacatctggaatcttggaaccaaaatcccagaaatattcaagaggcaaaaacgatgccttatttagagctctgcagaacataagagctaagttattggcaggagacgggcactttgctgatactttagtggggttaggacttacatggataacaattggattggagcaatgtttagatttccgaatctggttttccctaggacatataaaattagtgtgcacaacttgtaaacataataatttgtctcagggatggaacatctctccttgctattgaatcatgcttttactaaaattcatctggaaaaataaacgcttaataaatgacagtaattagaatgttcaaaagatgtcttctttgttcttttatactctttgatacccatgaagtaaaaattataaacagcttgttgtattataaatgctagtaaagattcatcctagaaaatcattttatttaatttcttattttttccaaatgtctaaattctcatgtctgtgaaatattagccagttcttcaaaaacaatattgatatttctatttgaaatcaaggcttaattttgctcatgattaatctcagaaataagtagcttatttctatgaccttactgagacctggtaacctaagaaggattatgtgtaactgtgtggaagaaatgaaaaggaggcggtaagtaattatttaagaaaaaataatattaatattgacagacacttcttgtgtctgtaactgatttcacactaggaaaatgaagcagagtttcaattttcttgttcataatttcacatttacagttccattgttttatcttgcttaactgttctagatgactgcctttacaaagcagggggaaaagaaggaagaaatgtttttgacagtaatgaaaaagacaagattagttctccttccttgcacatttttagaaaaagttggacattccctagcagattcattctagattattcgtatgtccttgtagcttatcaattagatatccattaaatttgaatatccctttaaaaaggtaaatttgtaagcaaaggcagttaattatttgtgaaaatgtatactgctggctttagcctgaatacaaagatagggtttatcttgctatcagtaaaattgggataacaatgaaaatatttttctgcttccaaagtcgtatacataaactgtagcttttattagaaatcagtgatgctgtttcacctacaaaaatttaaacaccactggacaaaatgagagctttgtgttgcctggagggtgaaaaaagtccatctttgccagcaacatcccttctactcttctgcttgtctttgtggcctccctccccctccctttcacaccaagccacctcaccccaccagctgttagggactcctcccctctttacgcagatcaccagttatcttacactgtctggctttagtctcagatgaagacattctaataagcaccaagttgttcagctcagtgctaactctgccaggaatgtgtgcatttcctaagagctgccgaaaatggaaattaaatagtttgaaagaattaaatgataatggtggcatttcatacaccagaagggcagattggcatcagtgtaagcaccttttcagtccttctttgagaacaccaggaaagtggctacctgttttgctcatgcgaaatttggatctctatacaaaagcaaaaagacagtttgtgaagcgttacaatattgcaagttgattcagggagaatgtgttgtgtttatttttgaactctctgctcctccaaggttgctgctgttcagggcagttctcactcacccactttctttgagctcatgtctgataagaaagaggtgaaactgtaaaaaccttttctattactcgtctccaaagctgatatgaaacctgtagcattcttaagaacccctggtgtcctggatgctgttgtgaaaacaagcataatgtttaatgtcttgagcttttattgaaattatatgaatattcaagactcccttggtgtacaagagacagattgagctttagaggtctcaaaatttgcagatatggtgatgttcactgagctcaactcttggtcaattttgtccagttcagagagggttaaattcactcttgggcacttgaagcctctctaatcttatcctgaagaagtggcgctctcccttggtttacagttgaggtcacccgcggggcagtgtttggatacagactgatgaaattatgctgcattgttaacattgaataccactcagtggtgaggaccgatgacggcactagggtcctttgactccttgggtacaatttcttgaaatagatgctttcccaaaatgtcctggactcataaaatatatgaaggattctatttggctttcatcatttatttaatttgaaagaaagttgttttaacagatttatcagagttaagaaatgtttctagggaatagaaaatggacaagataattgatctttgttgtcagagtcatgcattgtaattcactctctaaggtgacgcagcatctccttgagggcaaagctgccaaaagttctgaaagtgatctgcctgtttttttttctcacactgacttttagagaggcgctggtattttcaagacgagtaaatcctgtttacatcctgtggaaggttggctaagaattatatccatctctttttaagagaagttgaaataaggaaaattatagttggcagttagctgtgtgaaatttagtaatctttgtcagatgacccagtcataggcatgtattttttaaaattttttaacgaagccctgtgggtttacattttttaaagttcacactgatataaaggtttacccacttcaatcacaccttttgttgtgtgtgcatgcgtgtgtgtgtgttgtgcttttcaggagtggcatgtgactatgctgtttaatcagggctatatttaaaaacaaattttcgagggagtgtttctcacgttaattatgagataaggcctgagtgaagcaaactctgtcgcaaaggccaagtgtcatgcagcaggaagtcctggccatcccttccagccctgcctcagccagcctgccatctctctgtcagcgcataccactgcacaaaggaaatgccctcactcagctacaagtgcctcctgctccgtgcggggcctcagggccccagagccccgcaccagctctgacttctcgtggttcctggggatcttggcatcgtccttaaaaatggcttttgtttgggatcctctgggagccacggtgccaggaccatctacaagagccaaatcaagattgcgtttctcaaagtcctacaggtattactcttttccttttgtagctaggaagaattgtttaactgccttaggccccttgcaaataagcctttgccctatgttgaccttctaactcctaatgcttgttaaattgacaatatattaaataagagccaagaagatgatgtaaaccttgaaataggggtatgtaggtacgtgcagaagttgaaggaagttgactaactttaaaagctaattctgagagttaaatggcaaacttaacaaagcattcatattactgccacctgaaaaacagtgtattaacttgtctaatggcttaatacagtcaactctaaatgttagggaagggttcttgtttgaccaacaaaaaaaacactacattattcttcataagtgtttcagggcacatgcacatgaaaaaatggaaactaatgctgtttcaggtagtaattcagtgttcatcttgcccagcagaattacatgtcatgaattcaaactaaatattttaataatcttttgtttctggaagtcatattaaaaatcttgacctcatgacttcactaaactgtcaatgactgttttacaacaaaatcagcttattttaaccaaataactggaaagaaagaaaacacttaaaaaatattggatttccttcttcatttgagtattctaggtgttaataaagagaagattgattattctttattattgtttagaaagaaaaccttttctgtttttgattgattacaatctatagcactgaaaggtatctatttaatcaatagtaaatagaagtgacattgtttgcaaaattttggatataaggtctttcttatttagaccaaatgcagcacatctggaagctgccaagcctatgtagaaatatatattaacactgaattaaaatgtgttctgatttgcctgcatataaaacattcaaagtttgaattaaaataatttataaggattaattatttgctttagacactaaagaagataatgtccttggaatttttagggaactataaaatcagagaaatcaaatttaaaaattttgtataacaatgcataagcaaactttggcaagaggtaaatataatttgccagctaaaggtataggtattaactccatttatttttatttcaaaataaaataatgatttatttgttatgtttgttacagctataaaatttagttgaaaattttaaattatatgcttcctatgtgctttgcattttgttaaatgtgattctcatgcttattgtatgctaaattgtacatttagaacttaacatcaatgatttgctaacattactgtgcatatttccaacatatggtggcttctaggctctcttcatcactagatctgataacaagctccttaatatcataaatctccagctgctgaataaagtaaaagcaatagcttgattgactaatgaatttgagaaatctcacgaaatgcagagtttaagctcttctgtgtagtttgcaaatatattataaaccttgccttctcaatttggcaaagatatttttattttgaggtgttatggtattgtaacaatttaaagctatatgataaatatattttttcaaggttcctttggtcaagttctgaccctttccaaaatataagcattagcagctaagaatgactttttcatgtatttgaatacctcacatctgtaattttaacaagtttcatttgtaacaagtttaagaggtgagaatgacatctcaaatatccatcatgagtcagtttccttcggaagcttgagaggctcagtccttcctttacttcctcttaatttgaatatacaatttcccacagaataattaatttttttatatgtgctgctttcactgtttggaggttctagtttatctttccagttgcactgcaaactctttgaggttagaagtttccttacatacagcaaaaatgccagtaatgcctatttgataaagtattctgttaccctttcttatttggcatcacccgataatgttttattggcatagccaacttgatatgatcatatctatcataagttgaattgagtggaagggttagggaggtaggaaggcagttggccactggctcttgcatttctgcaggtccctcatgtatccaaaggagattacgcattcagccacgacaatgtactgacaataatgaaaaaaggtacatatcatataacttaaaatttttatcataccataatacctcaaatgcaccatgagtcactctatatatatacagacacatatacacaccacacacaggcacatgcacgcacagttaaatgctataattatcttctgaagagcatagttttattgcatagcattcttggaattaaaggtgttaaactatttgatgtaaacatgtaaaatatctcataatgtcacagccttgtttttgcatttcttattttttaaaaaatatacaaaatccttacgcggtgaaagtaacttaagcttatcttgacctttaagaggctttggatctgattccattattgaagcaactgaaagaactggacattggacaacatttcttcattgaatttctcccttataattttttttatgagcaatattttttatcttgtaaaatcttcaaatgtgcctattgtagtgtcatttttctttggctattgaatggataataatgcatgctactgggggtacacttagctttaactggaatatttttccttggcatggcttttgctgcctggtaatattcaggctaaaggaaagccaggtgtacaagatatgaaattcaattagtgtctgatttgttaaagtaatagcaaatcatatacatttaatgagtgttgactcttgagaaatacaatctgaaacagttttacaatgctcaaaatagatgtgaaagtttttcagctgtgacaattttttatcttatgtgggtaaaatacatttttataagaaaagattaatatatagcttattaagtttgattgaggcagaaagaaggattgaaagagaaaagaagagggagagggaaggaaaggcaggggagaggaggggagcagggccgtggaaggaggagtgaggaagagaaaaagagagaaagcagagggttacataataaggaaggtactttttctctgtgagcccagaagagattgccaaccatgttttcagtaatgggatcagtgttagcattagggcaccacttacaaagatgagtactaattttgagggcaaggtgctgatttatctgcctaggttctggcacacatgtttaaagattcacctaattactttagagcaacgcccctcccaagtattatagagaagaaagaggagaatgatgtgctcaagaaaacaatgtggagaagtttatattggttgtttaaacatagtacctaaaaaaaaaaaaatggggaaaaacgatctgggaagtaaagaaagaatcaaggagcaaagatttagcaagcctgtggaccctgacaactccaataagagaacactagggaattttgtgatttaaaatatattattgcttaaaactacagtagtgttcaaggaaactttaaatagaaaattactcttcttgagatgattctgtcttccaaagagaacaaatcacaaggatgttaaaaggaacattttatgtgacaagtttggggtaggtactatgtaaatagaagagaaagtcactcaaggtacatttgaatgtagggcagagattattccatagcattccacaggccagaaacagaaagtgtcttctagttttcttgccctttatagtaataggggtcatgggatagaaattctcagaaaatctccaaatctcatttttgccaattgtttcaacatcttttccttcccagcattttagcagagctgccaaacaggtgattaattaaatacatatgtgcatgcttgtacctcgtgtagaaggtctaatgagtaaatttatttgatatgacatagactgaacagtagaaggaaggattaatgacagtcagatcaacaaacaaaagtacaaatggtatctgggctatgaaaagataaagcaatatttgcccaaacaagaagatctagatatccctaaattacctcctatattattaggaagtaaagaccaaatctacaactttgatctggaaattgtatagtagctgatatgaacagggatcataggagagtgtggtctcatagctactctttgctactaccaaaacctgagtggtagcacatcagtgattgcccaaccaaactgcacaattcccattagaaaaagctgtctcaaacccacatcttagaaaggaagtgaatgccaccagtgaatcaatacactgggatgtaactttctgcataccccaagaatacctcctgttgcatagcactttttagttttcaaagcttttcagatgtaacagatgtgacagctgttgtttttagtgtgccacagctcatctcacttaattctttagggtaagtgaaaaagatgagtgtaattagtatcaaataagagaagaagaattgaaggttcagggactagagaccacacatatatgtggttagaaagtccaaagtaagaacagtagagctagtttgtattggacacttactatgcaccaggaaccattcccaatcccatacatgcattagctcatgcatgtcatcctccaaaacagcctcgggaggtggatctagcattacctttatcttacaaatgaggaaaccaggcagagcaagtttaagaaacctgcacaggtgtgaattctggaagtctgtgttagaaccaggactcctggtccctctcccacctccagcttcctcaccagatcctattatcagcacacaaggaaaaaaattccataatgagaggtattgttctaacagatgtactatcttcctctacttaactctgaatttttctctgaagacagaacaccacgtaatttgttatagaatagggcttagtaatcagttaaaatataaacttgttaaataatatctaaactgtcctctaacctaattgatgttggtttaaagaaatgctaagcaaaagcatcaaaatagaggtatttttatattaaaaagaagaaaaaggaaaatgaatccgttattttatattgtctgcttctgccccctcctggcttttgcttcatgggcttccatctggctcatttcatctggccaaaaacattggtcatgtggttgtattttactgccaaatattactccttggccagctgttcagaggagccagaagattctctgagctcgagaggtcaactccatcctgtgtcatgtctatttattctactggcatagtcttgactattaaactaggtttcttaatgatatttcaaattgtgagtaatgttggctaaattgacaaaaagaaattatagacaacatttatatctaagaataacaatactactaacaaccattgcacattgtaggaagaggtagcatggtataggaggagaactttggctctagagccaaacagacccagcttcagtgccaactctgctgctttcttgattgggcaggtttcctaacctctctgagccatttccatgtacataaatagaaaattaaaatatctacttcataaggtcgttgtgcagattagatgaaagcatgtacgtgaatgcaggactacctgccaactctttcatagcattttccaagtcttcactaacatttcacaaattttgtgaagcttcttttgtgaaatacattttcagataaactatcatcattggtaccactcttggtcacagaatagtacaatagagctggcttataaatggttaccttataagcaacttgcacatacaacccaggctcaccttggaaatgtagtgtgcaggaatgattgacagctggctagctctacagccacactgctgctgaggttcacattttcacattatcacttatagctatgagactttgggcaagttacttcatgtgcctcagtttcctcatttgtaaaatggagtattatgaggattaagtgtgttagccatgtaaagtgcctggcacatagacaacactaaaataaatgtcagctattattaataatagaatgtaagctccacatggcagcaatttttgtccttttttccacctttgtatggccagtgcctggaagagtgtgtggtacatattaggtgcttggcgtttgtgtattgaatgaatgaacctattagcaaatgtgttccgattcatggcaagtgtgaggatactctgcttccttttgccacattcatgggaagagggggttagagctgaaggaacctgatggttcatttgttcaaactcatttgtcttacattgaagagcttgaagaccttgaaaggccccagggtcatgcaacttgatagcggcctggtcagagctagaaccctggctctgtgtgcttctgtgaaaatctttgttccaatgtcccacccctcacttcaatacatatgccatctaattcagtgctttcagtaaggcagcaaaatgaatgaatgattcagagcacacttcttgcagacaggagagtgtataagagccataattgggcaatgaccatggaaggacaggtttctgaataagagaaagacttatccaagtaaaattatgttcagacattttacttacaagtctaaaaatcacttgctacaacagctacaatagggtttttgtaaggaagtaccactttgtaaacaacatttttgtagaatgcattatatgcatttttttcaaaattgaaggaaagccccatctcaaacattcaaaagaatctgctcaattatcaatgtagactagaaacagagatagagaggggagatacagtttgagtgttttctgtattatcatgacagcacatggaacaaccacaggcagaaagattacaaactctgcaataaatataaaggtattggttttataaggtggcctgcaggctacggaccagcacagagctctggcaaatgtggaatgccaggagatgtacaaaaaaatcaaggtgacaaaagaagaaaagacactccaaactgccaagggtttataatcatgctgtggatatttctgatcatcagtgtgttaatggttttcactatagttaaaactataccatttttgaatgggtaataggtatgaatatttatgcttaattagtagtttataaaatttatactatttattttcataatgttgattttatgattttcaacgagtgccatttgtccttaagtcatgaagtggatgagcccccatcaagtgattttaagagacagtaccttgactgagcagctggatcaaagcctgtctgatctgggcagagcaaataaggaatacttcttacaaaagaggaagcattcaattctatacactttaccttggtactccttgttctggaggcctcagcttctatcatgttctttgccacagtcatatacccaccttctaccttggctctccctcctcctaacttccattattttttctactttcaaactataattgacaagcctttttaatttcaacaagggtctgaagagaggtgtctgattttccgtaaggctgggttatataagcacacagagttgaatcagagcaaaggaaaaatccattggcaaaggaagaatactatatgctactttaaaacttgtctgaatgtattattttatttacttattttagaggcagggtctcactctgtcatctaggctggagtacagtggcatgatcatcactcattgcagcctcaaactcctaggctcaagggatcctccagccacagcctcctgggtagctaggactacaggtgcaccctaccattcctggcttaaaaaatatatattttagagtctgttttgcccgggtttgtctcaaatacttggcctcaagttatcctcccacctcagcctcctaaagtgctgggattacaggcatgagccatggcacatggctcaaattatataattcattagctggtaatagtgtaaatttggaagagaaaaactaaaatgataaagaggaaagatggattgtgaatagagtaaatatatattactgtaattatgttaagccaatcaaatgcaaaggacagttcaaaggggacaagtatgtaagccacattccaaaaaaaaaaaaaaagctttgaagtgaagctttaaaaagataagctttgtgttgagctaaagaaataaactctataaaaacaaaaccctaaaattgttatgacaatgaattaaacattcaaaaatgaacagaacagaatgtaaaagattattccttcaggtggtaaatgttcacaaccagctctctatgggggaggggaagggcactatttgtagtatttgctgatttctgtgccaaaaaattctctcacctgcccatttcaaacagcagaggtcactaaatgtggagttggcaagagatacatagacatagtactctatacagtgtttctatcatatagatacagtagatataagttgccccaaaaacataataatacaaaatgtagccaaatcattcagaagttatgagttttgaatacttatttccattgtttttaatataatttgtttaattatagttaaaaatttttatgtaatttaatttttaataactgttgggtattaacaactgacttataaatactcctaaaaatgtaacagaatgtagtgagggacaaaatggatgcggtctctgctttcatcaagtttacattctggtagagaaagacagaaaataaacaagttaacaataaataaaataaatagagactgagatgagaggttctgcttggggaagccagggaaacctttacaaagaaattgataatttatttgcatataagttcaagcatatccattccatacatctgtgagtacatttgtagttctaggcctgaaactcagaactgcacaaggtcaatggaaccatataaatattgacctcattactgacttgttttcagtctccagtctcttgagtgaatttacctttgcttctttgttattataaaaatacagtgagggaaagtaaaacaaggaggaagatgaaaagaagatgtagggggaagaggagcagtttacaatatactttctattacattgtttcacactatctcaaaactttttatacgtagaaaatactaaagcaaagaaaaatggaagttaaaaatcggtagcagtagtaatagtcctatagtaggaaccttgttttgtttgaaatatgtgtctgtgtctgcctacaaaacataaacaccttaagctaagaataactgtgagattaattttttattttcaaagaaataatacaaattttaaatcttgcattaaaaggaaagctagctggacgaaacttttctgacacacagattttgagaatagcacccataaatatgcttccaatgcttgtcacttgatccctttttggcaattaacttgcctttaattgatttgtggattacccactggaagttgctatggataaaggaatgtaatggcagagtttgtttatatagggtaacaaaatagactggctgggaggagggatttaactgcaaaatatccttgattttcaggaatttttcttttcacataatggcagtgtttagataaagaatggaaagttaatgaatcagatttgtgttcccatccaaagggaagatttatgtcctgtttaagaatcacattaatttgatgacgttagtacattctctagtgaaagagtggccactttagtggaggaaaaaaacaagcaacaaaactccttctgccatcttcaggttgtacctgacgaaaagcttttatttgtgggttctatgaagtatcactgccctgatctcagatgaactaaaagatgaaaacatttcatcgctcaaataattgtttatctcacatcttactggttctagaaaaggactatatattttccctcctaactttcctcagtttcttggtataaagttcaaaatgctttgagtagagttgttcaggaggtcctcagtggcactgccactcactggttgggacgtttttgttctctgtcctcctgtgtggaagatgacaaggacggctttgtgcaacttctgttgtatgcgctgcttttcaaccccttggatgagatactcatacaaggaacgtcaggtttttttcctaaagcaaatccgtgtaaactgagacaacataaaccttagggagatctgacacaccaaaatgccaagaaagggaaagaagaaattattatcggtgggggaaacaaattatcctgtattttggagtgaatttaaaaggcttattgtttgttttagcactacatgacttaaaaaaaaaagtctcgcagtcttgccttcctcatgttggttaaaatggaaaggattctctttctttgctatttatagataacccttagcactctgcaaggatctatttggtataaaatgatgggtgtgaatgtgccagtaagagagaaaaaaatgcttagccatatttactcatataaccaacatctaggtcaaaatcaaaatattaccagctcccaaggggacccctttattcttctttccagtcactatgcacccgaagataaccactaactgacttccaatagcatagatttgactacttttgaattttatatgaatgaaattatacaatataaactcttattttatttcagtcaatattgtgtttatgggattcattcatagtgttttgtgcattctttattctcattttgttagtattgcaccaaatgaatatgctacaatttacttattctagtgttgatggatagttaagtattccagttttaggccattatgaattagagccattatgaacattattggatatatcacttagtaaacaaatgtacatgtagtgttgcagtgttttgtgcatacacgtaggttgggtatatcccaagaggtaggatttctgggtcataggttatgcctttgtctttagatattgccaaatgtgtttctatactggttgccacatttatgtcgcccccaaagtgatgtttcagttctctgcattcttaccaaagtataggtcatccattttcagtgatggcatcttaaaaaatgtttgcctgtaataacaatgtcatcatgccttttatttatgcagttgagtcttttaatctttaggacctgtttttccaggaatagtgtgggtaacagtgagccattcacactctgtctgtttctcctcatgatgaatactatgtaactgtgaattaagtgactaaaataagaaacgatctgatatgcagaaatagagttttccctgtttgatccatatgcagcttaaatatgtgatgttattctacattttatccagattcatttttcaaaccaatagtaatcattgttagcaaaaaccaataaataatcttttattctgttttaaaatttccatgtcgtactttgagttcttgctatatatcccgtgctcactttaaatcaggttttccttcccgtacattatttcttggaaaatatgttttggacttttcctaaaccaccttaacctgttgaaaaacactagtaaatgcataggcagtgtaagtcacgctaaaataaatgtgtattgctttttcaagattttgtttacccatgcatttaaagaaggtttttttccctttattttctttcttttttgtcattatagtcattatgtctttttaatgttaagattccggtaatatatattcctcatttttatgtcatctccaaagctccccataactgattgatgatatcaatccggcttctggcatataaagtttgttgacctggttcagtttgtaccatgtcaaaatgtgatcattaattattagatgatgtcaggaaaaatttagtatgtgtgataactgtgggtcccatttcttaaagctttcaaaatccaatcttaaggctctctactttgtggcatatgagggaacataagtaaacattagagcaatatcaaacgtattctaagggtttcatgatgtgaaacaatatatcactttattaccagacagatacttcacatcgtgaaatttgaaaaagcatacgaggtggggcacagtggtttaccctataatcctagtgctttgggagggtgaggtgggaggatcgcctgagtccaagagtttgacaccagcctgtgctacagagtgagaccccatttctacaaaaaatttaaaaattagtagggtgtgatggtgcctgcctgtagtctcagctactctgggggctgagggaggattgcttgagcctgggaggtcaaggctgcagtgaatgtgatcacaggagtgtactccagcctgggcaacagagtgagacctcatctctgaaaaaaagaaaaagtatgtaatttttacgtaagagtcactcgattcatatcatgaagcttgtgctaaaaatggaatcattcagtgatcatgggctgcttttcaagcatttttcgctcaccctttaccattatgacagtaaactttggggaaaggggaaggcatgggccaatacatcttttagtatttcttggttatactaagaactactgaggaactgctaaggaacaactacatagataaaaagtatttttattataacccttgtgaaaaacctcttcccccataaaacgtttagtatcttgtatgaaggcataatgtacttttaaatattcaaatccaattccagatttcatttatgtgctatgtactgtgtaatccaccacgcaaaatgtaatttcttgcttttaatataaattttcattattatcataaatgaagtctcagaccacaacattttgttaggttgcattcaaatggtaatcataatatgacctataccagtttttgcatggaagggcagcagccggctgaactagatttccacttttgtcttggctcattaaacaacaatggacaagttaccttaacttcatgggtcctcaaccttctcattcgaaattgagtgtatggactgtatattacaatatccttttaagcttacagaaataacattatggaggtatgagaaaattgtaaatgatccaagatatgtgcctaaatatttcttcatacatcaagcatgcattcatgaaatcaacaccaagcccaggaaatatcaaagaatagctcaatgtccctgtgaacttatatccaattcaataattcatccaacaaatgtatattgagtatataatctgctagacttatgaagccttaaactttatgctgtacattctgatatatgttgttttaaccaggggttggtcagctttcaaaagtgacccttttgctaacattgttcttctggctgaaagctagtaagtataagcaaaaggagagatgtatatgatctcacttctatgtggaatctaaaaaagtcaaactcacagaggcagataatagaagggggttaccagggggtgatgggaacaggagggattggggaaatggtggtcagaggatataaaatttcagttagacaagaggaataagttcaagagatctactgtacaacatggtgactatcattaagaacaatgtattgtaaaccaaatattatatgtggtcacttataagtgtgacctaaataatgagaccacatggatacataggggggaacaacagacacaggagcataccagagaggggagggtgggagaagggagagaatcaggaaaaataactaatggatactaggcttaatacccccatgacacgaatttaccattgtaacaaacctgcacatatatccctgaactttaaataataacaaaaccaaaaaaaaaaaagaaaatttctaagagagtagattttaaatgttctcaccacaaaaaagtatgtgagttaatgcatatgttaattagcttgatttagctcttccgtaatgtgtacgtatttcagaacatcatcttgcgcactataaatgtatgcaatgtttgtcagttaaatatttttaaatgaattttttgaaaagaggaggggtgtgaaaatgaagactacttctgactttatattttatattctggggttacaagaatgagacctccctgatgcctacacacaaatggattaatgtgaaactgaaggtttacttgcccagtttacttgcccatgtttacttgcccagttgattcagctggtttatgtataattgtcaacaatttaaactctgtcccattcctccccaaaatttatgtactttaaaaatagatctcatcatttcaacatttcaatttatatatgagagaaataaaaaggactagtaaaaattatatgaagaagcaactccaaatatggtaatttatggttcaaaggagataggtaattgtcttctctcaagagccactagaccacaaaatatcaacatcaaagatgaatgcaagcgctaggggaaacgatacagatcagaggcaccatgtgttgtgcattctggtatttgtcagagataaggaatgaagctgaattttttcatggatttgtcttgaaggaaaataaaatgagaggttatgctaagtataaaactatctttacaaagttcctttccgttaagaccttcaaagatatgtaaaatcataatttgagaattgcttttaaggacctaattcaggttagctaacaaatcattatctaaaaagagagtgttagaatactatgcatttaaagtgagtagttcacttcatgattgagcagaaattcctgagttcaaatcatggctcttccacttgcagcttgtatgacatttatgaaattccttaagtgtgctctgtttcaggtgcctctgcgcctacatcattagagttattcaagtattaaatgagataatacatatatagccgttaaactagcgcctggcatagagtaaacagtcagctcacatcagctagcgttattcacaagaataggctatacatttctttccatcaaagataagtgcaagtttgaatagaaaaattaatttatgaaacaagactgattttatgcttttctatagtgcccatgattcaaaggaaaagaaggaaataatcaccaaccaagtgaccctgtaaaatagataggagttacgccatgcatacatacatgcatatatatgtattttggatatatatggatatattatgtgtgtgtttgcatacgcattatatatacatacatacctttgccaagaaaattggatgtctcatatctaaaaaactttcagtgttaagaactagccaagtgtcaagtacacaatttgtattcaacatatatttacagaatttaactttgtaaaaatttcaaatcactgttattgcttttcctacttgtaaaacaattacaaaaatcccttggcttttgtggtgtggactattataagggactctgatgcttcatgacagggagtaatttgatccaaagtacaacggagctctcgtgtggatttaagttaccaaactattgaagggacccatgcaccaccaagtattcaaatcacaatataatttcattattctctaccctcccttgcaaatgtaataactctgaactgataaacacattgtacctgtgtagaaaaatgccacccagaaggaagctgactgctaatctaggcctgtgctgtccaacaagagagctagtagccatagagcacttgagctgtggctaatccaaatcagatgtgctggtaatgtaacatgcacaaaggatttcaaataatagtgtgaaaaaaagtaaaaattttctcatttgtaattttcataatgattacatgtttaaatactaatactgtgtatagggttaaataaaacatatttaaattaatttcacctggttgtatctaagtgtccatcagccaattaacggataaagaaaatatggtacatacacacaatggagtactattcagccacaaaaaggaatgagatcctgtcatctgcaacaatatggatggaactggaggtcattatattaagtgaaataagccacacacagaaagacaaactttgtatgttctcatttgtgggaggtaaaaatgaagacaattgatctcatggagatagagtggaaagatggttatcagaacctaggaagggtagtgagtggcaggggtgtgggagtggagatggttaatgggtacaaaaatatatttagatagaatgattaagatctagtatttgatagcacaaaagactgattgcagtcacaataatttattgtacattttttaattaaagagtataattggattgtttgtaacacaaaggataaattattgaggtgatggatacctcatttaccctgatgtgattattaggcattgtatgccttatatcaaaatatctcatgtaccccataaatatacctactatgtacccacaaaagtaaaaagtaaatacattaatttcacctggttgtaaaaataactttttgtaatatggctttttaaaaatttaaaattacatgttgtggccatcattcatggttcacattatgtttctactgaacagcgttgatctagacagtagacactacgcaaaaacagctaagaaaattattaattctttaaaaggataaaatttaaagtgataaatgagatcaaattttatgagcaagtccatcgtagttcactctgtgcttgtttctagggaaaaaaaattggaactttctgtagagtgtgccagtcaatgcaaaagtgctcatcaagagagaattaaaacattagcaaataggggctgttgatgaaaatgagattccagagagggtgagaagactgaacacattcctgtaaagcaacagggattaatgcaccaatgagaattgcttttttttttttaaacaaaacaaaacaaaacaacaaaaaaacccactaaatttttctaggggaaaagtaaatgctagagtgatattagtgaattaggggatttgtgaagatgcatttgaatgtcaagaatataatgtagttttcttagtatttttgaattcagtgaccttttgttaacctcaagagactgaggctaagacaccaacatttaccatgtgcttcaatcattctctcaaggacgcacagctcctctgagctgtaataggaattcaggtctgtgtgactcctgagcccacatgaccgaacgtgtgcccatggaacactggtccctgcaactgctctgcaaataatggttctatacttaaatcattttaagaaatgttgcatgtatcgttaccgtcttaaacatgattcattgatttgcatattaaaggcactgagaattgctaaaaaactgtttaactttttaaaatctttttctcaaacttcttttgccacagaacacctcctcccctgcacatgcatctatatgccatttatcaccagttgcatgctgaaactaaccttagacagaatgctatttggaaatgctgagatgccttaaattgccttctatcatctctcattattagttactaaggaaaatggctttgagaaaatataaaatatttcaggaaaatatgtaatttgatgctcagataactcactttttgctacatcagaaaaagcaaaactagaatttaaaaataaacttggatgcatgtcttggttattcttatattcatagtgtgtgatccaaagggagtcaaagaaatctgtagcgaggctgctcacagtctaggtctctttttgtgtaggacaaaggtagggcttggcttctagttgaagctacagttctgtaggacttgggatttggaaaagtaatgacaagataaataagttatcaccatcagagacctaaatggttgcaaatttggcactggttacataatgaacaaaagtttcataacatatttcataagatattttcataacatatgtcttacaattactttttttattttctgaggttttttctctaaattatgctaaaaatgtcatcgagaagcataaaaacagactttcattaatagttgctatagcagtgggaaatttttgtaggaatttaagtaaaaaagcaagttatttagcagttttgttcaaattagacatttctgccatcagcctgccccctgggaacttggaaagtgcatacttgctcttgagttctgctagtgccctaaccacacgcctttcatgtctaccatacttcgatgatcttggattcaaatatgatcctctgccttcctcacagaaagaaacaatttagggacatggacttaatggtaatgactttcaaaagctaatgacgtgcagtctttcggcactgcctagccgaacactctttagacaacctgctgctttagactggacatgcacatgattcctaagatacactaaacaagaatatgagatgctgagtccattgtttcctgtgcaaaattcagttcaccaagaatactattttcaccaagaaagccatagactgtgtgtaggtaaagaacttttgcgctaatgaaacttgttattggctgggactaggggcctaaatactagtttgagattctgtttctgctgtgccatatagcatgagatcccacttttgcctctataaagcagggctatggttatctttccttattacctcagttgattgttggctgtgagaaccaagtaagatatgcttcatggaataacagaagaatgcaagatattatcacgggaggcaacatttttgggatatcacatattagtggaaacttaaagaatatttgagaggttatctttgacatttacataaaaccatgtatgaaacaagtagttcttgtgtttttttaacctatgaactttttcaagtgttttctccacaacattcctctcttctaccaaagaaaatcagtttacagtcatgtgttttgtaaaagcctaaatgggaatgaaggtggttagtaagagggttcacaagatggagaggctcccatgacatttgtaggtttaatctcgtgccccatgacctcttaaaatgtccccatgcccattcagaataccccaattcacttcaaaggcaaaaacaacgtgacattgtgaaatcataccagatgttctagtagaactgtgttctggtcctattgagttcacccaggagaggcatcaaactctgcaatcagaacatatcaacacatggcctattagctgattctgccacttggtagctgtatattctctctctgtttagtgtccttatctgtaaattgaaataataataatagctcataaggctttgtggggattaagtgagataatcatgtacagtgcccagcacagtgtctactgcatggtaaatactgcaaaaatgttagctgttgactgctcctatttatgaccttcattattaaaaaggggaacttaggctgacgcaggagaatggcgtgaaccccgggggacggagcctgcagtgagccgagatcacaccactgccctccagcctgggcgacagcgagactccgtgtcaaaaaaaaaaaaaaggtgggggggggggaacttatgaatgcctttcacttataccagcatcattaaaaatttaagttttttaagaaccatgaaaagctaaccattgacaatttaagaagcatgcaagcttggtttacaaaagaactggacaagctcagaatgggctagttcagtggagtgactgctgcaggagctcaggttttgagaccttcctgtcttcttccttcatccttctcctctttttgtgttctctccacacacttttcctcatcaaagccaaaacctttgttcttgctatattctctttttagagcctgctcacagtaaaattttaaaaaaatgaagaagtgctgaaagtgtagataagcaattagacatgagttaatgttttttatttgcaagagcatttgcattctaatatgaactgaacattgagtaaatagattcctgactccctaacagggctatgtcttgtgtcaggaagccagcgcactgggcttcttggtaggcaggagacccaagtcatcatctgctactaaggctgggtcttggaagatggagaaggccgtagaagaaaggaaagccaaaaaaagaaaggaatgagattttgatatattaattagctcatactataagcctggacttttgctaggcattttccatggtaatttggttatacctcaaaacaattctcaacattattatcactgccaccacttctgttagcagctgtgagaacagaggtcatgtgagtaagcagtttgctaagggttgcatagcttaaaaagtagtcaataagctaaagtttgaaccctgagatgcctggccttcacagctaaacttttattaattacacctgcttctaacaacaacaaccatggctaaagtttcattaacctaccagtttctaacaacattaacaaaaacattttcaaaaatataataatagtcatcaataggaataaagggaaacaatccaaaaatagctctgttgaggttactgatggatggggacaggaaagtacaaaattttttctacgaaagtttccctttgaggatcactttccttggctgtcttgccttgtgaaattataccttccctaatggcttggagctgattgtgcccttctttctgtcaaggacagcttaaacttcatggaatagtttatttgaagcttgtgggtaccaattccaggcagcaagatactactttcagagattcaattaacttccttcagagtcacagcaaaaagcgatagagctaaattgattaccttgaagtgccttaaccgttttgctgctgttgttacttcttgagccaatttattctcccagcaatgtcactgttactgaagttggtctgttctttattctcagtttatgaataggaatcatctgaatatagttatagacctctagtctagatcattttttgcaaaattacaaagatgggaaaatttccaagccatagttattccaaatggctgggagtgccttaggaacttatttctggagtcttttgaactatttatattattgatatgaacaatgcccctgattgttagttagcaatctattcattgatagggacatgaaaggcagtctgctgccatctagctttttagtttctatctttaggaattttccggtcctttcacagaaagacactttttaaaggagcaattcttacttcatccctgagagggagacacttatgaaggtactgcagaatcttaaaaaaaaagtcttcatcattcttttacttctttttgcctttaagttggtcttaaatgggtaaaagtgataaatgtaggttgtgtagttcaaatccattgcagtgactaagcagtgaccacccataggggcaaaaactatgtatttttagaggcaaagattgataaccacagccatgaccctgagcaagactgtgaaatagatgcagttctttgccatcctcccttttcctgagttatgggcactttctgccttcatagctgtttcctctgcaaaatggagattttactgtcagaagtctcctattgctattgcttcttggagttggttcccatgctctgggcacaggaaagcaatctgagatcttcactactagtatttattgagcacctatactatgccaggactggactgtgctctgaggtcacagtggtaaacataccgacatggttcctgctgtcatgagccttccaaaggaatagcgaagaaaaacattaaacatatcagcccatgattaaatgcataattagataaaatgcattgaagaagtaaagatcccaggaaaggagagaaccaattaatatgatggatgggaaatcaaggctgctggaaggaagtagtgtataagctgaaaaatgaggagtgaataggaattagccaagtgaaaagcagaggcaaatgggtttcaggaaaaggaaaaacatatgtaccagtaacatttcaagaagaaatgggaaggattagatgatttctgttattcttattaggttgatctcttccatggaagagacacacagaatgtaattaatttatagaatataaaaatgatttttttttttaggaatggggaggtgaggagaagacccgcttcaagttctgttccaatattaatatggttttgctttctctacaaacctaagtaaaacaatggtggtaccaagggttggttgggaggcactagttttcccagtgtacatactcacaactaacataaaagctaaatacgtataatcaacatgcttacactacaaacacaacttcaaataaaattcactagatcaaccgggcacagtgcctcacacctgtaatcctagcactttgggaggctgaggcgggcagatcacctgaggtcaggagtttgagaccagcctgaccaaggtggtgaaaccccatctctataaaaatacaaaaattagccaggcataatggcaggttcctgtagtcccagctactagggaggctgaggcaggaaaattgcttgaactcaggaggcagaggttgcagtgagccaagatcatgccattgcactccagcctgggtgacagagctaggctccatctccaaaaaaaaaaaaaaaaaaaaaaaaaaaactccactggatcctctcttccaacttttttcccctaatttcttcccttagcactgatattatcaaacaagtggccaatcctataaaggctatcagactccaatttaaaaaaactattaaatttaaaaacactcagagatataatgattgtatgccttttatgaggaaacttagtacctaaaagaaaaccctataacttaacattaagcatatgaaggtagctattattcaaataagtagcagtaaagacttttcagctttggatcctcataaacaagacctgcaggtttaaagatttgcatacatcttttaacaatgcatcatttttattatagtatattatatactattttatatttacttaatgagattactgacctgggtttcaagatatgtatgaaatataattaggatatgaaaattaaagataaattatccccaccagaaataatcttagcaggttatttactaaagaatcttaaatccagcagatcaagaaaaactccccaaggagtctttaattagaactctttaggatggaatcaaaatctctccataaaaaatgaatcttgccttaggctacataaattacaaaatctgaagccctttaagcagcattaaaactgctgattttaattgctctgataatgaactggagagagacacactaagcttcctggatttctgttggaaatgaatgggattcttgccaactatggatcacagttatgaggtattctgcacagggaaaatcaaaagaaagcagatggaccttgacatgctatgccatcctatgccttcttccttcccaagaagcatgttacaataactttaagtgaaggttgtcacaactttaagtgaaaagtctcccctttctgtctaatttttaatgtaacttcccccttctcgatatatccagaaaatagttaataacaatccctgagggaaaagaaaaatgctgcccttcatattaaaaaaaagaagataacagagatccccttagtggtgagtgatttatagtgaaaacagccaactcattctcttttgcctccttttgacctagagaactggattcgcggatttgtaactggattttgattatagagtatgttctatggctacaaaagagttttcctttgaggaaaactcaaactgccaacagatatgcttggtatatcagttttcaatgctttcaattgtaaataacagaaacctggactcacaatagcttgaacaaataggaattacttttaagtaggtggcaccggaggtgtttcagctgttgcatgatgttatcaccatttgcaaagaggcagcatctccacaattttcttggcctgttcctcttgatggcaaatggctactgcacgtccagatgatcatgtctgtgtcacagatagtgagagggaaggaggaaggatgagagaggatggccagctaaagttgtatctaccccacttataagaaacacaaagcccttccccagagcttacagccctttagccagaactatgacacatggtcatcttgagtgcagaaagatggaagttaacatttggttttctggtctttttaataaagatagcaaggatgaagaagtttggaaaagactgtgggctagccaatcaaattgtcgaccacatttggcctgtattaatgtatagtttttaaagcctaatgtcaatttgttaaggtgtcttaaggacaggaaaatggagaagaactaagattttttatatcaaatacagagtaaatcttggaaagggtgaattagagtggaaaataaactagacattatctaagagtgccttgaagccagatcttgcaaaacattaggcaagcatgtcactcataatggaccccagggctttccatctcataatgtggataaaaataacagtgtttctctcagtttttaaaaatgtcaccaaaaattcaataaagtatatacatacatattgtaattgtttaaagtaaaaattttatgctgttttgggaagaaaaataaccaaaaaaaaccatcactgaccattggtcatcaaaatctgatttatgccatgtttacaagataaaaacaagaataaataataattgtttgaaatattttcatcatattgcctctgaaatgattgatgtcatactgcctggatttagtcaactcagtgaatgatttatcagtagccatgctctaaggagctctctattcatagatacttatgatttggtgaactgggaaacccacagagaaaggtaaatgaaataggagagccaggtaaatgggccatggatctaagaaccaggaatcatgattgtttggaagaacatatctcagactgagaaaagctggcgctaaagtaagctagcatttgattagaatgttgaaggataatttcattcttggagacagaaaacctaagtagaagcaaaagaagtaggaaatagaagcctgtgtttgagagattcagagtgactgtgttttattagaattgcaagaaagggaacttgaaaacataaatttaacatggggcaacaggccttggattctgaacagagggactttgtttaaggatggctctgtggctgtggaacagtttttctatagattatcaaaatgattctggaaaagaaatgtcattctggactgagagcacataccatagggaaaacatgaggcttatgggctgaattgtgtcacacccaaagtcatatgctgaagtcctaacctaggacctcagaatgtggctttatttgaagattgagcctgtaaataggtgattttgataaaatgagatcattagggtagacccgaatccaacaaggctggtgtctttataagaaaaggagattaagatgcacgcgcacacgcagagaagactacgtggagatgaggagaagatggccatctacaagccaagaggagaggtctcccgaagaaaccaaccccactgacatcttgacctcagtcctctggcctccggaactgttttaaaacataagtttctattgttaaagccacctaagtctgtggtattttgtaatggcagccctagggaaaaactacaatgagcaagtattatttgtattttaagaaataatattataaactaaattcatggaggggaaaatagaaaaagaggtcatttctgaaaacattgtataggtgtaacatagttgacactatcaactactacaatgggatcaggagacagagggtcagtgataacggagctctcaagactggaaactgggcgatccagaaggacaggcggttgatgaaagaaaatgatgagtgtggttgaggctgcgtttcccttgaggaggtgctggtgctcagggtagaggcatccatcacgatgtcagaaatgtgtgtcagacacgaaggcaggaatgaggctgtcgaggaagccatggcaacataaacagagaagtgccacagcgagacaaccagccaatgagttgtgtagtttcttgtaagtagctgaaacaacataaccaaattgttcaatttagtctacatatgaaatttcaatgtcagagaaaggcctttaatctcaaaacgaaataaactaaaagacattattttcctgacagctaagtcttaaaatttcttttgagaaataaaaaaaatggttttctcttttaacatagaggcaaaccagtaagtcagatacttcaggggaaggtagcttggtgatttgaatgtatgtgagtgtgaatacgtgagattagaatcttacctgagaacaaattttcatgagcatcattggagagtgggagagcatgaagacttttacccttctctctgcaggagagaattgtgcaggaggaggtggggagaatgccaccaagaacaggttgcctggggctagtttagcgatggggtccaaacgatctcactaatgtgaaaggatcatagttaccttaccaagggaaagttggcttcaactatatatttcacttctgtaccaggttttgcttaaatgctactctttggagaatatcaagaaatttagatgagtttaccaaatccaagattgtgttccctgcttttaactcttgttactgaaatagccccctgatccccaagagtaatgcttgactgaggtgtttgcatgaattgtttatatcattcattaattaacgtgatgaacatattaaagataggactcccagttttcatcccaagggcttacatataatagtaacaacctttagaaaagtactgcattgtttatttatagaatggctttgactcacttaataatgctccataattaatttgtaaattactttttgactttgcacaattataatttaatgtcatatatctgcaaaagaaaacacttttatgttgctaatattaatttcccttcataaatttgagactgttttgactatagataaatgtaaaatgtcaatgtggtgagaatgactcagcttctcagatattcatttattctataaatatttttgaatacctactatgtttcaggcactgatctaagtgttgaataagtagacaaggacagcctgccttcaggttttttacattcaaataacacaagatgatgaagaaatttttaaaataatctggttccatttggcagataatatagatatgctcagttttataaattttgatacctaaagtattgtgataatccaaatcatgacctttagacattacactatgcttattgattgaaggttgacatatgtttagcatattctcttataatgtatttaaggacttcagtgagtagacaaaagaagtaaacttgatcagacaacatgatttctgagaacagactcttcctggagcaagcattctggttagattttacagggcttcaataaaaaggtatatgtttatgctttttgctagttgggggtttcctagcaaatgattccatgaaaacatttgcagggaattcccatctgttctatatttccctgatttgggggctctgaatcaataatgctgatgtaacagttggcaaattagataagaacagcccgagacttccttttccattaggtgtagtctcatggaaaatcacccttgaatccatcaatggaatgaagcaactgggtggagcctatgggaaaatcctggaggaagtccccaactagtcagcctcccctctctgccttgcactcttggattccttagcgaaacatccaaaatggccttcttgcaaggaggatgcagtcggtgatccacatactgaccaacagctgtgtgtgaaaggcaccgtgcccaccacaacaaaggggcagtgaggtctgctgagcagatgagtcgcttttctggacccttccaggcttgcagttggctcagatgaaaagctcaggcttatgagctgccagaaagtatttggcaaaaagcccaccttttttctcaagtacacgtattcaattgacttgattcctcagagagatttgtgagggtgaaagcaagttcattgtccacttttaatgaccctcaacttctaatgaggtaatatatgtgaaagtgatttttttaaatgcaatgcaaatacagggtgtttttagtcattatttcagtacctgaggaaaatgtaaaaacacaaagccacacatgtaccaaggcactacatgagtgtacttggtttcaccatctaatttagccctctgaagtgtagagtccatcgaggctattattttgtggattgtgtactgaagttgcttttctttgttctcccaacatacacttgtgacacttccaacctctgatatgtatatgttaaatacaggctgtttttcaaacaagataaatcaaatgctagctaggaagtgtgcctagagtttaaagcattctagaatgtactcccatataacagctatacttatataatacctacattgtgccagtgtttcatatatgtgaagtgctttaatcctcacaacaaacataggagggatgtagtattattaccccctttttacagatgtgaaaactgcagtacacaaggtgaagtgagaggccccaaatcacacagctagtaaatggcagtgtcagacctcaaattccactagtctgtcttcagagtctatataattaaccactgctccctgtgcttttaaaggttagtttaatggatattgtgctatttctaataaaaggatataatttttgttatatatttttcttcttagtcttcacttttggatcttggaccacatgtgctattatcatattttagctcataagagacttctctgataattttgtataaaatacacttatagaacatttgtatcttgtaaatgtaatttttcttaccattatctcatttgatcccccttatccacctctagaatatacagagctttatcctcatttttcagacgaagaaatggaccaaagaagactaaacaatttgttcaactccatatcaccagtttgtagcagttctgtgactagaaaccaaatttcctggctcttagtcctacattctttctagtatttcaaatcatcttttcatttctctcccttatgcttttggaaagaaaattgagaagaacgttaagaaccccagtaaaattggagaggcatttcttgagaaatatttaaaataatttaagaagtcttcacaaaagtagtaggcaaaaatgtgttacattaacaacggatctcattaagtcagtgcatacagctaggttctggtttattaattttcaattttttcatttttgggcctgcctaatctgaacactttgcagtacaattctgagtgctctcatgctttgtgctatcgctttcttaaggtagctcatttgcacttgttcatcatcctgttccttcccccagtctcctgggctctgttgctaattattgacccaggaaagcctcagaaggggccaaggcagctaaaattggagtgctctttacttagacttataatgcattttccatttttcagaaagagtaaagcacttttagctaccagatccagagaccattcagttatatgggcacttgagtttctgctaaagaatcacaactcaatttaattttttttttttttggtatttcattcacagccagtctggagtgtgtgtgtgtgtgtgtgtgtgtgtgtgtgtgtgtgtatttctgtttctgtattaacatatgagacagcagaataataatgtgtccattcattccatagatatttctcaaagagttgccaagaataaagaatagtgctaaaaaaaggtggaagatggttaggtgtaaaattacctcctctcacaggacctggcacatgacaaatgcttcagaaatatttatcaaactgaaatgagctattacatgaattgtattctctggctttggaatctattggggaaatgatgaagtcattaaatatatgcgaattggaaaggaatttaggaatcatcttatgcagcccttttactttaaagatgaagcaatggaaatgcaagaaagttatgtgtcttttccaagcaagatcacacatctatttcgaaataatatgctttttttcattgtaacatgtgttttagagattacacatatgtcaatgtctgtagtgcagggcataatgtgaggagagctgttgaatgctttagaacagtgctacccagtggaaatataatgcacaccccatatacaattttagatttttattaatagccagatttttaaaagtttaaaagtcagtgaaattatttttttcatactaagtcttcaaaatccagagtgtgtattatatttttgacacatctcaatttggactagccatattttaagtatttaatagttatatgtgtcttggggggggctactctatagactatatggctccagaatcacagagagggaaaaataataatgtatttttaaagctgcagtatttttaccatgggttatatttttaagtttgattgtaacacaaaagtacaaaaatgaaacaaactgactcaacacattttttttcttttttttattattatactttaagttttagggtacatgtgcacaacgtgcaggtttgttacatatgtatacatgtgccatattggtgtgctgcacccattaactcgtcatctagcattaggtatatctcctaatgctatcccttccccctcctcccaccccacaacagtccccggtgtgtgatgttccccttcctgtgtccatgtgttctcattgttcaattcccacctatgagtgagaacatgcggtgtttggttttctgtccttgcgatagtttgctgagaatgatagtttccagcttcatccatgtccctacaaaggacatgaactcatcattttttatggctgcatagcattccatggtgtatatgtgccacattttcttaatctagtttatcattgtgactcaacacatttaaaaaaaaaatctagagtagacctatacaatttgacagattgcatcaatagttacaattttagacacccctacccctccacacatagaaattagtgaataagcagactgtcaatagtactggctcaaataattctacatacaagttctaccaaactttcaagggaggggtaacttctaccttatacgaattatctcattttacaagtaactataagtatacaataagttccatttgcagcactataggagcttgaactgtctgccaatttttaaagaatatgctcaagcaataatcttggttatccatattatcttacatttccttatgaatattgagagttctgttattgataaatacaaaggtgtcactgtttaatacactactgtgtaggtccttttgctatgcatttactatttaaagcgtaaaaacgtaggtagcaagaagatttatctttctggctattcttgaaattcctgtttctaacaagatattctgcagaagcaaagatactactgcattgttcaatgtttccacaaaaggttaatataattgtgggttcagctatcaccttgaccttttcttggatctttgatcagagtttaggtaaatatgttgttaggtttcccccttttaagttcctgagcttttgaagtaaaaccagagctgagataggaaagtgaacagcaaggggcagagcacagcagaaactgaattaggtcacttttctagaggcttctgaatttggtacagtaggatttctgtgatcatcttaaacctagcttttcaaaaggctattactgttccattttattctctggcccagaaaataaatcagaagacttctacatccttttcctcaaaagctgattctgattctctatatgatgccacattaataaagttttccctattaattaccatgatgccatgcagccttctaagatgttttctttagttcttagttcctttgcagttccatctccaagcataaattctcattaataatcagtacagtgaggaagatagacatgtgtcagtcagtgagaatgcttgcagctgtaactgccagaaagttgtaacttaactggcttaaaccaaagccatcctgaggtgggaggctccaagtcactcagtgacattatcaaaggcggcctgagtctttttcatctttctcttctgccagcctcaagtgttggtgagttttctggtttgttcctgtaaactcgagatgtctgtcacaggtccacctattacatgcagataactatggccagtcagaaaagaggatcttctttttacgtcttcttttaagaaagaaaaaaaatcatttccagatggtctccccttgtcccacttcccttcaatgtcttattggccaaaatggtttcacatgccgatgtcttaacaaatcactgccttggaaatcgtactttcatgattagctgagacaatcaggtttccctcatggtggctggggctgaggcccacctccctgtaagtatgtggctgcaagggtaggtggatatttgaatttcactgggggcctagtaggaaggaatggctcttgggtaggctacccatagagtcaactacaagtaaatcagaaactatagtatcataagtgctacagggaaacatgtaaatgcaggatgctgtaggaacacgcaagaagggcccctggccatgcttgcttgagcaagagggagagaggaatgccagagtgggcttttaatgaaaatgttatctgatctgagatataaagctcaagaggagatagccaaggaaagggtggtggaaggagagagagggtatcaggtagacacagtatcatgtgcaaatgactgggaataagataaaatgtggtaggtttggggagatgcagaaaaattagttggcctaaggtatagagcataagttggggagtcagtcagaaatagggctatagaggtaaactgtagatcataaaagatctgataagtcacatagaaatttctactttattctgctgcagtggggagccagtgaaatattttaagcagcaaatgacataattaaatatgcacttcaaaaaaaaaatgtctttggctgctgtgggaaattggattgcaaatcttcaagaccaaaagtaggtagaacatgtgagaatcaattacaatattccaggaaagagtggtgaagggctttaagataatgtcagtggggctggagagaggtgaataggtttgattgatgtttaggggttttgactaaacaggacttggttaataggtaagagaaatagggattaataatcactcacatttctggcttggacaactaggaggatgggaatgacatttactgagttaggatatccaaagaagaagcagactgggggcaaggggagtgaattaatttaaattgtaactaatgaagggcttattctgtatgaaattcaagagaagtattccagtccttaaagcattttcaaatgccaagggatatattaaccaataagtggtatagaacaatactaggggtactataatttatcacagatggtcatcaataaagcaagagagagagataaaagagcttaaagaagaaattgcctctctctcagaaagaattagtgggagaatctgatgttcttcatgaaagaaaaaaattttagttgaatcttgcataaaaagattagacagatgggaattgtcgagggtggaggcactgtacactacatgaagcatatttaaggaatgataacagtctagattgctagcaagcttgaataggcaaaataaaatagaaaggttagggattagttgaattagtcagaactgttgagattccaagagaaaaacaaaattcacattttctgtgttgatctattattgcaaggtgcattagtcagctattgctacagtaatgctaccgaacaatcaactacaaaataccaatgacatttgcttcttgctcatagtcctactaatgggtcagaatagtgctgcttcaggctgcaggttgccttcatgcttgttcttcatgtttctccttcttggaccagtgatctcccagggcgtgtccttgtggcacagtttacaactcccaatgtggcaagtagaaatgttcaatactttgtaaggcctcagtttataaagcagtatcatttgtgcccacattctgttagccacagcacataatgtgactaaacccaatatcactgagggaggagagcatgaggaagaaaaggatggtgaatatatgctgcaatgcctaaaacataatgtaaatatagatagcattggatttgacccataagccataaagattctagaataccagtgttcccaactatggagtgcccaatgagcttcttgacaaactcaggagagtaacctccatttgtgtgacctcctttctttgctctttatttgtgcttttcaaagggatgacatgagcccataaactactcattgggttgcttggtcagaatcagaaccagttacttcaggactgtctcatttcatgattagttgcctttggtctcatgcagtggtatcagttcattcctctagaggtttatgttccctcaatcaccagcaatactgagtgaatgataagaactaaagcaataaaaaatgattgaactattttccttagtatgtagttattggacttcttccaaaaatccagcacacttataaaaaccaaactaaggcattttgctggttattgtgccaatagtgtgtcttaattagtcctgagaatttatgtggcccatgaaagaggcataattttcctaagattgcacagctaagttacatatctgagacttgaagacatcctcagattatgttatccctaaatctctaattgctatgtagcaaaagattttagccatttttttattcctgaatcaaggatacataaataaagttgtattcaatcaatccaaaaatcctcaagcccaaataatcctagtacttgagcagaccttatagtgtgtgtgcacaagtgcgcatgcgtgtactctatttttagattatcttttaagagggaccggtgacatggtcatacagtacaacagaagaactcactccctgtttctctataattcccatattacactcagcacttgctctcctttcattctgtggcttctgtgctgctagcagtgaccagtgactcaggaaggctgcatatagtgaagaaaaagttgcctttccaggcacagttcagtcctgaggcgccttttcacaccatctcatagacatttcagagccaaactctagctttctttttatgactacttttccattccacacttttcttaatgttgcaggagataatttgaaagaaaggaaaaaagaacagggagaacacaaaggcaagaagatgagcaagatgccagatttaagaagtatatttatatttagttctttacaaattaaattctgctgagacccttaaatattagctgtcacaggggttgtgcttgaaaaacttgattccaaccctaagcataaaaatcttgtctaggcagggcagtagattggaggattatcattacacattataggaggaaggccctgttcaatgccaggttccaagaatgccatctcagggagcgagggaaagacataggccaggtaacatgtctgatgtatggagaaaagccctcagggtgccatgttggtggaacaggagcagaaaggaaatcagactgagagaatgaaaactcaatagaagcacaataaacagactgaacaaagtacagatggagtcagttcaagtttaatatgaatgtccctgggccctgtgtttcatcccagtgttaagtgcaggaaatcattggatttctccaaggatgggtctttagagcaaccgactttagaaattgaatactttaaaattattttctataaacaaatttatcaatagaaaaaatagattacttaattggtttatcttaatgagaaaacaacaaaaagcttcaacaaataattgttgctgattggttggtgggttcgttggtgaataatgagaaggaaagaaggaagaaaagaaaagaaggagtagaggaggaaaggaggtgagagagggagatttgaaagggaaatagcggtgctctaagttcacaatttttaaaagcctagagttattaacaaattatgccctcaatcagattttatataacttttttcaatcttgtcatatattaatgtgctgtattcatgaaatgattttgagattttaaagcaatgattgacaatatagtagttcatttaaagtttttacaagttgctgctgacaaaatatgggtaatgaattacatcaaataagtataaatataagtacacgctttgaagttaaaactcagtaagttgttatgattaaaattgttcactttattttcctcctgtgtatgggtttctcataaatggtaacttatacctatgaaaatacagggttctataaagtctgaaaacatagttattatatatcttaacggaccgaagatgtccttcctgatattatgtatagcctgtgtttccagactaagtgccaggcactattctaagttaggcacgattctaagtgttttactgttcatttaggctgtctggctagtgtttttctcaccttatcagcatcccatttttattaagtgaatttgcctaaacacacctgcacacgcacatgcatgcgcgtgcacacacacacactttttgcatttggaagcctggctattatggaactctagaacatgagagctcagggtcaaccaccaagactcaataaggtatggctggggatgtgaccaagactatcctagcatctatggctgtggactgggtgtcttctccactgacccttgaaggtagttttgcttcactgctttagaaatggtgcagagacttaatcttatttcacttttcggtgtttgtcttggttcctgtagaactggcttgaggcttagaagatgtcctcccacctgcatttggaaaaatacatttctaacacttctcctcatatggaaatttttaagtcattgaaaaactcatactgcagcatttgtagaaacaatttcagaacagagtaccttattgcttttcctaaaagaattttaactgtgcatgtataagtattataaatgcataaaatatatagttaatccaaaagacataactatatcatgcatagtagttataggtcacctcagatatattagtaacatctttttatagagactctgttgttatttcactcacacaaaagaataaacacagaattaaggttgaaatttacataagaccagtctaaagccagccatagctatgtaatttccatgattttctcccaatcaatggaaaattactgtcagctgagccaaagtctgcagactgtgagcaaatgtctgtttccttcccacaactgagtgtttgaaacttttttcaatcagtaaaattaccattaaaggtcagagattagtttttcatgcatgatggattccatttgctttaaaagtattataccaggagagtagactttttttctgactttagaatcaaattagaattcaaatattcagagttttgggtcaacctcaaactattttattttgtttattttcccttgacaaaatgttattgttttaaatagggaaggagaaaggtcttgggaaaacacacacacacacacacacacacacacacacacatatatatgtactctctcatatttgaaattagcatgtagtttaaggatactgcacacagctctatgatgagcttaacttgaatctccttagattatgagcattttgaaagcagggacttgattttttaactaaatacctttcatgtttgataacctgttccttttcctgtgtgtattgtcttaactaaagactgcctgcaatgaacagaagggctatggtcttttttttattaagataaaagaattttccaaatcgttgtttataaaataaaagattagaaaaattcacctgtgtataaattgaactagacttctataacatagcagccatcttgtgcagaaaggggctgcttacgtagtttatttctttaacacacagttgctaattacaaaaacagcatgcatccagagattgtgaaaaaagaagttaaaaaaaatcttgcctattattctaccaccgtaacacaattatgtttaacatttttcatatttttaatttattttctctttccataaattctaatctgtctataaatgtactattgtggtctgcttcgttgactaacagaatattttcacccctttcagaaccctttttttaaaaaatggcttcttttgtgtatttgaaacaatttcaacttaaccctattgcatatattctgtaagtagctgtccttcatgaaacagacaactttttcttttaaaaatcaaggagattgtacagaactttgtgattttaattactgcatggcaaactaattcagtctcatatcctttccatttaatagggatttgtccctagctatgtgacctaagcaagctctttaactgtactccacctcaatttgcttatctgtaaaacatggataatattatttttagtctaaaacttcctctggtatgacagaaaagaccaatgtgaaacaattccctgaatttgtcaataaaccatgttacatttataaaaatgcctccagtgtacccagaccagaggaatctgtggcttatactaaaacgtgtattatgtattcattctcaaggtatatgccaacagttaagttagaaatccatccctttctctgtcacttgtccaaagtcaattactccatgcttcttttacataaggaaaactatcttaaaaggaggaagtaagatcacggacaaacaaaagttcataaggtctttcattttactgcctttcaaaaggttaagatcagagaacttagacatgcataagctttggtttgaggaacaattgagtcaaccatcgtaacagagggcctgaaagtatctgaaggtagaatgaatagtttatagtaagccagtccactctcagctctgagaacatccagctgcataacctcaagggaactgcgtggaaaaaattaagggaaattctttgggctttagagcttttcatttcctatgaacaaggcatctcctgcccttgtctcacccatatctccattgtcctcatgtagtcttctgctggttcactgtgtgcctggcaagtcaggttcttacgcgagggaaagagctgttttaagttgtttatgaatagagaaagcagattcagtcagacgtaatctgactctgtatgcctgcaggggttgtggcctttgttagtttattatgcctgtaatttgggaagtcatgctgcagagatgtaaagtgggatgggcctgaaataggtcttgtaataaaaaggcagttagggaagcctgctggtgtcctgcctggttactactatctaagtgcagcaatgtgttagttgattttaataaagagttgaaatcattgttaactggcctccctcccactgagtgaagaaggcagattacacaggcacacgtttgcctcccctagtgtgtactatgaatgcagctgcttctgaagggccagcacgtggccttcttaaaactttccttggctggggttttcccttcttgccaactggtgcccaccaagccagtggatgctctcaacgtctaggcaaatgccaaaaatgtcatctttggctcagatgtgcactggcctgttagagacaactgccatgcagagaaggaatgtcatcagctgctaggtctcaaattatcagcctggattgacagctgcaggatgtagtgcctgcctatagtactgaggccatgacccacctctggagagaccacagcctcatccctagagtagaactggaaattctccattgagacaggaaggcagcacttgaacctggcaggttttggagtgaagtgtctaaggacagaatttctcatttctccacctctgcccatgtgtaaggcagcaatattttcatagaggtgaagaaggcaggtgtcccgtggttattatgacatctgtttacctcattctagtcactgtgccatgtttcacagccattgtcaactacatttggtgaaaactgtttcctccgtccacaactggaacattgacactaaccacattctagagttcattacatagagctgtgtctgtgggtaagttaacaggtagttttaaataactagatatagtcttttcctcttccatgtaagccaagataatatttccacttctccttctgaacatgtgagtacagtttatatataaatcaacagcaagatggaaatttactctgagctttgtgatgttttcactttaagatgctgtagttctgatcctttatacatttatttcattttccccatctcaaccccagtatatagcaacactcacctgctctagaacatgattatcaactgtttcagctatcaatgtaacattaaaaaaaaagttctatgttcaaagactaaaggaacccaggtagtttcttttaaacagaaagactagttttcatgatcataaacatgtaaagaaatatgtcatttttgaaatttcatgaatcttatgtctataccgattccaattccaaactcagactggcaatctgcctttattattgcaaagccccatagcttgttatcttcatgtacctcttgatcaagtatttaagtgaaataaagagtctaaatgttacgggaggtgagtccaggcagggtctacggccctcagtttttgtcttcctggaagaaaaaaattcagctgagagacagatgtagatttcagacagaagcaaaagtttattgaagcaaagtacatttggaagggaccaagtgggcaactggaaagattgagtgtcccgcctgattattggctcaggactcttataaagttactatttcctgattcttcctgatctcctcccatcatacttccttttgggccagctgttggctaatcgccgcgtgctcagtgacttgccagtaatctgggaggggctgcatgcgccatttggtggttgtagttatgcacatgtactctttgggcaattttcctttactggtctagtgcccccagaggaaggtcatataccagtcaaactttgccattttgccccttactgtgcatgcctgctcaattcctagggttttatcgcaaagttgttgcctacaagcttaagatgtttcctgttaggaaatttccccctccctggtgccagccatgaccatctatcattcctgaagaggccacctgacagtcacaatgacagtcatttgactgtctcctgacattccttggggccctatcctgccctgctcatatccacctatctacctaccctaacatattcccccctcaagagtgtgagactcaattatttggggctagtggatgaaggtcagtcctctgtggctgcttcctgctgaaataagggctgtatttgtcctctgggtctcaatctcttgctaattgtcagaacagaatggtcccatcggtaggtagaattggtgtccagccaggtccaggggaaacaggtgtatgttttcttcacatttgggtagggaggtagatattcctgtattgcagaatttctgctcctcagttcagctaaatccaggttctgtgtcacgaccaggaaaagttaggcatgcagacacgtggaagggtgaggggaatggaatttattatttattgggcgaaaaggaaaacaagaaaagaaaaactttcagcaaagtgagaggggtttctgccagcaggctcccatctcacagattggattccaagcccccacacacgagctaaagttcccaggctctttccccccaacaaggcatgaacttcctggtagctttaccccatcgtcgcagtgcacaggcgggcgggagattctccagggatcctccctcttatctgcctcctgcatctatcacctgcattattgggaacttggtttgaaattgttatatcctggagaagacaaatttatctagtaggttaaaaggcaggggccaaaaagaagtagacgtatggagacagctggttcgagcaggggaggaaccatgtgagcaatgggagagcagattttacagagttccagatggaatctgctgagggattttctttcccagagtcatgaagccacttagcgtggtcacagattctctttatatgttcctctacttgcccactattgttgacacaagtgcaatagggtttattgatgacagcacagacgactctgttctgcaaggaggtaatctagagctagtctgttgtccatgactgcattagctactgaattcagtgaagccttgagtttagagattctgttcccagttctctgacctaggtctccaatttgtgtagagaggttttggagggtgactttatgataactgaatcctctgtatggggcagctaatcctatggcagcccctagccctaccattataaggccaagagctctccttttttaagaatttgtaatgttatagatggttacacctgttccttgtggccccaggagtcctagggcacatcccctgtatgttgggtgttatctatgcagataaaaaggtttacaagtgagggggttgaataagttcttttagaacttccctcacagggcagtttattttgtttaggtccatataaaaatacatagcctggaggggtgtaggcccactcgggaatgttggttttgaaccaagtgtaagcataagcaatcccaccatgaataagatccagagtactggggctaccttatgctgagctagcattagtttgaaagaaaagaaggcattacttataatttcattgaaagagatattatagatcttccaatgactcacaggaatactcaggtgctggtcctattgttgattgttcagaagcctctcaaggttttatttaggaatgatgtatccaactagaggtgccaggaactttgatagctgttgcagtggaaaggaaaacagtaaaagggcctttccatgaggggattagttgagattttgtagatccatcactttaggttttaataaggacctgggtgggtacacaagttggttgttagagggtctggagccagcagtactctctgtatatatatttggttctaggtatgaaattctctgtcttggatttggatactttgtaccttacattttgctaggaaggttaaggtttgtactgcatattgttgtgcaagctttatggagggggagcagatgagtaagccatctacatacagcagaagttgtccccactcaagatatagcttggttagatttctttgctgggtcttgtccaaataagtgtggggcatctctaaaaccctgaggtaggactgctggctttcctgggagaaactgggatattagggggaaatatcagtccagatgttgggtaaatattaagtggatacccattttggaaagtatattcctactcaaaagcagtgtgaggcatttagacattgccagggactagtgggagaatagtaattagtcccataagcaatataaataaaggggatgtgaatctttagaggaaggggttgctacttgctcctgttacccaacagaatttgggggtaagttgcctagagaaaaaggttagcacaaagtaggcagttcttgtatttaaaaggatatttatagcactacctgtcatttccagagtttcccttggctctgttcctttaatgatgatgtctgatttggaagctggccagagtggagggccccttcagctcaaggccattattggatgggggttcaactgggggaccttttggatcccagggcagtccctcttccagtgggacttatctccagcttatcacaaagagggcaggctgtgtggggcttcctcccatttggcccatttggaaaattccttctccagtagcctggtcttctgcatcagtggcagttacctggaggagggtccttaggagaccctggagggggctggtgggcttgtaaagcagccaatagttgagcctgcatcttgtccctgcatttctccttttccttagccctgtcctccttgtccagatctcagttataaaagactgaggaggctaatttgaggatttgtggcataggggcactgggttctaaggctgacttttgtaaattttcctaatgtctggagcagcttgggtaaattgtcctttaggactagtccctcaggagattctgggtttaagtttggtgtgcttaataagtttcctgtagacttttcagaaaggctataggatttccatttggcccctggtttatggtggctaattattgtagtttagaggcttgatcttacttcattttattacctctattagacacaagagcctatggttcctggcccatattcccgctttggcattgtagtcctgattggggtccagctggggaacagctgtagcccctccagggtagttggcattttccaggtgtaagtcatttcgacagtggattgctgctccgcagatggtctgtctttcctcttgtaaaagggcttgtcccaggagtacatttatgtccttccaaattaatctaaatgtaagagccaatttggggaagccctctatgagccttttggggtcatctgagaacttttttaggtttttcctaagttgtcaaaagtcgtacatggaaaaggggatctggacctggacgagttcagttggctcacttacctcctacaagcttggagaggagaactaaggagcccggtgtaaagtggggccaattccaaaggtctgggagtgggataaatagggggaggatccaggggtggctgtttctccctctttcacctccaaaggaggaggtagtttttccttttggcttctggaggaagaaatgttggagaggaatcagcagaggagtctccagggccgatgcagggccctggaggagatggctaagcatagctaggatgtgaggtttgccttacaagctttacgaggattagggtcttccctttaggccataaaggtttgtaaataggggacctctggctttttgccctgataatggcagaaaaggtctagccggagaatggtattaaaatttgtacttccattctctagccagacttcctctgcaatgaaaaattagttttttcattttagggtttggtggttggatttatcgcagattttaaggatgcatccaaggggtcagtcccagagtatggagacaccgttatctatctgcaagacagaacagggaagagtaaggaagaggaaagagtcccttcttcttcatcttttttctttttctgtttttttttttttttttttttttttttgagacagagtctctctctgttgctcagctggagtgcagtggtgcaatctcagctcattgcaacctctacttcctgggttcaagtgatgcttgtgcctcagccttccgaggagctgggactacagatgcataccaccaagcccagctaatttttgtatttttagtagagacggggttttgtcctgaactcaggtgatccacccgccttggcctcataaagtgctggaattataagcatgagccaccacgcccagctgaaagcattccttcctgatccccttataccttggatcagagtagtgagtagggcatcccccattcatcctggagttctggaataaaccagtgattaccaggtaccactaaccctggtcccacatttccctccaggaccagccttcatctctctgctaatggtaatctgtcctgcacctgtggcctctggctgacctgtacctttgacactgtgatcttacagtgacctttgtttggagcattccagcaatgaaatggttttcctttctctcaaattcccattctccatatccctttaggtaggtgaggatcttatccctagccagcagctgtaagggaactgggccttcctttctctggacatagcactgtaggtcccagtatatgttaagaatgtagatggtcagaggaacagaggaaaacctgcatctgagtccccttgtcatccctcctgtggattcctggggaagcatggaaaacaagtatttaaaatgacaggacaatccatctgccacccgtgggaatggtagaaaataagggatattcatggaaggctgcttttgtacagtctcacaaacagcagcccttagacctaagaggacattgcctatcagtcttctcagtgtagaggaagaactgtcagggccagggagtttgggatgagagaccacaaaaggcagagaaagaattgtcctctccccaaagtgcagatagctctagaaaggaagtaggagttgctcttaatggaccacatacagatgccctatggagacaaacaaatgacctcaagagccactggaaaacctggtctcaatgtgtagcaggatttaaaaattcatgataggaaataaagaattggtggagacagagtcttcccaatattaagcagagaaagaagttgcatgatatgcagaatagaagcagggaagaggttgacttgcccccaagacagacagtgtggccagcatataaggccatctcaaagtccacagaaaaaaaggaagcataatagggtgtagacttattggggaaaagtccactttggttaaggaaatgaaggtctccagtctttgaatggcctaggctcaagccctatcacccttgtgagccacctgtccaaaagggccacagtgacttaggtctactcagtacagactctgaagtcctccacctctgctgtcgcccaccaggatgaactgaggaatctgctagagggaagagtgaccaaagagaatttttctggagatgggctggtgagtgagacagcaagagaaagaagacctcacgtaagcagagttgggtgcctccagccaaagatggcaaggcacagagggtcttaccgagaagctgcaatctgattcatgacaccaaaatgttactggcagcgggtttgggcaggatacacagtctttggttcttattgtctgagaagaaaaaatacatccaagagacagaagtagatttaagatggcagacaggaggcaggactagattgcagctctggacagagcagcatgtggaggctcgcattgtgaattatagctccagattgactgcaagaacaaaccagcaaccttgagaggacccacacaccctctgaaggaagcagactgctcttgcaggacctgggaaacaccccaaatactgtgagtaccccaactgtggaagtgggaaagggagaccctcctctcctgaacacacacccccactggagaagctgaaggtctgtttgcaagagaagtttctgactttacctggagctgagtcaatgtggagagctgagtgaaatacagaggcaaagaaagtagcagaaaggccctggaagctctctgagtcccctagcaggccatccatgcctggcatcacagggatccatccagagggcagccagagccagaggtgcaaggggtaaaactctacagggagaagaaaatctctagctgaagtttgtaacaatttgaatggggtgagaagcctcctggccagaactcaggggagggcacacatctggcgtgcagactccacaggtggagtagaaccaatccctttcattcacagctgggaggtgggtagcctggggcagattttcaagctcatcttgccctccaactgaaaatggactcaggctgttagagggtgggagacacagtgagagtgagactagccatttggtttgggtttgcgtggaagcagagtgaggcctgtgactgctggctttcccccacttccctgacaacctgcatgactcagcagaggaagccataatcctcctaggtgcacaactccagtgacctgggaatctcacccccatcccccatagcagccctagcaagactcacccaaggagagtctgagctcagacacacctagccttgcccccacctgatggtccttccctatctaccctgggagtggaagacaaagggcatataatcttgggagttctagggttcctccccatactaccacagctgatgctctctggaaggcaacacctcctggcaggagaccagccagcacaaaaatagagcattaaaccacgaaagctaagaacccccacagagcccattgcgccccccaacccctaccccctgcaccagaacaggcactggtaacctataaaggaaaatctgtgagattaacagcagatttctcagcagaaagcctacaagctagaagggactggggccctatcttcagcctcctcaaacaaaacaattatcagccaagaattttgtacccagtgaaattaagcatcatatatgaaggaaagatacagtctttttcagaaaaacaaatgctgagaaaatttgccattaccaagccaccactacaagaactgctagaaggagctctaaatcttgaaacaaatcctggaaacacaacaaaacagaacctcttttttttttaaattattattattatactttaagttttagggtacatgtgccatgccggtgtgctgcacccattaactcgtcatttagcattaggtatatctcctaatgctatccctcccccttccccccaccccacaacagtccccagagtgtgatgttccccttcctgtgtccatgtgttctcattgttcaattcccacctatgagtgagaacatgcggtgtttggttttttgttcttgcgatagtttactgagaatgatgatttccaatttcatccatgtccctacaaaggacatgaactcatcattttttatggctgcatagctttccatggtgtatatgtgccacattttcttaatccagtctatcattgttggacatttggattggttccaagtctttgctattgtgaatagtgccgcaataaacatacgtgtgcatgtgtctttatagcagcatgatttatagtcctttgggtatatacccggtaatgggatggctgggtcaaatggtatttctagttctagatccctgaggaatcgccacactgacttccacaatggttgaactagttgacagtcccaccaacagtgtaaaagtattcctatttctccacatcctctccagcacctgttgtttcctgacttttgaatgattgccattctaactgatgtgagatggtatctcattgtggttttgatttgcatttctctgatggccagtgatggtgagcattttttcatgtgttttttggctgcataaatgtcttcttttgagaagtgtctgttcatatccttcgcccactttctgatggggttgtttgtttttttcttgtgaatttgtttgagttcattgtagattctggatgttagccctttgtcagatgagtaggttgcgaaaattttctcccattttgtaggttgcctgttcactctgatggtagtttcttttgctgtgcagaagctctttagtttaattagatcccatttatcaattttggcttttgttgccattgcttttggtgttttagacgtgaagtccttgcccatgcctgtgtcctgaatggtaatgcctgggttttcttctagggtttttatggttttaggtctaacatgtaagtctttaatccatcttgaattaatttttgtataaggtgtaaggaagggatccagtttcagctttctaaatatggctagccagttttcccagaaccgtttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagcgtgatgcctccagctttgttcttttggcttaggtttgacttggtgatgcaggctcttttttggttccatatgaactttaaagtagttttttccaattctgtgaagaaagtcatgggtagcttgatggggatggcattgaatctttaaattaccttgggcaatacggccattttcacgatattgattcttcctacccatgagcatggaatgttcttccatttgtttgtatcctcttttatttcattgagcagtggtttgcagttctccttgaagaagtccttcatgttgcttgtaagttggattcataggtattttattctctttgaagcaattgtgaatgggagtttactgatgatttggctctctgtttgtctgttattggtgtataagaatgcttgtgatttttgcacagaacctctttaaagcgtaaatcacaaaggacctgtaaaacaaaaatacaagctaaaaagcgaaaacaaaacaaaacaaaagtatacaggcaacaaagagcatgatgaatgcaatggtacctcacatttcgatactgacattgaatgtaaatggcctaaatgctccacttaaaagatgcagaactgcagaatggataagaactcaccaaccaactatctgctgccttcaggagactcacctaacacataaggaccaacataaacttaaagtaaaggggtggaaaagactttccatgcaaatggacaccaaaagccagcagaggtagctattcttgtgtcacacaaaacaaactttaaagcaatagcagttaaaagagacaaagagggatattatataatggtaaaaggccttctccaacaggaatatgtcacaatgctaaacatatattcacttaacaatggagcccccaaatttataaaacaattactaacagacctaagaaatgagatagacagcaacacaacaatagtgggggacttcagtacttcactgacagcactagacaggtcatcaagacaaaaagtcaacaaagaaacaatggatttaaactgtaccttggaacaaatggacttaacagatatatacagaacaactgcaaaatatacattctattcaacagtgcatggaactttctccaagatagaccatatgataggccataaaatgagccttagtgaatttaagaaaattgaattatatcaagcactctgtcagaccacagtggaataaaactggaaatcaactccaaatggaatcttcaaaaccatgcaaatacatggaaattaaataacctgctcctgaatgagcattgtgtcaaaaatgaaatcaagatggaaattatacaattatttgaactgaacaacaataatgacacaacttatcaaaacctctgggatacagcaaaggtggtgctaagaggaaagttcatagccctaaatgcctacatcaaaaagactgaaagagcaaaaaagacaatctacagtcacacctcagggatctagaaacaagaacaaaccaaacccaaacccagcagaagaaaggaaataatcaagatcagagcagaactaaatgaaattgaaacaaaaaaaaaccatacaaaaaaataaataaataaatgaaacaaaacctggttctttgagaaaataaataaaattgatagaccattagcaagattaaccaagaaaagaagagagaaaatccaaataacttcactaagaaatgaaacaggagatattacaactgacaccactgaaatacaaaagatattcaaggctactatgaacacctttatgcacataaactagaaaacctagaagagatggataaattcctggaaaaatacaacactcctagcttaaatcaggaagaattagatacactgaacagatcaataacaagcagagagattgaaatggtacttaaaaaattatcaacaaaaagaagtccaagacccgacagattcacagcagcattctaccagacattcaaagaattggtaccaatccttttgacactattccacaagatagagaaagaaggaaccttccctaattcgttctatgaagccagcatcaccctagtaccaaaaccaggaaaggacataaccaaaaaagaaaactacagatcaatatccttgataaacatagatggtaaaatccttaacaaaatactagctgactgaatccaacaacatatcaaaaagataatccaccatgatcaagtgggtttcataccaggggtgcagagatggtttaatgtacacaagtcaataaatgtgatacaccacataaacagaattaaaaacaaaaattccatgatcatctcaatagatgcagaaaaagcattcaacaaaatccagcatccctttatgattaaagctctcagcaaaatcagcatacaagggacatacattaatgtaataaaaactatctatgacaaacccacagccaacgtaatactgaatggggaaaagttgaaagaattccctctgagaactggaacaagacaatgatgcccactctcaccactcttcttcaacatagtaatggaagtcctagcaagagcaatcagacaagagggagaaataaagggcatccaaatcggtaaagaggaagtcaaactgtcactgtttgctgatgatatgattatttaccttgaaaactctaagaactcctccagcaagctcctagaactgataaatgaattcaagaaagtttctggatacaagattaatgtacacaaatcagtagctcttctatataccaacagtgaccaaggggagaatcaaatcaagaactcaacccattttacaatagctgtaaaaaaaataaaataaaatacttaagaatatacctaacaaaggagtcgagagacttctacaaggaaaactacaaaacactgctgaaaggaatcatagacaatacaaacaaatgggaacacatcccgtgatcatggatgggtagaatcaatattgtgaaaatgcccatactgccaaaagcaacctacaaattcaacacaatccccatcaaaataacaccatcattcttcacagaattagaaaaaacaattctaaaactcagatggaaccaaaaaagagcctgcatagccaaagcaagaccaagcaaaaagtacaaatctggaggcatcacactacctgatttcaaattatactataaggccatagtcaccaaaatggcatggtactggtataaaaatagacatatagaccaatggaacagaatagagaacccggagataaacccaaatacttacagccaactgatcttcaacaaagcaaacaaaaacataaagtggggaaaaggataaccttttcaacaaatggtgctgagataattggctagccacacataggagaatgaaactagatcctatctctcaccgtatacaaaaatcaactcaagatggattaagggcttaaacctaagacgtgaaactatgaaattttagaagataactttggaaaaacccttctagacattggcttaggcaaggatttcatgaccaagaacccaaaagcaaatgcaataaaaacaaagataaatagctgggacctcattaaactttacgagcttttgcagggcaaaaggaacagtcagcagagtaaacagacaacccacagagtgggagaaaaatcttcacaatctatacctctgacaaagggtagtatccagaatctacaaggaccccaaacaaatcagtaagaaaaaaacaaacaatcccatcaaaaagtaggctaagggcatgagtaggcaattcacaaaagaagatatacaaatggcaagcaaacatatgaaaaaatgctcaacatcactaatgatcaaggaaatgcaaatcaaaaacacaaaatgtgataccaccgtacttctgcaagaatggccataataaaaaaattttaaaaaacagtagatgttggcatggaaggggtgatcaggaaacacttctacactgctggtgggaatgcaaactagtacagccattatgggaaacagtgtggggattccttaaagaactaaaagtagaactaccacttgatccagcagtcccactactaggtatctacccagaggaaaagaagtcattatttgaaaaagacacttgtacacgtatgtttatagcagcacaattcacaattgcaaaactgtggaactaacccaaatgtccatcagtcaataagtggataaagaaactgtggtgtacagatatatatacaatgaaatactacacagctatgaaaaggaatgaattaacagcatttgcagtgacctggatgagattggagactattattctaagtgaagtaactcaggaatagaaaagcaaacatcatatgttctcactgatatgtgggatctaagctatgaggacacaaagatataagaatgatacaatggactttggggacttggggggaagagtgggaggggggtgagggataaaagattacaaatatggtgcagtgtatactgcttgggtgatgggtgcaccaaaatctcacaaatcaccactaaagaacttacttatataactaaatataccacctgtaccctaataacttatggaaaaaaattttataaaaagtaatagatttaagtcagaagtttattgaagcaaagtaaagtacattcggaagggaccaagtggaaaatttaaaagattgagtgccccgcttgatcattggttcaaggcttttatagagttactgtatcctgattcttcctgatctcctcccctcatccttcttgggggaactgttggctaatccttgcatgcgcagtaacttgctaatatctgtcaggggctgcatgtgccgtttggtggctgaagttgtgtgtatgctctccatgacaatttttcgttactggtctagtgcccccaaaggaaggtcacatatcaggcaaactctgacgttttgccccttcttgagcatgcctggacatatccccgaaggaaggccaaactccgccattttgccccttactgcagatgcctggtcatgtttgcttagttcctgggatcttatgaggaagttgttgctcataagctcaagatgtttcctgtttgggaggaaattttccccttcttggtgccagccatgaccatctgtcattcccaaggaggcccctgacaattgcatgacagtcacctgactgttgcctgacattccttggggcactctcctaccctgctcatatctgcctatctgcctaagtaacatgaagacattttaaaccttctcagtggttctcccatttcttctctctctctctcccccactttcccttcaaaccacctcaaaactcctttctatttctactcagcaaaatggagattaaaacctcactaaaatgtgtctttgcccacccctgccttcccatttcacagcgcacttctttcttcaaacagatttagatttacagaggaaaaaaggcagaaattctctttaccggcttcagacacttaaagaaaatctgtccttttcatctctacacgttaaaatatttgctataataagtgtagattcaagagccatttggacatatctggcttttaaatagtgttgactaatgaccaacttaacttagatctttgaatctatgtgtggtgttatgatatatattagttttcatctgaggtctagctcataactcccacagcccttgttacagtcttttgttataatgttgggtgtgttaggcctcaggggcaggcccctgaccttctccttctctcctttcacctgttcctgcctttctgattgtggcttttaagaccttccccagagagagtactgccctataccctgggggaaggaatgctgatgtcatgaagcctccataaaatcccagaaggacagggttcagtgagcttccacatagctgaacacttggactttcatggaggttggcacagccaggtaaggcatggaagctccacaccccttcccccatacctcaccctatatgcatctcttaatcggtaacatttgcaatatcctttataataaactagcaaacataagtaagtgttcccctgggttctgtgagccactccagcaaattaattgaacccaaagagaggattatgagtatgccaacttggaggtggccggttagaagctccagaggcccacacttgtgactggtgtggtggggggcagtcttgggaactgaaccttcaaccggtgggatctgacattatctccaggtagacagcgttggaactgaattacaggacacccagctagtgttggctgcttggtgtgggggggaaacctcacatgtttgttcgtagaaggcttcatctgtgttgatgatttttgtggtgtgagagtagaggaaaaatgccatcagggagagttttctctacaccctatagctcctagatgctttttatttaagacattcaaaccttgtgaaaaacaaacaaacacaaaaatctttttatttaagacggtcaaaccttgttcaaaacagcacagacattaactcggaatttaggatttattattgattaattgacattatcttcagtctgttcatattattaagtgatataagtcaggtacacacacacatgtatggggagtgtgtgggagtgtctgcatgaagtatactgtcagaaaatatactcatttcaaagaaacactgatttaggccctggcaaataaggaaacatttctatttcttctagaaataacacattcatttgccaacatctgatctatccatatgacctcttaatacacacatgaaataataaagtgtatttttcattcatttaataagcatgtgattcacgtgacactgtaagccttttttttttttttttttttttttttgagacagaccctttttctgtcgcccaggctggagtgcagtggtgtgatctctgctcactgcaacctccacctcctgagttcaagcgattctcctgcctcagcctcccaagtagccgggactacaggcacgggacaccacgcctggctaatttttttgtattttttgtagagacagggtttcgccatgttggccagactggtctgaaactcctgacctcaggtgatctgcccacctcggcctcccaaagtgctgggattaaaggcgtgagccactgcgcctgggcgagcatttttttttattccagtgtttctcgttaatctaccccatggcgttttatttcaggttgtatgtatgccagagatgaaaaaaggcaaatgacagaagagcaagtatatggagaaagataggagggacttgagaaaacttggcaatttactaaaatgaaatggcattgtttccatatttaccaaaaacagacaaacaaacctaatcattcctctcattttgatcagctttcatgtatattttctaggcctaatcaaaatcttctttggtgtcacaaaataatggaagagacatgtattggtttaggctcctgcagcagtagaccccaatataaggaatattagttgtttatttaggaaattcaagaaacctaagtaaaggagtagggaagtgagacaggaaatggaaggatctctgaaaaaatacacatcatcaagtccgttcccacagagggaaacaggagctcagtccccattgttgggttctggaagacagtgtggaacagaccccagagttatcccaactgtgagatgaggaagctggggtgcttttcaccaactcttcatccatcacctgcttccgggggtcattaacaatccaccactcccaggttatttatgctcaggccaggcatgtaactgcagccagaaaatagcccttgccaagactcacaggaattaaaaaccttcaggcaaggagctactggtctttgtaataataagctttgagaggcgggtattcagaggctatgggcaccaataacttcccttatgtgagtcataaacacaaagttaattttgtttgcatgtgtatacaagtattttgaatgaatgcttctctttgttttgtgtgtttggaaaatttaaacaaaattattattgtttttgtattggtatttaaacatctgaatatgtaacatcaaagatgatattaaaaagtataaagcaaattatcacaaaatcagatgtgcagttacatgtttacttgaaattctctctagactacatttgaaataggagcttccatagggggaaatttaaattttttttacaagttgtttaattataatgtgctttaaaaacactttagcatatcataaaccttcaaaacaaaatgagtaatcatcttctgagatccatagaaaatgtttcttaaatgtcactttcaattaccacttctggagctaacttgcaaaacaattgtgtttccaccaactgaaatatgttttcaccaaatttaagataatctgtggtcagtgtgagctttgtcttgatttaggaggaggaaagcaaagttccatttatgaatactttgaaaattttcagaaattctcctaaattgtttcagcaaccaggccaaaagagaggcctggaatcccaaggtgagaggaaactttaaaagttacacttatggccaggcacggtggctcacaccgtaattccagcactttgggagactgaaatgggtggatcacttgaggccaggagttcaggaccagcctggtcaacatggtgaaaccccatctctactaaaaatacaaaaattagcctggtgtggtggtgcatacctgtaatcccagccacttggcaggctgagacatgagaatcacttgcacccaggagacagaggctgcagtgagtgagatcatcccactgcactccaacctagacaacagagtgacactctgtctcaaaaaaaaaaaaaaaaaaaaagtttcacttgtgccttggggttggctgcctgctatcatatttttgttgtgttcttctaccccaagctccagtacctcccctcacagaaatcacctctcctaccaaccccaagggaacccattccatttttattagagagttcttctttacatggcctcaagtcttttcatcaagatttactgatagaataacagtaaatccacattactccaggtgtctctttgcccttacctagcctttgtgtctatgccattcttctcaaggaaattgccttcctttatcagctttaaaagtccatatttgggatcccctctcctggaaacattctctgactatccagcccagataattttttttctctgctttctcattataacattcatgatctgtgtcattcattcattcattcatttgcccaatatttcttgagtgcttcctaagttcaggcactgttctaggtactggggacataggaggatagaagccagtcaaattttgcactcactgaaactttactttagtaggtaagaatctatagtttaaaaaaaaattcacatatgaggcctgtgaagcaaataaagcaataatgtggtggttttcatggacattatgtctttcactacccgtccctctttttgttgtaaactctctaaggcaagtataacctcatctatacattagtatttatttaccacaaggacccataagtatttattgatatatcttcctaagtatgtgataatattctaaatagatagtagatttaatcattgggatttatgtgaagttggattaaatagataacatgataattacatttagtattgcatggaaggacacattttctcacttatagaagcctaaacaaatgtcacaatgttgatagattcctttataggatgttaactctgaagctgtcgtgaaaatgtgtgaactagtttcactttcaacttgatccttttggaatcatgacagattttgctagcccttaattcttctgcaatctttgttgatccctcctatttcaatctcataagacacttatctctcctccagaaagatctgaagggttaagtcacctatttatacctaattacagtgagccctgtgttggatttttaagggataaaaggaagtatcagatctcagttaacttatgtactgtctacagtgcctaacaatgacacaggatgactcagttaaggagaaaaatactccatttatcagcacagaattcttccctttaagctatcatatggtagctaaccttgcctaaccttgcgagtttaaccttgctttttacgtgcatgcacgcgtgtgtgtgtgtgtgtgtgtgtgtgttactaatttctaactgtaccagctcctgaattaatatttggcaacatcaatattccttgtataatgaagaagcatggtccaagagacttggatgtgacctctctaaacatcaacttacagctgcaaaataaggaataagttgtaattattccttatttgtaacaactaccttacagtgttgttttgaagattagaagagaatatatagatgaagtacccagtggacagtaggtattgaataaatgttagtttccttccaccttctctggcttatgtaacaaaattactcattctactagtcactcagactttagttaatcattagctaaagagtaacaatgcaggattttttttttaataaattggctaggattggttttatgcctggatggaataggcacttgccatttcatcacaattcaaaattcctcctgaaggcctgaaggcctgaaatgtttaccattggaaactaatcccactgtatggttactattatttattatatctattaacttataaaatattaaaatataaagtaaatattaccctactgatgcattagccactcaacataaatgagtttcttggagattaataaagcagtacatcagtatgtcccaaacaatggctaaaaggaaacctagtaaccaccccgaccccaaacttgttttgttaggccagtcagatttttttttttcattttgaattagcatcacgattgaaagtggaaagatctcacatataacttcacatttctctgtacaattgagaaacgttggctatgttggctctctgaatagcagctacctcctttcaaggtttgtatttacaatatttcccacccccatgagtccttattatcctgacactgaggacaaatatgagttgctgtccatcagcattccaaagctgtttttttttttgttttttttttcttacacttagcctacttcactccctaacaccaccagcctgatttctgagggggcctgaggtaggaggaggagaatggagagcactttctctgagagccgccattttaacagatcattaaagacacgatattcacatgacggttgcttactctctgatgaaaactacaaaaacagaatacacagggaaggtaatctgaaggtgatacctttttcctatgatccttggccttataaccactaatcaagcctgagggccgaagttcctgcctcatctctgcctgatgttacgaactaggcaggctagcagaggcaacaggcaacctgggcacctgaagagctacctggataacctagaagaacagtaggaggttaaagatgaggacaagtctatcaaaacaaaagcctgtcaagaccagaaagagaaagtcacacttttgactttacagtttgtgctgggctgacacaaaggcctcagttaacaccaaatacaacttccatagacttcaagtttccctcatatttttcctgggtcactattccagagttgagaaactgaactacatctaatattttattaaaataaaattgaagattattagaaaagtttattagtcaatagtaaaacgttatttggttagctttcttaaacaatggcatttatagatatctgattatcccaacaaaaatcttcaaatggttcatggacgctttgtcaagcttttgtgccacctgagagaaaaaaagataaatggggaggtataatgttaattttgtagcctttgcttaatgtttatttttgaaatgcctatcattttctatcagtatctgaaactccatggatttctattagccttcaccaataattacatttgaaagcatccagaagagacaatccttaccacagtctcttttaaactcttaatggctgtcacaaaattctatttttcattttctctaagagcattctattaaactgttcctagttattagctttcataaaggcacacagaaaatgtttcctctacagccacaaatattcctaaagcagaatcatagtaaaacagctgtgataatgttttattcattccagaatcctaatgattgaacaaaagagagacagtcttaagagttaacatctattgagtccgtgactgcgtgcattgttctttcaagtattttacctgcactatttaatgtaattctcccagccactctgatttcactcattttacaattgaggagactgaggcatagaaaactaaagcaatttggctggagtaagggccaggttgggacttataccttggcggtctgcctacaaggtgttcctcaccaccatctgacactgctttctctgtgtagcccagagtgtcagcctcagtgcttcaacttgagctttcaggatctatttaaagatggaaaatatagttacattatgtcaccatttgagatgcagaaagacagggccaccattttgcacaattctgaaagcacaattcatgctgtggtttgtaaaaatggtactccctagagttgggcaatggacagctcacacagagatgcagtggccctgctaaactaatgccttacataaaagagttttactcttcattcccttaaatgattcttagtaacactggctgacacacacacaaaacagtttctaagtaggtctgtccgcatactatgatcactggtcaacattaagtttccacaattaattttacataatccaaagactgccaagcagtttatctgggtaaactaaacattctgtagtcatttattctgcttccagtcatgcccagcaacaggttgagaagacaaatgttctcagaaatgatctccaaggagttgggagcaggctgcttatacgtctaattcaccagaataggtgagcgtggtcgtggtgaccttttcatactgttgcagagctgagtatgaagagatgactcacagtcctccaatgcaacacaggtgaccctgcagccagattttgccttcagtggtatgtgactcccatggggtcaggagagtatctcagacattgaaatttgacctaatggcctacctacctgcacacgcaccctgcccacttacagaagggcaagaactctgcattactgaggccttgttattattatagttcctatttaggtaagaacgcaatggagaaaaaatgcatttggttattgggcctctgtttgaatatcctgtgctttttgccaaacaatgcattctacataatcttaaaaaacaaagtccatttcaaagaacaaaaataatgaccatatccactgagcaattgagcagaatgggaatcggagttttaaactctgatatatctgttttccttagggctgaaatcttcttttcatggttctagtttctctaattgaaataagaacctaaccctgttcaaaactacatctctgggaatgagtgaaaaattaatgatcctcctattttgttggatcataataatgactctcatcctggtggggccaccagcaatgctattcttctcagactctatcttagttcctaagccactcaccaggtatttaaaagaatgatttaacacaactagaatcatttaaataactgtattttttaagaaagccatattattgctttagtttggtcattcatatatccaaaccttggactcatcatcttgcaatctcatgtgttcagttattccagagaaaacattaaggagaattgtattcttcttcccagctaaattttaggtcctcaaagctggcaaccacaatttatgctttctaaaaatcatctatgatactaagtatgagctggatcatgaataaaacccttgtaacaataaatgcttgatgacttacttcatctcattagcaagggaaggtaactcataattatcaaggtactacaggaaatagggcactatctggaaatgctaaatacatctccttgcatgaatcacttcttaccagaattccctttctttccagatcccacctccagggttctgtggtccataccaggcactacattcctcaggggctacagcctatgagcgtctcatggggctatgaaaccatttgagacctggaaaatgaagtaattgaatacaaacagaaaactgcaaaatgaggactaacatttaattaaatgttcaaagcataagattatgtcgacttcaataattgtcaaatgagtattcttaacattttactaaattaaaaaaacttatgtgctgagttttttattttacaagtatctccaagtatgctggatgattgcaaagaaaatcaaggccagtcattggttaaatgagtttaatagtagccacataatttcaaaagcaaaattataaagacccttcccagactgttgatagcaaaaataatctacgttgtggaaagtgggtccatgttaatatgttagatataagtagtgaggcctaaaaaggtattaaaacatctttgcttaaggtactacctatttgcaagattgttattttaaaaatagcttatgttttaaattgttattgctttttatcactctaataagaatttatagttgctgtaagataacaagaaaaaggttaactatctgcagagatgcctgagagtcagccagggagtaacttaaatcctgcaggaatctgactcactgaagactgtcaactgaatgaaggcttaaatttcatggtcttgggtgggagaactttttcatattctttccccatatggaataacaatctgccctgaaaacagggagtattttggcatgatctctttttgcttatttgccttccattttccataaagcaacttttgccaagcaccatacttaagactcaacttttttgcaaaaatatcagacaaagcactgtctttaagaacacagagaacacactagatcccttcttctgaaaatcactgttctatgttgtttgtggatatttttttagcattcactgcatgcctggaatgaataggctgtgtttctccccaaaagagcacaaattaatatacaaggtcaggttaaatagttaagtctgctttcctatcccttatacagaagctatccattcaaaaaaaaaaaaaaaaaacttctttttactttttttaatttttaattttggtgcatacatagtaggtgtatatatttgtggaatacatacaaacatacaatgcataataatcacatcatggtaaatgggtatgcatcacctcaagcatttatcctttttttatgttacaaacaatccaattttaccctataattgcttaaaaaacatacaataaattgttaactatagtcaccctgttgtactatcaaatattagctcttattgattctatctaattacatttttttatacccgctaagtatcccacccttccctccacgctaccctacctaacctccggaaactgtcttctgctctctatctccttcgtttgttttaatttttagctcccacaaaaagggagaacatgtgaagtttgtgtttctgtgagtaacttatttcacctaacataattatctccacttccatccgtattgttgcagatgacaggacctcattcttttttatggctaaatagtactacattatatatatgcaccatattttctttatctatttgcctgttgatagaaatttagattgcttccaaatcctggctattgttaatagtgctgcaataaacatgggagtatagataactctttgatattttgactttctttcttttgggtatgtacttagcagtgggattgctagatcatatggtagctctatttttagtcttttgaggagtcttcaaactgttctccatagtggttgtactaatttacattcccatcaaaagtgtaccagggttcccttttctttacatcctcaccagcatttcttattatttgtcttttgcataaaagccattttagctggagtgagatgacatctcacaatagttttgatttgcatttctctgacgatcaatgatgttgagcaccttttcatatacttgtttaccatttttatgtcttcttttgagaaatgtgtgttcagatgttttgcctatttttaaatcagattaattttttcctgtagagttgtttgagcttcttatatattctgattattaatcccttgtcagatggatagtttgcaaatatttcctcccattatgtgggttgtctcttcactttgtcaattgttcctttgctgtgcagaagctttttaatttgatgtgatcctatttgtcccatttgtccatttttgctttggttgcctatgcttgtagggtattacttaagaaattgttacccagtccaatgttctagagactttcttcaatgttttcttttagtagtttcatagttcagagtcttagacttaagtctttcatccattttgacttgatttttgtatatggcaaaagatagaagtctagtttccttcttctgcatgtggatatccagttttcccagcaccatttattaaggagactgtcttttcccaaagtatatacttggcgcctttgttgaaaatgagttcgctgtagatgtatggattcatttctgggttcaaaactggtattccagttttgttctttttgctcgggatacctttggctattttgagtcttttatagtttcatataaattttaggattttttttctatttctgggaagaatgtccttggtatttttatagggactacattgaatctgtagattgctttgggtagtatgaacgttttaacaatattgatccttccaattcatgaatgtggaatatctttccatttttttgtgttctctttttttccattagtatttgatagttgatagatcattgtagacttttttggtttagttaaccctaggtacttaattttatttgtacctattgcaaatgggattactttctccatttctttttcagattgttcactgttggcatgtagaaatgctactaatttttgtatgtttgttttgtatcctacaactttgctgaatttatttatcagttctaatagtgttttggtggaatcttcaggtttttccaaatttaagatcatattttctgcaaatgggataatttgccttcttcctttcaaatttctttctttggtctgattgttctagcaaggacttccagtattattaatatattgaatactagtggtgaaagtgggcatccttatcttgtcccacctcttggaagaagagtcttcagttataccctattcagtatgataccagctgtgagtctgttatatatgacttttattgtgttgaggtatttccttttatacccgattttttgaggatttttatcatgaagggatgttgaattttatcaaatgcttattcagcatctgttgaaatggtcatatggtttttgtccttcctgtcttccttttagtaaaagtgattttctctggtggcgtgttttaattttttgctttttattttttgagaacctgttgtatattttttgatttgcgattaccaggaggcttgtaaataatatattgtaactcattattttaaactgataacaacttaacactgattgcataaacaaactaacaagcaaagggaaaaccaataaaaactctacattttaactttgtcccccgctttaaaactttctgttgtctttatatcttattgtattgtctgtatttcaaaaaatagttgtagttattatttttgatcagtttatcttttattctttctatttaagatatgagttgtttacatactataataacagtgttataatattctgtgtttttctgtgtatttactaatgctagtgagctttgttcctccagatgatttcttattgctcattaatatgcttttctttcagattgaagagaattctttagcatttcttacaggataggtctggtgttgatgacatccctcagcttttgtttgtttgggaaagtcttgatttctccatgtttggagaatatttttacaggatatactagcctgagataaaagtttttttccctttagcactgtgaatatgtctcctgccctataaggtttccactgagaagtctgctgccagatatattggaactccagtgtatgttttttctttattttttcttgccgcttttcagattctttcttatctttgacctttgtgagtttgagtattgaatgccttgagctagtcttctttgggttatatctgcttggtgttctataaccttattatacttgaatattgttatatttctctaggtttaggaaggtctctgttattttccctttgaataaattttctacccccatctctctttctaacttttttttaaggtcaataactcttagatttgcccttttgagactattttctaagtcttctaggaatgcctctttcttttttattattttttcttttgtcttctctttgtattttcaagtaggctgtcttcaagctcacagttctttcttctgcttgattgttttgtgctgttaagagactctgagacatttttcagtatgtcagttgcgtgttttaactccagaatttccgcttgattcttttaaattattttaatctctttgttgaatttatctgataggattctgaattccttctgtgtgttatcttgaattccattgagtttcctctgtctaaaaggtcacatatctctgtctctccaggactggtcactgatgccttatttagtttgtttggtgatgtcatgttttcctggataggctttatgcttgtggatgttcgttgttgtctgggcattgaagagttgggtatttattgtagccttgcagtctgggcttgtttgtacctgtccttcttggtgaggctttccagatgcttgaagaaacttgggtgttgtggtctgagttttgggtcactgcaggaatatctgcattagggagcactccaagcccagtaacactgtggctcttgcagaggtaccaccttagtagtcttggataatatccagagtcattctctggattaccaggcagagactcttttttctcttctcttactttctcccaaacaaacagattcagtctcagtctgtctgtctgtctgtctgtctctctctctctctctctgtgtgtgtctctgtttcctggatctgggggaggggtaacacaaatacccctgtggccaccaccactgggactgcatagggtcagacctgaagccagcatagcactgggtcttgcccaaagcctgcagtaaccactgcttggctcctgcctatgtttgctcaaggcactagggctctataatcagcaggtggtaaagccagccaggcttgtatccttcccttcaagacaactagttcctcctagtcctgggcaggtctagagatgacgtccaggagccagggcctggagtcagaaatcttaggaatctaccggtactctattctacggtgggtgagctggcacccaagtcacaagacaaagtccttcccactcttccttctcctttccacaagcagaggagtctctccctgtggccaccactgccccaggcctgcgacaagtactgtctggctactgctgatgttcattcaaggcccaggggctcttcaatcagcttgtggtgaatgctgccaggcctaggaatctattttggggcagtgggcccacctgtaagccagggaaggtccagaaataccatctaaagccaagccctggaatcaggaacccctagaacccctttggtgctttaccctgctgtggctaagctggtacctaagctgatttttggttcttatgaaggtgcatgaaggtgcttttttgtgtggagagttgttcaatttgttgttcctttgggaggctgctatttagccatatggctccacctccctctccatccaaaaagaaaactttaaatgaaaatatacatccaaagaaagtgtttttgaaataaaaaataaatggtcttaattccaaggaaagaaccaacatagtaaagtaaaaatgcattttttccaaaagttacttgtttgatcacatattgtattttattttaatgaaatatctagaataggtaagtccatagagaatacaaaacaggttagtagttgccagggaatgtgagtgtgcagaatgaggagtcattgcttaatggcactgttttcaagagttacttttgagtacacttgcagtctggtatctaaataattgaaatatttgaaagtcgtgattcctagaataaaaacagtgactaacttttaatgatttcaatgtcatgtgcacaaaaaaaccatgtccagagtaataagtttacccattctaccattcttttcaaagaattgcttaaataagttttaaaaaatttcctattgagatgttacttaaaatacgatttgtttagttctcaaggttatgctttccccaggttatgcttcatttgggtaatctaagtttaagtcctaatgtaagacctagggcatggtacttaacttcctgtagacctcagttttcttgactgtgtggtggaagaaataatagtacctagcttgtgagtttgttttaaatgttaaatgagagaacatgtggaacatcttacccagtgcctggcacatggtgagcaatcaataaatgggagttcatcctgtcatcttcagatttctcttctggagccagccaggcttgagttctgacctggttcatccactgaacttgtaggggaagcacttagtgcccttcggtcctctcatccagtacatggatatacagtcttcatgtggttgatacaaatacgaatgtgctaatgcatctttaccaaaaagagaggtaaaagaaaggaaggataatcctgccagagatacatatgcaaagatctgaaagtaatcgagagtgaggggttgcagattggacaacacttagtagtggctccagataaggttcttaaagactggccaggatgcagccttttcatccagagaaacagccatctcattcatagacagtggtgactgattggcagattttataagatgacacaaacaccctccccattgtcctgccaaaatgtggggaaactcttcctggaaaagttatttctttgaattgagcttccaaaaggttcctattagaattcaaatactctgtctgggttgaatatcacattgcataatagtttctccagattaaggccatttttcctaaatatttaacaaaaaatttttcgcttcttatcaatgatgctggcgttggttcagtgcctgcataagacttcttccagtgtatttctttaccctggcaaccagttcctttttctttgggagaattttttttttaattataacactattgtaggaactcctttttggcacagaaggcatctaaagtaacttttagagatagaggcttatgaaaaacaagaaagaggcaagactcagtttttgaaatctaattccagccatgaagcaaatgccacaaaagggcacaggaagaaaatctgtaaagggcttatctaccaccgttgaccaaagatttattctgctgttaagcaaataccttgtaagccagatattgtgctaggtattctgaatacaaagatgcagaagcctcattccctgttttctttttttttttttttattatactttaagttttagggtacatgtgcacattgtgcaggttagttacatatgtatacatgtgccatgctggtgcactgcacccactaacgcgtcatctagcattaggtatatctcccaatgctatccctcccccctccccccaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacatgtgcatgtgtctttatagcagcatgatttatagtcatttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatgaacagacacttctcaaaagaagacatttatgcagccaaaaaacacatgaaaaaatgctcatcatcattccctgttttcaaagaaactcacagcattatggaggcccaggtttctatttgggcctccataatgccttgtgctctaccaagaatggtaaaacaatcctttccagtaggagttcctagttagtggcttatagttaaccaaatgaagagaggatgaccatatggtgctgataaattgaaagaaattaggatgaacatctagagatttgcatggccagacacctaattcagattgcagagcagcaggatgggaggcgtagtcctgatttaactcttgatcaaaaagaggggtaaaagaaaagaaagataatcctgccagaaatgcgtgtgcaaagatctgaaagtgatcaagagcaagggattgcagattggacagcatgttttctcatttaatcccagaggaaccctgggaggattctaggtgtgcatattgtccttattttgtagaagaaggtactgaatcttaaagagataatgtgttttcaaagcttacagagtccaaatcgatagctaaacagtgtctgtgggatttgaatccccctgtgatgttcactgtgtgttgccatatactgcaaatgtgttataaaataataattataataaacaaaattaacctgagatattcccagattgaatcaatccaaggagactgaacttctgagtttgtcttggagttagttgggctttactgctacttatgctagatcttgaaggcagagtaggaaatatacttagcagggaagtgggagaaaggtgagaggttccccaggcaggggaaacaaagtgagcagatttggggcaaggtgtgtgagattgtgtggttggcaatatagggtgggaaaaattagttatcaagggcaaagctgaatagcagattgaacccaaatggtagaagtttttatttaacacacaaaaaaggctgaaattgatcctgtaaggaatatgaagctatagaaggtttttcatcacaggctttgacattttaaggtttgtatctttgaaagataatccaaagataagagaaaaaaaccttagatgtgtaaaatagaagtcaggaaaactacacaagctatgtgtaaagggagtcaaggggacaggatccaaaggaagacaaaagcacaaaccaattattttaaatcaaatactagtgcagtaacatatatttttaagttttaaagctgcttttctccatagcttattgattactcttttaaaacttatttttaatagcagatattatttattgattccttaccattttctagatactttgctaaggttttacatgtcttttttagtcctcagaaaattctcttctatctccattttatagctgaggaaactgaagccagggaaggttaaataatttgtttgcaatcaaacaactagtgattggtggaatttggatttgcaaccaggcagtctgactccaaaggcctcttcttaacttgatcctacatacccttcctaaatagtaggcgtttttctcagagcagctgttttacattagagaaaacttatttgtaatctgtgatcaaggagaaactgcctgagttgcctggattattttggcatttttaatatgtacaagaaaaatgttatcaaataaatgtaaatttaaaggtcctgatgagagtttactttctaataaaacaattttcaacatttcccattacatcagaaactaaattattattaaaacacatcttgtgttcatttatttttgacaggctgcttttcacatctttttttttttttttttttttttttgagctggagtttcactcttgtcgcccaggttggagtccaatgacacgatctcggctcactgcaacctcctcctcccaagttgaagcaattctcctgcctcagcctcccaagtagctgggattacaggtgctcgccaccacacccagctaagttttgtatttttttagtagagacggggtttcaccatgtttgccaggctggtctcaaactcctgacctcaggtgatccacccgtctcggcctcccaaagtgctgggattataggcatgagccaccgcgcgcagcctccaatcttattttaatgaaaatctcaatttatctcagtgttagaaactagggcttcatttggcaatgtggtctttccagttgtttcatctctttcaaaagtcttttaagaattattgaagtaagttaattttaaatttttgctttatcccttgagattggtatatagagttaggaactacttgattaaatacaggaagctactataaatttgaaataagaactaaagttataatgtgaccagactgggtaagcactgataacatttgtatatatttaaacagaaaaaaaatagttagaagaataatttttaaaaacacacaccagatgttggtaaaggcaaagatatttttgctcttgactttgtctatgaaagtcaagtgaatactttgaaagaattgatgatggataaggcaagtacattgatttctcaaggtgtgaattgttatcttcaaactttgtgcttccataattgttttttctttaataatgagacatctagaccataactggctatgtgattctgaatctacctttacaacttaatctttgtgattcccctatataagatatctagagtagtcaaattcatacggacagaaagccaaatggtgcttgtcaggggctgggagaagaggagaataggaagttactattaatgagtacagggttgtcgatttggaaggatgaaaaagttctggagatggatggagataatcgttgtgcaacagggggaatatacattacaccactgatcagtatacttagaaagggttaaaatgtcaattttacgtgatgtgtattttaccataataaaaaatacttaatatttacctatgcttagagagagttgacatatagtcatttgataaataaaatttgtaaatgcgtatgcttagataaacatagaaaattgttttaaagtagaacttatagatttctagctttaaaactgtggagaaacaatcttcctatgccatttttttctttaaaaagtcactcaaaccaataattagtacaaaaaacagaaaggtacatttcatctttgaggaaactgggagatgtctgtgactctaagccacaatacataaagatagaagtaggaagagaaaaggtcaatgacttaaccaaatcagagaacaatactaaagtgaagcaaactgagctgccccagtcgcccaaaacatactttggaagatggaagagttctaaatatagcaggtgtatgaacatgtatattatatacacttctccataagccctcactctttttcagtgtagtcaacatattttgcatccctctccatggaagacagagactttgggatactaagcaaagagtaggagaaggatggctgtatgtttaactttatttaggacaattaaatgaatgtctgcaatgtgtcagtaagaccttcagcgtccttctcctacccacaccagaatgctaggaagcatatttatatccttctctagaaaaatagagataccccagaggaaaaaatctcttacaaatagtaacatttggaagaggcaaaaaaaatccccactgggcacttgatgatactgcagtaaaactcccagtacacaagcctcacccatgcacttagaacttactgtcacctttctagggtctcattcttgtgtatgaattgggatcaggaatcaatgctggagtttgaggatattacactcattgctctttgtttacattatttacatgtatttctttaataaaatttaaatatttaattcaaaataatgttaaatttgcagagattcatttaagtttagaataaagaagaacaagaaatgtgaaagagggacaagaggagaggcagaatgcaaaggaaatacagcagcacttagaaaattttaaattagatagtttttcttctgaaatccagtattgaattagtgcaaaattctgaaagtcaattacaaaattcattttatgtcaacattactgactccatgcacaaatgtttattctagttttaaaaactagtattctgtaccttttaatagccaatgtaatttgttgacaaatattgaaatttatacgttaccagaggtctcacgtattgttaccttttaaaatgatcatttattaaccagtattgcctaatgaggcaatcaaaatgtcatctgttgcataggtaacaggaaactaccattactcatgttgtgagatggtcaaagaccttatcatattttatggctaacaaactcatgatgttgtcatatatgccctcatcacagtgtttatgatacctaaaagttagtgcctaaaaattagaaacaaggacagtgaagttagattgtttaatcctgcatatcttaaagatctaacattttctagctgttaaatatgtttatcattatactagtaatgtacgtgcaccatttttattatattaattcattgccactgtacaactaaagaggatggatgaattttaaaaacttccaaaaacttggtagcattttttaatctctttctcttcctcttttctttctgtcttccacacacacacacacacacaaacacacacatacacatacatacatgcacacatacacatcatgaagagcaagctttggaatgaaatatacctgggtccaaaaattttgaacaaattgttgactttctttatgtatgaaattattattatcacatctactttggagggatgttgtgatgtataattaagaaagtatagtctacttagcatgtaggtaattaataattagtagttattattattatcctaacctgacagtttatgaaagaggtaggaaatctgaagataggaaagccttcaaaatataatactccggacttctcctttgggaattaagaaatgtagctccaagcaaggttcatgccagtaggaaagtccttgaatccaactgtattcctagtaagtgtaataaaataaaagaaacctctagaaattgcctcaaaattcccctccagataaggaaaataacacaatatttctcaataatgaggaactgctacaggagttcagtgtcttattctcattaacgttagagtacaatagagaatagcaggaaactgtaaaaactgcagtcccctggtctttttttctaaaaagttagtttgacatatctggagtactgaatttcagcatatttgagaggcctgaatatttagttgatatataatatggctctaagaaatatgctcatgatagattggaaagtatagaatatctattgtaatctgaaaataggaatttagagaacagaagatttgatagtaggcagagtatttgaaaatagtaatacttgagaaaacctgagttgtatagtaaaattactccgtaacacctcattcagttggcttcatttaatgtttaatgtttaatccatggataaatgtcataagtctcacaagtcacgctcaccattggatgataagagaaagggagatcacattttaggtgcgcacaatctacctgtatgcaattgacgctttccatgtaagtgttgccaagttgtatcggggcaccattagtggtatgagacagactttaggagttattttggactcctttttttctattaatatatcttatattttgggggcaaattataccagtatattaaatctatttacagaataaatataaagttaccttttatattcagtttaagtttttttaaaaagtgagtcaattaagaaaaatatcaaatcatggtatagatggaatgctaatatggaaagaattatgaaggtggtgttatgactgaagtttcagaaacatcaaatgacatagtcatttgattcaacaaaacatctacagatggatgacccaatggatgtatacatctatggtacagtctattgaaatgtggtaacaaccagaaagtaaaaggtccatacattatacaattcagtacaacagggaaatactgagaaataatcgcagcttctggatcaaaagcatgggccacatggttcctaaatccagtctccccatattcaggcctcctcatcagcctgcatgccatcatatgcttgcatgctaacaggaatttcgagggaaatgccatatcttttccatttggggaagcttttcagagggaaaactacaggatgcttagataacaaaacattctttcagaaatgttcatgtgagaaatggtcttacaagtggataaaactctgtaacatcaaatacatactttttttttattctgtcactaccttaaatattaggagtagaagcaaaacttaaatttaaatctcaatggtcttacaacatagcgcatctttctttctctgtaatggcaaccttgatgtaccaatccaaaaactttgagtattctggttagttccatacattgtcagattccccacttaagtttgtttttgccaggggagagggacgatttcttagtcattatggtactattatacagtctttagtagatgcccaataagtgtgttaggttttcagagaaagattcttggaagatgtagaatgttgggcaagtaagcaaggaacagcacatggggctgcactaaacttgtgtgtgtgtgacagagaagggagtagcatcaggctaaataagctcattgtaacatggatctgggggacggtagaacacaggctaattatttctggagagttgaaaactcaacagtcagacattacattctctgatcattgtcatttgctttctgaaatggcaactggaagctatttggtagaccttacatggagggaacagtgtttcaaataaatagtagttgcctaattttacttggtttgcttttgttctttcttttcccacatttaaattccaataagaaaaaaattaaacctcttcctctaaatcccctctcccctaaaaataattagtctcacaaaacttttaagtttccaaaaaaatacatgattaattaacctgctttaaaatgccagcaatatactagacatgggacagtgctaagaaagtgtgaatgtcccctggcagtcataaggaaactgaaaagcttaaggggataactatgtggaaagcaatttattggcatttaccgtaagaggcctgagagtcattgaaagaagactaagtcacaaatgcaccttgaagtgtgaccaggggagcagatgaagggtttgttgtaagaagcagccagagcctctggcggatgccgtactacattttccaagttgtttgggtgggtcacaactgcactccaacatcctgtctgcaaatgctaaataaacaccaagttcacgtcagactagagaaccaacgtactagctaatgccatttaagcaatcagaatgcttacattattttcacttggtaattcacatccaaaataattgaagttggcacacccagaggagtatatatcctctgtgtagatgttcagagagataggcaggctggtcaactgttccttctgttgggagcaattggaatcagcttagattatatctactgtaatagaaaatattttatatttaggaggtgggaaaggttttggccttcgaaataataagagatattgacaagatataaagcttcattccttactgaagagctgttaaggattagcaaacccaagtctttgtgtgtagagatgaatgaaatttgcattttttttaaaaaaaaataaggtttagaaaacattgtgcaagggaacagccttaatacgtgcagccacttgtccaggaataatacattcaatttttcagtttaaaattccagtatgttctgatccaagggtgcctgttacactctgctgaatttttaagaggtaatttacatctctacaaccaactccaaagcatgacatttcattacatccgctcaaaatgaacagctgctaagtcatcaagttctctcaactttgcttctaaagagaaaagtttagttttagtgcttcagtgaaatacttttttgaaagaatgacttttataaaattcatttgtttattatggtaaataaacaacttaatggcaaggggtgtgttccttgtaaaggtgatcacggaatgttacccagaataacacagacatctcatttcccagagaaggaaatggttttataagttttgtgaggtctcttgtctgcttggccggtttacagtgctggtctctggagctgatccgcccctttgctttgtaagtctcagcaattgacgaggctaggctgggcgctgggcttttctttttttttttttttttttttcctttctcactgccctgcggtgttttgaactgccttcttacagacgtcatacagcccttgaggaatagtttctgcctggtgagattgaatgatagttctcattcacaaaaccctggattctaagcagggacacacagaaattactttcgcaggtaaatcagcccacccagccaaagtgtggagagatttgttccttggctgacttctttgctccacggagaggagtgttttcctgtgcttgccctgaaatggaacttccttgacagctctcccgtgttacagtacctcccggtcattttctttttctctctctctacctgcgctcttcgagtgtcagaaacctttaaagctgttactatggaattgcaaaaaagagatcaagtgactctttcactatgctggtttcccttgtgacccagatgaagaatcaattcagaattcagttcctcccttggcattgcaagacacagaagaaactgtcacttcctaacagcctagtactggagtaaattcagtatgaaggaagaaagcgctcctgcgtgttagaaccttgcccatgagctggaccgaggacaggagatggactccaggaaaattggatttcttcaagcagcctcccttggaaatggaatatctttaaaatcttctttgcagaaagacagttagaatgtattaatcagaatagttgaagacttattttcctttttattttttttcaaaatgagcattattatgaagccaagatcccgatctacaagttccctaaggactgcagaggcagtttggtaacgttcttttctctcatgcttttccccttttctcttttaagattgacgtactccttgagtatttagtaagttgtgtgatgtcgaggctttgtgaaagaaggcagtattggcggctcttttattctttattttgttcccaaactcatgtgctttaaccaaatgggtgctgattttttttttaattcctcttggactgtaacaatttatctgatgataatttttaaaggaggaaagaaacttgcagatatgttgggagttttgaaaatgaaaacttgtcatttttcagtgtttgattcagttgcttgttttcttatcttctttgcttgctgcaagcaggctggtggttgacaggctttgcccttgtctttaaaagcaataccctcacttttagcacagatgtgttagaaattaataatgttatttatatttaatcatacacatgaaacaaacttgaatttaactatgtggctaaatgtatatcaagttgcttatcattcattcatctcttatgttttattttattagaaatgattcctagtaattatatttttggttattttaatgcttttactctgatgaaaaaatatgtcagtttcaatgtattctaatgttctattatttccccaatggtgatttgatatgctaatcagcatatggcatggcccttaaggagtattttccaacaaagtaacttttttttctacaataggtatttacaaaatacttttatggctattttaggggttagtcttattttgtttttcttagtgattgattataaataactaagctcacctctttgaaatggaaataatcatacctcacactggggaaataaaagcaatgattgaagtgaggtggttgagaatgggaggaaaacaggccagcaaaatatgcattatcatgtgagcaggcaaacacacatgtaaatactcaaattatttgcgtcaggaatttagcttgtgtttttgtggataggttagcctttgctgttattgtagtgttttacagtcaaccagaaacaagaattgccccatccgcagtatttctgtgagttttaataaattatagatgaagattttgtctcttaacgttacttgccatttcttacaaaataacacgtgcaataaattattccttgagtttatttaaagaaaagattgcatctgcaaacaaatttggagagtcctgtcctttttttcctcaaacaataaatactggaaaatccttaaaatccttgtatgaattaccatagctaatataaatcaccaacatgagtaaacagaatttataatatacatgaatttaactcatttataatttataccattcctatgtgaaaagatgttactactttaaaaatagtgtttaaccaaactatttctctttttgtctaaactgccaggagatgtattttcaaattcaggtttcaattggaaataatttgttcatttcaggagatgagtaacattgacaccctttacctctctgagattatcatagtctatttttatccacaattattatattttttgttttaaattgtatgggatattttcataagtcaagccacaatttaaaatgcatttttaaatattttgatttgttaatgtgtgtatttttccatttaactaaaaatattctccatagacttggggatagaatgatttctgtgtaagaaataaatctctctctatatatgcatgattcttagatttaactacacactatagaaacctctccagttattaatcttacatctgacttaataatataaccgcttgggtatatcactgcagctgccaaaaaatttggcctgagggtataatcagctgtagtaacagttttgccattttattatccgtctatcagtcaaatattagacacatctattatatttatttatttaattacatgtataaaatcaatatagattatagatttggtatatagagaaaatatatgtttgtgtgtatatatatgtatacacatacatacacacacacatgtttacttgagcattaaaaaaacccaaacggcctctcttcttgtgcctctgcacataaaggccacaggcctcaaattgctcagagggacaatgttttctcaccagtgttgctgtctgcatttctccaccaccaccctaccctcattccttttcagttgacttcccatgagagagacctaaaactttgccatttatctctttttcagatgtttatttgtttccaggttgatctccaaaatactttgttcttgggacacatctttctggctttaccatcttcactctgattacataaatctattttgtgttccattggtctactttctccaaatctgtctactgtcctccgggattccctaaagccaaacattacgtttggaagtttgttgtattgtgcaagaatccaatgttttggattacttctttacctttttctatttgtttctctccaagtatcataaaaagcagtccacactaacttgtccttacagccttaattaaattgctatgagatattcacattttaaatgggatttcatggcaaacttgtattttatacccttcctcttattaaaggtcagcctgttataattaaaattttattaatttcaagacaaaatacaaataaccttaaaattaatctatttgtctctttgtaacataggtgtccaaatttagggtttatttaataaaggtgtatactaggttgcttttatttaaggaacagttatttatatgccacgttctagcagaaagtgattatagtatttattcttaagcattattttaaaaaaatgtgcctgcatgaaattgagaaaaactttatatattttcttatgctcataaagctaataaaattagcagattcattgattgcagaattgtttgcctttcttgcatatcttaaattcagatttagtcagttgttatatactatgaaaatattaccttacatattccttgatatctctttaacacttttataaacatttataaacatttcccagggatacttctcattaatgtaattaagacttgtgatttagtttaagtaagtaaaacattattagtcttacaaatataaatataaagagaagtttagtcaatggaagtggacttttttctttcctgctgacagaacagtgtttaggatttatgtgttacatgtaagatcattcattatgtaatctgaaaataaaagagatgctactgttcaaaatatgactgtggttgtttttaaagcaaattttaaaattggttattgtatatgtaatagtacttatacttttcattataagtattattatgtaataagtatacatgtaatacttaggtttgtagatgcagaaaaaattctggaagactctgtccaagcttttggtagtggttattttttaggagtaaaaaaaaaaatggtaggagtgaaggtaagggggactgcctctcttttcttcactgtatttgcatattgtatgtagtttttatcaataaagtattatatatgaaagtttaaaatattaaaaatatacctactatatgtattagcaagctcatctttatatatgccaatatctacttagacattaaaccacaatttgctcaggttatataatatgcaaatgagtatttcagtactggttggatacaattttctgaattttcttgcaactctgaccaatggaggattataatttttttattagctcttttctcttaaggttgtaaaaatctagactggcttagcattcttattttggcctcatgatcacagtggaaagcattcatataagctaaaatgtccaattttataattgagaatcaaaaagatggaataacattaatatgttggaaggaaaataacccattaaccccattattccatcctcagttattctcattttcaacttaccttacatatcttaaatagctgtaaatactatttctgtactctgcttcttcatttaacatatcaatatttttctatttttggccaggcggcgtagcttgctcctgtaatacctgcaatttaggaggctgaggcaggcagatcgcctgaggccaggagttcaagaccagcctggccaaaatggcgcaaccctgtctctactaaaaatccaaaaattagccagagtggtggaacatgcctgtaatctcagcttcttgggaggctgaggcatgagaattgcttcaacccaggaggtggaggttacagtgagccaagatcgtgccactgcactccagcctgggtgacagagcaagactctgtctcaatttaaaaaaaaaaaaaatccatttttctaatacttatagctttcattttattgagtgtcttatgaaagagctctatcaagaattttacatatatattatttagttcttattacaatattgaaaagaaggagttgttaatcctaattttacaggtgagaaaatgattccgtgagatgaaataacttgagcaaggtcataggctggggtaacccaagtctgtctacctcaaagaacgtgctctggttcttcagcttgttgccttcctctactgtggatataattatctttttaatggccataaaagtgttcatgttgtgaatatttctagatgcattacagtatttggcagttttcttttcggaagtatggtagcctatgaaattcagggttgacgttgttggttgttgaaaaatagctttgtgaaagactgttggttgttgaaaaatagctttgtgaaaggctcttgcagcttgtagaccattatattctctactggtagcaaataaggtcctctggtctttataacagacaataaagaacaaaaggccaatgcctcacaattttgaatagattatctttccaattctattaccaagtttttctgttctctgcaagctctgtaaggcttcaggttggaaacaagtagtacatatcagattttgtatgacatctaagatcagctttgaaaaaaatatgcaatcttccttcctatttcttctatcttagaaacttgtaaatacgcaaacaaatggaattctcatattttctgcctgtgcaatatatattatgatttggtttaggtatgtgactactgtcaaagttggttcagggttttgagcatgaggtaaactttttttggtcctattacccaagttagtgatgtatctgttatgaaatatacttaaagatatacagcttttagaaatgattaagataccttgaaatatttgatgtatttaaaacataactagaaagacacagagtggatcacagataggtttactctttaaagtcatgaagtatgagattccctggaaaaagccatttgtccactgtacttctaacatgctctgtgtccctggaggagtcacctagtccctctgaagccaagtctactgtcctgtaaaataaaaggggcaaggcaggtcaatggattttaaacacgtttatttcaatgggacattttttattaatgaaatgtgagttgaagttaatataaatgaatatttatactgtaatttttagatataaaatcatatataaattcaatatatagatataatttttaaaaacatagatatgtgtgaaatatataagtaaaaagtataagcacacataaaacaataaaacagccactgagtttgtacatttaccccccaccccaaattcaaaccctctccttaaaatacctctaaagactttaggattccaaggaatattgtttgaaaaccactaagctaatgactgttaagatcacttacagttttactctctgcagtgctgccttaccgcgggagagtcatttgtgtattctgtatctctatatggattgggataaactcgtaggtaatgtagcagttcaaatacctctgccttataagaccttgaagttatgtaacttttcccacttctgagatatcacagaagagttatcactataatagttaagatctattcattttatttagcatcttattttttacaagtttattttaggctcatctggaatgagaaaatcatgcactaaacactgtatgatgcatagctgataattcaggaagtgagtatggttgttggtaaagaaatgctgaattggtatgaaattcttcagaagcaagacgcttcttttggtatttcaaaatggggttctccaccctctttttctatcatgtcaactggctgtggttatgtgtgcaataatacttagtcctgactgcaactcttttttttttcttccccacggatctgaggcacaccatggttttggccttatcattaaaacttgccttttaggagaggtaaaggaatagctcacttagtagttcctctgtcaatcattccaatcatgtagtgaattctattgaatcagaagggatgatgacatgaaggtaaccatgagtatacgaatggttagtcatggatccacccaaccattactagcaagattgagaaaagtagattctaagatgaaactgaaggggaagaatattaatgaggcctttaaggagtttttaagctttttagggaaagatgctgagcgatatgtataaatattcccaataatactaatactaaacatatagaattgtcaaagtttagataaaggtatagagaatagggcctgagggatattagctaggttggtaaggaagatagtcacaaagaaagcacagtcttaataaaaaatcaatatagattttcttggaagcctttccagaggtgatccaatatctcaaaatataatacaggggttgaaggtatattagaaaatggacagaagtaaggtatacttcagccacaagcaccaaatctctccagggattggtgcctatgggaagggctggggtaccacatggggcacaatgacagcaagcctgggtgagacactgttaaatataactgtgtacaggtaactaactaatgagagcccgtgccagtgatatgtctcagctctcaaattgcctagttctttgtcaagtttgacctaaattagaaagcatttcaaaagtatggaaagtaggaagaatgccagaacctatggatgcagttttttagcatgacaggggcaatattgtaagtatttattatctgtcctaagccttctaaggggattggctccctaatgagcatcctgggtgatggctgaggatgcgaattagagaagctaacagaagggtgaactgctcttcagaataagagttagaaaaacacaagggaatatttcaagagaagagctggggaagtgtggcaagaaaaaagagattatacagagaccaatatggaagaattccagcccagtttgaactaagcatccaccatctagcaccctaccctgtttaataacactggcaacctctgggcaaaagctgccattaatgaaactcagtgtagaggacatttgccccccatctcagccctaagaatttctgccatagggtaaagggggtcacctgcaagcccttccatttccctactacacatgaggaagaataagaaattagaaaactagaaactaggtgtagaatgtatgcacaccaaggattgcatcttccaaagtacccttataggaagcagtcctgttgttttaaacccacagagttaggaagttttctttatatctaatacaaatcttctttgcttaaattctaacccatttcctcttagttgtcagtagatataatgagagtgaatcaatagataaaccaattcttctttatggcctttgaaaactgctagtgagtgacttcttggtcttttttcatttcatattgcaaaatattcattctaaattgtaaaatagatggcaccagtgtgacttgttaaaataaatgtttcattaaacataatttcagtatgtaattgttttcagacttcctagagaaaagtgctcccgttgtatctaattctctttcttgtttaaaatacatcaaagatgagaaattgagctctttttagtgaacttgcttgagacattcatatggaatacagaaaataataattcctaacattcaggatgtcattccattgcaatgtggcacagagttttttctttgcatcaaggaatttatatgactgatactattttagtcaggataaattactgtaaaatgtgtccacttttaaccaatggcattctaacatgggataggcaacagcgggctgtgatttttgctctgatactgcaactttgttatagaatagcaagtaactgattggcagctagatcaccagctagctggagaaagcagcttctaggtctatagtcatagttggagtcataacctcattaatgatagctacaatgtattgggcatctactctttgacagacaatgaacttagtactatatacagttgaagcaactgtatgaataaactgtatgaataaaacttgaagtcgcacagcttataaaattacagtgctgcagaaaaatcttggtctgtcgaaactacatcccatatttgttgttgttgttcttattgttttgtttgcttttcctcactatctaaactgctttggctacacatagttctgtttcatggtattagaaaagtagtcaacaagctgctacttatacttttccttcctgtcctagactgttcaagtttcttcttttaatcttatgtatatcaagaacatgtttgcctatggtatttgtctgcctttccccccaagatttgtatacaagcctccaaccgtgagccctagagatatattgagaaatagaacatggactttgacacggctccattccttggagatctagctagttcctgactcgttcagcttattgactctcttcctctggtcagactataaattgcagttttccttctctctggcatttgaccagttagtagcaccataaaacctttgaaataaaagagaccacagagaataacctataatctgattttccccacccctaaccccaatgtggagctggaaacattttgctagtctttaacatttccagtcaagtagggtcaagaaaaactgttaaaaacaatgtcaatgcttaagtggtaaaaagatttgttgaagaatatatatatatatatatatttagagacagggtctcactgtgtttcccaggctgaggtacagtggctatttacaggtgtgatcatatgcactacagccttgaactcctagtctcaatcctcctgccttagccttcccagtaactgggactacaggcatacaccaccatgcctggctggagaaatatttttttaacttcaaaaatgaagtttgagctgaaaaagagagctaaaaattagtctgtcaggcaaatgtgtgaaagcagttctattataatttgtattgagctataatgtaattcctaaacttatgtcatatagctaagtaagtagctgtaattcgcatcttgaaattttaaatttacttctttcctctcaatatagtcttcatctgaattaaaaattgtggcaatttgtatttattgtgtacttaactatgtgccaggcactgtgctgttcacttgacctaattatctcattagatcctcatgatgaatcctagacagtactcattagtcttattcctcagactgaggcctaatgaagtaaagtggcttgcctaaatttgagtggcaaataagataatttcatgattcgcatattttcttaattataaaatgttacctttagcaatgatgtatatgttaatatgttcaatgagttgatctacctgaagtgcttagcacatggctggctccttgtgagtgaccaggaactgttagcttatattatgcatttttgaagtttacacattggtatgactttctaaataatcaagaactctaaatgtgaaagctgattcattttgtaagggtttcttttccataaggtagtcttttttaacacagtcagaattaagcatttatatagagctaggtattccagataaatcacgttaatagtgtgattcaaagaagacacactgctatctaggtgggtcaaagaagtaaactacttagtggaggtggcaaaataagaagtggtcagtgggaagctaaaccacctctgatttagttatttaaaactcaatgagaaccctctaaggaagcacaactaggcaggggtttcatctgaaaggaatggtcagctacctgagcattatctctaggtgcacctttgtaaagactttctccatgtatctttcctactgggtgccaccctgtggcttggtcctacggtaatcacactgccaggcattctctacctctacaaatcccttactcttctagtcctaaggtgcattcctggttgtgtaattcacagattattatctccctggagctgagcctcatcatctctatcagaccagactgagaaggactcctttttcctttgtcccgccatcccagctcagtgcagaaggcttaagatgctttctccatcatttctaaagaacaacagacaaaaatagagatctggttaggtctgttcttgtggcgtgaagtgttaggatgagctgaacagccacaggggctagaaatgtcaagaatgcaatacgttagagcaggcatttagcattcctgtctctgatatctactattttattatgagtagttaccaaaacaaaacaaaacaaactgtaaaagcattattttgttataattaacaactgcacattggattaagtgtgattgagggtggagttcaccagcttgggaaaaaaaattaaccattaaagattccctgagtgttttgctttaaaaagagatagcccaattacttttctgtgtttcgttaagagtctactagtatatgaatcagtaagagcttctagggtaatataaaacacacacaaaaaagcaaatttgatgttagcagacaactttttaaaggtattcgtgtaactgaaaaaatcattttacgtacataggaatgaaattttatgtttacctagaaatatatgtgaaatccctccattattgcaagatctttttcatgtaaatatcaaaagaattagacagtctgcattgtttaaaaccaagatagctagtctttttaatctatgggcaacttgtaattacgaatagcagtagctgcctggaataatgtactgagagctgcgttggtctcagagaaaatgtgctgtgatccattggtgatctctgccagacagaagagggacatagtgtggctgcttgccatttaaatggccttgatgatctcatcataactctatatatctaatctcaccattaaatttgcatgcaaataaagtcattgtagcagaaacaggttttatgcatacatacaaatacatgtgtattttttgatatgttttgtctatttgtcacctatgaagaacatataaatattgtaaacagaaaaactctttttggatgttgcaaatgcaaagaagaaaaataagtaattctaattttcaaaggtcacccctgtaatcaccacccagattaaaaatagtaccagcagccaaaagtcacctttatgcccctttaagcccctgcccccacctactaaaaataatagtgatcctgattttgaaaatcacaaactttttaaatttcctgcttttgaattttatataaaaggaataatatagcatgtactcttttgtgtttggctgtttccctcacccccttgcaaaattatgtttgaaagatgatcccttgttgatgcggatatggttcattcattctcacttaagtataggtaattaagcaaacttttgtttgagatacaaattcagggtaaaaatcagattttctatttaaataataatttggtatatatgactatttgagcattttaaactgttgtcattttacaataattattttagtatgatttaatatccaaattctgttgcttagattcaccctcagtggacatttcttctgaagggccttcctagacttccccaattagaattaaaactctcttctctgtgctgtcatgaaaccttgtacatttctctaactcttgaaggattacaattattgtcttctgtctcacgtacctctcctgtgagcatgttttggagtagactgggtttgctcatctttgtagagcaatgaacccctgttcccagcaccatgcctgctccatcatgggcattcaacatctgtcctttgcatggaaagtagaacagtgagttcttccatattacaaagaatattacagtcaatttttatttttaattttcttttagtagatggcacttttcaggagattgtactgggtgagttgtagacacagtagttactctttatggcaagagttgtatagtatccgggaggatttttgcctcttccctgtggctttctttcacccttagtttgccaccaccactggcaattctaatctaggcacaccttccattgcctcctgtgtttcccattctaaaatatatacttccaagttttcctctatattttctgactgctcgaatgactcttctcgtgtcataaactagtaaagagtagtgcatatagaaatgctgataaatgtgttgcacatggttatcacccgactgacatgctgaccttctgactctatcaatgggtgatttttatatgaagccaagaaatctgttggtggtaagtactaagaccaccacttcaggctcactctaacctcattgtgtgcatcttgaaaccccacacagttgtcacatatgagcagattccacaggagggatgctgaaccaaagtgacaagcttgtcctggagccctaacacagggattgacccccgaccttcaaagtcagggaacaacttagggttggcttaccttcttgtattgtgaacttttccgattgtgaagccagcttttagctttaccacactcccagacttaaatatttggaatggcaagaaattaggcttaaaaaaaaagaaggaaattaaggcttaatccttaataatgaggaagtaatttgttttagtattgtacagaaacattttctagctacctgatcatttagtctagttctatagcttaaaatatatagtccttaaagaaaagttttatttctgtgggtctattagttacaaaagtaaaggtgcattttttattgctttatttaagtgtttattaagcttgttctgccacaggtaccctgctggctgttagagagacaatggtgaaatatacagcactcggcttcataaaatttatggtctagtgactttctgaagtatttctatagggcaggagacttctatttcaccttctactatatccttggaatagtttttactttcctggtaggagtgtgcatttatataagtgtttcagttgcttccagaaatccagtggtaaacaacataattttaaaacctccctacttgaatttggggtggagtaatataaaataaatctggaatatttgattttttagaccaaaatactttccctgggttagagagatattttcttttcttactggcctggaaatccatgccattttaataagagatatttttattctaggtaaattgtttacttaatcacctcctaacaaggctgtgtcagccaagttaaatatttaaatttatttttatttaaataaattttaaaaccaacagatttctttctcattttaatgaatttagcctttgagttttcaaagataaaatatacagagtagaacattttaatgtatctgtagagagggaacacaaaaagggcacatcaggaaaaaatagttggaaaaaagtgaattttatacaaaattaactcataaaatgaatataaggcattatttcacttattgccaaaatctgtctttacagataatcttcgggagacctttatttttataggccctagttaaaatattttttgaatgcttgaggctctatttcactaataagagaaataaactttttctttctataaataactgctactagcttgtttgtcagctctctaaataaactcattttactattactatgcttgagtgctgttatatattcctttgttactgtgcataatccctggctataactgcattaataagtaaggccattacatcaaatagggatctaacaaaaactttcgaatggactatcaaagaccagattcaatgcaggaaatcagaaggaaatggcatttatgtcctagtgtagttcagttaaaaggcctgcccttaaggattacaactgccataaaagggcaccatgcaagaatggaaaacctgtttacaacaaaatatcaaattattatctgactttcacaatgaaccacattattctatgactgccagtcatacatctggactactataccatttgtgtgcagttacagcagctccagttctatatggctagttttgaacttagtctgactttaaaacccatcccatttactatcctctgctttttttttttttttggtgtatattgtgggaaattccataaatgatttttataaactttagccagtaatcgggaaaaactgtaagattttgtttgtaagctttataaacgttacttataagattttaattgaattctaaattaatttctaatttgaacctctcccttctcttagctttatatgcttggtcatccctccttaagtaattagcttttttgaagctttgttttttttggtttttcactgtttctgttatattgacgatttgactttcttataaattgttagtaatttcctgaataaagtacagaagtttatctttcaaatttcccatggatcatttcttaatagtcaaacaattgtctaaatttccaatacacaaagaaaagttttagctaacttacttcaataagatggataatttgttcaaagtgccaaacacatttgctttcgtaattcatgccatttgtgtgttaagtgtataaaagagatagagaaagaatataggaaatgtaactacacatgcaatcttgggctttccaaaatgtttaaagtaccaaattcccttggtgccaattgctttaggcatttcatcttcactcagttgcatcctaaatatagcgtaggtgtgacataccctgtaaatttcaaattcacataaagaagtcccagccttcgaggcaagtcttaattgaatactaaataaaaaccttagtgtcttctgaaatgtttctgaataaatagttgctttacagtctttgatttctatgttcgttagtgtccaaattcagaatgggaaccaacttggggagaaaaagaaaaaaagactctcaggacaatctttttaaaggagtaacagataatctattttggctaagacagggtagattcaggtagtcagataatagaaaggggagtcccttgtgtatcaactgatgctggaatttgtgaaatcctataaagttttgtagaaaaaaatgttaaattcatggaaacttgtttggtcataatcctcacagtttctaatttagtataacatcctgaataaattcattcagaccgacggagagaagaaattattatttgcaatatgtgaatttctgactaataggagtaatagaaaataattggtcccttaggatatttctgattatatatgagaggcttggggagggactctgtgtaaccgttgcttttaacccttgtttttgatgggtaaatagaacattaatgctacatgaaagatacttactctggcatcctcaagagaaagtaggttcttttttttctcagttatccaagaaacttttaacaattctaaagaaagaaataaaaagcacttagttttcagaagcatgtttcagcttcttgcatcaggagtaggccagatggccatgttctgtatggctttataaatattcctttttgttccatgtaaaagttaatggctagttttaaaccttggtatcatttcgaagtcagaccttatgtgcttaacttcattcaaagtatttctattttgttaggctgtaggaaaacatagagctgagctattaaaattccagggcagtttggaattgccaacaatatgtactggagagatgggggtggattctgaagtcaaatgaatttggaactcatcttcttttacatgctgggtgattttggacaagggggaaaagctacccatagggtttctgtgaatgttaagtgaaataatacatggaaagtgcttgaagtaatggtagggacacagcaaaccaaaaaaaatgctagccagtttattattagaagggaaaaactcctattaatattttcttgtttatgtttgtgttttcatgttagtcttaaaacaagttactgtttgagaatgtgagaattttaaccatttacaaaatggtgtatgatatgacatgtatatgatctctcacaagtgaaatgataatggaaagtttactgaaaatgtcttaacagttctaggtaaaacttaatttttccttaatttgaaaattaataaaagtatgaattagatttaatctaaatttattattctgttaaagtcacatgaatgtggaaaaaaatcagtatcacttctaactaaatctggccttgaaacttctttgacatagtcttcttaaaatatatatatcttatattctaaattgtatattatttagaaatatgctatttctaaactgaaatgtctgatatttctaactgatatatatatctatatatgatatgatatatgattatatatatgttatctatatgatatataatatatgatatatatttctaactgatataacaatgtatctcagttcttagagatatgtaaattatattttaatagtagcctacaaagatgatacaagaagataagaaataaatatacttttatatataaaatagttcaacagcaagattcttatttagaataattttctacagttttatttagggtagtttctatacagaaaaaatacatattttatctcctttctgtgctaggctctggagatgcaatggtgcctccctcccttcctggagcttaccaagcaaaacaaattcactaaataaaattattcctaattgtgttttaagtccagtgaagagaacacaggagggaccgagttaaacagtgtgtttgtgtatgtctgtgtatgggtgtgtgtctgtgtctgtgtgtctctttgtggctgtgtgtcctagagatgtactttagttggagtggtcagggaagttgagaactgaaagaaccagtcaaacaaacattggggagaaggggattatagcaggtacaaaggtcttgaatatccagcagatatgaggagcagaaaggctatctttttcaatcacttaaaaaggaaaagaagtgaaagattgctgtcttaagaacttaaatttatatggcactcatgtatagatttccagtgaaaagttggacaacgtgaaatgatgggtttcctacctacaagtctccagtgtttgtctttgactggggtgttttctgtacatatctgacctgatttctgttgctagcctgtcttcccaggggccttggtgagccgaggtcagagagagtggacttcacctaggaaaaaaggaaaggcttctgacataaaagtgcccttgaaaatgttctgctgctgtaaatcccttctctttacacaaagtttaagaccctcccaagagtttgacttgctaaactacaagagcatttttattaggtgtaagatctcactttgactttaagtagcaagtgacacaccaggcaaccctcgctgaattctctcttgccataagtgcatagatttcagtgttctaatgcctctctgagctaaatttgcctctgatctgagttctaaatgtaattggatagtagatatatgtgagtaaaaaaaaattctaccaaatggttggaatagttttcccaaagaatgtaatattggccttcagctggtaataggatgtgcctgctggatgaatgacatggttgatgcaaaagacagatgtaagccgtggttccccaaactgcagtagggatgagcatgacagccacacatatcaaaggccaggtactgatattcttactggaaagactgctcaggatgtatgtggtgttctttttcctggccacccttaaggagtttatgaatgggttccatcagcttcaaacagcaaacacagtttggcctgtatgaactgaaacccatcacacatcattgccacgatcattttcctcatgtatgcaagttctcaagtatatttttggtcacaaaacagcaaaatcatgacaaaagcaacaataacaaccaaaagtaactaaatacgatttttatttagtatgaaatgtattgcattgtaattatttcaacatcataacatttattaaagatgtatgtatcactttattattctatgctcatcccccctctttatacaaaatggagcataatctgcacattcattgttctgcagtttgtattttgcacttgacagtatgttgatacaaagagaagctacttgtgttgctctggaagaactttattgagatataactcgtatgccatacttttcatctatagaggttatataatgtattgatttttagtatatttacgtagttgttagttaatatctaccattctttgaccataatgaataacagggttttctctgcacagatatgtccatttaagtaaagatgccaatgcagctaaatagaatcactcaaaaacaactccaaaatgagccagggagagtggagggaaggaaaaggaggaatgcatccaaacatagccctacgttccatgaacactcagtaacatcatcaaaacgtgatgcaattaaattttaccaggtttactgctgtcctgatgctttccaattttttttgacaacagttttgcctttttcaaattcaaatggtataattggggcttggtagttgatgtttatcttaattgaaacagattctcttcatccttttgctctgagactcccactttgaggctgaaaggtcattttaaatctgcagagcactcgagaagccacataatgaattcaaacaaattcatgcctattaaaaggaggcttctctttctcaacttccagagcttacatagaataaaccatttggtttttgtctgactttcttttaaaaggaagttattgtgcttcctttttaatgctctaactacagagaatggggaaatcctgttttcatttattcttatcagaaagaaagtgtattttgctcagtaattgcaataaaatactactggggttacagctactatacttgtcaacaaatttaagggatattctttagctgcattactttaaggatttcttgtctatcttttatctagcaacttcattttttaacatttactctatgtacttgtgtaaaggtgcaaaaaatatatgtacaaaaatgttctgctggagtttttgtaacagaacactggagaaagcctaaatgtcaatcggtatatggctgattgaacaactgatgcacaactataagacaatactgtgcatctatgaggaagacctctctagtatgacactatctccagatgacatttactattgtattatttttatactttgaaaagaagatatgcacactcccatgtatccattttcactagttttctttgtatatactcttagagtttatgtaagtgcaatgaaaacataaattctattctcttcctccctttttaaacaaaaagaagtataatctgcacattcattgttctgcagtttgtattttgcacttgacagtgtgtcaatacatagagaagcttcttgtgttgttctggaagacctttgttgagatataactcacataccctactcttcatcaatacagggtgtataatttcgtgatttttagtatattcacacacttttgcaaccgtcaccaaaatcaatgtagaacattttactaccactataagaaaccccttaccttatagttatcaccctccatctcccccattacctgctccatatcacctgcctcccttccaccccacagctctaggcaacggctaatctacgtttttttcctctataatttgcctactctgaatgtttcatataaatggaattatataatatgaggtcttttgtgacttgcttctttcacttagcataatgttttcaagtctcattcatgttgtagcatatatcagatttcattttttaggaccgaataatattccattatatgaatataccacattttgcttatttattcatcagttgatagacacttgcgttgtttcactttttggctattttgaaatgtgctgcaatgaacatttatgcaaaagattttgtgtgtgcatatattttcctttcttctgggtatattcctagtagtggaattgctgggacaaatggtagctctaagtttaaccttttggttattttccagtgtatctgcattctcatgtttcttacagcagaaagttattctcttgaatggctgcatcattattgatgtagtcaaggtgtatttttaagtggaaaagttaaggcacaatgttcccagttatggaaaaatatgctaagactgtacatacataaatatgtttcactcaaaagcatctttctgcgtatgcacttaaggtgatggtagaagttgctagctttgaggaagaggtggctacacgtttggaatctgaggtagaagggggctgagtactcaccattttaaacttggggaaattttactatgtgtgctaattaatttttcaattgaaaatttgattcattaatgtaaagaagaagaaatgtaaaaaataaaaaagaagaagaagaagaaatgtattttcctggactcctctgaccaatgttggtcaggccaggggcttcttgacctgtgctttgtttgagtcatccggcaccatgaggtgcttagtgctgtacaagcactcttcttgccatctgctctgcttgacatcatttttagttattaggacaaaaaattaatgactgcttttctatctttaagccaagacaccatttaaaaaacagacatttagctcttactctaaattagtgtttcttaaatgttttattcaaatcaatccacatcaaaagcaaaataggagggaaaactagggtagacatctgagtgaaccttgggattgagaaataggagggtggtatgtgaactaatcattaatggtattagcaaatagagctgggcagtctgtctgaagtgcttcccagttttttgtacattcttctccaagtatcatgtgttggtgactggaagagggagtctttactttccgcacagtttccatcatgtagctctggaagggctttgtgtttgttctcatctttgcttgagaatcagctgtcttattttgggcttttctattttttaagacaaaacctacctatagtggttatacatgaaacacaccagtagatttgatttctgcctttggttaaattagtttgccttattaaatgataggaaagaatcaaaattcgtttgccttatagatttgttcattcttatattcactcatgtattcattaagcatttatttattcaacactcctatgacatcactcctcactgagtgatgattccttctagggtgccatagagggcttgatttccagctggaggaagaataatttaatatcctttttaatgatcaaaattctaaccaaacccaattttgaaaaataacttgactttgcctaaaagtacattaagaaagatatagaaaagagattctatgaaaatgaaatttaataatgtaaaataatttggttttatcagaaattcataaacagactttacttagagttaaaagtccctttgagaggagtaaaatcattaatgaaaaaaatgcatacattttcttcaatcatcatctatatcccatcgtgataatgaggagtacgctgtgtgtagtgactgtgtttgcaggtggagggagtttgagtaatggaagtaataaagatgctcccagaacaagtaccgcatccaattagcttgccaattaacaatctattcctgaagtatttgtttatgaagatgattttaactagagagaagtcatattttattttgtttatatataaagatatgttaatcataaaatgtattcctttcaaacagttatacatttttcctttggcagcactattgtttattttaaaggaaaagacagtaactaatcacagcatttttaaagaaacaaatagagattatgctgctgtaaagccagcataaagccatttttccaaatgtcaacagagttaacaaagaattttatgttgtaaaaacctcacagttgcctagtttactccctcatcaaaaaaagagggggcaagattctttgacatttttatgtataatgtgactagagaatgtgacttcagtgatgatgatgatctaattgcaatgctaagaaccatggctgggctacgactgtgtgtgcacgttgttatgctggggagcaagggtacctaggaaagaaagcaataatgaaagtatcacttgggtatttgtttatttctggatcttattctatctgctccatattatcactttggcatttaaaatctagatgatggctgggtgggtgcagtagctcacacctataatcctaacactctgggaggccgaggtgggaggatcacttgagtccaggaatgtaagaccagcctgggcaacataggaagaccctgtctctacaaaaaaatatttttaaaaattctccaggcgtggttgcacacacctgtagtcccacctactcgagaggctgaggtgggaggattgcttgagactgggaggtcaaggctgcagtgagctgtgattgtgccactacactccagcctgggtgacagcaagaccccatctcggggaaaaaaaaaacccagatgatatggttaaccatattcagtcattattcagttattagaaaataagatttacaaggcatccatggaggggaaaacaattacacacctggttagttgggctgaggcttgcagagataaaatcacctgcacactgttgcagagccagtgctccaacctagacttccggacaccaaagcctatggccattaagcactctgctggactgtatcttggatagtttgctttatggggaacgtagtacaactttacaatacaactttaaaaataaagtatagcagagtagcagtttgtccacagtcaaatatgaaatatgtaaacatttcacaggttctttttttaatttttattttaggtttgggggtacatgtgaaggtttgttatatgggtagactcatgtcacaggggttggttgtacatattatttcatcacccgggtattaagcccaaagcctaatagttatcttttctgctcctctccttcttcccaccctccctgatcaagtagaccccaatgtctgttgtttccttctttgtgtgcctgagttctcatcatttagctcccacttataagtgagaacatgcagtatttggttttctgtttctgtgttaatttgctaaggataatagcctccaggtctatccatgttaaaagacatgatctcattcttttttatggctgcatggtattccttggtgtaaatttacctcattctctttgtctaatctgtgactgatgggtatctaggttgattccatgtcgttactattgttaatagtgctggaatgaacattcgtttgcctgtatctttatggtagaatgatttatattcctctgggaatatgcccagtaataggattgcatggtcaaacggtagttctgctcttagctctttgaggaattgccacactgctttccacaatggttgaactaatttacactcccaccaaaagtttgtaagtgttcccttttctctacaaccttgctagcatctgttattttttgtctttttaataatagccattatgactggtatgagatggtatcttgtggttttgatttgcatttctctaataatcagtgttattaagggttttttcatatgcttgttggccgcatgtatgtcttcttttgaaaagtgtctgttcatgtcttttgcccaccttttaatggggttgtttgttttcctcttctaaatttgtttaagttccttatagatgcaggatatttgacctttgccagatatatagtttgcaaatattttctcccattctgtaggttgtctgtttaactctgttgatagtttctttggctgtgcagaagcttttaagtttatttagatcccacttgtcaatttttgcttttattgtgattgcttttggtgtctttgtcatgaatctttgcctgctgctatgttcaggatgggattgcctaggtcatcttccagggtttctatagttttgggttttatatttaagtctttaatccatcttgaatttttttgtgtgtatggtgaaaggaaggggtccagcttcaatcttctgcatatgggtagccagttatcccagcaccatttattgaatagggagtgttttctccattgcttttctttagctttgtcgaagatcagatggtcctaggtgtgcagttttatttctgagctctctattctgatccattggtctatctggctgttcttgtaccagtaccatgctgttatggttactgtatccttgtattatagtttgaagttgggcaaggtgatgcctccagctttgttattttttattagaattgccttggctattcgggctctttttggttccatatgaattttaaaaagttttttctagttctgtatttcacagcttctaactacattctattgttggacatctttatattttatccaaataggaaaacattaatttaaaattcttgtcatataatctacaaaatatttatattcaaggcacaatgacccttacatattctttttttcttttctttctttctttttttttttttcgaggcaggatcttgctctgttacccaagctggagtgcagtagctcaatcacagctcattgcagctttgacctcccatgcttaagcgatactcccacctcaacctcatgagtagctgcaacaacaggcgtgccccaccactcctggcttgttttttttaattttttttgtttttttttttgtagagacagtgtctccctatgttgcccaagctggattcaaacaatctgcctgcctcagcctcccaaagtgcttggattacaggtatgaaccaccatgcccagcccttaaaatagtttttattataaaggcaatttatgtgcattctaggtttctttaaaaacctagcaagaggccaggcatggtggaatgccagaaatcccagcactttgggaggccaaagtgagaggactgcttgaagcctagaaatagagaccagcctggcaacaaagcaaggccctgtctctacaaaaaataaaaaataaaaattatttttttatggtgtgtccctgtagtaccagctctcaagaggctgaggtgggaggattgtgttcagggtgcagtgagccatgattgcaccactgcactccaccctgggtgatggaacaagactcttaaacatacacacacacatatacacacacacacaatacgacacacgtatagaaaaaataaaaatacaaatataaatttctcataacctcaacacactcccaaataatcactgctaattcttagttattttcttctattctttttccaagcaagtatgatactaatagcaattacctggattgtacagttttaatttctttttttaatttagcattttatcatgagcatttttccatatcacttaacattatttcaaacattacttatatggatacaaaatgtttcaccctaaaaagattttgtaacttatgtatttgccaattattggatattcaggctgtttctagcttttcccaattattaaaattatcagcaaggaacatctttgaactgaaacattggcttatctctgaatatttccttagtaaaataactatgtcaaagaatatgactattttaagactattaatatatgttgcaaaaaatacttctctaaaggttataccaggttacactccaagccacactgcttgagagttctcatcttactgtgctgctgcaggaaatgtttttcattaaaaaaaatctttatccacatattaggttaaagtggtatttcagtgttgttttacttaacacttttggactactggtgtgaataaaaatggttttaatatttttattagccatttatcttctgttaattttctgtttgtctcttcgcttattttctattggggttgcatagttttttactttttgcaagagttctttatgtattagatagatgaaccttctccagctcacatttattgtaattatatattccaatttttagtcccctttttacttttgttcatggtgttttatacagtcaaatttattgattttttttcttttgtaacttctttctttgctttaataatttgagggcttttatcttaagagtagataaatgtttagctacattttccgtatttgtgattttttaacctagctcttaatctgtttggaatttatcttaatataaggtagggatacaagtttattttttcccactatacgtctcaggaccatttgttacatgtgccctactttgcttattgctttgtgtcacagataaaattttatgtatcatctatcatgtgtagacacctcagatataaattacattttacaaataacatctcaatagaaacaagtagaaaaaaaagaactctggtgcaacccattgagagaaacatactacattacaactataacaatgatgtaactaaatttctatttgccttctaaacctttttattgcttgtagccatttgctaactcctgaagaaacttttaccttttcttgtcccagggagttgattatttaattacagtagcataagacaaaatgataaggattggaatccgcaatgagccctttcactgggatgaagcagaggctgatgggactgggtggtaggtgggtaaggtggcagatagatgcaagagcaggaaccactcaccaggcactaggaaaagctccatctagccaggcatattggcaatagtgtgccctgactagtctttgggggcaaaacataacagtctcctaaaaagtggctcagaacaggtaattcctagacatatgcccaggcgtgaacaggacaacttattgaggtatggaaataaaatcttatattttttcttatccgctcacaaattttctttttcttgtattttgtaaaatagataatattttgacataatagtgcaagaacataacttattgaaaataaatatacgtaatggaggtgcttgcacttttttttttttttttttttttttttttactaatagatacggtatccaataaaattggtaatcacttgtctggatcatgtgacttcaggaagctctatacaccagcttgcagttcatggatgggacaggaagagagtatcttaagcctatgttggaaggccaggtggactggagtctcagggacggaagataagcacagggaattaaagcagaagccagtagtaatcagagataagacgtatgttcaagttaactgcagcaggatggtgtggtgctgggctcctgaatctgtttctgcctaaagtcatatctgtaaagatcaaggaggaggagccagagcagcaggtgaggttcaagtgattaataacactggaaaggagaacaggttgcagaaactatggctcaggctacctattcagccattttcattttttgtaatgcaagtgcctattacataatcaagggtatccttagtaacatatgaagcctacattctatttccatttttaaaaagttcaccagtaaacaattgtacagcaaattttatcaatgtaaaaagccattgtactctatccagtcaaaccatattcacctctcctaaagtgcccattacggaggctctgggaaattgaagttgcccttaatcttgagttacaatgggcagggcctctttttttctctaaattttactcaataaatgcaggcttcctatgcattaaatggtgcccacaaacattgaaactactagctcacctcctgaaattcagcactttactatgtgtctttcaatgtaagagcattcactaatttaacaagcattacataacatgtgtcattaatgagttcagttagctaggccatggaatagatattcctgtaaatcaactcctttacagttactaactgacttagtttcatggcagaggcatttatttcaattagactgtggttcctgttgagataaaatgagatcaactatgtgacatgattttgaaaaccatattatattggtgcatgaatgtatatgtgtgtgggtgtaggtagtttacagacagaatgtgtaacataggcatgtggcttgtaactgaaacttttacaaaacctagttcattctcattctataaaagtgtgtacacacatgtgcatatacacacacacactgtgataatgtatctgtgtatttgagggttataaatatttagttgtagagttctgacaaagtagtaaaatagtctcacttcatctggataaagatcaccatctggaactataaaaattgcaatgattccaaattgttgaatagttggattgcatatttacttttcagtagtatgttggcatgcatgtagatccagccttcctttcaacaaagaacagtggtggaagattcccttaaatggttactctttcctcaataagagcaaccatataaaaattatagaactattagtcatcatagttgaaagtatcgcataagattaacagagtccccatctggtgatatgtttttacatcagatttattaagatcagagcgggttttaactagagcaatgacactgctattattaaataagagacggaaggcctaatacataattgtctatttctttctagacatttatgtgtttttattaggataatgaatacagaattatcaacatcatgatcatagtttttttggtttttaagtagtatctgtaatggcaagctcatttttattttataacctacccacacacagacctacagtgaagcaaaacagatgctgaaatatgtttgttgccattggctttgaagaaacctcagagaggtttgcctcagtattttaaaagcaaaatggttggtacctttctgaatagatgtcattgtgtccttcaaacaaagctgacactgtagaaaagaaatggattgccttgtctttttaccagtgaacatcttcacctgaacaaaactcatcaggaaaaataaaggattttcgaagtgtagttgttgtttaagcagatactagttattccatccttacaaatattttatatataatatatacatttatatataatatttatatgtatatttcatcacacaccaacatccacagacacacacacacacttgtttgactacttcctctattccttgaaacgcttttgagagacctgaaatatccttgtatggcaagaggggaatggaatcaagctgatttttccatttttacaatgtgcctgggattgtgctttgcagtttagtggcattttctgattcaacctcacagagccctgcatggtataatattgtctacatttaagatgagaaaagcaagatgtggagaggctaggaaatcttcccaaaggcacgaagctcctggcagaaccaggatttgaggccaagtatcaaggttacagtacagatagacatacatacactcaattataagtaaagtttttatgaggctgggtttgacagcaacatgataagtagaagtttttgatttggtaagatttttcgaaaactcagagagtttattgccaaatttatttttctcctagaaacatttttgttgttgttgttgctggcatggacagttataaaaataaattagaagtaaacagataacagtttcctggctgccttcatgtctgtgagcctaacacggctcccagaaggaaaaaatatgcctcaaggaggcttatatgatattgcttatttagggaacctttgaccacttatttacaatatccagttacagctgtgctactttcctttttgggcaaaagcacatattcgcttgaccattattttggaggaagctgatattgcctgtcacttccaacatgtccttgtgtaccctagctcataattgcagcatttaagcttggagctcccctaacaacacaattattgccaaatttaccatcgttgggaacattggtgaggcctgcttcagaggcctctttgtcagcaagaagcatgttgcagatatgcttcaccttgcatcataaatgcatttctaaaagtagtttcctattgaattattttgtaataacatgtttttctaactacaaaataaacacatgttcattgtggacaaattgggaacttcagaaaattcccaataaatattccaatatttattaatattttataaaatacacataacctgtcattgcagcttccagggatagccatcattaaaacgtgttggtttatttcctgaataaacctttaaagcatatacacacataccccacaaacatgctcacacacacacatatatatatatatatacatttttatggtcatatatatcctattatgtgccagatgaaatcaggtcggtctctctatacacacacacacacacacacacacacacacacacacacacacagacacacacacatacatacatatatctatacatatatatgtatatatgtaaatgtacatacatgtatgtgtatatatgtgtatatatgtatatatatatgtgtatacatatgtgtgtacacgtatacatatatgtgtgtatatagagagagagacctacctgatattcatctggcacataataggatatatatgaccattaaaatgtatgtatatgtatatatatatatgtgtgtgtatacatatattatttccaaattttgaaaatttttatttattattttttgagatgaagtcgccctatcgcccaggctggagtgcagtggcacaatcttggctcactgaaacctacgtctcctgggttcaagtgattcttgtacctcagcctcctgagtagctgggattttagttttgccccaccacacccaactaatttttgaatttttagtggagacagggtgtcaccatgttgcccagggtggtcttgaactcctgaagtgctgggattacaagcatgagccaacatgcccagcctgtatatatatataattttttattctgcattcttcgcttgacatttttaagaagtattttctcgtgtcatttaggattctagaaaaatctgatattctaatggtgacataggaatccattttacatgtaataaaatgatttattcaatatttagccattctttcattgttgggcattttaaattttcctcttttttctttattgtagtggttcactaagcatctttgtagaagaaatgttaatctgtatctctggttaattactttggcaaaatttttggaaatgctattactgggtcaaagagtttaaatggtgtctaaacttgtcaagacatactaaatatacttccagatagtttttacaacaaattttaagcctacatataaaaaaacagttccggtggctcacgcctgtaattccagcactttgggaggctgaggcaggcagatcacctgaggtcaggagttcgagaccagcctggccaatatggagaaaccccatctctactaaaaatacaaaaatcagctgggcatggcggtgggcacctgtaatcccagctactcaggagactgaggcaggagaatcacttgaacctgggaagcagaggttgcagtgagccaagatcactccactgcactccagcctgggcaacaagagagaaactccgtctcaaaaaaaaaaaaaaaaaaaaaaaaaaaaggttattttaagaaattgtatagtgaattctcttttttaaaaaagggaaaacatttatatatttattaatatttaaacctgcagttttataaaattttgtctagtccgacactcttgttttacaaatgggaaattgaggccccagttccatatgagagacaaatacaaaaatctgccttctaaagctggtcaaaagcagttatatctctatgatcaattcagaagttgagtcctctgttgaaatgatttcaatagttgaggtgattttactgtttctctttaatgttgtgatatattttctctcttatacgactctatagtaaaaacgagaatcattttactcaatctggttcatgtagcagtatcaggctgtgaaattcatactgctcagacactggttctccaactgtgatgtacgtaagaaatactgtgcctgctgtctcttaaatgtagagtcctgatcttcatccctaagaccctgattcatttgctttagataacactgagagctaatcatttttagcaagcatcccaggtaattctaaggccatattgtgagaaaagccagtataacgatggagaattcttatgttgatgctctgacactggctctacatctgtccataatttatttaactcctctctgcctcagtttccttatctataaaggaggaaaggaaatgccagtctcttccacctgggattcttgtgagattaaatgaaataagccatgcaaatgatttaacacagtctacagcacacagtaaatactcaataaatgtgaactcattatcgttactgttgtcattggtattcatattgatatcattattcctgcattggaaaatgtaaatgtacaattttaagtgattagcattgctggtggattattgattgcaatttgtcctgctgtctcttctgacattgctaaatttcatttacttaaatatttcccttatttttctcttgttcccacccatgcaccccagtggagttgaaattgagttgagatcaaatgcagcaggtgttgctcagagaatttggtaagactagttgaaaaaagatcagtgaaactttatcaaaaatagaatagtgattctcctggtcacctgcttagagaacccattaagaagtgtgaggttctccaggccaccatagagctataatctgcaccttgtatcagccatagcaggtatttgcacagtaaatttcccctcacctagtttattcataggtctgatcatagcacactacagactcaaactcctgggctcaagtgatcctccaatgtcagcttcttgagtagctgggactacatgtgtgggccaccatgcctgaccatggagttcttaaaaatggatattgacatacatatatagaaaattcattcaataaatagttatcactttcctatacctggtgtgagaattatgctagatattggaaatacagaaatgaatatattaatattaaagtcacttaactaagcttttccctgtgataatctttctgaaacaaagcaaaatgatacagaattctttaagtactattcaatttgtggctatttcctcctaaagatcagtgtatctgaacttgctggctgctagatattttagtcatttcaaaatgtactgatttggctaaagaatctactttgaccaaaataggataccttaaaatacaacatcagcaaaatatgtgtaaaatccccagagaaaagccctcttaaatgcctacttatttcaagtcaaatttagttaaactacataacttagtcccctgagtgtcagtggaatttctcccagagctgtgacttcgtcaagtaaagttaccctctctcttgacctttggaaagagatggcatttgttgatagttttgtgtgtgtccttaagctgggcgcttaacaaatattctctctaacaaatattctctcattaaaacctgaaacagccttttcttacacctagaactttgtaaagaatatgtcaggaataggacaatcaccttttaaggctcagacagccaagaagctgttttctttttcagtcaagtgtagagagcatccatgactgccaagttctcagccatggctggtacaggcgggtgcagtaggaggcacagttgccactcctcagaaagaacagggacatggctggacccattgtcctacttgctcagggccaggcagggtagcagacctagttgttgaatgcccttttattgatagttatttaacttcaataggatcttgtttttatggtaggcagatggtccttaattggtttgaactttgtcctcttttcatagcagaaattcttaatctgctgcccacaaataagctttggagatctgtaactcccttaaaataacaaaaatgtacaaagcatttagtaagtgtcatacagtgtgctgagcacttcacatgctttatctcctttaaatctcataaagactcatcacataggtactgttttcattcccatttttaaaatgaaatttaaagagactaaatgacttgaagaaggtcacaaaactaaatagcagtagggtcattattttaggccaggttatctaactccaaagcccttagcttaatcactaggctatactgaactttatggaattacatccaaaagggatgtgtgtgtgtgtgtgtgtgtgtgtgtgtttgtgaatttttccgaagactcacatttccaaagatttataagtcatgtcgttctcaaaggggtctctggtctccaaaatttgaaactctttgcaacagggtggctatgttttagaatgacataaacagatacaatgttctccagagtccagagcagggtctaaacctattgggatactatacttgtgttatcaactgaaccacttggttagttcactaggaagatctgcaggtcttgagctgagcttagtgttttacagacatgtgccattcattcatcacctacaccactcatcaaatatctgaagaactatgaaggctgaaggaaaataagtgggtgagcacaggtgcaaataaataataaatttggagcattctatttcgtgttatttcttgctaaaactggcatattaccccaaacatcaattgcaatatgctattcaacaagagtttttaactagtttataataggaaaattgctcttttttaaaaaccagggttaaagtcacatcctttctctcctctgacaaagtcactgtcacataaaataatggtcctagagtcaaaataataacagaactttgttctgatggagactgtaaatataccaatactcccattaaaaatataggtgggctgcctgaactgagaaggttgtgtcatggctgttagttttaataactggaaggcttgacagagataattgcgttagtgcttcactggcctcaagatgcatgcaatgagtaaaattaagaccatcttattaaaataccaaagcattgtataggaaactcccatgtattcaaaggggaaagaagaaaaaggaatttcatatttacggagcatgtactattttcaaaactctgttctaggtgctttcacattcattaactcattttaatatgtgagtgctttgtaatcctttttgagtgttgcaggctcagagagggtaagaagctttgcttaaggtcccctagctggcaagtaacagaacctattcaaattcagatctgatttcaaagtgcatgtagtttttgccacagtacgatgcttggggagctaaatggcatttgggaacctagagttaaagcatcagtattttttactaaggggccattggatcctagagaggcaacgaattataatggataaaaatacaaatttcaggcaagttacttctcttagcaccattgctttatccggcatagtaataaaaatcaaatgagacaatggatatgaaatgctaaaaatagtacattctctgttgttattatctattgtgattattgtgttacccttggaaaaaggcctgtagaatagtggcagctgggtcccctggacagtgaactaccaacctaaaaactgtctgggcaggcttgcctttgggagttcttgtatatcagctctaattctgtccaggaattcagaggcagagagcagggttgaggagaatttcacaggtggtaagatctccggtgaggaggcatttcagcaacgtgatcagtgttgccaaagctatgaaagatgttgaagaacacactttctacctgagatatcaactaaagtttgaagcttcaggagaaggcatagttctatcaacagacagcagtacagcaccaatagttaaaccctatatggtagatttaaatgctgagccttcaaaatcatttgcctgttttactttagctccagcaaagggatagagaaacccttcttctgtcatccctctcccatgtttgctgttgcttaagcagtatttattttggtaacaagaatacctggccttgccacttaatctccaccattccaaagaaaacctttctgagatcatcttaacgttgtctctaggcaataaatatctctggtttctagttattcccaaggacactgacctcacatttcttactgtcttaaagtcaaaagtacctttgtccttaactcacaccaatatgtatgagactaggatatgagagagattgttacatcttgcttgatgttttgacattataggtagtgtaggttttgttattacagtttgacttttgaaatgcgtatgagatttctcaggtgaaatagagcctttgatgtggtactcaaaagggataactatgactcagaggaaccatttctaaaagatggcactctttctccttccagttctttctgttcaatagtagggctggggaaaggcagaggcagtttttgttatttcaaatgacagcatcaaagatagtaatccacggtgctcaacaaaagtcgaatgaccttttttccttctccattcataaatacataagagctgatgcttcattatgtttaaatacaaaatgcacactcctactttgttttcctatatgtgagttctcatgtattcttcaaatgctcatctaattactgttacctactattccaaatgcaaatgacaaggtcccagtttactgttgatcctatattacaagagtcatcaattttggttgagaaacacaaaggacaaatatctcattattgtgctaaccatgcctattattagttttgtgcccccataacataagtaatagccccaaatacatggcacttatcacacaccaggcataattctaaatggcatgttctccatgttatggaagaagagactgaggcatggagagagtgagtaacttggccaaactcacaaggctacaaaggcagagaatcaggttttgaactcagggctgcctagaccctgtgttcttaactatcatcatatagtgtctctcttactgtttctcactgaagatgagagaggattaaaatctcaggaataaatgtaacctccacaggtaggcttatgcataaaattcagatgcaatgaataacaaaatgactgcctcccacaaaattaagaagcaaacatataatgaggacttactctgtgcacacactggtgaggacacgttacacatttcatatcactgagttcacacacacacacacacacacacacacacacacacacacctatatgagggcagtatgatttccccatgtgataaagaaggaaagggaagctcagacagattagatatattgtctgacattgttcagatagcaagaagcagattcaagatgcaagcatagaccagagaccattatttgagaccatgaggccttttctcaccagttattcattcacttaatattaatcacttaatatgcatttgctgagcacctgtcgatgtcttgtaaatcagtgcaggaaaatcataagatttgaaatcacagcatctaggttcatatctcagcttcatcattaaccagcaaaccagtaaacctccctgtttgcagtttcattatcaataaaatgggttgacaaaaaatttatttaacagaaatgttatgaaatgcaaataaaataatggatgtaaagaaattggcaaatggtcaagcaaaacatgaatgttaattttatgatgattaaagtaaatggtatggagacccccaacctcaaatagctgggaaggggtagttgataaggggagaaatgtgtttaaagccagttgctttattattttaaccctgagataatgctttattgacagtgtgaataagatgtttggaattgtggaaggaagaactggaggtcatattacacatttcttactacatgttgagctttgaaaagtgagaatgatttcatgaggcagaaattggttgggtctaaaacttcattatctgtaacacatactccagagagtgagaacagtatgaccagaagtatctttggaggggctagagacaagatttgaagggaattaggacaagattttaaagtaacctaagtgccgtgataaagaatccacttttataggcaaaagtagttattcaaggaagtaaaataattacattttctagccactgcaagctatctctttttccttccttttcttccttcattccttcttcctttcttcctgcctttctttccttccttccttctctccctctctccttttttcccttctttctccatcccgtttaaccacacacaaaatcccaacagcagcgtagaaagtggtgttgaagagctgggcatgtgggcagggacaccaccaaggaaggtggtgtaatatagcctggtgacgacagctttggctcttctcaccactcccgctcccgagtaagcacagcatagaggaatatgagctgagttcagtgctgtccagttggaattgggaatgttaaagctagaaggtcagcaagtccggtgttctcaacctgacaacacatcaaatagctatgacagccttttgaaaatagagattcctggatccagcttcagctttaccgactcagagtatccaaaaggaggcctaagaatctgtatttttaaaagcctctccaaagtgatatgtagcagtaattgaaaaggacaatctctttacttcattgatgaaatagctaagtcccagagaagtcaagaggcttgccaaaatcacaacgaggtagtagcggggtcagaactcaaactcaaggctcccaattctcaacccagtagtattgcccagcatcagttcttatctttgcgttataaatacattcctgcccatcaacagtggattgcaaaagcagggaggaagagagggtggcaagggtcaaaaaatagctatcaggtcctatgttctctacttgggtgacaagataattagaagcccaaacctcagcttcctgcaatatagccatgtaacaaaactgtgcatggacccctggatctaaaatttaaaaatcaataaataatacaaaagaaatacattcatatttttctgaaatattcttcagaatatcaagtgggaatccctttgttttgcaaagctggtctgatatgtttaagtaaatttaaccagatagttgttttctgtatctccctctaagtattaacaaacatttaccatacactataaagcattacaatattgttaggatgattaacaagagtaccaaaatgaaggactcttgctaaaatccttttccagctttttcattctactatttacagacatgtaagcacatccattcatttcagcaaaatgtaacattccacacaaaggttttgaacattgtgctcggctagagaatatttctagtgagtgctcataagagacattaaaataagcatttgtctttcattcaagctttatgaaggattaaaagtaatccaattgttcaatccttcatttaaatctttagtccaaagaacagaagatttgggattgagtcgtaatccagccatttaaatctatgagactctaggcacatcattgccctccttcctgagcctcagatttttcttcagcaaataaggataaaaatctacactcccaatcccatcacttattgcccagggtcactgtgtgaattccactgaacaatgcctgtgaaggtgctcagaaacaacctgcttgtgagggcataagaagcacaggaggaaaaggcctttgggaataattcttttgtctcacccaggacaggttatctgaccatcaggggcacagatggaactctttttggacatggcaagtgggtaaagcacccaaggtgccctgagagatttttttcatgtggtctgaagggccacatactttcgtgggattagtggcatatgtggtatggaaactcataattacattgcaaatttaaaggacagctctgtaggaagaagccaagagcagaataagcatagatgtggtttggattttatttttcctcttgtcaaatttaacttaagttctgaattctataaaaaaagaaaaagagtggtgaaacagtcatattttaagatttttaaaagtcttaaagacatggaaaaagcaaagacgatacctacactgcttatttaaaaaaaaactcgatttgagtttcatgaagtactggcatttgctcactctgtaattctcaaagactattttcaaaatttggtcaaattaaatttcaaaggtcagcaaagtatataatcatgtttgggttcttttttcccccaagtttaaaaaactgacatctatcctttttttaggctatctgaatgtatgaaaaaagagtagaagttattttacagcatatatttttctgtaaaagtaactacatttaacattaaattatttaccagtggtattcattttatataagcaggctggagatggaggttctatttacatatttccactgtcatggtacagtatagtactaagtattttacaggccagcaatcaaaagaattacaattgctactaggaaacactaaatctgaggattctgtcatgactatgtatagctggttagaaaaatctttgctgaattgaatggctttctcattacagatggccttgtttacactgtacttagagttctgtgtgccattttggactcctcattaaaaaagcataagtcattttttaaaagaggataagtgggaaataaaatgggagccaagattatatcgaataaattctacaaaaaaagaaaaaagaaagacaaaatacacataattgaatatcataatctatctagaaaatagatgaagtggcacaaaaatggatgaatatattcaaatgtttgagaaatattacttcataaaaatgagagaaattttaatggctggagaagtaaaacttgattttttatttgagaacatagttaatgtcaaaacaaagaaagtcagcaatgaacattgcttctcaacttgaggtgattagagaagaggtcaaatgcctttagaaaacagctgtgcatttatcttggctgtggacctggcaagtcaacaggatttatgaatagcctcaccatgaatttggtcatcctgaggggaaggaaaaccccaaattaattttggagcagaagatcagtgtaactactaccatccttacgtcttctcaatgagcttcattattcctcccagagtggctagagtaggtagttgatgagcatttgtggaatggataggtatctcttttctatgacctactctatcaccctcaggatctattaatcctttgagtttgatctctaaggtggcaatgaaatatttcttacaccagaaatacactgaaactcagagaaagagggctcaaatttgaggagagtgctatactggcaagaggatgccccaggtaatatcctttccttcttctagagaggaacatttggctctagaaaggcatttagcctatgagttcagaacaggaatggtcttaggcatctgattcaacctacgacattgccagtctgaaccaactcatcctgatcccactgcaaatgagctaggcaacagtgaagagtggttctagtctgggtttggataaattgtgaaatatttctagaatttttctatagactctgaaccatttccccagaagtgtgcacattcaaaatgtcattttgcttcagaataacattttgaataaggcaagcctaatttttgttttttaacagaattttaaaataattaattcacaatatttgtacataggataatgggatattttgttacataaataggatgtataatgaccgagacaaattatttagggtatccagcaccttgggcatttatcatttctatgtagtggaataatttcaatttctttcttctggctattttgaaatatatgatacattattcttaactataatctccctattctgctatcacacattgtaacttatttcttctatccagctgtatgtttgcatacgttagccaacctctcttcattcccctcctcctggtagctatcattctattaccttcatgatatcaactttttttagcacccacttatgagtgagaacatgccatatttgtgtttctatgcctggcttatttcacttaacattcaggtcaattcatgttgctgcaaatggcaggattttgctctttttatgactgcatagtattccattgtatgtgtatgtgtgtgtgtatatatatatatatatgtattttctctatcggtttgtttgttggtggatactttggttgattccatatcttagctattgtagatagtactgcaataaacataggggttcaggtatccctttgatatacagatttcctttcctttcctttagataaacacccagtagggggattgctggattgtataatagttctacttttagttttctgggaaatctctatgctgttttccataatggccatattaatttatattcccaccaactaagaattcccttttctccacttcctcaccagcatctattttttttttttttggtcttttaataatagccattctaaggtaagatacctcactgtggttttgatttatagttccctgatgattagtaatgttgagtactttttacatacctgttggtcattttacatcttcttttgagaaatgtcttcatgtcctttgtccactttttgatgggattatttgggtttggtttggttttgtttttgctgttaacttgagttcttggcatattctggatattagtccgttgtcagatatatattttgcaaatattttctcccatttaacatgttgtcttttcactctgttgattattttctttgctatgtagagatttttggttttaatatagtcccatttgcctgtttttgtttttgttgcaatgctttgacgtcttaagggaagcctatttcgatctggtacttctgaaatctcattggctcaagtgaagcacgggtgtaaatcctgagtgtttgttaatctcggttctgtgtgtcttctgtaatccagagacaaattcatgtgtcaggttcacacttgagctgatcctctgtaactttgctgattgttgttaagacagaacagaaccagactggctttcactttacacaacaatcacaactgtgtgtaatgattatagacttattctctaacatctcttaagcacttaggtaatgagaaatgtcataatgaaaatatctgttaaccgaggaagatcaagggaacaaaacaaaaaacctaaatgaagtgtgaaggtggtagaagtaaagacatagatggtttcacttgggccagagatagattgaatgtgagacatttgaaagtctaatgtactttcagtacgtactttccagtttactttgatggaacgcactgtgttgaatgttattgtgctgacaaataagcccccaaattaaatgacttaaaaaataaactcattcttcatcaagtagcgttctaggatggtgtttaggaggatgtggcagctctccttgctctcagtcacggaccaggattctcccaccttctgtttctaccatccttcacgcatcagcatctttagcatccagctggcagaaaaagaacatcaagataggcatgtgggaggagctatgagccagtcctgaaagtggcatgcaatatttctgctcacatctagtcacttggccaaatctaattgcaagggaacgagaacttcttttatgcccaggaacaggcagagaatggaatatggcagacaacaagcagaatttcctatactcacagtcctgattattgacttctatgctttcccaaggtcattttgtcttcagccagattccatttcaaggaaacatgaaaatgtttcttcactctataaaatcattgttgaagtagatcctgctacctctgtggtagcccatccaacatcttaaaacttttaaaagataatttgtaaccatacataattcacccaatataagaaatcatgagagaaagctaatctcagtgtacttattatacaatgagacacataatgagacatatctttttttattctccactatatattttaaaagaattgaagaggcaagtgattgtttatggccatcgtaagataatattcttatcattgctttgcccagtaagattgaaaaaattgtctgtaattcaggccacacaaccctctgaagcccttcgccattcattcaagccccattaaggcagaaaacccatctgtttggattgttgaggttggaaactgaataatatcacttctccaaaatagatttaatagtagggctggtgaatggtttcctgacctgtttgatgcagagtgcaaacccagaggaaaaacatggtatatgagttttcgtatccattagtctaaaagaatcagaattcggttatattttaaaggcaattatagtagaactattacttttttgttttctgttataatcttacctagacttatttaacatacttaacacataatattttaaggctaagtatttctacaaaggatttatcattcaatcattcttatttagtcaataaaatcttttggagattaatttttagtaagcctaaatacccaaatagccaggaatgtgattgaggatcacatttttaaaacccatccctcaaaaagaaaattgtaatatcttgagagacaggtatggtttgaagatcacccctcttcaaagtgagttcaatatctgacctaatggaatcactccccattccccaggactaggtgacactcactgatctgggaaaaataaacacgtgcaactaacaagagaaattttgagaattatgagtaagctttgaaaatttgggtactgaaaatagagagggagggagagagggaggtgatagggagggagggaaagaataaaaaggaatgaagaaaaaactaataacaatttatctcttaagaaaatagaaggtgcagctgggtacggtggctcacgcctataatcccagcactttgggaggccgaggcaggcggatcgcctgaggtcgggagttcgagaccagcctgaccaacatggagaaaccccaaatacaaaattagccaggcatggtggcgcctgcctgtaatcccagctactcgggggcctgaggcaggagaatcacttgaacgcgggaggcggaggttgcagtgagccgagatcgcaccattgcactccagcctgcacaacaagagcaaaactccatctcagaaaacacataattaattaagtaatgatataaggtgctaaatttttattttcacccatccagtttcttttcttattctttcctgatatgtaattacctcagatgcagatctgaggtgaaactaatgaagatcaagctaagagcttctcactggcctggttccctttcaagttgtaagaagtggtactagcagctgcacgtagttttaggttttgtaaaattcaaaaaactaagatttttttgtattatttttctgaaagcagacccttataattgtataatcttcgtgtaccacaaaaccttgatcccacccctgattgcatggctgactgctgttcaaacagaaggatattcaaaataacccccgttaaaatgccttcttagagatgttccagattatttcttcaaatgtgctaatcaatctcattaacctatttctttaaataagtgaccaactcctagctaaattaaaaaatagttatgaagtttatttaaagtagaactacacagataaccatggtaaatgataaccggtatagaaaaagtaccgctgcgtctaaagatacccatgtattcacgatacaaatatttattgagcaactcgtacgtgtgaggcactgttgtacctgctgggggacacattaacgaacaaagtagatttttaaaaaaaaatctctgcacttgtggagcttatattctaatggggtgagtaagatgataaaataagtaaaaaacaaagttcatcagaagctgttaaatgcgatggagaaaaattaagagtaaggaaggttttttgtttgtttgttcaaaaaaaaaaaaggttaggaggttaggggtgccagttttaaataggccagtatgggaatatctcatgaaggtaacattgagctgatatctctagaaagaatatgccaggcaaagagaactgcaaatccaaaggccctggggagggagtatgcacagtgcttcaaggacagctagggaccaagaggctgagcagagtgaacaagagggagagatgtaggtaaagatgagattagagaggcaccagggaccaggtcactgagggccttaaaccattgggagaacgtagtattttctctgaataaaataggacaccattatgggataatgagtaggaacttgccgagaatgggcttacattttaggaggatcgctctgtctgcaatataaagaataaatgtgggtgggtggctggagaagtagcagggcacatcattaaaatatcaatgtttcaaagtcggcttattaaatcaattttacttgctctatgtcatagaaacaataaataaagacagaaacaccccgcaacactaccttgggtatttttctttgcttgcttgttttttttttttgttgttgttgttaatattttaacttttattttaggtttagggttacatgtgcaggtttgttatataggtaaacttgtgaccccgggggtttggtatacatattattttgtcacccaggtgctaagcatagtacctgacagttagtattttttttctgatcctcttctctcctcccaccctccatcctcaagttggccccagtgtctattgttcctctctttctgtctgtgtgttctcattatttggttaccacttataagtgaaaacatgcagtatttggttttcttttcctgcattagtttgctaaaaataatagcctgtagctccatccatgttcctacaaagaacatgatctcattcctttttatggctgcatagttttccatggtatatatgtaccagatttttctttatccaatctatcattcatggacatttagtttgattccatgtctttgtgattgtgaatagggctgtaattaacacatgcatgcacgtatctttatggtagaatgatttatattccttttggtatataccctgtagtttgattgctgagttgaatggtagttctgtttttagttctttcaggaatcaccacactgctttccacaatggttgaactattaataatttacattctaaccagtagtatataagcgtttccttttctctgcaaccttgccagcatctgttattttttgactttttagtaatagccattctgactggtatgaaatggtatctcactgtggttttgatttgtatttctttaatgattagtgatattgagcattttttcatacacttattggccatatgtatgccttcttttgaaaaatgttcatgtcctttgcccactttttaatggggcggtttggtttttgcttgaatgttcgtttaatttcgttgtagattctgggtattagacttttgtcaggtaatacaatttacaaacattttctcccattctgtaggttatctgtttactctctgttaatagttgtgtttttttttcctgtgcagaagctctttagtttaattaagttccatttgtcaatttttgcttttgttgcaattgcttttggcatttttatcatgaaatctttgccagttcctatgttcaaagtggtatttatttggttatcttccagggtttttatacctttagcttttacatttaggtctttaatccatcttgagccccactttgttaacaagacgctattcctctttggactttagcttgatgaagccacattttgagaaagagtgcattttggaaatatagcatcttagaagtgatcttagaaagtgaaagattggtagtaacctgctgtgagcagtacaaggaaaataaaactgagttattcctgtgggactacagctgactctcaggtccagcctggcctggagagcatgtgcttttctgctcttccctccatactcttagttagtggtcagcacatgataataggatgtaagggaagaaataaatctctacttgttttattctcaatcacagtgacacctgcatgaaattgccagagaaattaaggcctcccaatgactaccaaaaaaaaagacactttccgcttcccattgtcagcacgtattctgattgaatgtatatgtttactacttgaagttctcatgatttctaggtaattactgcaaatatggacctcatactgctactgcaggctttgcctcaagagtccaaataccatggcctcatgttagggccatttgagatcctttttgaaaaagttgctttattgtgctaaaaacaaagacacataatatgagatctaccctcttacattttaagtgtatagtacattattattagctgttagcacaatgttgtacagcatatctctagaatttattcatcttgcatgattaaatgatacacattgaacaacaactctccatttctccctccacccaggcccagcaaccaccatgctacttcctgcttctatgagttcaactactttaaatccctcatataagagggatcatgcaatatttatctttctgtgactgacttatttcacttggcataatgtcctcaaaattcatccatgttgtagcatatgacaggatatccttcttttaaggctaaataatattccattgtatgtatataccacattttttaatccattcgttcattgatggatatttagattgtttccacatcttggtattgtgaatatacataaatgaatatgggaatataaatatctctttgacatgctgatctcaattttttggataaatacccagaagttgaattggtagatcatatggtagttctgtttttaattttttgaggaacttccatactgttttttatagtagtggcatcactttacagtcccaccatcagtacataaggattccaatttctgtatgtccttgccaacaggtttttttttttaataatggccatcctaacaggagtgaagcaatatctcattgtggttttcctttgcatttccttaatgattagtgaggttgagcatcttttcatatccctgtttgccattttttgtcttctttggagaaacgtccatttctttcattgggtttttttaattttgaggggtttcaattgggttttgggggggttttgctattgagttgtaggagctcctatgtattgtagatattaataccatatcagatatatggtttgcaaatgttttctcctaatctgtaggttgtattttcactgtgttttctcccttgctgtgcagaaacattttattttgatgtagtcccacttgcctatttttgctttttttgcttatgctttgatgctgctgtggattaggaaacttaatattgttaaaatgtccacaatgtccaatgtaatctccatcaaaatcccaatggtattttttatagaaatagaaaagcagtcttcataagaaaccacaaaaggctgaatagtcaaaacaatcttgaaaaagaacaaaatatctggagatctcacacttcctgatttcaaaacatattactaagtgacagtaatcaaaacaatgtggtactggcataaagacagacataaaaccaatagaacagaatagagccaagaaataaactcacacatacacagtcaactgatctttgacaaggatgtccagaatatacaatgaagaaaagtcttgaatggtattggaaaatggtattggggaaactagatattcacatgcaaaagaatgaaactaaacctttatcttaaatcatacacaaaaaatccactcaagacttaattataacacctgaagctgtaaacctagaagaaaatttagggggaaaatttcatggcattggtcttggcaataatttgagatgctttcttagagagagtttcagttaagaaaatttttcttaacagtcattaaaaagtaatgtataaacttcaagtaaaacaatttttggttggggctttctggttgccttagtcaactcaggccgcataacaaagtaccctagactggtggcctaaacagaaatgttctcacaattctggatgctgagaagtccaagaccaagattggctgatttggttcctgttgagggctctcttcctacatacagatggctgctttctcactctgtcctcacatggtgaagagagaatgctcttgtgtctctctctgttcttataagaacaccagcactattggattagggcctcatccatatggcctcgtttaacatatgaattctaggggaaacaagatagatttaacctcaacctcaacctcatgtaaccattggtgattaaggcttcaacatatgaattataggggaaacaagattcagtccataacactggcctaataaatacttttcagaaaaattggccttttatcatatcattgtgtcaaaagtgtgctaagcaagtccagcttatcctctttcatttatagtccagacatcaaactcatgctatcatttccatcttgaatctctttattgccctgtgttacttgggagtgtcactgacaagccagaaacatatgttgtatatttccagtaccacctaatgttttactcataagtaagcatatacccttcatctttgtaccagtgtgtgtgtgtgtgtgtgtgtgtgtgtgtgtgtgtatgtgtgtgtgtatgacaggatctcactgtgttacccagactggagcgcagtggcatgatttagactcactgaagcctcagcctcctgggctcaagtgattctcctgcctcagcaccacaggcttgtgccatcatcgtgcctgacttttttttttttttttttttttttttgtagaaacagggtttcatcatgttgcccaggctggtcttgaactcctgagctcaagcaatccactccccttagcctcccaaagttctgggattacaagtgtgagccaccatgcccagccctgggcttttgtttataaaaatcatctgtgaaaacaaagggtaaaacgtgtctgttaaatatcttaactctgtgcaaatatatatattatacaagctaacatgtgtagtataatttagctgtgtaatcttgtaaagtagctaaatatcatgccttctccgggtatcctacttaaatttaatatgcagttttatgattgattgggaaagattgccatctgtgcatatcactgtaaaatgctagtttctacagtctcatctccatagataatcagagaaaagtaaatattaaaatggtgaattttgcaaatcattattttgtttacttcagagaagctatttgacctgcagggaaattttcaatagagaagtatcagtggcattgattagaaacgagcttcataaccttgtgatattgataacaatgggtaaaatatttagtattataaagagggaaaaatgtatgtagtcatccagttacagttactctccccttaagctcaagggtaagcctcccctccccttgagggcaaagcatcaaaatgagttccaatgtgttggctaacagcatgagctacaatacacaggggagagtggagtacaggaatataaacatcagtataattgtgacctgaggtccccaagctacaccctgtgtctggagacctgaggtctgaaggactgtttctgctcattatattcagctggagccccacctaggttgttgggacctccaagccttccacacttcctggtaggaaattattctttctcctcagtgagtaatatctagaaaaaaatcagcagtctccaccctccccagatgttatcacactggaattatggagttgggtggagacataaaagcagctgaaacttttagagcaatctggctccagcatctgtcacctcattgattgcaagggctgattcaggtgatttggccctcagttctcttcctctttcatctctccctttaggttcttcccaaagccatgtgttcaaataaagttaaagagaatgacctagatgaagatctccctgggagaaaaagagtaataaaaatgaaaaacaatagctgctaaataatgggagtgtactagctgccaggcaatgtggtgaatgctttccaaacattttctcttctaatccttataatggccctagagctaggtattgtaattatctttatcagcagtgaaagcctagaaaatacagcaacttgccctagagcacccaaataggaagtggctgaaccaagatttcaaatttaacctgtgttttctaactcttaaataaacatcttaacaggaacatttttggtaggtcaatattttctatgtgccattgttcttactatgtagtgaaaaaggcagctttcagatggtcctggcttcagtgatggctcccaggattcccagcgacattcagcaagatcttccctgtgagtggccttcatagatgcttcggtaatggaggctgctattgatagaggttccttagcagctgctccactgaggccctcattgccccacccactttgggcttcatactgggggtcagtgctaagtataaggtcctgatggctaggatagatgaggaaagctatttactcagcacagtagcaggactctggctcaggagagggcccatatcatggtcaaaaataaattgggaaaagtttaaactagggaagcagtgtctagcaaaaggccaaaaagatgagaaatgaccttcagcagacaaacaattacaaggtcagtagacacaaagtatgcgagcagttgagagcgtggatgaaaggtagattggaactgtattaccatccagtaattccactgaaatggaacagtgtggagaactgggagtaattagttcattcgtcagtttgtccgacttctctttgtttcttgtagggggctggttccatagaaaaggatgggtctgtggagtaaatggtcatgagtagtgctagccacacacattctttaacacttctgaatgcagcaggccagctggtcattactgttactgccccctcatgggagaccaaatatagctatatcattcctcctccaaaactgccttctggcaaaagttatctcttttaagaattgtgtgcattcttaaattgcattaagggaagcaaacatatggaacaagaaagcacctcacttagttccatttgctaagcccttttgcagacccactgacccttccttaattccaaatgaaatctcaaatgctataaagaaacccgccaaatgggttacagcaaagacttttttacaccctactgttatgttcagaattggaaaaagctggggatttggcaaattccaaaatgttgggtcatatgaaaacttttttttttgagacagagtctcgctctgtcgcccaagctggagtgcagtgacgtaatcatggctcacttcagcctcgacctccttagttcaggtgatcctcctgcctccacctctggggtagctgggactacagataagcaccaccacacccaggtaattttaaaattttttgtaaagatggtgtttcaccatgttgcccaggctggccctgaactcctgggctcaagcagttcaccagccttggcttcctaaagtgctgggattataggcatgagccaccacacccagccccatacgaaaatttagtctcagaattagcctttgcatgcgtcacctgtaagttaatcagaatgttactttcaaaagttccctgcaggtgaggaagctaaaaggtattcttgtatttttttaaatgaaacttcataatagaggtgtaaacagagtccattctccccagccttagaatcagacagcttgagtttaaaacccacttatgagcttgagcatactactgaacatagagtcacttgtctatgcctcagagtccccatggtcgaatggaaaatacagtgcctacttcaaagtgttattgtgaggattaaatgagataatatatgcaaagcacagcgcctggaacatggaaagtgctccagaagttttattgttattaacattattattattgccaccatcatcattaaacttggtaatttttactctccccaatcctttagttactttttcaaacttctagttttttgcttgggctccatctaattggctgtgagtcaaaagagaattcaccacatccaagtgttttctaaagaatgtctttggaaaattcacaactgatcattttgataccagcatctaaggttagggctaccttatccttcatcaccttcttgttttattcataacaccacgatgtggactattgataaaattatgtttcaaagataactagcttatttgaagccatctataatttcagcccaaactgactaattaggctaactttcagaaagttaagtaagtgtctaattctcagttaacttactacctactgagtaaaaatgtgctgccttttaaaatccacaactaacctccctactcaaggcaaaccccctagttctaatatttgaagtatttaatgaacaagcctttttgggggtcctcttgtagttaaaacatttatttttctcctttttttttttaactctgttttttgtctttctttttttttttttttttttttttttgagacagagtcatgctctgtcgcctagattggagtgcagtgacacgatcagtcactgtaaccttgaactcctggtctgaagcgatcctcccacgtgtgcctctaaagtgtcgggattacaggcatgagctactgtgctcagcctctactctgttttctaccttttatttgttgcaaaagcaacatgtttattttaacaaatactggtcttcctcatcttactcccctgagatttcaatgttaaaagttgatttgtgtgtttccacgtaagtctttataacaagcttctgctgacactccttggcccagctttccataaacacatccatccctacctattaggttgaactgtacaaaattgccatttttataggtccccactattctttaataccaagcctcaaatttagccagacactaaatgtcctgttttatatacacgccttattcattccttcttggttttgtttttgtggcttcacttttgctggatggcctccacccccaaccccagctctactctggctggacattttttaactctccttcaaaggtgtacatcctgcaacttcttaaattccctttacattcattgtctacatcacatagtctgattgcctatataatacaatttcgtgttttagtatttatatgctatttaatacagatgccacctgttttgctgcttttattttctctggttgcttgatgttctattaccttaactagactttagtgctttctagaaaaggacaatgtgtagtatatctgtacttattcaagtgctgatctaaggacataggatgtaatgtaaaagtttattcaatgactatttcaaaatacaaagtctctctttgtataaagtcattcactaatactgacattggctgatacttcagactggagattctcggtaatattactttttcttgataattaattttgattataagaggatttaatatcatggaaataaattatgcaaatgaactcagaccctaggttcacttcccagaacaaaccgtattctgagaatacttgtggtgccaaaatttagagtgaaaccccagactattaatgatgctcaagttactttactccaacacaataagtactcagtgatttgttacggaaattcaattaagtcttctcaagtattttttttcttttcttttttttttttaattatactttaagttttagggtacatgtgcacattgtgcaggttagatacatatgtatacatgtgccatgctggtgcactgcacccactaactcgtcatctagcattaggtatatctcccagtgctatccctcccccctccccccaccccacaacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcatttaagaaaaagtccaataaaatatcagtcactatttttagatcttcattctcaatgtttgtaaagctaatactaatattagattaatgtaattttatcaatattgataattacttagtatacattgtgaactttgttttttggatgtcatttaaagggttattttcatgagttcctaagaaataatttaggcctttaaggttatttaacccttcagtagaaaatagtttccttgtttaagaaaatgatctccatctagtggacaaatttttatattacagtatacaaagaaaaatattaaagcccctagaatatctcatatcaagcacttcctgacctattaataaatgttttggttttagtgctaatattatggcttaaaagttgtaagatttaaaaatatcataactatctaaatgacttaaggtatttagcaatatttgtttcaaaacttatagtggagtgttaagacttgcttgatttaattggaaaaattataattaaagaaaaaattactgatttatacaaatttggtgtttactcagttgaactgaaaaaaactaaaccaaaactcacacttctgtatctcttacatttctgttcatgcacaggaaggagggggtattttcttttttaaagtgtagcaataagaatatcttgatattaaagggaaataaacataaacatttctacaggcattcacattactaggtcctcctcatgctgaaaagctgccatgactatcttcttagaagagaaatctactttgccaaacccccactatttagaagtttttaatgtcttccagttgtgtactaaataccttcaaaaaccttcttaaatactactcttcatgaaaacttctcagatatcccagcctgagttagtcattcatcctttatttttgtatcttaatgcactcatattaagtgcttaataaatgcctatttaagcatatccaaggagagtttgccaaagatccctaatgtatgtctattgaatgattagagaccatcctccccttccagccttcctgggaattgacaaggtttcacatacatatgtgcctatcctattctggtgaaacagatgtcccctgtttgggtgccacatatatttgtggtttatataatcatgcagtagagctggaaggactttaggaacaatcgatgattcaatgcagttagctcagtgactggtcaattaacttttctaggacctggtatcctcgtctgtaaagtgagtctgttcgacttgacaatctctcattgtccttcctgaaccaaataaatatatctataaagagacacaattctaagaaaattttaagttggaaaaacatatttacagctgctcaagataatgagttttccctcttctgtttatttgatggattatttcggagccactgttatttgatcacagattcaaaagtgatccatgaaacatcttccaatcttagagtcataactctatttattaatgactccgataaagaaaataaaggaatgttttaaaatgagctagttaatagtttgaataaagattctaatggggaaaatattaatgacagcaaaacttgaattcacatgtttatttattctttcaacaagtttttctttaaaaccacacacctgctgggctatcataagctatcaccctcctctcctaagaacacatgaaagttgactttattttaatactggttgatgtttcactagaaaggttctttgtggaaagtttatctagattataaggactatgacgttaagaactgtgtgtgtagattttttcccagctctaaaatatgtattgctgagcacagtgccttttattcatttaatcatttactcaagacacttgggcacagttttcaatgtgccaagaatacgctgagtctccatttgtagagagctcacaatctaggaatggagaccgggtgaaaaacattttcaattcattgtaaattctgtcattagggagtgggaaagtgtcttgggagcgtagagaaagggcctttcataaagctctgatgtaccagggtagcctttcaggtgcaggctaagtctcaaggatgagtgacagttaggcaggggaaaggggatttgattatttaggggagcaggaggtgaggtggtgatggcctgtgagaaggagatagtgcctcaatatgagttgagcaagaagtacccaatagctgaggatggcaagttgaggctgggggcaactaattgcaattgagagcagatggttagactggcagtctggcaaagaaattttgacttcatcctgagagcaatggtaagttactgaagggttttaaactgaagaatgacactggaaaatggattcaagacactaatataaaggttgttataataatataggtgaaatttgatggagacctgaatttaaaatattggtagtagggatggaaggaagtgggtacaatagaaattaatgcttggatggatgttatagggtaggagtgtggagggagaagcccaggtttgggagaacagcattaggcacaaaatgggtatttgttgaatcgaattcaaatatttgatgaattactgtgtatttgttattttccgaaaggaattttgtacttagaagattatgttttgcagagtgtttcccttttaactgaagtagagtttggaaaaacctgtatcttgtatctggtcagttaacaacagtatccaggagaacaagaatgtgaagtcaatgtgtttttcttttatgtatttcaatattatcatatttttatggcagaaattagctgtaattttcattcctgctaattccactgtcagttcctcagctgacgctaaatgctttttgaaaatatgaacatgtgaatgttcacagcaacataattccttctccttcctttacagttttgatgtggacaatggcacatctgcgggacggagtcccttggatcccatgaccagcccaggatccgggctaattctccaagcaaattttgtccacagtcaacgacgggagtccttcctgtatcgatccgacagcgattatgacctctctccaaagtctatgtcccggaactcctccattgccagtgatatgtaagtacaagggcaggcaaagagagagaaaaccgagtaaatttatatctagagctgatgacataataaaactaatgacttttgttcaactgtatcactctcctccaatgtagaaagaatatgaataaaattatacaagctagaaatgaatggtagatttaacctgagtgcactgtcactcttgattaacacacacacacacacacacacacacacacacacacgcatgtatttattttcccagaaaatactttataggaaaactgagaattaaatttttaatggaaactaacacttaaatcattagcttatatttatgtagagcctgagttttagctacctaactacatggatattttctaatattttgaaaagctttcaactccattgaaaagtcctgtgataatagactgtatagcattttgaatatatttcaattaatgtatgtacagatgttagcactggtttgccagatcatttaagaaatctttgtgggactttgccaaaattaaaccaacttttaaggatcatgagaggcaagcacagaaaacattagacagacttgaatatcatttaagatatagtacagcttgaaaaacaatgaaaactgacaagcaggtttgcagatcctgtaccatcactagctcattttctcagtgcatttcattcttgtggtagtgtgcatgtttttctacataggtctttattctcactcaatacctatactatcattcgtggcacatctgcctctgtatagaatcgatcttcatctttctctcttggtctatacatttgtccaataacattcaccatcttttcatgacacccatctcaaaaactcataacaggctgcaatttatcttataagaattagtctgtatggaacccctgagtgtctagtgttattcttgccattctaacagagcatcagttgtattgcaataggtctacatggggttctagaaatgaaattatatttcactcatttttacaaactatggttgctattttagcagttgtattattgacgtctacccttcttcatctctaaacaactttctattcctagtggccctatttttacattatttttatctcacttccttagatttgaaattcatgacacttacttattcattcacacataatgagaatgcttcttgagcaaatatggtgtatttaaagctctgaatctgtggagcagtgaggtctggcattttagaccattgtaataaaatatggtgagcacaatccttgaggcatttatcatgtactgcaggaacagagagaggagatggagagttttccacccaagggaaagatacagaaaataccgggctaagggaacaacatttactaaatgtgaggcatggaaaattatggctgaactaaggaatgacaatctgcttgatgtgaatagcgaaacctggcaagagagaagaaaatttcaaatacagtctatgggacctgagagccacagaggtttttagctgagttttggcatgatcatattcttgtttttattgcatcttgattactctattgttgaatgattgcatagcgaagtcactacagggaagtatttcatgtcgaaattcacagaagtaaggcaggctaaatatgatgaagacctaagtcaagggagtgatggcagtggagcaaagagctggtttagatgcaagaggcttatagaatggttgtgtgtgtgtgtgtgtgtgtgtgtgtgtgtgtgtgtgtgtgtgtgaagtatgtatgtatgttgggggacagccagtggagaaggagaatcaaagagagtgctgatttttgtccatgaatgagtacgtacatggtgatgtacgtacatggtgatgaggaacaaagggcagagagtagaaaacatgacagataacaggtgatgaattggtttgtacatgataaggctaggggaaacaagacaacagttaaagtactgggacagcaaacagaaataacagtccagaggaccaggagaaatagaacagttaccttctataattactaggtttttgaatgacagttgagtggtgcgttgtattcaggtaatagcattaggagcccctgggttaaggagtgaattgaaagtggaaatgtgagcaaatgcaggcatctctttaaaaggctgatgggtggagtaggaagaaagaactaaggctgcctgacagagaattaggttcaagcggaatttttttgaattcaggttacttgagctgagggaaggctccaggagatagaaagagactaaaaattcaaggggaaagagggtttaaagatggagctgtagttgctgacaaaaacatgatcatgagccaaagtaaggaggctatccttggaaaagtagtaaataccagaactgtattctttaggaaggacaaagaagacctgccttggcaacatagtgagaccttgtccttactaaaaatccaaaaaaatagctgggcatggtggcacatgcctttagtcccagctactctggagaggtaggaggattggttgagcctgggagttcagggttgcagtgagctacgatcatgccactgcagtccagcctgggtgacagaggaagacaagactgtgtctggaaaaaaagaaaaaaagaagaaggaggagaaggagaagaataagagagaagagaagaaggagaaggagaagaagagtaaaagaagggaaatgtaaatttagagatggaggagtaaaatgttaagagatattagccatgagttctctaaacattttactcctccatctccagatgaatgaatgtaaaagtagaaggtacagccatcaatagccagaggagagagggatggggcagcttgagaagaaagggaaaggcttaaaaaagccactatgcagatcaaaaaagggaacagggtaaaggtgagtagaatactgaccagccccatagataacaataaacaatgttaaataggcgaatgacagaattgaaagtcatctaatgcaacttcatcaaaggtgagtcaggcttggtattgacaaaagaaagaggaaaactcacagtgagttagtggagtccatttatgtagttatgtgttctacctttttaaattgtagtaaactgagtttgggatagattgtttctttcatacattctactccagttagtaaatattaaatatatacatatattttatgaaaagcttatagcatttcatatttaaatatgaaatgcttttatttcaaaatcaaacttgcaaggatacctcattttgctgtgtgcctcaagagttctttatctgatcagactcaggtaggaatgatgagtttaatcagaccatgagtcaacactatattttgctgaaaagtaatgtgttgatatgtttagctttccattctccttggatatttacattggagcagtaagatattcctttgataccaactcctagaaagcattctttctaccaaggagattaagtttctgtggaaggaaaaggaaatagaataaataataactatttcaacatttaatctgacacgacacatatcttccaccataaaggactgtgccttctcttaatttgaattctcatatggccatgtgtaaactttaattttctcaccttacctagttcacaataatgctatgaagactgtctgatgtgtataattcaactgcgctttatagagaatgatgttatatatttaattacttgatgatttcttattaatagttctagttaagctttcctattgagaaattttcttagaaatttcaaatacaaacagtacctaatgaggataggtacctaatgaagggtatttaaaatgaaggtttgtggttatctatttaattgaactgttttggaaaacctttaaatactctttaagtttaaatataactatttactctattgggaaagtgagaagaaggaagataatcccttcctagtagataggatatcgtcatcttatcctctataaatagaaaccaatgaaatagctgaagaacaaaacagataaagatggtagtaataataatcataacatacatggtgtgtgtatatcatcaactttcccaagtattttcacaccagctatcttatttgatatactcacagtccttttgatagggacattgttatgccattttacaggttagaaagccaaagtccaatgagcttaatcttttgaaaaaaaagcaagcattttgattatttctaggagcacataatttgataatgccattgtaaacaaagtactttatactactacagcaaaaactgctgagaaacagaagtaattgttgaccaaattcattaaaccaatgaaatacatagcagtatcaaaatttgattaagaataaaataaaagctcaaggaggtacaaagtaaatatgcagccaactcttagagaatgtatacaagtatatagcactaggctaaattcagaatctaaaaaattagctcatataaggcagaagagaagttcctgaccacttctgctcagagaccgtcacacaatttgttaaatatagatgatgcagtagcaacttaattcttaagaaaagtaagaaaaagaaaaatgttaagtattagcatgagtctagtaaataaatacatgaaaataaacttgcattaccattaatagtaaaaattttttataacagtagaaacaactagataacaaaaggctggttgcccaagtggtgtcatgaagtaacatgaagaaaattacagcgtaaatagacaatatttttgtcatcttaatatttcagcatctgaataacaatcacttctgtgttttcacatcatccagtaatatagtatctgtatttggaaacacataaagttatgatacattgcaaagattaagaggagaattagcaatgacaagataagtagaattaagtcacaaaactatgaatttattaagtataagttacctgtcaaactacttaagttttaagaaatactcaattcacctggataactaatcctctattccccatcctctgttaaattaacaccaacacatagaatgcaaagatgatccaatcggctcttcactcacattcatatacattgcttctacacacagaatatggggtggggtgaatgcattcagagggccagtgacgaggaagtgagtagatttgatataccataaaaagctggggcatatttgggaatctagctaagttatccccaggcactatacagatatctcagacctcactgatcaggccttcggggtgccccattggggcattttctcagctagtagataatactctccctacctcccatgtcaaactactgtcctttctttagcaattaacaagtccctcaccacttcttgggcctctaatgtgtgttttcagtcacagccactcctctctactacttttgcctgctaagtataagagtagtattgcttccagtcctgagtttgaaaaaggaagaagaattccctttatgtcaatttgtatcttttattccagattattaatcttccctggtctcactaggaagaatataaataaaaagacacgttgcattacaaaggttctaattctcactggatctacatgaaaagtttgtagtcatctcttacctagattgcaagataatattacactaatgaacatttcaaaagcatatcaatttgttatcttgaaagctttcttccattaaccacagaaagaaagctaccatggccaaatcatctcttccccagttctgggtttttcccagctggggaggtatcctcacccctcaccctgtggtgtaggagtgatgggactagggccagagttctcaaaatgtgtcctgaggcaacagagggaatgtacatgggtgcaagcgttattttaaatgttcaagaaaaacacgaaaacatctgtcaaccacctggaaaactaatagcttggaatagttcccagtttccaattaagaccatgatattcctttctgtgacaccatatctttgcaaaattgggttttcagcagttgctggataaaaatgaagtgctgagcagaaatcaatgtgcaacaaaaaataagggaggcaatgtccaatctcattccaaaatgagaaattgacatagtgctcagtgggtgctaaattgttagaacaaaaccttattaagttatttggacttaactatttaataattggaactattatttattttggccaatgtgttgctgttattaaaaaattgagatattaagggcaccatgtactgagaaagtctgaaaatatttggattagttgtttattcatatctgaagaattagagctaaatcaggctaggcatggtggctcacatctgtaatcctggcaatttgggaggccaaggcaggcagatggcttgagctgaggagtttgagaccaacttgggcaacatggtgaaaccctgtctctacaaaaaatacaaaaatttgctgggcatggtggtgggcgcctgtagtctcagctacttgggaggctgaagcaggaggatcacttgaacccaggatgttgaggttgtagtgagccacgattgagccactgcactccagcctggatgacagagtgagaccctgcctcaagacaaaaaaaaatgattaaagataaatcagatctctatgtgagactatttgagagaattttgttaggagttaaaaaaataacagtttccaagctgtgaagtatctgatgtgctctagagtagagaatttatctttttcttaattctgttaggatcccaggtagccaaaatctttttttataaaatgtgatattattttggtaatgacctagatagaccaggctttttcttccattgctgtgtgctggccactgttactagtattattcggagtgttgatgcaggcattaatactagctattaaatctcaagaagtttattggcaaaatatgctaaggtcatctgctactagaatacctttttactatctttttgtttaaaaattctgctttatttggtgccatttattcaatcacttaagtcattttatttctgatttaaaaaaatgggagtttcatgaattgtaaaataagtcttataaattagctaaacaagtttcttcaatccttgaactgggggatttaaaatattagctgaataggcattttatattcctaatctcatactttcaaaaaaatcataaaaatgaaatcctgatgtttagacattttaaatggtaatgtttttaatgccacagtataaaaataaagcattgattttaatgcactgctacagtgagatggtgccagcacctctaagtatcattgccagtgctctaacctttaaaataacgaattaattgagttatatgtagtaatatatcttggctattactgccaaagtaatagatatatactgaagtcttaggagagatagagggataaatgttagttataaaaagttgttaaagcagagggaaaaagaagtgaaaactgaccaaacatatacgtaattcattgtttctatgacaagcctgctgcaattcgaactctaggactttgtgctaatatttagcataccattttattttctagatttcctttatactcactatgttcctcagtatttgcactcacttcttttgtttgtttgttttgagatagagtctcactctgttgcgcaggttggagtgcagtggcacaatctcagctcactgcatcctccgcctcccaggttcaagcgattctcctgcctcagcctcctgagtagctgggattacaggtacctgccaccgtgcctggctgattgtgtttttttttttacttttagtagagatggggtttcaccatgttgaccaggctgggctcgaactcctgacctcaagtgatcctcccaccttggcctcccaaagtgctgggattacagactgaactcacttttaaatcttttaaatgtgaaaaaaaaaactctaaaaatcatgtgagtttttctcactcctgtataaaagagaaagagtgtgaaggtgaattatttaaacttataaataatgattatataattatgcttatacatcagatttaatacatttcaaaggataatatctactttctttaaaaaaaaatgcagggagaagtggtagtttaataacaagagcaattattccacaatcctatgagacactgaattcctgccagaagaaagtaaactcagaattggcctcagtcaaggaagattagcctatttttcagtgcataccaaaagaatgcaatctctaagagcacattatgtgtgaaataaactaaaataaggaaagtttgaagaacattttgaaagaaaaaaactagtccagtaacctggatagtgctctcaatgaaacacggcccctagatgaaggacccatagttgaaaattactgattcttcctgcctcttgaaattccaagaggcaaatggccattacaggagagatattggttcacccagttgtggatattgtacctagaggtacactagtgtactctcactttatctcaaccctcttccctctgtatattaaagaagactaaaatcaaaaccatgctccagtgtattgtaaaatagaaatattttgaactttaatttttttttcttttcttttgagacagagtctcactctattattgcccaggctggagtgcagcagtgtaatcacagctcactgcagccttgagctcttgggctcaagtgattctcccacctcagtctccctagtagcccaaacacaggggtatgctaccacacccggctaattttttttaatttttagcagaaatgaggtcttgctatgttgcccaggttggtctcgaattcctgagctcaagcaatactcctgctttggcttcccaaagtgctgaaattacaggcaagagccactatgcacagcctgaactttaagtcttgacggtggggcatatggtggcaggctgggaagaagaagaaagttgacttctattggagatgaccaatacgtgttttccaccacattctaaataaaggtgtgtattaattgatgtgcatttttgaatgagtatcactgttttactcgtttggaaaataacagtagcacctactccatgccagggtatcatttgaagacaccatagatccatgaaagtaagacaaaaaaattgtttggagcatgcattcttgtctttatttaatttttaaaaattcttgatacaaaaggagatgtttccagccaacactgagattcccatatgaatacttgttttcacttacacatcaatcattttaaatatttacttttgcttgtcagtcttagcttcttaatgaattgttctcaatgtctcctttactgttttctgagccatataaggaaaaacagtcacactgctggaacatttatgtgatgtgtttcttgagataagatattccagggagtattactaaatcatactgtctaagcccttgcaatatgaatcatctaaagatgtgcttctataaataaacagaaagaaagcatcaagcagacccatggtttttctttagaaaaccaagtaaggaatatcaaccactgggctttgctttcagattcctggtaatctgtggtatgattcacaccaggttcacagaggaaacaaccccaattattccgtctgcctactgcagcatctcctaggctttgtgtccacctacggttaattgccttgagactttatggtttttcctaaccttgggtcaagaaaaatttgctgacattgaatactggaaagttgtatctaaacatatataatgtgtcaattcctgcaaccctctctttaagacgcagggaacttcagagcagaaagaaaaagaataactgctcacccctcaacaaatgtggaaggttgtgatgtgacaagaaatcatttcaccagttcagtaaatgatgttgtctcccaataaatgtcatgaatgatcccaagtccaaaattttttaactcattgtttcactcccaagggagaacaaagctacatgcagatctcatatttccatgtttcaaaattcattttttctttggtgcttacagaacttcaaattgaatttgttataaccaccaagatcagttttgtttttgtggattggtgtgtgtgtgtgtgtgtgtgtgtgtgtgtgtgtgtgtgtgtgtgtttagctagtggatagcatattagacagcaccgagagtcttgcagaatattctgttgcagaaatagaatgttgcagaaatattctattggacagtgctgttctagagtctaaaacatttacttctatgtgccttcagaatagtctaaatccatttgagcatacagaaagcggcatggtaaaaacaaaacagtatttgaaggcctgggctcaaatccagctacactgaacatttccatgccttgggattttatgacccagtaaaatttctgggacactgacctagggttactaactccttattttgccaggtaaagaacattaacaaggaattacccatcaatatatatgttaattttattttttaaagacattttcacttcagtgaaaaagaaagagcataatctcagaataaaagaattttccaaaggaatacgtatagtttaaaaaaaaaatctcactgcatggtccatgtacactctgactttgacaaggaccactgagcattctgttgggcaagtaccagatcttagagtggcatttggaaaccactgagttctgtcagcttgtcaagggcatgactgccaatgagtaacttaagttgtcagggcctagttccttatgttagaatgggaatatgagcatccatttaatgcagagttgtcaggattaaattcagcatgttggtagaacaccgtgtctggtgcctagtaggcattcataaaacacattgctctcctctctgtttgatcaagggcttccttttaatctattgaatcttttcaccacatgcagacctttaaaattgttgcactagttgaccaaaaatcttttccctaggatcccattctggtgaaaaaccaaaagggcagggccactggcattaagaacaagcctgccaataagataaactgtgaaagaagatcccgttcctagaacacaaagtgagagcacttgtgaatccctgcccatgtactcaactctttcgctgtctttcttccctccatggaagtcagactctcagctttgtactcaaaccttctggtgataatttgggacatcagccgtcctagaaaagtctctctattgtattggtttttattaaacaaaataacctaatatgcttagtgaatatgtctacacacatgtgctaaacatttgtttaattatttaacttggaaaattttggtgtatcatttctaacagagatagtctttgtgccatcatataactaacaaatttgaaggcattcattggcatcatgtattttctctaatgagtcctaaattgttttctcatgacaaataaagagattccattttagactagattattttttgcttatgttgcgtaaacttcagtcccatctgctttatcatcagtgcctgtcctccacaagtgatatgagcacacatgagccaaaaattaaggatttttggttgaaagattttttttttttttttggtcaaagatggggccgggctctaattcttgttttaaatttatttttcatcaacaaataacaaattatatgcatttattatatacaaggtaatattttgatatatgtatacattgtggaatgattaaatcaagcaattaacaggtccatcacctaacaatttatcattttttgtgatgagtacatttaaaatctactctcagcaattttcaggtatactatgcatgattattaattatagtcaccagcctgtacagtagatctcttgaaattgtttctccttctaactgaaactttgtaccctttcaccaacatctcccattccacatcctcccattctcccccaggccctgctccagtccctgggaacaactgttctactctctgcttctataagtttgattttgtttttagattccacatatgtgtgagatcacatggtatttatctttcttgcctggcttatttcactaagcataatgtattctaggaacatccatattgtcataaatggaaggatatcccctttttaagcctgagtaggattctagtgtgtgtgtgtgtgtgtgtatataacattttctttattcatctgttgttagacacttaagttgattccatattttggctattgtgattaatgctgcaccaaacatgggagtgcaggtatctctttgacatactgatttcattttctttggatatatacccagaagtagaattgctggatcatatggtagttttatccttaattttttgaagacccttcatactgttttccatagtgactgtactagtttacattcccaccaacagtgtaaaaaggcttccttttctccatgtcttcaccaacatttgttacctttttttgattaaaaaaaaactattataggtgtcaggtgatatctcatcatggttttaatttgcatttcacttaagattagtgatgttgagcacttttacatatacctgttgacctttttttgtaggtcttgttttgattttaatttttttgtagagaaggtgtctcacgatgttgcccaagctggtttcaaactcctgggcttaagctatcctgctacctcagcctcctaaggtgctgggattacaggtgtaagccactgtgtcaggccattgttttgagaaagacctattcaggttttttgcccattttaaaatcaggttatttgtttttttgccattgagttgtttcttaattcttaaaatattaataagatgtgagcaaacagtttaaatttcagaaaactaaatatctttgaaggtcactgtactagtctgttctcatgctgctgataaagacatatctgagactgggcaatttacaaaaggaagaggtttaactggactcagagttccacgtggctggggaggcctcacaatcatggtggaaggcgaggaggagcaattcacatcttatgtggatggcaacaggcaaagagagagagcttgagcaggggacctcctctttttaaaaaattagatctcataagactcattcactactatgagaacaacgcaggaaagaccagaccccctaattcagtcatctcccaccaggctcctctcaggacatgtggaagttgtcggagttaaaattcaagatgagaaccccatctcaaaaaaaaaaaattctaacctgctttaagaaataaaaatagtggtttgcacttgtaattccaactgcttgggaggctgaagtgagaggatcacttgagtccaggagcttgaggctgcagtcagctgtgaattgtgccactgcactctagcctgggcaacagagtgagaccccacatctctttaaaattttttcaaaatatttaaaatgatcaaaacgggcgaggcgctgtggatcatgcctgtaatcccagcactttgggaggccgaggcaggtggatcacgacgtcaggagatcgagaccatcctggctaacacggtgaaatcctgtctctactaaaaatacaaaaaaattagctgggcatggtggcaggcgcctgtagtcccagctactccagaggctgaggcaggagaatggcgtgaacccgggaggcggagcttgcagtgagccgagattgcagccactgcattccagcctgggcgacagagtgagactccatctcagaaaaaaaaaaaaaaaaaaaaatgatcaaaacaccagaaaagctgcatacacagatatacaaacaggtggcctgagtttggcgttgaaaagtttcaatttggaagatgttacctcacacaatactagacagctttaatgttactcatatattaatttacattttctttgattctcagtaaaaggttgctggacattcttgccaaattgaaagttttggtagttgtgatttttaatacaagtttttgtgttaaatagattattttaattctaagtggcaatagcttcaaagaggaaaagcacattcacttgtaactgaagttggctttattatattaggaactttattccctagggtttcataaatagatgtactgcttaatttattttgacttaaatggagctagtttcaaattaaaaggccaagcaatacagaggatccatatcctcaagtatgtctaataccaaggaaacagtttttatgtatttttggtattgttttatttactatatagattacttagagtttataaaaaaatctaatgcctcctttataagtaattttaaatcattcattatattcttaaatttataatttgtcagagtgaacattatttttggaaaaacaaatcatctcttttaaacgctatatggaaaaaataatttggttttgcaaaattttcttggtagtcacattttacagaatttttgttgtctgaaattagagtttcatgattttaatttaagcaggtagcaatataaaatacttaacattcccatgaattacctgtgcagcccagtttctcatgtagcattttaatatttacctttgtcttatgtatatttaattaaaataagcatgtttcctttaataagtagctttttaaaaatgaatgaatgataaatgaactgaaattcgtctgaaaaacccatatgattattttttaatttatttaaaaatagaatcaatgcttacattttaatacatttggattcacataacttgaaaaattttagagattaccgaatatagattggaatcattaacaatattttaaaagaataaaggcatgtataatttttatggttcattaatgtttaatgctaaaagcaagatatacagttgaatatacactatgactctaattctataaggaagtatgtagtccataatagtcacatactatattgcatacatgtgctcacatacatgcagtgggaaaatgttatcaatagttatctttgaatggttctttaagttgttctatatctcccaaagtatgtatatgtatgcatgtacttcatatgtgtgtatgtatatatatacatacacatatgtatgtatacgtgtatctatacatacacatatgtatgtatacgtgtatctatacatacacatatgtatgtatacgtgtatctgtacatacacgtgtatgtatacgtgtatctgtacatacacgtgtatgtatacgtgtagctgtacatacacgtgtatgtatacgtgtagctgtacatacacgtgtatgtatacgtgtagctgtacatacacgtgtatgtatacgtgtagctgtacatacacgtgtatgtatacgtgtagctgtacatacacgtgtatgtatacgtgtagctgtacatacacgtgtatgtatacgtgtagctgtacatacacgtgtatgtatacgtgtagctgtacatacacgtgtatgtatacgtgtagctgtacatacacgtgtatgtatacgtgtagctgtacatacacatatgtatgtatacttgtagctgtacatacacatatgtatgtatacgtgtagctgtacatacacatatgtatgtatacatacacgtgtatctatacatacacgtgtatgtatacatatatacatacacgtgtatacttatatatacatatacgtgtacatacatgtatgtctacatgcatgtatgtgtgtgcatacatgtatgtctacatacatgtatgtgtgcatacgtgtgtgtacatgcatgtgtgtacatacgtgtgtgtgcatgtatgtatatgtgcatgtatgtatgttgcatgcatgtatgcatgtgtatatatgtatgtatgtgcctgtatgtatacatgtatgtatatatgtatatatgtgcctgtgtgtatatatacatgcatatatgtatatatgtacatgtgtatatagatgtatgtatatatgtacatgtatgtatatatacatatacacatacacacacataaagatcaagtaggttacattatatgtttgttttatatgtccatacttctatgaagatgggtctagagagttgtgagtagacgtggtcctcctatagctaatccttgggtgttgtcaaatagtctaggctcccagaaatatttttatattcattttaaaattagaacatacttgtttctctataattctaaaagaagttgtcaagggtgaattgatagatggatgatagtttttaggctgaggaaagaaagatactaagatttcaaaattatcaaaatcttggactttaaaatatatttcaaaaatattattttaattttctatatgtttatcaatttcctaatcctattgacaaacttcagaggagaatatctttctagtaagagtgagtgaagcacagaagatgaaaaaagtttgcacaagattccattcggccagcgcggtggtgcacacctgtaatcctaggcaccccatagactgagacaggaagatcacttcagcccaggagttcaaggccagtctgggcaacatagcaaacctccatgccattgaaaaaaaaaaaaaaaggattagattcaaacgtaagccccagcctgtgactccttcacagtgctagttcatgcattcatttgtcatgctaaaatttgcaatgtgtgatattcaaaagcagtgggtcttacatggccactaatgctttaaatatagtaggattaggggtctttgctccataaagtaaaaactttcttctaattaactgtatctccttttccttatgatttcgtaatagtaaaacagataaagattgccacctagtgtgtttaagatttcaaccaatcatgaaatgaacttctataggaaattatattttcaggtgctgatgttggttgaacttatttttttaagatgacaacaggctttttcatttttaagtacttgaaccatatatggatctcaacaaagtcaccataagagtgtgggcatttggatttcttgcttttagtttcttgcttgtttctgtttccttattacagaaagaaaaagggtagaaaataacgtgataaataatacagaagtagaagaaggatgggagggggaatagagaatagaagttcctgactctactgtcatttctcttgtgagaaaaaaaaagacaatagtatactgttgagccctgtattctcctgctttcaacagcgctggctcaggactcagcaagtctttctctttgggagagacaaggctcgccaggactagtgaagatgactctggttcacttcctggtaaccagggaaggtgacagagcatgtggcacctccttggacatcatgaaatttaaaaccaatgtgacactgactcccacagtgacctacagtggctcatcctggctgttctagaagtttctgcacttgcattctgctgtgactgttaccttggtaccaatctcatctctcacatacatacatatgtgcatacatacatacatgtatacatgtgtgcatacatacatacatatagacacgcagtgtcaaaatgactttttttctgagccttcctatccctcattcattctccgcctgtcctccatgaacactccagttcttttttttaaaagagctgtattttccttaaaacagatcacagctgttttttgttaagggttgttgttgttataattgtttttatttaaatgaaagacagtattgcatcatcctcacccaaaattcacattaccaggcggtacaatttcaaaatgtccaggcgatattcactgtgtgactttgaatctagcttttcagtcactttatagagaccctaatagtctcttcccatctcagaagagactcagaaaaatatttagccaagtaggcctaggaagccccaatttattacattgtattgtaatccctcccagccccactttacgtggcaaggcgctttaaaaagcttctgtgggtaaagttgttcaggtgcaagatttcagaattattttatttcataggatttttttgagcatatgtgattattcagttcattaaaacccacacatactttaaaccaaatcatattcacaaagtgaatcttctgttgatcttaactaccagatctgtttttaaatgattataagcaaagtgtaagacacaattcaaagatatgtttgtattatatttattttcttctaaccacaaataaaaataggttttacttgccttattctcctagtgacagtatgtctgaaaagatctgttttaatattgagttgaggacttagacaaagattttaaaattatatgttaggtatatattcaaagataatttaagcatgacatacttttgaaaataaatggataggctataacctgccgtttatcgaggacatctgccactgaaatgctaggtatcattttactgttactaaaatgagaccatcttgagatatttggcagaaacaatttctgggcaatttattaaaaagtaatatatttccttcactaaaatgataactgtctttatgctttcatagggaaaaaaggctggtaaattatcataaatattgtaaagtgtattacttataatacttataaaggagatacaaccaaagagaaaattaaatgttttaataaatatgcaacccttttgagttttgaaagattcaaatccactgcaatctatataaaaaattaggagacatatttccatggattcatttcagattgatgatgtgccttgtcaagatgacttagtcctgaaaaaaataaactttatagtaggtcaattataaagaataaaatgaaagaagagactatagcttgggacaataagaagatgtcatattattttaattttggttatctgaactgcctctcatccattttacaatacaatgtcttcagcttggccatgcactgaagcagatgaatagtttatcagactggcaaatcaagtcggcataggtggcatgtcttttctccttgtgtaatatacctcccattatggaatttttaataacattttttaatgtcagaaaccattgaactatcttgaatgcaatatatgtagtatatacacctattgaaaatgttttttgtcttcggacttctaacacactacacagtttactgatttgtccaccactcccaagaatgtttggcttcaaatgaactctaaaggtgcctttatgtgtgtagaaatttgtcaaatgctgaagtgtttagctctggattttgtcttcatgctttttaaacactggtgtatctgtaaatatttctcagttgttttgtgagagttaggctactgtttcaaaataagtacataagagaaattgcagccctatatttacctatatgacacagccagaagggaaagtcagaatgatgggccaaggaagaaatgtagctggccaaccctggcatcactttgtaatttgcatttattgggccattttcctagagctttatttttaatctttttaagctgttccataggaatcagccaatgcatatcacaaaaggggaccattccaggtatggctgtgcagcttactacctgcgtgtctttgtgttaaatctcttaatcaatttgagctacaattttctcatctgaaaaatgggagtaatgtcacctaccttgcaacattgttgtaacagctgatgattgtatataaaatacacttgctgtgataacattctttttacttttgtaaatgcttgaaattttcatatctttttttccccagaactttttctttcccccagagcttttaatgctgtcatcgtccctctctctctctctctcaactaccactgatttagtttaggtcctcatctcttcttttctctacactggtctccctgcttccatttttgcccctttaaagccctcaatcttttatagacctgtcacagggtctcaagagtccttcttagcgaagtatcagttttctgagtctttgcaatttcctgactgcataggaaagcaaaaatcattatgatttaaaaggttttactactgctgctaattattattatagaaatgtttattgaacatttactgtgtggtaagcacatttttcagcacttaacattattaatttattgaatcccaaaacatcactctatgtatgtgctgttatctccattttacagatgaagaggccaagggaaagtgaagtttaataacttgcacaatttcacacacctagtatgtggcagagctgaaattccaacccaaacttccatcagagagtaaaatccaagttcttgtacatttcatacaagggctctgtgatctgctgcctggctcgttaccacccatgattctgaatttcctgccttccatggcattctctagaatcaccgagcttctcgttgcagctctgtatctgcttctttctcatctaggcagctgctctgcctccttggcttcatccctctctgctggctcccacgggctcaatggcctccttgccacttcagtgcaccaggcctgctcctaccctgggccattgttctaggaaagagcctttctgggcttgacctcagaagaccttttttttttgagagtcaaggtaaattatgtaaattatttattgatgacagaagaacactatcttagtccagtttctgttgctataacagaatagcatagacagggtaatttatatagaaaagaagtttatatcttacagttctagaggctgggtagttcaaggacatggcatcagcatctgattaggatatttgggatgcatcatcccaaacaatggaaaaatggaagggcaagtgagcacatgcaaaagagaaaacatgaggggctgggctcactttataacaacccactcttatgataactaaccccctcccaccataacagcattaattcattcatgagtgtgaagccctcctgacctaattacttctcacaggcccccacctcttaatactgttgcaatggcaattaaacatcaacatgggaaaatacctttttcaattgacatcctgcctctaccacttattagtttttagaccttatgccctctctgaacctcagttgcctcttctataaaatgatcataaaacccaatgtcctaccttcttagagttctagagttctatgaataatctctacaaagagcaggtgccccttgaaaaacatgattctggaactaagggggtgtaaaataacacatgcttcctttacattgttttttccttcttctgcttttatttcccacatttttattttcaagatctccacatggtttgatgacgaccacagcacctattctagctattggtaacaatttattgagtaacatcatccatatgctccctgtgccccagcatgtttcatgggtgttgttttgggtcactcaggttgttttcagattgttcatgagtgagcgaaaagtttatttgcactgttctcagggccatgtccagggagctgtctgtgttgaataacagcattcacttttgatttaagaattttatctagctagatcaagaaatagctgatggtgactctggaaatccttgtctcaaattattcatgctaagaaataccacaaaagaaccctgggccccagtttctcactttcctctaactggaatgttgcacaactttccttgcccttccctgtccctccaagacacgtcatgctgacaccttgctcccataccccaggcacggtgtagctggggttgctgcagcaacagcacacaaggagtaacatttcccagtgactacagtggctgggatgagtcagttgaacatttcactgggtttttattagtgtatgatgcagtcccatgtcatctacagttcctagcctgtccaagacttacacgggatgatgtggaacactccatgctaatcaccttcaaatattagatggtcaagggttctctcactgaagtcactgcattgctggttccttccacagcaccccttactaatatctacagtaagaggccaaaagtaaaactcaggccccactgctggaacaccatttctactattgcatatcctgtgtgcctaaaaagcaacagtgaccctggctgatgatcaagaagcccctctttttacccagggagttggacaattgttaacatcccagaagacatatttttaacccagttgctgggaagaacatgtgctgaagtataaggatggaatcactgtaattctctatgggaactcatgaaagtggaacttgccgtttaatattgaacgacactgagcacagagttattgatgatttctaatgcgggatttggtttatttttcagacacggagatgacttgattgtgactccatttgctcaggtaagcacagcttggtgaatgggcaggtttctcacagatgtaaaaatttaatttggggaattagttcgggttattaatttaatttaattttaaatcaagcacaagtacaaatacaaattcttggttcattcaagcaattcaaaagcaatgctagagaaagtgactttggctatattaatctgtttcctataaacccatagtaccaaagagtgtctttgcttcaaataataaattagctaagggatatacttaattgggctcatactgacataagcactagaagcagaaggctatatcatggcttaagttatgtttagtataattaggtacatgatcagtgcttgaaattcaatattccaattcaacccaataccttatttatctcttttttacatatgccatttgtgcagagatttagctgagtgatgtgttgatgtttacttcttccttctaggcatacaaatcatgaaaatactttaaccacatgacatatgtgcaagcaggtgataacatgatctaaaatgtttgggaatataaatatgaaagagttgatgaccagatgttctatgtatagaccaatacttctcaaccctacctgcacgttagattaacctagagacctcttatcccagtgcccaggctgcagccctggtcaattaaatccaaaaatttggagatctgttacaagcatctgtatttgttaaaggccttagtatttttctagtgtgcaggagaagttgagagtctctggtatagacaactaagggcggaatgagataaaactgatttaacctggggcatgaagcaggtttaaaaccaacactgatgagtaagaaatgttaaatattaaaatgcaagtaatcctgagaggttgtaaaaattataatcaggcctatatcatacatcaaggtgctcttgcaccttggacaactcacttaaattttctgggtcctcttttttttcaactggtagagttaggggactgagctggatgaaagacagtcagatctagttaaaaccctttcaccgcctcttgccaactcaatggacttgagcgagtcactgaacttttccaagcctggtctcttcctctgttaaataacagttccaagagtacccacctcataagattgctaagacactgaaataataccacgcttataaaatgctaggcacaattgcttgaaaatataatattataaaaactttgtgattggtttaaatgtatagagctgaaaatgttctttcatttctaaaatgtcataagtattattttttaaatggataatagggtttagatagtaggattatgtatagttctactttttaaaactttccaaacttttattactgtaacttagacctataatataatcaattcataagtaacataatgtataatagtaactttttaaattaatgcaggcaattaaaaataaaatacaatcaccatccttttcagatggttaatatcttgtttgctgaaggttttgctggagattatgaattctttctagtacctgtatttctgtgtccaaaaaatttacacttgtatgatttaataatatgatgtgatagcaaaatcttataaagctgagggtttttaattgattactattgaaaacttatggccgggtgcggtggctcgtacctgtaatcccagcactttgggaagctgaggtgggtggatcacctgaggtcaggagttcgagaccagcctggccaacttgatgaaaccctgtctctactaaaaatacaaaaaaattagccaggcatggtgacgggtgcctgtaatcccagctacttgggaggctgaggcaggataattgcttgaacccgggaggtggaggttgcagtgagccaagatcatgccactgcactccagcctgggtgacagagcaagactctgtcaagaaaaaaaaaggaaagaaagaaaacttataattctatatctaagacctcagagagaggtgaacagacaaaatatggcataacaatgtaagtaacatcatcaaacatagaaccaatcattccaatttgagttcattcaagtagctattcttgtttctaaccaaatgatctaggtattattataagaaaaaatatatataaatatttaataacaaatgaaaaaaggtctgtgtatgatatatggtcttttacatcaagtaatatttattaagctgcaacaaatagattagtaaattggacttgaaccctgccatcagtgctcttaaattccaaggaaatctagtcttttacctgattagatattttctgtagtgtacctataatctccaaggaaaaaaaactaatggaatttcaagatattgggaaatacacacatatatgtaatttagtccatgttagtaagctatttaaataaaaaagatgtgtacttaatatacttgaaattagaacttggaatataaatcagctgtataatttataggcatatctgatgcctaaaaataatcccatagtatattaagtctttgcttatgattagctaagtgactcataacaccttgtagagagtggtcattacttgagaggctgccgattttttttaaggggcttcatcatggttttcacaaatggccttttactggagtataagacctggaaagccccactagaattaaaaacaaaacaaaacaaaaaactgttaagccctgaagagtttcaccactcttcatagagcatctgtggggaggggttaagagagaagtcccagtgagtatgtttgagtggccttctcttaaaccctgttggacatgattggcatgttttgctgacccaatcactaacttctcaaattttctttaatacaaagtaaagcacttaccacttaatggtaagtgctattttagcattaactatttaaaactaaaaatataagatacttatgtcacttgaagtgataccaatctaatttgtcctgatataccataattgctttcaccaaaggacagaaaacaatggattttagaaaagtcactcagaaaaatatttagccaagtaggccaaagaattaccctcttttctcagcatgctttgaaaattggaatttcacactaaattccagtgaaaaagctatgcttctcaaaaagacaaaacaaaacaaaaactttttgcataaaagtttagaaaaataataagaaaaagaaaaggaaaattttctaaaattccaaaccccaaaataactgctactgacattttattttatatcccttcagatttatttttctgtgcatattttctgtcccatggctcctaaaaatggccttcccctgtctaaggtgttcaaagatcccctcccaaatccatctcatcttctgcctcttcttgagaactcatttctttatgcctgagtccatctccaaaacacgaatcatggtttccaaatcatggtttcctttgacgtgaaaagagcaaaatcctaaattagaggagaatttaggaagccgtgcaaagatagattgcacttttttggccaggctaaagcctgaaacatcttggatagtaattttcagaaaggatcctatagtatctctccatagtttatcccattgtctaaaacactgtcagggctagaaattcttgctggtgtttaacctaaactcttttccacctctgatttcttatgctttcccctgtaagctcagaatccctttggtcctcagaaaaagtgacagctttaaatatttttcttatttcaattgttaaagtattctcttgtgtttgtgttgaaatcttttggtgtgggtgtttccttagcacgaaggctagagaggaatcccactggagtgcacgcggcaactgacctttttttcttggccagagttcttgggggccaaggagcactaaggaggcacaatgctgataaactgtaggaaactcttctctgctgtcagctgcctccgggctcagtgatcccaggatttgtgacacaactaccctgtagtaaaactctaagttgactagaattttcatgtggaagtgtgtaatgttaaatgaagtagactctgatgaaagaaagagaaaacaggaaaacccaagcattatgctggatccctggagaaaccctcacttcattcagactaaggagatatccctgatttgaaaatacagaggcgggagaataacttgaacccaggaggcagaggttgcagtgagccgagatcgcgccattgcactccatcctgggcaacaagagcaaaactccgtctcaaaaaaaaaaaaacaaaaaaaacaaaaaaaaaaacggggtaggaacaactacatctctttacctttactctaaccaaaatacagcacctgggatacttctaggataaaaatgcagtagttattaatactatagaatattaccatttagttggtaataaaatataaccaatattctcatattcctgcctgtccctcagccacttcacccagcagcaacgatcttgtggcctcatcaccatcctcaagcttgcagactgtgctaggccctccctgccaggctatgaaagaagatagtcacctcgtttcagtcggtgctaaatttttagcttttctttagccttaattaatttaaattacaactactatcttctggacatctaagttctttttaagagcgaaccatataaaattgtctatcaaccttttctggtgtacaaaccagcaatttcatagggtttaaacaaaacataacctggaaagaggttttcttttcataaaaatgacctttctattttgtaaataagcataacttgactccagctttttccggaggtaaaaccgaagtaatgaatctctcccagtgcgggtcgccgcttcctccgccgccagtggcacctcaacctcatggtctgtgttttaccgccatctagtggtaacaagtgtatatggttatgaaaaacaatcctcgaaaccatttattttcctctttttttttaggctatgatgttcagctgtttaagtgttaaatgataaccgtattttcctgctattttcagtgattcttattgtttaataaatgtttagaagcacctaagaagatccgagagtagtgtacgtaaataacattgaatccttccccatgggctaatacatgaaccatctttgtctaaaatttttctgtaaaactaccagtatttccttcctaaggaatatatatttctcatcattcccaatgtaattttgacattgactggctatacttctgcttggtggggcagaagagaaagaaatgaccttaattttctaaccattgagctctgtggaagaaacgtcagggatctttttggttagcaagcattaaggagtaaggacaactgtaaaaggagccttaaagctttgactacagttcttaaagagtcgaattcaggggaagtgagggctgccctgaacaaaagcaaagaacaatggaactttaacttaggggcttcagtaaaactgtttatagttctccccacagcctgcagtaacagatgctccctctttgtgccctgcaatgcaaagtgaaagcttaaaagactaacacagtgataacagtgatgacgacaccaagagtcagtcagcgaggcccaagacaacacccccttataagatttgtctagaaatgttatttacacttctgccaatagcatacatgtcatactgtagaagataatagttaacaccaaacataaaatttataaaatagtttgtcctgctgcaaaagaaaaaaaaacccacacacacacaataaataatctaatactggcatgcctaggaaataatttctctacaagattatttattgcaacagtgtttgtacaaaaacaactttaagatagaaaacctaaaagttgattgctagtggccaggcagctgattgtctgaaggagagaccggaagacagattccttttttcactttttattttgaagtatttcatatatataagggaatatagcttgtaattatgtaaaatataaagaataatactaaaatgaacagtttaagaaatagaacagttatcagtattttaatgtcccctgagtgtccctccccaggttaatctgtttctattgcgtcttttcagaagtaataataattttgatttttatcttaatcattgaaggggagactttttgctttatactcttttgtttaaattctgaagcatgtgaagatataaattatacaaaaatacataaattttaaactaaaaacaaagacaaaataatattaaattagattacttattaaattagaagtttattataatagaggcaaaaactcctctacagaaattttttctttgatgaactaatttttcttttcatgactgatgtttcccttcaaatgatcatagaaaataagttgcctgcatttctatgtctatttacccagctgtcaactgcaatgaacttaactattatgtattggaataaaaatctcagaattctagggttaaaaattttgcctaggaaggggatcaattagctggtgcaatgattttatcttaaagtttccattagtatgtttgatattcacttcttaaaacataaattaagcctgcatgatttaacgacagtggatcatttatccgatttacttctgcatcattcaagatttcatgcctaatgaaagacatcgtggtctgatgtcagcagtcggccatttgaatactccatcataggcagcgtgacctttcagagccgtgggttgtttatatgagataatgagccaggtttttccagtgactgagttaatcacggttggcttcttaggaagcagcattaactcctttaggggaaaattctctaagtcactgtcccaaggcgtacacagctctccattgacttacacaaatgaatgtcaatttcataaacagcaacaacaaaacagagtctgggacatttttgtcttagaaaaaaaattagactgattttagtctaggtctgtgccagatgaaacatttctgaaaacaactctggaaactttgaagcaattaaaactttggagactcttgaattaccaatgctaggcattaagtaaatttcccaagtgcatgccaagtcattaagtcaaaggtaacgctgccatcatgggctaatattggctgaatgctttctatttgccaggcactgttcttggcaccaaacctgtcattccatatactcctcacaacaattctacgaggtaggtatcactatcccagttttccaggttaggaagctgaggtacaaagaggttgcatatctagtccaagttcacacatttactacataacagagccagacagtctgggttgttaggtaatacctactcagacatttggaatctgtgttttacataaacttagcactctagctgtcacccaaatcacctataatcccatctaatatgggtttgaccctggggaaacttgcccatttcaggagaaagagaggagggaagaaggagataaggctctaggaaccttctcctaggctcacttccagtccgttggctactttctagttccaactggaattagaaaaagcgactgttagagatagtgacacctattggtcctgccttgttatgtgtgtgggcatgttgtgtctatgtattcatttagtcaacaaatttttattgagtatcttctgtgtgccaagcattgtgcatgtacagggcgtagcattttacataagaaacgcatccctgagagcttcttacaatgcacaattcagataaccttaacaaaagaaaacaatgtctgcttactagctagagtagccatgtggcaaaggtagaaaaacagtttaaaattcacttcacttgccaacttattattatgagattcttcatcaatttttgaagagatttgggagtagggaattttttatccctaaagtgagctttattagcattttatattatactatttgaaatgtgcaaaaatgcaatcatgttatctgtgtattgcctggaatattgtcttggtgactaaggaacccagaaatactgtggaaactgctgctactgtcaccatgtgcatagacaatgtggagggatttctggaaaatttctgcagtctggcctctctggatttcgtgtggatacctacaaactgcactaagtgttgggagattctttagtggtatatgaaactaagttgcaagcaatatcaagttttctcttaacaaaccattttcaagtgtatttaaaatggccttagctcaagaagtttcaagaatcctttcttgttgtaggtcttggccagtctgcgaactgtacgaaacaactttgctgcattaactaatttgcaagatcgagcacctagcaagtaagatatccttttttcccccctcttttttgctgaacttttaaataagttttctcaacttgattgagcccaaggcaatatgttagacttctctgtgttgttgccatgttgtctgtgtatactaagtcatatgatgtcctgttaattttctataaatacttcgtggtgatggttctaatatcagaaatgaagcagtatgacaaataaatatggtgattccatctgtcagaaatcacctggcatgatcagtcctccgcccagttatttacactcagggtaactttatagtttcggcttacttcataaattaaccgtgggtgaataatctcatcacaccttaagatcagctgaaagtcatcctctcaagacaacgatgatttggagaagcgccatatcatagcaaagatctttgattctcctgctgttactgactttcagatcagcagcattcatggagcaattaatagaattgtggtttatatgacaacagggaaagcatttgaaagatgggaaaggattatcatttcaggttcttgataaaggcaaaaaaatctaaaaagataaaagtaatttttcaatattaaatggaaaactggtttgctgttatttcaatgtccatttttttaaaaaaaatctgctattaatatgaaataaaatattaaaatgccaacttcaaataattttccagaaggaaaaaaaacatttaaatcatattaagaggatagtaaatataagtgtattaggaactataacttacctaagtgcataacatttcatagtagttactacttcttaaaaacaatgagaaatctgaactttacatttcatagtaataaaattgacctcccagattcacgtttttcattatcaaaaatagctctggccgttattcaagtacttcttgtgatagaaaaaagtttttaaaaatcaatataaatgtaacaatgcaagctattggaatggaacccattaggttctgtttttccaggtaatgaatttttgcagtcctattctctcagcctgaatacttctcatcttcttcttcctctcctcatctactgggataattgtcattcattcttttggttgcagcttaaataaaatttctcttggagcattgtccctgatgatacccaacatagacacacacccacaagccctaatcaaagtgatgtgcctttccatctctgtctgattgtaccttgtacttgattcctatgttagcacgtagctctctgtgctcctgttgcctgtttgtctgttgggatgctcctgaacactgtcagttcccagtgagtaggaatgtagtcggttcacatttgtattccctgtgcctagcataatgcagagtctatcagtctgcaaaggcctgttcgctgaaagggcaaagtagtaactcagcatgtaaaatctgagggcatgctttgaggtacctgttcattaccaatcacgttttctatgtaacgtggccgtgcaatgtcatactgacctcagcggcccccttgggctttggggatttggtagcttgtaaggtcaatcacctcccccttagaaagtctcagctctgcagaagaaatgaagttaactggttgtcactcccaaactttttagtctcgaattttacccaggaaactgagatttttgtctttaaaaagtgaacaagaaactccctttatgcttcctttacatgtggtcacctgggtaccagcatttaaatctgtggcaggtaaatagttgatcagtcaggctccagagacgatctgaggcctgtttctatgcaagacagaagttttcagctgacatacagggatggaacagattgaaatggaaaggaggagctagaagaaaacagaaaatcatagcttgagcctgaacttcctctctgccttgtcaatgcccagggtgacatctaaccaaacagtattatctggcagactctaagtaaaggccactgtggtcttccttttggtcaatgcaaatttgtgcctccattactgattcaaaccaaatcggcttctttgggtatcagaatagtaggattcaatctattcacggctaaactcgattctgttcagtgagaacaaagtgctgtaactctgcctcatcacatgatgaccctgggagaatcagaacctttcctgctgggcactcacagagccactagaacatttccaagctcatccttggattttatggaaggcatgtgctcctttgcacaagccaccctttttatttgctgcagaaaaggagtctaggaagaatgcattccaaacccagcccctgggtgggtattcagatgcacattgctgacttgttaacacattactgcttcttgtcaccttgggttttttgtttttgttttgcccttgagattttttattccagaagtgagttctggctcatctgtcattagaggaggtatcgaggcaaccatggatcaaagtattaatattttctgcttgccattacttgttcagatatcaagttcctgagtaccagttaattgtaggattgatagtaaaaggagataattagaattgagtcaaccatttggttttccaaaactgtagaagagtgtgaaaatatttatttaataccattcccagacaaaatcaatggtttctaaattttcacagagcaaggactaaaaaggagtaatcaggatatcaattatttgaatgataaactcttagccagaaggtaacagataacaccctgttacacacagcaagaccccatctctaaaaaaaaaaaaattaattagccaagcatggtggcatgcacctgtagtcccagctacttgagaggctgaggtggtggggggaatcactagagctcaggagttctaggctgtagtgagctatgatcacaccactgcactccagcctgagcaacagagtgagaccctatctcaaaactttaaaaaaaaaaaaatttaagaagaagaagataattactggtatatagaccagagctatttcagagcagctgcttaaaatattaatattttggtttatcgagtttaaattctccccatttttcccccaaccattttattttataactaaaaaaaactaaaataattcagaagtaaaatttggtgcattttcaatcaaacacaaaattttaatcccaaatcgataccaataaccttaggagcaatgaaagggagccagaggctgagtggaaccagtgagaatttacaaaatcccaggctgctttccccaactttcccccaccctgctaagaaattcatcatctcagcaaggcatatttgaagagattgatgccattggcacatatgtgaggctgtgcatgcaggttccacaaaaacatctcaaactaaggcagcaaagcagagcatagaccctaggatcacattcgtttagttcaaatctcagcttcgttacttaaaacaagttcttcaaattctcaaagttttgtttttctcattggtaaaatgagaacaatgaaacttacttccttaaggcttattgtaaggattcaatgagataattcatttaaagtacttatttagcaatgtctgatccacaagaagtgtttattaagtgttcacccttggtagaggcaatatatatataattattatatacctaatatatatatatatatatatatatatatcagacatctttgaatgtatctaaaagtgttttttaatcattatattttaaaagctgtcagttacaagtaataactttataaagttatatttcaaaaatgttgatggatactttataaatgatattcttttcaacataatttattaagcactgacggaatactggatgcattgtgctaggctctgtagggaatataagttaatcagacagcatgctttttttttttacttcaaggggtttatagtcattttgtggaacttggcaaacatctgaaaacttagagaacacaagatataatttatttaagtacctttggcttagagtatttctaaagcttctatagtatctatttggacaagtcattaatatacctctctaacaaatatatcagaggtgtttttcaatataagaaaagaaaggaaaaagttcaaatagcttctctaattataagatagtttacaacaaatcattcacttctgataatgtacaggcaatcacgagaatttaggccaacaataaaaatttcttaaccctgtattagggaagacaattataaattgactgctttttcaaattcagagtctataagctctggcttcagcgaataaagtctgtaagaatttcctcttctctcatgtcccagtgacacttacatcagctttatttaccccaaatcaatcactgtgagatttaccagttttctttttggacatgtgtgatctgagccataatacaaagaacgcctagggacttgtctggctagtctgaaagaaatcatttgcgtgtccaaacttaaaaataattctttaaagtaaaatgctatatctgaaatgactcagagagtgatcaaatcaataagccccacatatttactgctttgtgtttttctgtctttgtcagaagatcacccatgtgcaaccaaccatccatcaacaaagccaccataacaggtaagaaagatctggagcttattcttcatgtgtctaggaagaaaccatttctgccaagagtcaatataacaccaacaccaatttcatgctgcaatttgaaaatgttaaagaaattctttcttctctacattatcatttctatcattgatctcacaaattgtctaagctgttatttggaacatttttaccgatttacgttttttactgatgtacattatttttaaccatttaactatgtgcttatactcatttgagcattgctctgggcatttgtattttgagagatgatgttactttcaagtcacttcccattctggttccacacatgtgttattagcatgatataatatgtcatcatttagtttaataagagtgaaggcataaataaaaggagtaacgtgttggttcatcaatatcccacttgtgtgtaggaagcaacattgtaccagtagtccaataaaggactgagagagctgagaataaactcagtttgggaggggagagaagttaatatacaatgcagaaaaagttcaatgagatcaaaacgttgggatctatagatgtttgggaaagaaaaataggaggaaagatgagaggagccaagtgcataaaaataaaattatctcaattcctattagtctgttttaggcacaggacttgaccccagctgaaccaaaaacagaatgcatgatctcattttgctgaacctgaaaccaaattgaactcttttgactatttcttgaaaccccaattgattcattaaaataattgcctggaaaagaaaacctatgttttctaaaattattaccagaagaaaattagcatattctccaaactaaaacaattcgtcattggattcaagtgtcttccttgagctccaacccataatgtgctgaggagctcttattaagttattagtgagtacactttgcttgaaatttaactttatcatgtccagacgtctgtctgtgtttgtggtcaccacattagagttgattctggaatcattgttaatgtcatcttttctgaatgtcatcaagtgaaacttgtatttcaatgaatgttaaattattgatctcttcttcatgtttctctttcaacatattattggtgatgacttccaattatcattttatagtacatatatggttaaccagttttgttcttgatattgatcaagagatgaacaatagggccaggagtggtggctcacgcttgtaatctcagcactttgggaggccaaggtgggtggatcacttgaggccaggagttcaagaccagcctggccaacatggcgaaaccccatctctactaaaaatacaaaacttagcatggtggcgagcacctgtaatccaagctactcgggaatctgaggcaggagaatcgcttgaacccaggaggcagaggttgcagtgagccgagatcgcgccactgcactccagcctgggcaacagagtaagactgtctccaaaaaataaagagaaagagagatgaacaataacaattcctatatgctaaaataaatactttgagtaactgatttcttctgccaaaattcaaattcaacataaatgagtctaaactgagttggaggtgtggaaccggatccctctgtttctatgcactttcctaagttgaggaatggacaggcctacatttatgaacctgtacctgaggcctctagtgagagaagccacatggaagctggtcttcacgctgctccaggcactaaatctgacccctatcaagaggaactaccctcaacccccaattttgcaataagcaagaactgacattgctatttgggcagaatgcagtgctattttggtccctggaagcttttttagcttgaggtcacatatgagctggcctcacaggtggagcagcattctcccagaagagcagcatcaggtaccagtggaaattgttgtggctgacaacagatggttgggtgctcagtggtcagggcagctgcccagccatcccagcagatgccaggcacagattaacaggagagagtagctacactcaaagggcacacacttgatcttaagcatatgtgacagacctcatagaagctcctagaaatgtatacatagtaagggggtcctggagcaataccagagggaattatgagccacagaaattaagaaattaaggtgaatatggcctcattcgtacccacaagctcctgacctgaggcctagggacaagggggacacagaaataccttatctagaaagggaaactaattaactgttgttaccacttagtgctgctgggctcctcacaaagcacaacaggaaatgaactgactaaaactgggaagtcgtttttcttgcccaagcatagcaaaccaaggtgggaacatggcatagggatggagggatgagggcagtagcaggggaaggttcccctttctgagcccattttgaaaaagtgggcccttaaaacctcagtgctagtaataataatgatggttgagattttgacattagtaagatttgagacactcagaaaaggcagtgcttgtgcctttcctccctctgcagctgaccactcaggccccaccctctaggctcactccccctgaagttggaacctggctgtactgtggcagtagtcctgggaagggcaaagaagtattaaaaagagtcagtgaggcacccttaagatgaatgggtccctgttgataggggtcagacctagtgcctggagcagcatgaggaccagcttccatgtggcttctctcactagaggccccaggtacaggttcgcaaatgtatgcctgtctatccctcaacataggaataaggtctagagtaacagtgtagcctaacagttaagttcatggctgatccaaaaggctgctagagcacacagctccaagtgcctccggagggcaactccacagaacatcacaacatggtgcccctagaattataccacgtggttgctctgcctacccagcactcaaatcatgctctatcatgagagctttgtggccctgggcaggttgcataccctttctctgctcagtttccctacctataaaatagtgacactgcttcctgcagttgttgctggcttgaatgagtgaacacgcatgatgcccttagcatagtgcctcacagaaccagcacttaatacatctttttaaattccattttgttgttattacttggttttgtttctagggcccactgtatacatagaactaggggtttcttcatcaattcaggctgccataacaaagtaccatagactgggtggcttatagacaacacaaatttatttctcacaattctggaggctggaagtctgagatcaggatgccagcatggttggggtctggtgagagtcttcttctaggttgcatcagtgccctttgtaaaggcactagtctcatttgtgagtgttgagtgctccaccctcacgacctaatcacctcccacaggcccggcctccaaataccaacacatattgggttaggatattgaaatgaattttaggggcacacaagcactcattccgtaacaagggggtaatggaaagaataggacaaagacacaaacgaaggaaagggaacagtgagagaaaggcaagcttgcaagatcatgagaggaaaacttgtgggtccttaaattggccaaaatggatgcgcttgctttgtgcccatcaaaatggggtctcctcctgctcccagcactgtctcctttattctcatcacaattcacagacgctggtagctttgtgatagagatgatacactgttgttcaggatgaatttctaagtctaagaactcacttttgagtcatagttgtttgaaggagaaatattaattctctatcacttttctgtaaaccaactctaatttttaaaaaagaagagttaagaacttcagcagtctacatatcacataccatgctttctaaggagttgtcacatagaatttacaataccctcttcctcttttcaaggttattgcatttgacatgtattaaagccaggagaatttgatttttttttttttttcttgagatagagttttgctcttatcgcccaggctggagtgcagtggcgcgatctgaggctcactgcaacctccgcctcctgggttcaagcaattctcctgcctcagcctcccaagtagctgggattacagatgcccaccaccacgcccggctaactttttgtgtttttagtagagacagggtttcactgtgttagccaggatggtcttgaactcctgacctcaggtgatccacccaccttggcctcccaaaatgctgggattacaggcatgagccaccacacctggccgagagtttgattttatagcattagggttttaaagctaggttttaaaggtaggtcactggccagtttttatttcaatatatagtaggtaaacatacaggtctaaaatgatctaacaattccttaaaagtaaggctttgaagtttgcatttataaaagagacttaaatagctcttttgctctttagtgtgatatgacaaagatgatgtgtggcatttggagcctgaatgtgaacccagtctctcctttttgcttcatttcctcattttggagatttgagtacctaacacttaggactgttgcaagaattcaaggagataagttatataaaaggatagagttcaagttgggcatggtggcacacccctataatcccggctactcaggagaccaaggtgggaggactgcttgagctcaggaattcaagaccagcctgggcaatgtaatgagaccctgtctcctaaagtaaaaaaaaaaaaaaaaaaaaaaaaatggaggccgggcatggtggctcatgcctgtaatcccagcactttgggaggccaaggcgggtggatcaccaggtcaggagttcaagaccagcctggccaagatggtgaaaccccgtctctattaaaatacaaaaattagccaggcgtggtggcaggtgcctgtaatcccagctactcgggaggctgagacaggaaatcgcttgaactctgagggcggaggttgcagtgagccgagatcaggccactgctcttcggcctgggtgacagagtgagacaccgtctcaaaaaaaaaaaaaaaaaaaaaaaaaaaagaaagaaaaatggatagagttccgaatgtgatgaggaactcaccaagtgtttcttcctataaccctgtcccaatgcctgacatttttttgttcctaaagctaatttaaaaactggtagaatagaggtaacagagaatattggtatgtcagcttctttggtacatttcatttatgattttgttttcacacagtcatggcatgacatttttagtaatccttttatcatttagagtaaggctcacctacatacgtccttaatgtgtggtgcacaccagaagtaaagagtgcattggaacatgagagggtggcaaagagtcagagatgcccaagccatacctgcactgggacagtgatcccatttttgaagtacagccatgtagcttggagcacagtccttccttgtaagcatttcattttcgaacaaccttagctcaaggcaagcattctgcagccatctcattaaatgttacatcttcacaataccattttcaatgcttctgaatttccatatttccaatatgtttatttaatcatcctcaattagaggattttcatgcaaggacacaactctaaagaaaacgtatttaaatatctttattttaaagatgaaaaaactgagacctagtgagagagggtgctgcttagtgacaatgccaggaataaacatgtggttcctttttcgagtccatggtccttcttacacctttataaagtaaaataaaccattagattcgggtggcctttatacccaccgtggaagtatatgctttagagaaagtaaatgaagtattaatactaactcctgagtaatagatgtggcattgtattatttgtatatgagcttgaaaatttctcatcccaacctctcactggacatatctctgtagttatagctattttgattatatctactgcttataccccagaggcatagagaccagcaccctaaagcaaaagacttctggattttgactttggaaaatacaaattcttctacaggagcggtgaaactagtacagctgcctgctctttacctgtagggggagacacatgatgcagtgacaagcatagaacagcacagaagtggttttagtccagaaaataaataaataagtaaattggtctaagtcttcattcctttttgtatttttttaccctgaagattcatggcttcattaaaaacagtaagtgcattctaaatagaatttagtcaattggcacgtagaaaattaaaaagtaaactatccaaataatgctagtctgtcaaaacacaatgagaagaaatttaatcttatatgtttgttgttctaaagcacaagcagtttctaagaattaataagggggaaaaacaataatgatatttaattgggacaattatttttttgttatctgggctaatcacttaatgctttgagcttatcgaatgaaagaaactaagcaactatttcatggtgacaataaggatgctggctacttacttagatctgccttttaaatctgtgtgtgtgtgataaaagcaagtagtatatatagttttttaaaaagaaatatagagagatctaatagatgggagcaagaaccatataaagaaggcaaaagggatctacatgagagaaatatgtaagtcctcaggagatactgaagtaaaacatgtgttgtgtcagtgtatagggaagacaagagacccagccattgccagagaagccctacttcctcatcaaccaccagcaggcagcagcttcatgctgtagttctttttttcctttaatagaataaagattgtggccacactttaataattgccagaaatatgtgttcattaagctttttaagaaatgtgatcgaaaaatgctgatgatacattgtgtttaatagctttaataaaaaactgataaagcatctaatacatctaatgactgtcggatttcctaaatcttttaagctgaaggagtttacttttacaaaaatcctcattgaaaaagaatcttccggtaaaaacattgaactgaaagatttgcataaatgcatggagtattactatttattagttaaacttatgatcttttagagcagtaaaagtcagttctctttcttacaaatgaatttgttttggccttttatgcttttatttaatgagtagagccatacctattaatatataaaaagatcagatctgacaccgtggctttttgaccaggaattgattgaagttagacttgttttaagaatagtgaaaacaagggctatgtcctaattatgaggggaaataatttaattgtgtctctcttgtctgaatatctgatttggatgctttgttataactttaattgaaataattaaatggggctcatgttcatttagcctagcaaaaaggtgatgagctagcatatatgttaaaaacccagctttcctcttagtagttgtctaattttggtcaatgtacttaaattctccaagttttgggggtattctttatcagtaaattctaattcagtgcttaacatagtacttggtactcagaatgtattcaacaaatgttacttatcattattgctataatattattattattattatctgcttggtcaacagtattttccatgcaccttatatatggcatgcatacgctctggaggtaaaatgtgactactggttcaagaaatttacaaagtaagggagaaggaattataaatagttaagtactagctaaatgccatgattgaagcctttatattttttattttaattaattaattaatttttagaaatagggcctcactctgttgcccaggctggagtgaagtggtacgatcttgtctcattgcaacctccgcctcccagtctccagcaatcctcccacctcagcctcctgagtagctgggactacaggcatgcaccaccacgtgtgcataattttttattttattttttgtattttttgtagaggcggcgttttgccgtgttgcccaggctgatctggaactcctaggctcaagcaatctgcccaccttggcctcccaaagtgctgggattataggcatgagccacagagcctggactgaaacctctttaaatatatatatttatataaatatatattatatataatatatacaaaatatataatatataatatattatatattatatattttataaaattatatatatttcttatataaatatatatttcttataaattgtataaatatatatttattatatattatatacatatttattatatatttattatatattatatacatatttattatatatgtattatatattatatacatatattatataaatatatataatattatatatttattatatatataatatatatttattatatatataatatatatttattatatatataatatatatttattatatatataatatatatatattatatatataatatatatttattatatatataatatatatttattatatatataatatatatttattatataaatatataatatataaatataattctcatataaataaatataatatttattatataatgtatttctcatatatatgcttattatataataaatatatttctcatataaatatatatgtttattataaaataaatatataaaatatatattaaataattatattatatatttaatatataatatatatgaatatgtattcatatatagagagagagagagccagtggctctacctaggaaatgctccctgataaatttgaagaacataatgctttccatgtggttaggggaggattgaggattacctcacaacaaaagaccagcaagaataaggtatggaagcatggaatgcctgtccatatcaggggactgggaacagtaaaggacaaattgagttaaaggtgtataggagcaactgaacaggatgctccagaggtagattaaggaaataatatttgaggcctacataaataacagtggactttattttatggacagtggaaaatcattgagcatttccaatcgtaggaacaaatacacatttcagaatgacagtaattggaagcagtgtagaaagagattgaaaagaagaaagactaggggcagccccatactcttcagggggctgtcacaggccttgtacaggatcaagataatgcagctctgaactggggtggaagtggggctgtggagatgagggaatgggttcacaactcttcagagataggattgaagggacttgggggttgattagagcagagactgaggatgaacaattttaaagtgaaagtatgagccaggtgtggtggctcacgcctgtaatcccagcagtttgggaggctgaggcgggtggatcacctgaggtcaggagttcaagaccagcctggccaacatggtgaaaccccatctctactaaaaatacaaaaattagccaggcgtggtggcacgtgcttgtaatcccagctactctggaggctgaggcaggagaattgcttgaacccaggaggcagaggttacagtgagccgagatggcaccattgcactctagcctgggcaacaagagagaaacttcatctcaaaaaaaaaaaaaaaaagtgaaagtatatatacacatgttcattacagcactgtgaatgtgcataaagggttaaaaacaatccaaattctaaataatgtgtgaattctatttaggtaggggttaaaaaattcccataataaaatgattttaaataatttatttttgagaaaattttaataatatggaaaaatgtttgtattttaaggaatacataataaagtgccatgtgggcaataggcacacatttaatgcactttaattatgtatattgaattgaacttaagttacttttagttgttgaccagtagttagcaaaggtagataggtttaccattttacattgaatctagtgacaaacatgttatttctcaggtcccagttgttagtttgcctctccttgcctagaaagggcactggtgagacccgccctaacaatatttcaatattatggttccacagtccagcattaactgtattttaaaataataatatctctcacatagggcagcattttatggattattgagcctatgacaaaaatgttgtattatccttcagatgatcagaaaaactacccttagggctgggtgcagtggctcacacctgtaattccagcactttgggaggcaagggaggaagatggcttgaggccaggagtttgaggcaagcctgaaacacagtgagacctccatctctacaaaaaattttaaaaattagctagacatggtggtgcacacctgtaatcccagctattcaggaggatcatttatgcccaggaagttgatgctgcagtgaaccatgatcatgccactgcactctagcctgggctacagagcaaaactctgtctcagagtaagaaaagctaccacatgaataaaagatctcagtgtcaccaaagtccactcctgccagcatcccttccccgctgccctgagtttaaaaagagcaatacttcccaaacctgtctctgatcaaaggaatccccaagggcttcctgagaacaaccacaaaatgactgattcccagactttccagaactgaatgtctaggataaggctcaggatctaaattattaacaaatactcccaggtgaatgggcttgattggccaaatttgggagaataatggaatactgaagaaagcaggtgagagggctgcctgtgtacagtgttgtcattgagttgatgatagcttgttggaaaatacctgtctttctggaaagtatatatagtgacacccacaccctcatctaacaaacagtgcagcccaggataagcacgatcatatgtgcaaagtgctccacgattagtgaaagaagatacaaggtgatattattatctgtgctgacttcgtcatcctgggcatcagcgtcagggtcatcatctgttatctctcaaaatacatacaagattttaagtagagcagcttgctcgtctctgagaagaaaatcaagtatcacatctacctttgtggatgtgggagggagggaatttgggaaatgtttagtaattgcattctttttgtcttcttggacacagtaccaagtctccttaaactaataaaagaaaaaaaaaaaataaaagaaccacacaaactgcattcttcagtcactccctttctccacaaagtgcttcccacccatttcagccttaaaaaatattctaggcatactcagaaatacagtgactgtggtggggcaaaatgttgaaaattcctttgaggctcatttcccaaattttactagttggatgttacactgaattatttaactctaaataaatagggagtgcactcacagcgtcgtttcttttgttatatcaaaaagcctctctcaaaaaatgctttaaaaatcagttggatatattattaatactaatattaataaaagttaacatttactgacatttgaaatgtaccaaacactctagatgagtaatctttttaaaccttatgatatccaaagaggtagacaccgttgctattcctgcttcatagatgcaaaactgggctagacaagttgaataatttgattaagatacataggtagaaaattacaaagtacggattgactcagagggagaatgtcaagtcctctcctaaaatgtactggcatgtacacacatacacaagctgctggatgtgctggtcctcaaaagttattccctagggacatctctcttcttttttttctctctccttccctccctctctctctctctttctttttcttttttcttttgagaacagaaaacaaatctataccatctattcctgaatgtatatgagtggagggtaggacaagaggagggataagatctgtggatgcacagaaactctttgggaaaccctaaaaactctctatagttatataagctaaggaaaggattcctgccagggggtataggattcttcaattcccacacttctcttcctgactcttctgaagtgcccgttgtcaccagagtgcccaggggcagagcattgacaaggaaaggcccaggtgtgtgtgagaagtcaggcagatggggtgtttcggaggaaccagggtaacgcagtgcttcagcgttagcactcaccttgcttctgggaccacttaccacgaaggcctgaaagggcaggccccaactactgggaatattaatcttctctttgggtgaagtctcttcatgccattatcatctcttagctaccattgctaggcaaaagtttcctagctcaccatgtcctgaatgcacttccttgagatatttctgatgcttaaatatccagtgctttctagtgtgccgtcttccttctgtatttttgttttgttttgttttgtttttttgtggttccttttcagcactgttggtcctgtggaagtatttctaattgactgtattctatatgccacacaaaacagatgggtgtttatgacattcttttctggatatgtttctgatgtttgcatattgaacacagaactgtccacatagagaacttgatttctgcctcttcctggctttgcttttactcatttagtccctagtatgtgaaaggctatgcttaggctccaaggacccaaggatgaataaaatacctccagtaagcttcaggaccattactctagaggtttgtggaacttaaaaagctaaaatgtgttctgttgaatgacaaaaagcattaagttaatagaaaacagagggcttataagtgaatggataaatgaataagtaaaataaagaagagagaaaggaagggagagaggaagaatggagcagatgcaggtgagattgtttttctaaagagctaagaagctgcctacagtgttagcttagagactgaaaatggtttgggaaaataattcagaaatttagggaatacttcacagcatgagaaagtggagggctgagattggtaaaagaagacatgtttcaaaatagccaaaaggaaaatagaaaagaactggtcgtgaaaccgagacctcagagttgaatgacaagtaagatacctctgaagtcactgacagtggactgactgttatttgactaatattgcttctacagagacagacctaggttttatcctcccatagaaaaaaatctcaaacattggtaggttttgtttttgtgttttgacatacaagtcaaaatctatgtgaaggaggaggaacaagactcaggggtcagaaaattggggtttcgtggctggctgtcctgctcacccactttacgtgtgaccttagaaaagtcacgccgatgtgttagatcttttctgttaaaatgtggtgggtaataattataccttcctaattttgaggaattacatgagataatctgtgtaaaaaaattagcacggtgtctgggacatagtaaatgtcaggtcttatttaaaagcatgtggaaagtgcttaatatgttgaaaagtattataaactaccaataaatattattatattattcaattactgttgatcctcaaaacagccatctctggaaactgtgcaattatttgagccctgatgccattgctgaaagcattttggaagtggctttagagaccatttacagaccatataagacacacacataccaaaaagcaataagcaatctcactggtttatagtaacacttcacttatgaccaaaaatattatttccaatatgattaccaaccctattcaccagacagaatgtcaaattagcttagatggggctaactccagaaatgaaaccattctcaagggattttaaagagttttttaagaagtatcacatggacttttaaggcaattccaagacagggagccctaaaatcattacaatgatggcaatgtgtggaataagcatataaacacattttcccagatgcaactttgaaggagacaaaatctgaattctaggcagtttgtgaaggaaaaggagcaatttctgggaaatttcttttacccctcagccaacctcaagacagtctgtctttctacagaccctcccttgctgtttctctttactggaaactgttgagggtactggaaataaaggagaaggccaatgtatctaagaccagtggatcagagaggagcccaagaaccttcatcatttccacagaaagggcagcagaggaaattaacctggccttttgtcatgctattatttctcagtgagtctattaaattattgtggcacactaaacagtgttgtctgcatcttgttctttggggattccatacaattctccccttggctggcttatcacctccccttagaaaatggtgtctcagcaatgatcctttgcttgcaatacaaaaaaaccaactctgctcattaatgcaaaattcttagtggaagaatataggaagaattctgaattccctgagaattagtggggcgacaggtggtggtgggggtgctggaggacgaggtttgaaggaatcagtgcatctttacagtgctagaaggctacaaatcaaggggaaagtctcatggcaggagtagtcgagtgagatccccacaactgttcttagtttctttgtcattatttcaagagtcaaacagcagtgaagggatctaatttgtcttgtttgcgtcctgggccttggctaaaagagaacaggcaggtggcttcagttctaccaaactatgttataaaatgtggtagtaagagctgaatgatgggaccagattttgtgggttcatattctagcactacgacttacagatgcttgtgctcaaacaattcatttaaccttccagagcctgaaattcctcacttttgaagtaagcacaataataatatttatctcatagggagttcatgaaaattatttgaggagatatttatgaaaggctgggcatggttgctcacgcctgtaattccagcattttgggaggctgaggcgggcagatcacctgaggtcaggagtttgagaccagcctggccaacatggtgaaaccctgtctctactaaaaacacaaaaaaattagccagacatggtgttgcacacctgtaatcccagctccttgggaggctgaggtaggagaatcacttgaacctgggaggcagaggttgcagtaagctgagatcgtgccactgcactccagcctggataacagaggaagactctgtcttaggaaaaaaaaagatatttatgaaaaatgaagcaaaatgcatggctcacagtaagcacttgatcattgctggttaactattattaagattatctaatagggatacaaagtatattcctgaaagaaattagggtgctcttagataggggaaataaatgctagtaggattggtttcaatgcactatttattttattaatttatttctcactgaatttctttttatgatactcattttttttagagatccagatggtacctgtcattaatgtatcctgagaactcagttcctctgaaggcacaaaaataatttgaccatctcatcatttgatccacacacatttattgatgcctcttttatgcttggttctatacaagacgccgtgacgtgtggcccctgtaggaagtcctggcctctgtctctaaatctgtcatctcagcccaacccctattcagattatctgtgccctctgcgtagccattcacttcgcctgggtgcaatcatgccttccttacccaacgtttaacaagtccagcctagcaacctacatcatgccatccaacagaaggaaggcattattgactcagaacaaagtataggcgctcttagaataagtttattaaatcatttttttaaaaaaaagatatgtgctttttcccaggggagcagtgaggcattgtcagagggtggattcattaaatcaatacagagaatcctggctgcactatttgttagctatttgactttgggaaagttattctctgagccttgatttctcattagaagacgggaataatagcaaacctatctcagagcattaagtaagaattaaatgaagtgaattaagcacgaaacctagcatctgacgcatagtaggaactaaaaaagaaatactagttcttgaataaacatttttttcttgactgtactgtgatacttccatcagtgagtttccaaggcaaatgaatcatctttagaattggaagctcaatgtaagcaacaatgaagtaaagaaaacaactgaatttctcttgaaattattttcctttactgacttgtctttattgtctgtgttcacaagaaactagctctgactgcaaaaatgtctgcctgtttctatggccagttcttttctacatgtttaaattcctaattgtgcacacaatcttagtcacaatattttcatgtgcaagcaattaagactcatttaacagccctccctctggaaggttttgttctccatctgccacaaatcagattccttaggaagatatttgattttgaaacaatgttaaagtactgttcattttgttcaaatttcatttatgtaccattttttaaagtgatgtaaatggacagccacaaaaagctcagcagctggtcaaaacaaaacatcaaagtcaccattgaaatggggcaaaaaaattaaaaactaatatgctgggacaatgccaaataaaaacgatagtctgataaacattcctcagacacattttgctcataacaactatttcctttacagcagatttaaaatatgggaaaataggaatataccccagttgccactctgaatcttagctgtcctgagttcactgcaatgtatataataaggaagtcagaaggtggaaaagaggaaaagattaaatttgtaagttttttgaaagatatatggtaaaaagtagaggtatccaacagatttgtacgatagattgttcatttaaggaccaggagcggtggctcacgcctgttatccagcattttgggaggccaaggaggggcggatcacctgaggtcaggagttcgagaccagcctggccaacatggagaaaccccgtctctattaaaaatacaaaattagccaggcgtggtggcacatgcctgtaatcccggctactcgggagactgaggcaggagaatcgcttgaacctgggaggcagaggttgtggtgagctgagatcgcgccattgcacttcagcctaggcaaaaagtgaaactgtctcaaaaaaaaaaaaaaaaagattgttcatttaaaaatcaattcgattggccaggcacggtggctcacacctgtaatcccacagcactttgggtggccgaggcaggcggatcgattgaggccaggagttcaagatcagcctgggcaacatggtgaaacccccgtctctactgaaaaaaaaaaaaaaaagtagccaggcatggaggcatggtggcacatgcctgtaatcccagctacttgggaagctgaggcacgaaaatggcttgaacccgggaggcagaggtgagatcatgccactgtactccaacctgggtgacagagcaagactctgcctcgaagaaaaaaaaaaaatcaattagataagtgagagtgtatattcagggcaacttaaatctatgctctcagattaaaaataagatttaattacaattttttttttttttgatgcagggtctcactttttgctcaggctagattgcggtggcacaatcacagctcactgcagcctcgacctcctgggctcaagcaatcctcccacctcatcctcctgtctacctgggactacaggcacatagcactgcaccaccatacctggctaatttttaatttttttttttttttttagagacaggatctcacgatgttgcccaggctagtcttgcactcctgggctcaagtgattctcctgccttggcctcccaaagtgctgggattacaggtgtgggccatcacacccagccaattttgaagtatttaatttttaaaatgaaaaattgattagataatagttctccctcactacaggtgaagtctgtttttatttatttgttcaatgggcttctttagaacatgacatagaaggcaatccttggtcaaattaaggcagaaacaagaatttattaggttctgaacataaataactgtctgtgaactggtaactctctaattaagcataaatgtgaaaagaagaggattagctcttcttgaggagttggaaatggaaaatattacaatttggagaggtagcttgcagaaaccgtacagttttctctgcttatatgccccagcgttgggagacttgaaaggaatcaccaaccaagttaatgcaataaatttccatatatagatcaattggatgttttgtccccagcttcctaggcctttaataaactgaattgttttggtatcactggatgaaaggttctgtaaaagttcaaagtattgttatttggggcattcacacctgcatgtttaaaatgcctttgtgcagaatgtagtccaatctgctttcaaatcagaccttcaaagaagggtagattcatccatgtgacagatccccttaggtgcttctctaaaagaaaaagttaagctagcaggtctacccccactcattatctttgtctctttgtgcgtaatcatcaaaccgcacctctgaaaagaagaccaagagaaaactttagtatctctttgctggagatgcaaagcaagatatagaaggaactggaaaatagttcttaagtaaatacagggggaaaacggaaattgagaggacgtacttttcgctaacagttgtaaactaaaaataaaatttgaagcacgcctgcaccctcacctgaatggacttcctccttggccagggcactttaaaatttaacctgaaagactgatttaggccgcaaaggaagtcagacatgccttattttacccctccagtattaacatcaccacagaccttaagtctgataagaaacatttaggatctcttttcttggaagcctgctacctggaggcttcatctgcctaataaacctttggtctccacaacttttatcttaacccagacattcctttctactgataataactctttcaaccaattgctaatcagaatatgttgaaatctacctgtgacctcgaagccctcccccaactttgagttttcccgctttccagctttccagatagaaccagtgtaaatcttacatgtattgattgatgtattatttcttcctaaaatgtacaaaaacaagctgtagcctgaccaccttgggcacatgtcttcaggaccacctgaggcagtgtcacacgtgcatccttaactttggcaaaatacactttctaaactgattgagacctgtctcagatattttgggctaacacaatgaatatgaaaaaacttttttgttggcgggggtgggaggtgggacggagtctctctctgttgcccaggctggagtgcaatggcgcaattcggctcactgcaacctccacctcctggattcaagtgattctcctgcctcagcctcctgagtagctgggattacaggcacacgtcaccatgcctggctaatttttgcatttttagtagagacagggtttcaccatgttggtcaggctggtcttgaactcctgacctcatgatccacccatctcggcctcccaaagtgctgggattacaggcgtgagccaccacacccggccaaaaacaactatttttaaagagcatctaagctcagaaatcacaggcatattacgcctgccactaagggagttagttccattgaaggatataattaagagtgaaatgaatggtgtgctaagcacttagggatagtggttcacaaatttgtctgttccttaaaatcaccttggggggcaggcgtggtgcctcacacctgtaatcccagcactttagcaggtcaaggccagaggatcacttgaggccaagagttccagactagcctgggcagcgcagtgagatcctgtttctacagaagataataataatcacctggaaatttcttttttttaatgcagctaatgaaggaaaaaaaaatccgaggttttgaaaccaactcaaagacaacagcgatattcaagcataagatgtaataaaggttgtacactagatagctagatagccagaataaaaaggaagagatagttacaaaaaatataaggaggataaatgtataggatttcataactgctaatcatatgattttactgagtaggtgtaaaatgcttctgataatgtgtgaaaatttataatccttcgtattatatgtaggataaacataggttaagacctggattctaaggctgaatttaaggctagtttatctccatccttagatttcctacatttcatttaagagaaaatgtcctgtatattgaatattcatgaaaatctctgaaaggtgttatgcttattcttaacctcttaaaggtgtacactgaatgtaattaaatcatttttgctggctctggttcctcatgaacatctgcttttgtacttccctgtcattcacaaatgcacttaggagctaatgatctatgaggacttttttttcccctacagtaacgagcagcaaatctggctgcactttaatttctcatctgctgtcccatattgtctggtggtcagttcatgatgttactaagcttggctttattggcatcttttgtgagctgctgctgctttttccttggcaaacctgattaccaagctattgcattgagcataaaataaaggtaaattaattcaaaataaaagtgaaggttgagggcaattcatttctgaggtagacctttaggatatgagatgcataaagtgaacaagatcctacaagtgtttacttgacttttctgggttcttttcacctacttactgattttgaatagtataaattcctggataattaatctggataagtaagtcgtcactgtacctctagagaaaataaaatcaaccaaaatatgtttaattctgtgctctgggtttcaagaaaacaaaaatgaataagatatagtcctacccccaaggacttgacacaatataattgtacatgtgcaaaagaaactgtctaggtgtggtggctcacacctctaatcgcagcactttgggaggctgaggcaggaggatcacttgagcctaggaatttcagaccagcctgggcaacatgatgaaaccttttctctacaaaaaaaaaatacaaaaattagccaggcatggtggcacatgcctgtagtcctagctactgggggagttgagataggagggttgcttgagcccaagaggtctaggctgcaatgagctatgatcacagcactccagcctgggcaaaaaatcttaagtagtctcaggactgtaccacagagtatcgtaagaattcagaggaggcaaagaccaaattagaataataagcaatgaaggcttccagcaaacatggtatttttgttgggccttgaacactctttagatgctttagtttaatgtgccatagtcacactttctgtattgggagtgttaatgggtgataactactccagagctttaggattgcttccagtatcccagcaaagcagcccttttcaactagaaccgtttgctattacaaaagagaggtgatcacttgtgatttcttaacatttcttcactttgcctctggcactgggcttctgaaagtccaggaaagagcaatgacctcagggttttaagaccaggggtataatcccagctctgcctagctctctgtgtaatttttggtcagtaatttaacctgggttgtgttctgtaaaatgatgatattggattaaatagtacctaatcatctaactttttcctaatattttattattataaaaaaatgcatgcctctgatgaattgcctttatcttctttagtcatatttccctaagaagtgaataaaagataccaaggcaatgtgtgaattccactttttccaatctggatgtttaggggatatccttgacaccatttgctattttgagttttcaacaaagagttaaaagaaaattctggcactcctatctagtcatcctctccagttggcagaagtcttcatgtggacttgatggttgcccagagcaacaaaatattagggacagaaacatgttcagggactcgattgtataagtgactcagagctgagagaccttttccagcttgactgcagcccatacttagctaaagtgggtatttgtctattcctgtctgcatactgtgacttggagatgcctattattttgcttgctaaaatatggaagccaaccttgaaactggcagagaagagttaaatgatcagaaggcaatcgtcttcattcagcacgtctgacacatgaaagatcattaggactagcaaatataaacaagatcagggagtggtcttgggctttgaagagcacataccaagaacatcaagagaactcaatataaattcaatataaaagctactattcaaggccaattatctcttttgagttagaagagcccaatggagagccactcacgcaaatcaataccctttccttctctcagttggagccagacatctctaactatcctctgaattaaactggatttttaaaatgtttttctgtccctaaactctttaaatcctgaggtcatcctttctttgttccatcagtctggctccatgataccaattactccagcttgttaaagcagttattggcatatggtagtcatgtcttttgtttctatgcaatgtttcctggagcaagaattggagggagaagtattagccaagtcttgttgctttaagtctcctctcttcaactgtttaactaggttccatcctaattatgtgtttggttggttttattttgatacccaatatacattcttctcatttgtacatgaacaatgtcattatggtaataataacaattatacaatattactttctgtcctcattgaatgtcattatgatcaggagctggtcctcttggtttggacattataatttgaaatgaatattctttttaaatgattggaaacttagtcgtaaattcaagtggtttacaatagtaactcttatcccagtaaccacagcacctgtttagaaaaatgtcttcggatcacttgtttgcaaatgtctttttccttaggatcctggatggaattgaacccatatacgttacttgacatgtgaaacacgtgtgaccctggcagatgatttggctgaccttgaaaactacagctgtttagtcactttgaaaacaatgcaatacaagtgatttactaggcttcagttttaaccattttatgctgactggtggaaattctaacccttcagaaagaaaaaaaaattgtgaagcaatggaaatgtaccatcctgggtattaatgtcattaattttcaatacattttctcacaaaaagtataaagaagtctttgcttgaccttacgggaaaaaacaacatacatgtggctttattttgcctttttttttttttaattaatgaagaaatccaagatttgacttttgtttcttctctacccaaatcaaaagcagtctataatctcctgcaaagatcaaagctttttgcttactataaagtatgtgccctgcttaggcattacatggtagaaagatagcattctgttccaagaaatctctattcgttctctagttgctgtgtatatattctcttttagctagaatatggttagtaaatgagtcctgaaaatttcgctgtatataccaaaacatgttgtataccataaatatataaaatatttttatttcaattttttaaaattgtgcttcaatcaagacagaagttgatttctttttccagaaattcagagtgagcagtccagggctgctgtggctgctctaaaatcaccaagggcccagagcttctttcagataatttttttaacatttctagattataggctttgtcttcatggtctgagatgactacaagagccctagccatcacaactaagtggccagcagcaagaaggaggaaaaaagaaggaatagtacacccactccttttagaaaaggcttctgagaaatcccacataatgcttctacttacatctccttggctcaaatttagtgtctgccacaaaagagaataagacacacacacacacacacacacacacacacacacacacacacacatatatatatattttttttttttctggcaagtctctagttcagggatttcaatctcctttaagcaaatgagtcttctcctaacctctccctctggcctgcccagtctctctcgaatctcttgccatcctgtcctccttactcactttgggaaaatccagctctgtcagttttacagtctgccttttccacttccttacctgaattcctgggaaaaataatcccacatcacttcaagctggaattccaacaaagtcaagacctgtcacctcatcggactctcagagcacttgacagttagttcctgctgtgcccctctctcagtcctcttcatgctaattccaaacctgtcctctctcttaagcctcccaaaccagcagctcttcatctcctttcagcaaataacttgttgctttttgaagaaagtctgtgtcaaggcatgaacttcctcagctcctacatcctcttgccatagatgttatccataggtctcttactgacatccataatcccttcctcccttctggtctcagcggatgacgtttcccttctccctcctgctctaagtcaacccctgcatctgggcccttgatcctctctcctcccagctcccacaagtccttgcttcgtctgttttcctttctatctctcacatcttcaatctttacttttattctggctctttccccattcatgtctctcacaatcttaaaaacaatacacagcaaaccacagcaaagttcagccaactctttattgatcctttagctagttcttgatcttctcttttcagtcaagttgctctacctcctcatccctattcagtctgcagtccactgtagtacgactttctcacaacacctctgttccagctgccctcccttggttgccaatgaactcctaattgtcttcttagttcttagaggcttcttcttcttaaactctttctttgttcatttactgagtaaatatttattcaacatgtttttgttgggagccattttgttccagatgtttccacactcttcttgctgctctgaatacttcttttcactattcttcatggtctctcttcctccccactttacctcttaaatgtgagtattctagaatgttctttttgattaattggttttctcactctgtgtactctgtagatgttttcatgtacctcatagttgtattttccatcttatgaaagtgggtcccaaaactctgtctctactcagagtaggcacttccccaatttccaaatttattcacacaaaagcccaatgtccattgatatccaactcttcaaatccaatatgtccagagctggactcacatatttctttgcaaatctgttcttcctatctcagttagtgaaacacttttagccaagatcgaaacttataaatcatgaatccttctaccaaatctatctgtctgtctatatatatttttgaaacagagttgtctcactctgttgcccaggatggagtgcagtggcaagatttaagctcactgtaacctccacctcctgggttcaagcaattcttgtgcctcagcctcccaagtagctggtattacaggtgtacaccatcacacccagctaatttttgtatttttagtagagacagcgtttcactatgttggccaggctggtctcgaattcttggcctcaagtgatcctcctgccttggcctccaaagtgctgaggttacaggtgtgagccaccatgctcggccccaaatgaatacaatttttattttattttataactattgatcaaatccatgctctcttctctaacctgctaatatttccctagttcaagcactcaccaactctcccctgaattatagtactagtacctgaaatagtgtttttgaaactgtcagttgcatttagcattttattttaaaaatatgatacagaattgcgtaaaaaataagagtataaaaccacatctataatatcaaagataaatatggttttataaaattattgatacacccacagacatgcaaacacacacagacattttgccatgaaaatgtatttcttactataatttttaaaattagagaactactttcttaaatggtcgatctctgttgcacctcttcttagctctggccttccatgatgccagcaaatttatgtagttgaaaaattaatctgcaaatgtcactcttcttaaaaccttttcaagccttcccatcatccatgataaaatcagatctctttcgtgtggtacccaaagcccctatccagatatgtattgtacctcctctccagcccagcccctggctgactctttcagcagcaaactttttccacccacgtgcaccatgtttcacaactgtcttcatttacttgtactcttctcaccatctaaaactcgcttctctctcataattgcctggttcactttatctcattttagaggacacctaaaattcaagcccagtccccttcctcaggccgagtcaggctcttctcccaaacctacctctagcataacctaatgaaattgctctaaaaattatggtctatgcctctttattaaaaaaaaacaacaacaacaaaaaaaaaaaccctgcccaccagtatagcaattcttttgttataaccacacatagtactagtgtgtggttctggggcactgtcatgccaacttacctgtgttcaatagacctgaagtagggaagatcagctgactcttttacatctcttctcagaacatcttgaaatgattcttgggtgcaatataagagcaaaacatggaacagtagaaaccagcatggaaaactttttctcctatttgagaaagtgggatgaaaatgtgtctcttaatccctttggcagaagggagtaacttgaaagaagtggatgatggatgatcttctccactctgtcagccctctgagcagaatgaggaaaatgtgagaagcgataccattgctatatttgtttcattgaccattattttaaataacttacatggtcctgaacaaggacatgtttttgtgaaaaggacaacatttcttttggtgtgtccgagtagcatttaagaaaagccttatagtggtcaatgaaggttggcctttcacccgctgctactggagagtctgtgagaacactatttattcagcctcatggaaacactagggagtcatgcctgggatctgacaactgtgcagcaccatgccaggtgcacagagagttgttgtgatgaatgtcgagagaggtggtgggggatttttgttgtttttgctccttccattttctttccctctgacttgggctgtggtttcattcattctacctccccacccctatgcaagaatagatctctgatctctttctcatactttatctgccctaacttccactttccttttcttgagaggagaagaacaactccacagtgctttccttttatgttttgggctaattttgttgtgttgttttatggtcttgaactgagagctgcctcagcactcaacaccagcccctggactgtgagactaatgagaaaagcaaaatgacttcaagtaaaaggaagtggtttgtgttgtggagagaaacttggaaagaaacaccaccaagaacactaggggctttattttccctaaagcctacagttgggttaacacatttcaaaataaccggtcaatttagttaatcccatcaaacgacctagtcaatacagtaaagaggtagggcaaataaacaaaccgttttttggatgaccggtttagcttcatgtatccttcgtcttactcatttctagggaataatttcaactcaaggaaatgtgaacatctgttttgcaaactattacaggctggtttaatacaaaaatacctttaaaaaaggtatgttcatactcaacatgtttttccagctgttattaaagcaggtagaaacaatatagtaggcatagaaatcttgattataatgtggaaaaactaaggttaaaattattagcagaaatacatttcttttccatccttccactgtctgaacatctctctttcctacttcctccattttattattttctttgctttgtttctctcttttaacctcaataataacaattctgtgtgccaaacactgtgctaagactgggcatgcatgatcacataaggtaggtaaaattattattcccattttacagaagaagaaactgaggctcagagaatttagggatatgtcccatggtcattattctggaaagctgtggagccaggcttcaaaacttggcagttatatttcagattccacaccctgcagtcaacactctgctgcctccctcaaattttatctcagttcatttgttttctccgatcttctccttttcacatgttctctactctattctcttgcctttttcctttccttatatctgcctcttctttttccagtctcttccctcactccttcccttatttgtcttgtttcccattctttgtctaaatctcctcttttctctccctcttcaccctattcattcccagctccctaaaattatatcattcttccttcatcatgctccctcattcctcactgcagcatcacccagtccaactctgtcccatctgtgattcctcacttctgctttcgcaccatctctctccctaaggtagaagtggtgcccagctttaaacacaaggcaaagtgagggtatgttccactaggacagcgtgtgtcactctgctgccatacacagggagtaccatcagtgattataaagaggaatttcattcctgccagagagctcacaaattaggttattgttgatgttcatatagtttttagtgactggaaaaagataatgcctccttctatggtcactaccaggaagtgagctccatgcagcagacagaaaccaaccagataactgtgagatcccagccaagcacaatttctacatgttagtcaattgcaagaaacactgagatgtaatgtagtactttggactcatattactcaggtgactatgttttcaagcagccagtacaggacagaagagattcatttccttgaatcaaagctatttggtgacttttcctggaaacactctgaggcttacaggaagggattccagattcccaagctactggcacagagtaagcatcttttctttacatagtaattcacaaacgtccctcatcaccatatgacaatatcctcactggatcagctcggttaccagaaataactagatcaaaataaatgtcattctcacatggacacaggtggactagggtttagaagttttgggaaccatcacagttctaggcacctgaaacttcttcttttgcttgtagtaaatatggtgtctttctcaggactctgccctttgtttatttatatatctggtctggtttttgttttctagagatagttctctactctccatagtgtctgctttctcattgcctgagtttgtacatggcttgccatagcttctctaggcccaattttaggccatcagtagatttaaaaatttttttttctcttgacaccaattaccttagttgcaatttcccatttataattgcaacttgagcctacaaatttacaaatacaatgaggtaactttccactgtggttaaatattatagattattggctgctggtaaacccatgaattgcctgcctttggattagatattcagaccaggtccatttaacaattcagacatttttttaaacaatacttttttgagagtcttccatgtgccaggccctaatcaaagctcttgagatacattgatgaccaaaaagaagcattatccccattcttactccttataatctagggtccaggacaggggagatatgcactgtattaatgaaataatctgtactgaatgtaaaattccaaactgaagcattttatatgaaggaaacattctataagaatggaagcccagaagtccagtctacacatgctcctggaattttatgggaaaataaaaagtctgtcagaatggatcttttgagaagattccagaagtatgttggccaataagagaaaatgagcaagtggatgccagaagccatttcttccattgttgtgctcagtttgcagtgatactactgcagagcttgaaaggcaagtactggcttctcttcctcttgttcttccacccagaaaaaccatccttatcctcatattcctcctccaccttcaccaccactactacctattttgaggctgccaccaccacactataacatattcctccccgctctaaggctctgaatttggacctcccacatgacaggactctaaataatgactaatccattaagtttctgctccatttccaaaatattcattcaaatttgaaatgcctggggcctcttgtgtagccatggctgggctaatttctgcatttgcattttaaacaccctgaatcaggattacacctgaagactttcaaataagtgcttagatggcacaataaagatattcaggttaaaaaaaaatctaatgagtctgttgttcctttgcaaggcctagtgataggaacctcttcttggaaatatttgttaagccattctcacttgtagtcactcttggtaccaaatctgttgaccgaaaaaaaaaaaaaaaaaaaaaaaactcgaggagagagggagaaaggcaaagttactctaatgttttaactaacccatataaccacggagaaccagccctaggaaccaacactaaaatcttaaggactgttttttcagactctgaaaattctcctaaatctccattccagtatcattcaagctctttacaaccgctgtttgtccttaggctgtaacttgtgcctgaaatcccactctaaggttcccttgtggtatttttaatagtgtttgatgctgcagccagcttctctgcggtttgggagttaaatgggatacagcaatgtggtgtgctgtaatggctcttggagaaatgttagggcaaattaaattccaaataggatagcacctgaaagaacctggtcctttagtgaaagagcgtaggaaggaaggcttagagagtcttactggctcctaagtgattaagaagaaacatctaacctgagtttgaaattcattttggactcaaatacagagtatttactttaagacactggtccttaaccacctggttcttccctgtttgcttttctgcttagttaagcccaaagatgggtgttagtttaagagaaaatggtactaaaagggaggaggggaataattaacacctttgcttaaagcaccaaatcccatgagctgatgattgcctaggttaggcaatgactactaccactactaccaaacaggtctggcatctcctattcctatcctgacacccaggcccaagctgagcacaagcattgcaggattccgcagcctaatgtccgtcagcttttcctttgaacagtggttacatatcgttagtgtatttgagtcaaatgtgggtttaaggtagtggaaagacttttttctgctattgagaacagaatcaattttttaaaatgtgtatgtacacacacagatacacacacacacacacacacacacacacacacacacaccgctatatattttattttggaaaacagttttatttccagtagatctttattgaataacctatcatctacggagttcctatttaaaagttttcattggtaatggatttattccagacaggacaggttatatgtaaaatacaattcgtaaccaattaaaacaataacaaataacttgtgctgagtggttaccatgcaggtgctgggatacgctttctctctacatcatcatttcaccctctccacactgtttgaggtgtggatctattgtcattgtctccatgctataaatgagatgaggcacagatgttttttattatctccatgaaacaaatgagagcactgaagcttagagaaggagagaaacaacaacttgaaggtttagatactgtttgaggagttatagtaaaaagaaaaatgaaaagtcctctcaagttccactgaaaatcttataagtgtgtttctttcccacttttgcaatataatttttctcttctaccctcaactgaaataaggtcacacagcctatacagtatagaaccaggactccaaggtcactgacaacaaagtaaaagtcagcagttttggaaaatacatattttttttttcctagctgaggatgggttaccttcattagtgacataactatgtcacttgaatatcaattattggcttgaatatcaattcatttctctattaagaaaaagaggaaataactcagatataaatgatggaagtggctactgagttaggaaaacatttgaaaatcactttataccaagaaatcacattctggcaggcctaatatggtataggagatattcgtaactggttatcttcattgaaagattatagagactagagaataggaaggttaagtaaaaactctacaaatgataaaattttatgttaacaagtaacctaaccaaatactgtatttcgctggactttattgtagacaaacagaaattctggcaaaagaaaaacaacaaaaaataggaaatacagttactaagttaaagctcttgcatttacattataagtatttctaaatccagtttaagattgtggaaacaacaacagaagtatatgaaattctaaatgccatttaattaaagtgttgaaagagtagagatttcaacagtatcaaaacttgtgatcttcaaggatcaaagtaaaggtgagtttatagaatgctcactctaggttctgatttggccaattcaatcacaccactgcccaattcaatgaaaaatataggcaactttgtcaagcaatgaattttatcaatgtattcaaagttgaatgcatcttaggaataatttgagggtttagaaaatgtttgaggttttttttaaaaaaaatcttccaatttaactgaaaactcttgtatttcctttctacttttcaaatatagcctttgtcctttaccctccattgtagcttaagatgtggtcttgcattataaggaatatttaaaaccattcaatattttaaaccaaagacattcaatttttaaaatttaaatggaactgccatgtattcttgagtgttgtagctatacagcagtggtccccaacctttttggcaccagggactggcttcatggaagacaatttttccatggatggtggggagaggggttggttttgggatgaaaccacctcagatcatcaggcattagattctcataaggagtgcacaacctagatgcctcgcatgcacagttcacaataggattcacagtcccactgatctgacaggagataaagctcaggtggtaatgctcgcttgcctgctgctcacttcctgctgtgccaccaggttcctaacaggccatggaccggaagcagtctgtggcttggaggttggggatccctgctatatgggccagaaatgtgaaagaggtgttcagtggggagtatacttctaacttgaatacattcttttcagcatttctacttattttatcaaaaggtaattttttttctcaggaaataaagcaataggcaattgttttttatagtttttctgtacagagccttattcaattatactaccaatgtaatcctattgcactgctcaacagaatcagaataagaagaacttccaagtacaatttgaaaataaaagtatctttcaagaatttgcactgtactgcattatttgatttggaaaaaaaaaaaaatcagaccacttccatttcttgatgaaacaactaactcatttgctaactttcaactggctctcttcagtggctttgagaatgtggcacttccatcataccttgcctgtagtaccaccctagaactttttttaattgaaaatattttaaaagataattgattcgtatgcttcaaaattcaaaacgtgccctagaaaggatcgattattaacagcttcttgtgtattatgtaaacaaatcttatgcatatacaagcaaaatacatattggctagcactcttaaaaacataggaagggttgaatctgaccaagttaatatttcaaaggtgtctatcagaaaggaaaaggaaagcttcctacagttatgtgtatatttttttttagtttaaaaagaataagaacaagatattgggtgtgtatgtatatatgtatctatttatttattggagacggaatcttgctctgtcacccaggctggagtgcagtggcaggatctcagctcactgcaacctccacctcccaggttcaagcgattctcctgccttagcctcccgagtagctgggactacaggcgtatgtcatcacgcccagctaatttttgtatttttagtagggacagggtttcaccatgttggccaggctggtttcaaactcctgaactcgggtgatccacccacctcagcctcacaaagtgctgggattacaggcatgagccactgcgcccagccagattttgggtttttaaacctattgaacttatctttggatacatattttaagttttccttaactgtaaatgtgtttatgttcactagaaacaccacatgatttcgcagacatggaattatgtaggtgaaatcagcggctttcaattagggctcgataatattagatatagtataacttttatggcattcacacatactcttcagggataccctttgcaattccggaatagtgtttttcttgcttacttcagtcgatttcttatatctttaggaaagatctgcacattcattctaggtgaatgtaaaattgcattttaaatccattcattgggaatctcacttcttaaaaatcatgcggaaagatagatgtacatttttagtaaccgagctgttcagtaaatttcttaagattattttctcataacctctgtacatcaaaagtgaaaagaacctgtccccttctctctgtatgcaaaattccagagaagcaccaagaaccagaagaagatgaaagattcggaagagcacacattttccagcctgccagcctgggtttaatttcactttcccaaatatttacttggtaaattcagaaaaatcactggacctccaggaacctcatttccattactgtcatgtgggatagtgataacactatggatcattacaaatattaaattagactgtatggagaatgctccaaaagctaaattattgagtgctcacaaaaagcattcaacaaatacacctttccagttgaaaatgatcattccattaaattcaccctttattttctttgagaaaaaaaatctatgttctgcattttcaaacttacttttcatggatacatagtctgtaataaaaacagcatattaaacatacctttaaaagaacaaagacatttataaaacaataacaacaatcagcttctggatggttcccccccccccccccattaaaccctattaaagggaatacggtctctaaaagggaaatccagagacctgtgtattcgagttataaccctgggtcaagcaacttaactaggctgatattttggcttgatgtgatttatatgtaaccttttaagcaatgtatattaaatccgtactttttactcatctacttgattgcaagctcctgcaagataaactttgttgaactcaaatgttgtaaacttcatggggcttagatataaactacagacttcatcagtgtttaacaaatacttgcttaagaaacacaaagtcctgttatatcagccaattaactatgaagctaattttaataactgaaatatcatagaggttaatattcaaaacaccactcatcttttttctcattgagtattatttatttatttttgctttctggagacatacgtttaccctttatttactgtctcattttgtcatctctgaacataccatttacagctttttagttattctggaaaaatcactttgtatgaaataataggctatgatggctagaaaggatctcactgatcatcagtgcaaggattgattttagaaacaaggaaagtgaaaccagagacagccagtgactagtctcagtactcagagaggtcatggttggtcagaggtcagaactcacatctcctgacccacagcacgtttggctttgtgcacaactgactgccttagttaaggacagataattcttttctctttaacaatagaaaattagactaattaaagtcataaaagatgttgctcctttataagccatagagaaacccccgatggtttctttatttggatctgtgatctttaaagcatgtgactagcagctataattggattaaagtgaaaacatgtgattgtgaaggagttaaagtacctttgccttattctgctttgatagccagcttcaattgcacatcgtgacaagcagtgaaccaacatcaaccctgtggaattaaaactttagactctatcacaagcttttccaagttcaaagcccaccaatttattattggttccaagttctaggtctagaatcaagtcagctgggacatcaaatacttgttacaaaatgacatttgaatgagataattataaatagcactagaagcacatgaattaaatattgcctgaacactaattttcttaggtaggatattgggatgtcctttgctttatcactttgcagtgatgtgagcagtatgagatactatgttttgcaaaactgtattaattataatatttattgagtacttactatgtcccatgcacagtccaagtttttcatgtacatattattatttaaccttcactgctatgcttgcagatggatgtgtggtatattttagttaactcgctcaaggacatgcacagtaagcggtgcagctgaagtccagactgggtcaggctgactccacaacctcttaatccctatattaaattgatatatctgcccatgctatacatctacttgatctttaggttgatttattgatagtgacatttaatttttgttttcttcaaaattaaattcttactgtaaaactagtcaaggcaactgaagtttgtgtttgaataaaagtgtagagttaactgaggatttgtgtattctcattccaagatgagaagggagggagggaaggaagaaagaaggaaaagagggagggaaggaggaagggagggagggaaggagggaggaagggaaggaggaagggatggaggcaggaagtaagggaaggaaggaaggaaggaaagaaggaaacagtaaaggaaaagaaaggaaataaaaagtaacttcattcctctatagaatctctattaataaatgttattttttaaaaataaaaatacagttatttttcatgaatataaattttagaacatatttttcagtgctccttacctaactcccaaataatccattacttacatttctttttttgagatggagtctcgctctgtcacccaggctggagtgcagtggcacgatctcggctcactgaaacctctgcctcctgctttcaagcgattctcctgcctcagcctcccgagtagctgggactacaggcgtgtgccaccacgcctggctaatttgttgtatttttagtagagatggggtttcactcgatctcctaacctcatgatccgcccgcctgggcctcccaaagtgctgggattacaggcatgagccactgtgaccagcccatttcattctttataaccattatgaattcccacctagtttgagaaccactacttttgtgtggtttccaccctttgtgtgatttcaaaaaggctcgcctttaggcaaaatttagcaagaagtcaagccaatcaataattgcttgaagtcaacttttccagaataaaactgtataagggactttgaatttgaaggttacaatctaaagtttgctttgagatgggaataatacgtagtgttggggattattgtaaacctaagtgatctaattggaaattagaattgaaagtgggaaagtgaaggaggaaaaaatgaaggttggggagaaaagaaagcaatttaggagactctatagggaggaaaggatgagatgcatttcagaaacaaaatattaacgtaaacagaaaaaagagaaagcaatcatgacaaagcctaagagggctagtggaatgctagaatgaactcatttaccttcctttgatatttaggggctctattgcctgctaatttcatcactgttatttttcttacctcttatctttttccctgtagttattatcagcctaatattcattcattcattcatttacctgagttttcaggcttgtgcagagacaacagggtggggccaggttgcaagattgtgttcccaacttggaagtaacgtgggtaaggaaaaagtcacagctggccttagaagacacaagttaaccacatcccatgggtcagtggaagaaaacaagggaataattagaaaactgtgcaagatcagaagggagcccctgaagctataactgcaagaacctccagaccctattgcctttaaatccccttttaaaaggcaccaagtgaggaaaattccaagatgaatgggttacgggtctgaccttcaggaacatgtaggctgcctgccgatgtccacaacatcgtccctttcacatgcctaatacattagcgtgggccactcatttaaaatttaaaaaatttcatttagcatttaaaaattcatttgacagaagagatgtttcaaataaatagtcttcaaaaaaagcccggtctataagtctctgtaacacagcccatctgctttaggtgaagtgaggcagtaggcctggagcctcacctggttggctcttaaccacatttactttccaggagaagcctttcaccaacttcctcagaacctccaaaacaccaaggaacaagatcctgaaattgtccatagtcttaactttgttaataacagactgcatgcccctggaaaaactatttcacttctcttggcctcatcaacaaaacaaatgtggcctaaaatactttgtaagatggtttcagttgtaaacagcctgaaaactcttagtacaactaatttgggcaagtaggtttggctacagataaagaacagaaagacttagacagtggtatacattactctgaaatatttttattatgtaagtacaaataaatggatgtctaattgttacttttcaggtagcaacatttgtaggaaatgcattttgttaggaattttaaaatcactgaacagattgccatttagtttacattttcttctcacctgcagatcctgaaacctctgaacttttcttctgccacataagtcaaatatccatttatagtttttaactcttctctttggcccctaaaaatagaagatcattcctgattttaaaagtagcacttgtatgcatatatataatttttatctttaaaggaatacgctgatgattcctgactctagccagtcctttgcaaccttcaaaggattgtctccttggccctaagatgtaacattgttaaccttttatgacagaatcacgtcaaggaatattacatctcttctagttcctgtaccatatctttatgataagaatgtgtgcttgccatctcaaaatattgaccctctggtacaatcacttgtatctacttgaatacagatgtcttgttactatttctggaaaatattcagtaacaaatttttctctgaaatattgttattaaattttcttaaaaattgtttctaaccttctttactagagctcactataaggtagtctttagtttaagaacttcaacactctctgattttggtttaccattttcatttgtgcaaaatgaatgtgtacataagaatctgtatttccaacccaaagaggcattataatgaccgttaaattttccatccaagaaataaactaactccaccatccctgagtgtataccctgcccttctcactcttgtgttctttaattagacccaatgtgcaggacatgacttgactgaaatttatagccacattgagacatgcagctaaagaaagctcttagaccaggcatcatctcaaacttttaaagcaataggatcatttgacagaagtgtgactcgctatagtaattacacaggtgcaagttataactacttaatctgctcccagcatctctgttgcccttgagaagtatgatgtcctctagccaacatggctgttcatatgggactgaatctgcacatatttgaattgagtttttcaagtttagaaatgtgatactattttacccttatgtgccttccacaatcctactcctctcttaggtggatcagagtttctggaatccatcatctttagttctgcaatttacatctcagacttacatgtttctaggcataaatgcaagaatgacaacatcaaggcctatgaaacttagacttgtatgtatgtgatggtagacattgaagtttgttgcaggaaaatgtttctctgtcatcctaggaaaagcccccagtttctcagttcctcctcctccacacgacagttttttagtttttttagttttttagtttttttctaaaatggagttaagtccaggtgcaatagctcacacctgtaatcctagtattttgggaggctgagatgggcagattgcttgagcccaggagtttgagaccagcctggacaacatggcaaaaccccatctctaccaaaaataaaaataaaaaaaataaaaaaattggcatggcagtaggttccagtagtcccagctacttgggaggcagagcctgggaggttgagactgcagtgagccgtgattgctccactgcactccagcctaggcgacagtgagaccctgtctcaaaataaaatccaattatgatcatacctctctcctgttgatgtccatcagagtctgcaatgccttcagggtaaagtttaaacttccttctagaaacaatgttctgcggtaaaatgaccagggtctttggtattagatacacctggcctcaaaaaatgggtcagcccaggtataaccttccccatcttctgtttcctcatctgcataatggagtaacaaacattgtcaggaagttactggagtaattgtgtgagataccaaacataaaaagcctggcacaaaataaaagctcagtaaatgtaaatgtcctgtcttttgcctttccctcattgtctgcgacttacctttctaggttcctttctcccatgtgcatccccttccttccaaagcactcattgattctagcctgcagtgtatagtttcctgatcaagccaagctctcccacacctctgtaacttttgcgtatattgttcagtctccctgtaagtcttccctaccttcaccttttatagaaactgcagggtacctacttgccccttgagatagctattcctgaatttctcccgaatttaagcattcctcctctatactttcataaatctttcacacacctctttcatcctacaatgtcataatattagttggttttatctgtcttccttaatgtatccttaactcctgagagtggacgctacatcttagtcatctatgaaaccccagaaaatgtaatcaagctaaaatggctcactcatttcctagcaaatattggttaaatgactgaatggatgatacagggggcaaaataaatatggttttagaaaagtggcatggctgctgatctatcagtgcaaaaaggagcacacccacccactacatggccaaaaatgttgaaggcaagagactagatggcttgtgaataatatcaaatgaagttgtctttctgtaggaagtcttagacaatgtaatcttgggaggcgggtggatcacaaggtcaggagttcgagactagcctgactaatatggtgaaaccccatctctactcaaaatacaaaaatagccaggtgtggtggcatgcacctgtagtcccagctactcaggaggctgaggcaggagaatcacttgagcccaggaggcagaggttgcagtgagctgagctcgtgccactgcactccagcctgggcaacacagcgagattccgtctaaaaaaaacaaaccaaaaaaagaaaatgtaatcaagctaaaatggctttggctttccttcagtaaatggttactgtgggaatatatgtgaaatgaatatcaatactatgatgagaaacacatgcactaaacagctatacttctgatgccattctcaaatctgaaactttgcccaatttcagggacaaaagtgaagtaatatgtatccccagtgtttagcttttctcttgccatggatactaacagtgagattcctcagggactgttcctttaacctcgttagggttgctaggggctattgtgcctttcacaacacagcacctgcaactgggaataattgaaattttctgccattagctattcccagcagagtattctgagtcacatagaaagtgtcagaagcatataaattactgatacattttttaatcccatattccctcagggttggcgtttttctctcttgaaagtttcccccttaaggctgggcgtggtggcttacgcctgtaatcccagcactttgggaggccgaggcaggcagatcaagaagtcaggagatccagaccatcctggttaatacggtgaaaccctgtctctactaaaaatacaaaaaattagccacgcgtggtggcgggcgcctgtagtcccagctactagggaggctgaggcaggagaatggcgtgaacccgggaggcggagcttgcagcgagctgagatctcgccactgcactccagcctgggcgacagagcgagactccatctcaagaaaaaaaaaaaaaaaagaaactttccctcttaaaatattcttgtttaaatctaaattaatttcatagataccatttccatttttctaatgaataatactgtatcctttcctatctataccatgaagtttttctttgccttgaaaacccatttagatttatgatttctagcccccaaaataacttttgttcctatatccaattccttccctcacagttctttcacaatagcttcttttctcctgtaaaaccctacataaactccaaaaacatttctagttttggaaatcctaatccaagaggtcacatcactaacgcaaacgtagaaatctttgtaccaaaggacagaggtgcaagggaagtcgggagttgtggctgtgggaaagtgaggaggactctttggcatctgggcagaggtacagggaagccaggatgggggcagaaagaaagtttctcagtttctcttgtgtctacggttcatgcttaggcctctgcagcagccccaaggcaggtgagggtgatcagctgttccagtttgcctggcactgagggatttcctgggatgtggggcattcagtgctaaaactggggaagtcttggacaaattaggacaagttggtcaccctacctttcccttgctgctgctgtccttttaaagtcctcattcctttgaaaattgcagtgatcttcagttcttcgtgattttaactgtatacaaatattcaaagagcttggaccagcacatttctcagagagagctctacttacagtaaatgttatgtgacagagcaggatagcaaatagatgttacctggggcaactctaattgcttggtcatgactgtcgggagtaaagtgttaatagtttcttgcatatcctccaagagagtattacaaatactattctgcaccaagctctttgtaatttaatagtgtatcttggggcccttttgtatggacttatacagatcatgatctagagataatgatcattcttatttgacacatagtattgcattatgttatgtctaaaaacccatttaactctattgatagtcttgtgggtcatttccagtttttactacaattaatacaaataacactgcaggcatccttgtgcctgaacatctttgtgagtttacccattgaataaagtcttagctgtgaaactgaatttaaaattttcataaatattgccaagctgtcttctaaaaagaatatattaagttacaatcccaccatcatcacaagaaatgcttgtatttctatacacactgaccctgagattcacaaaaaacatattttccccatctaatttaattgcaaagaaaattagtcacctttcatacatttatgggccagttccctcctacctccaaagactcattgaatcaattatcttgaggagtttattttttatggatatgttaatgttttgagtatattaagaaaatgaactctcctcatttgtgtaaacttttcaaaaaattttaatttgtttagggttttttttttttatcatttagtcttttaaaatatttgagtagtcaaattcatcctttcagatggtttctggacaccctgtatcttttatgcttgtttttcctggcattcggtgcagtacctatcacaaaatagattctcaataaatgttttttaaataaatggacaacgaatgcatgaataagtgaaggatataatttattcttttcattcctcctcatgctatgtagagatttgcaaaatgaatgccaaaacatatctttgaacagaatttcatggcccagtatcttcaggcagtggtttttctgttttgttcaaaatgatgtccctatcatctgcatagtgctggcgtatgggagatatacgtattgaatgaatacataaatatagagaataatgagataaatagaacgtggattatttggagttcatcctcctgagctaatgatgggcatttctggaagtgctgggttgcaaataagtccagaccagagaggattgtgtttaaaggcccagaatctcaactgataatcctcagaagctcagatttacttttttcattccaagtaaattaaactggagtggtaagaaaaagaaaaatggttatgaccatcaaccccagaaacagggaccacatttaattgaatttataatgtccctaacatctctgctgtgtttgaaaggttaaaaatttcctagagaaaacagcttttgctactacttgccaaagtactcataaaatggactgattgctaagaacagaaaacaaaccaaatcaaaataaaatgaaccaaaaagcaacagaaataaatgtgccttaatgtagttggatgattaccacatctactctcctcagaccaccagccttcagagtaagggcacatccttccaaataagtgcatccttgtcagggacatttggtgaggtgcaaccccttcaatgtgtccgtttcctgggtcatttggggtcttaggaaaatcttcttgttggtgcgcactgaattgcacatgcattatgtaactcattgcaacccaatagctgaactcatggtttcatagctattaaaatatgccacaaaccaaaccacctgtgaggcgccaactcagcaaatgtgccttttcagaaagtagtcataaaaggtacaaaaaatgaggatgaaagaaccctgaataacaacctagagctcatacatttggagccatgaggaaaagtattccatgtaagttgaaggaagatagcagtcaggagcattggtgttgaagaccaccctcactatgagaaagggtcatatatataatgtggaatgaatcagagctaccactgtgggtcccctgttggaaaaactgcaattttggataattatgtgcaagcactaggagaaatgccagatgttagaatccatgtttaatgtgaaaattgcattttgttgtttgcagaacctcaatatatagctttctctataaaatgtgggcatatttctgaaggaaagaaaaatgccagggtttcgttttaacatcctgttacgttttagttaaattcaaaggaacatgacttttcaaagagaaaactgtctctctctcataaaatagcattaagtggttccaaacatatcttaggttataattgaaattggactctgtggaacaaaattaatgatggtttgttctcaaaggcccattgtcccgttgattttatcagttattctttgttaataaggtggtaatgtggtcttaagagcttccactactgagagaatccaaggaatcatagataagtaaattgatgtcaaatattatgactttttctctttcattcttgtactgtatctagttgcctcatctttttttctaaatctcacagtttttgatcaaattccctagggacagcttacatgctagctttatgagggaggtgagtcatgcaatcccaagaaagcaaaagtggagttgagggggtgaaaggaacagcagtagggaagaagagaaaccatgtacaaggtaatgcattactaagcttgtcagagcttcccaacaacaacaacaacaacaacaacaacaaaactagttgctaagttacaagggacattgcctgtgaggctgtgtcgtaaaacattccacatggagaagaaagggtgagcaatttttctgtgcataggtcttttgtctctcattggtcaaagtttgctccatggtacccttggccctcccagagtccctggggaatacagagcctttgtccatctcacgtgtagctggatggttcctgtcaagtcagaggccattgcccacgctaagcccgcaaggatggggaggtggaaaacatgaggcaattgcagtgataaccgctgctttactggggctgctgtggcatgcctgggaaactgggagagtggcttatgcccaaggggtagggtgggcagagctgacctggggaggccacaaacaggacctagtgtacttttctacagtatactagcagaattagaatgaatcagacaagagatttattaaattaagcttttgtaatgtcctgatgtagtgcactgtattttaatgctgtgtcttctgttgcttgagttcctaatttgtaccaggtgttgtgccaaatgcttcaaataaattaccttgtgaaatcctcacgactctatggactccaatttacaaatgagaaaactaagacttaacttgcttatcttcaccaagctaggaagtggcagagttaaaatttgaatccaggtctaaagccattggtcttctatgccatagaatcggcatccattttgctactcttactagaaaatcatgaatcctagctatgaattgtagtgaggaggaaagttttttctgtttcatgtttatgaaaaaatctctacctttttcattttgtgtttcatgcatgtgacagcattttcagagattttgtgtaagagtgtgtgtatatatatattgtatatttacagacagaaaaaaattgagattaatttttcaattctctaagtcataagagaatggaaaaacagaaatggacaagcagaattttttatcccaatgtattctttgacatacactggtcataatgctaatgttagcaaaagaaataaagaaatccctggtgcaatgggatgattgaccttcctttagcagaacagtgttgacttgttaccgttgtcaaatcagactgaacacattcaacaacatgatcatttctacttgtgggtttggactgacaaggacatttctagtatatcttgttgacatcaggttaataagctctaagcaaagctgaaaatgaatgctacttcccacaatcaagtggaaatgttaatattatcaacatgtcttaaaggccatgaagtcctatgcctgtatatgtaacaggaatagcaaacaggaacttttcttaaagggaagattaaactagtgttatttttatgtattcgttaattgcatgctccccatttttaaaactgtacctgaaaatatactgtaataaaaaattaaatttgaaatattataccattgaataaggtcctctggatagttttgagatttaatattctttatttcaatttacatgtatactgaatcacgtaaaagttatttaggtcagtacttccccacatttgttccttcatgacatacgctgataactatatttctacgaaaactgcagtaaataaaggatgtggcttgtgttcagtctcccacccactagcgacaagagccaagggaaatcaatagcttggctcacctgtcatctccactctttggcacaccattgagaagtctaatatgtgcaaagaaaagttaattttactttcaagggttatacctttgcttattccaaagaacggtgggggagtgtaccagggccattattataatgtatattattaaactttttacattttaactgatttctcttatagtaaaattaattatatattagctttggggtatacaaaattgcactttgataataatatttaggaattggcaactttgtgggcaaagttgtgggaactatcagaaaagtaaaaaataaaggtgggacccgaaagaaggaaggattgtaggttggagccatacgcgactagaaactaagacatgtatccttaaaaaccctcaaatctgtgttctgatgggaaaaccctgctaagtcaatggttcccagactttggaatttcaaaacaaaaaactgtgaggcccaacatacaattaccaactcttcatttttgccaaacaaaactattttcaacagaacacactaacatatactggaaccatgatttcatattatgacatttattttccacattctatatacttttaatatgcaaaacaaggacaaaaagggcagtcatctcccatggggggcttagaaatctctcattaatgtgtgtgtgtgtgtgtgtgtgtgtgtgtgtgtgtgtgtgtgtgtgtgttttaaattggccttattatttctttaaatttaaccaagggccagtaaaactcccttttggaataccacacgcccgtgctgttcaggaatgattatgataaagtcattcatgaggacatagagttatttcatatgctctcaaaaatgacttgcagtgcgaaacacagctactattggacaagacaacaacccaactttatataacaattttttaattcactagtacttgtgtatcagtcaataaagtacctggtacttgtgtactaggcactgggatggagttggggatacgaaagtgaaaaatatagtcacaatttctaccttatactctagtaggggaaagaaaaacaaaatgtatgattgaactgccttaagcaccatgaaggcaacatacaaattgctgtgagagcatataaccaactcagaaatcagccttaaactgagacctaaaaaggactccccctgtgccttttgtatatttaaggcatcttttttatattctagaaatacaatatcattgagcagatagattccaaagggccatcttctagctggatgaaatagaaaagggcaccccttcctcaggctaacagccctgcctgctgagggcatagttaggtgaatggatcatcactaatgaatggatggttttaaagaagggaataacatgaccaaatttgcatttaactttactcaatagtctggagtatttaaatatgattaaaccttttctttccattcacttgaatgaggcagaagggctattcaggaatttaaagttgactaaggtattgattgggtacaaaatttttactaggtaggtaagggcaggatgattccattagaaacaagaactttttctccagtgctctgggaagaattgattggttcagggctaaatcaccaagatgaataccttcttttgattcacacacccttttgacatctgggtttccctgaatcatatgcaatctaggacttacgcagaccactccagtttcacttacgaaatttgggttagccaacttaaacagtcatggctgtaatttgcttctgagttaaaatgctattattattttatgttatttatggattcctgcaaaggagaaagcatttttattttgataaattttgttattaatgaaattaactcaattttgtagtaacatagtatacagtgaaaatgtgctttacgagatgccgtggcttgtctctcaaatggacaatgaggctttccgaaacctttgtgcctttaagtttaaggaattgatttggcgtcttatctcagtgtacacaaagcttagttatcacctaggaaatattggatgtttgtctcagggagaagagacaatttttgagaccacaattaggttttgtagctatttgacatccaattataatcagatactcagtgaaacatgcattcataatgcaggccaatgatcatatatttggcttagcttttcactagaaaaattctttaaagaaatattgtccttccaattttagtggtactgaggaacagctctggttataaggggggaaatactatatgtcctttgttcaatcttactaatctttattaattttatgattttccccatttattttttaaaaatcattaataaaattatccttgattgagtttctcctatgtgctaggcattgtgataggactttagtaaacatcatctctaaccctttcaataaccctgcaaggtagggtcatattttatagataaggaaactgaggctcagagaagttatgtcttgaaattatatagtagcaagtggttaagccaggtttccaacacaggtttgtctgactctaaaaccagcatctgccccatctcctcaccattcgcgaccagaatgtgatgcacgtctaccaaaaagagagtagcaaaaggtgatttatagaagcagttacagtcctctgaagagaaggcaaaactattggggatagggaaaaagtaactataaagatcatatttatataatcgaatattaacttaatggcttgaattaggtggcaaataaaatatattagcaagcaatgttacaaaccatggtgagagctatgtagtagatgaagcagaatgatggctgggctcagggagctcatacatttggaacccagataaatctttgctccttcttcccagagcccatcatcactttttaaaaacacgtctttgctgggctcagtggcttacatctgtaatctcagcactttgggaggcaaggcaggaggattacttgagcccaggagtttgagaccagcctgggcaacatagggagatgctgtctctacaaaaaataacaaagaacaaaaccatctgaatttcatgcattccaacatatattattttgttccattctacttaataacctttacactagttgtgaaactcactgaaaacaaaggagaaactcattataattcatctaaacattcctgaaatatcactttaatcaaaaaattaagaaatattgctcagatttaaaagaaaaatggaaactcccttggcaagtgggtttgaggtttggtcattaggttttgaataatcaggagctatgtgttgtagtaggaaaagcataccatttagagagagacagctttagtttgtcagtcctgcctcttaataggtggatgaccttgagtaaagcatgacgcagcctttgggcatcagtttcctcacttaaaggtagaagggttgaaccaggtgtaagctgctgttcttccatgttatgattctaaatagttctagatggaattatgttgcacatttcatatgttgttaaacagcttctctctggaacagttgctcctaatctcctaataagcttactatgggtcactcagcaatcttcaagagaaacaaacattatttggttggtggataccaagacaattctgatgtgtttgtgtcaaagattggtcagatgaaatctaactagacatgtatcattccatcatcaagcgaaatgaccttgactctaaacatcttaatttgaactgtagacatttcccaaatgctttagggtagatttggaccataatacactccactgtaaatggagaaagttcatcatccccataataattgcccccaaactgctaggtaggaatgcatactgggtttagtatgtattaactcccttgtgaattcagcttttgagagcagacctcttaacaagtcatgagtatttagagtgaaatatttaattcttagtgatactattttcctattctgctattattattcagctatgattattttccttctcctcccaacctcctatttctttttctttattaaaaaaaggagaggaggtgcatgctgccatctggggtgaatatgggcttcacgtggggacctgggcgctggttctgatccagagagtgagctaggagcacttacacaagagggtcttagccactgtgtcgggggaatagccttatatcaaagactgaagccttttagtaaaacctgaagaataatcagaagcagcattgactagtctctaaccttggttgagggacacacacacacacacacacacacacacacacacacacggctctgaaagctcagacacggaggacacgctgtgatccacttagccctctcttctccttcagggggtccttgcaggacagaacgctaaggaacaaagtcttaactggcaagctgccggcagaaggagactgtctggtggattgcagcgctgattaggaacggggagtcctttgcgtttcagaatccggtccacattttgctgagagcccaggcactgtgaataagaggagcctctgaggactggtttctgatgtcgcactaggcatgataagaatgccattgacgtcagcagagtcatcatcagggagaatggcaccccagctcttgaaaccacaccaagcaattgcagtgcttttgaaaattaaaagccggtgctggagtgtggggggtgaggtggggggtgggggggtggggagggaaagaagcaaagagggaagtcgtggctccagctgaactcttctttcttctatgcgtttcctgtattttaaaaaggcaggctcacggccctcctgtgcacacgcccgctcactcacacacactgctgcctgggctcattaacctaaattgggggaggtgggggaagaagaaagagagaaagaaggaaaaaaattaattctgttaacacttctgcatgcacataaaacaaactgtgccacccaggtgctggacagaggccctgagccacataagcctctgagaatcaaattgctgaggtaaaactgatatgctttaaatgtgtgttgatgaagagattacaagggaggaattaaacacttcaaaggagctactacaaagcaacaatcactcttcccccatccctcacacacgcacattactgtggacgcttgcatgtttgtgtgtctgcctgagaaaatggcaaagttggtttaggaagggaacactgcaggcatgttgtgatttcagctttcacaggcagctccaagaacatcacctccagctataattcaacggttacctggactggaaaatgtcttggaggttacgaagtctttgaattctttagtgtaaattgtctccgctttgaaattccacaattgatcgaatcctttcattctctttcccactcctaattgttccactctaactctccacccaccgccaggaatatgaaaacaacatagagtagaactgatgatatcagctgtataacacgctttattttacggcattaatgggcagctttccaagtccataaaaatcttttgctgatctgattttaatatccatattcttcagttatactagaaagaatgatttccgagatgtggaaatgttagccgggaaacaaaaggacataggcacataaagcaaaatctggcaggaaatgtgggtttaataaattgaattatgtgaaactcctatttcaaatggactgatactagaggagcagccctcgagagatatgcacagtaatgattcttcgttttcaaagacctgtttctttttgaaaaggaagaagccctgaacagcattcctttcaaatacacaaaggtagctaaagtacaaccttctcctctttcctatttgttctttaaaaaattgtaaaaattatattaagtgtgcttcttgtgatagagtcaataaagggagaaggagtttagcaaagcacatttactatatactcttaacccgtcttgcttactgtaataatcgaaagaaagatggctaattgtcttgcaggaatttgggttatcctctgaaaggatacaagtaaatttgtaacttgggtcgtattggctattttttgttctcttttgctttcatttttgttttgtctgaggtttataaatggaacccttctttcctttcttccttttttccttccttccttcttcccttccttttttcctttcttccttgctttctctctctctctctctctctctttttttttttttacaattgtacttaaaagaataaaggattctgaaaatcagttccaggatccaataagggcctagattgtatatcacaggatcagagccccttgctctcaaatttatgattgtgaggatgtattattgtatttgggggatcaataagcagagccagagccttcacacaaggctccttgtgccccctcccccgctccatcccatgaggttaaaaagcactgactttgactttaacactgtgaacaaaatacagaacaactgtttcaattcccttcactatttctgctatgtgcctagattagatgttttctgacctgtctccctaagttgttcctgtcacttgtgtctgtcattcgctcccccatcgcatcctgcccaaccctccctgtctatgattcgaattgctctctgtccagatcatttcctgcagtgaaaaacgaagaaagactttctcccttcttcccacctacacattccttttgtcccccaagatatcccttcctcttgcctggaatcttcccaggccttaattgattgatttaggccccctttgcaccaggcaccctagcggaagcccagaaagccccaagagtctggatgtgttttggagagcaggctcaggttcactgcacactaatttgcagcaggaagtgctaggaagcccgatgagggatgggaattagcaaataaggttggcagtcaattgacagaggaagcttaaggaagaggatcattttgaaaaggaaaaataatttaatccttttcaggtgtgttaatttctttcgtggaccaaattaccatggacctggaatagttgagattttccctaaggtctggctgtacttcatagggaagaagcaagggtaagtgcagtaaatttgattatggacaccagtctaactctagcttaatgagccatggaaacaaaatagctcaatctcttctaactgctgtaatgcaacactaggagcattgagagcactgtggttttggttacacaaatttgtagtacaggccttgcctcagcatttgaacatttcagcaagagagctgaacttgcttcgttcttcatgtagcagatataagtcttttggaattaatttgaaaaaaaaagaaaagaaaagaaaagaaatgtacccagaaagcaagagatcttaaatgtatccaaaacctagaacaaacaaacattaacatttgccataattactgtgggtgtttttaataaaaatatatagatagataattttggaggttgcatttccccaccatcactgccagcctcatttttcttccatcctctccagaacaacctctgccataaatttaggaaatagtcaacctgttcacattttcatctttttactatatatgttcttattcacaaacgaatatgttgtagttataaaaagtcatcagtatcttttagcttatttttttaaatgcaacattatgtttgttggatcattttactcttgtcccagtgcaccctgtaattcccatgaattgacaggtagcgatagatcagcagtagtaaagtaactgatatgggtaggttaatagaatgacccttttaagaagggatctcaaagagggaggctaggtaagctacaaaattatcagggcgaaatgcagtgaggtagaagtgaaagcagcttagagtcagcctgggctaagataaatgaggagtggagctgcagctggaggagcaagagaatatggtctactcgagtataaatcaagcttgctggtgagcagtttaggactagctcctggttttacagcaagactttttatgtgatcttgaccaaaccactgcacttgattgctcctttctactccttggtcctcacgtgtcaaataaaacccctgaattgcagagccaaaatgcaaacaaatagaactcctcactcaacctccctcagtttataagtaaggaaatgaagacctagtaaaacattataacttacagatacctgtcagggcagaaccagaagctggacttgggctaggaaaagttgttcccccctgattacattttccaaaggttataccttttccacagtttctaaggtaacatgttgattgacttgacagttgtagaaatattaggaagtggtataaagccaagaccatgtttactaaacagtgctgctcttttttttacatcatacagatgagaaagctggtgctcagggaatttaagcaacttgcccagagtcacgtagcttagaagtgttagagccaagatttggaccccagtctttctcactttcacagacttgcttttaaccactgtgttatgctatgctgcctcagtataagctcctttcaaacaaaccacttccagtctctgacatgcaagcccagaagttttcagatttacaatggcatactttttttctatctgctaagtgttagatgtcacggtgtctgcaatggagtagagctttagaaatgaggataaaacatttggtttgatgttagtattaagaactccaatatccaaggcaggaaacttggtaattaatattttaaatggactggaggggtcacaggtattaaaatcaatattttgatggcaagataacaatgtaggaacaaataattggagatgtttagcaaaattatgaattaagtagatgtataaacggcagattatgaaagggaaacaaagattacctgggaagagttttgtgttttagtcaactgaattaccagaatgggcagaaaaaggaagtatcaaagaagggtctgctgatagaaaattaaataaagaagaagatgccatggaaacgtttttagtgcaaatacactattgctcatggctgaagacagaaagaagactatgtgtgacttccagatgaagttcaggcatagaggcagggctaaataaacaagcacatagacccgagaattctcgttgattgatctttggaaattcggtataaatatgatcagttcaaccatgccttagctactggatcaaaggagacatctaccggctttgggagataggaatctggaaaattgacagactgaaaaaaccaaaaccaaagaaaaaaaaaaacaaaaaaaacagagaatgcagaatgccattttaaaaaccctaagaggctgtgtctgatgttacaggactctttgactccattagtctcaattctaatatttaagttaagtgattgtgggcatagaatttttttcaaaacctgtttcgaaatgaaggcttcccatacattgaagttaaaagtggtcttgagaaaagaacttcttaataggtaaggggttttactttggaatgttgaaaatgtttggaactagatagaggtggtggttgcacaacattgtaaatgtgctaaatgccactgaattcttgactttactatttttaagtttatgtgatatgaatttcacttcagtaaattatctttgttggtgcataattactgtatatatttatggggttcatgtgatgttttgttacatacacaatatgtataatgatggaatcggggtatttacggtatccatcacctcaagtatttatcatgcctgtgtgtcctctttctagctattttgaaatatgcaatacctgttgttaactctagtcacctaatctgctatggaacattagagcttattctatctgtgtgtttgcacccattaatcaatctcttcatcccctcccctcccacctacacactcctcccaggctctggtatctatcggtctaccttcatgagttcaagttttttagcccctgcatatgtgagaacatgtgatatttatctttctgtgcccagtttatttcacttaacataaagatctccagttccatccatgttgctgtaaatgacgattttattcttttttatggctgaatcatattccattgtgtataccatgttttctttctttcttcctttctttcttgctttttttttttttttttttttttttgagatagagtcttgctctgtcatccaggctggagtgcaatggtgccatctcagctcactgcaacctccgcctcccgggttcaagcaattcttctgcctcagcctcccaagtagctgggactacaggcgagtgccaccatgcccggctaatttttgtattttaagaagagatggggtttcaccatattggccaggctggtctggatctcctgaccacgtgatccgcccgtctcggcctccaaaagtgctgggattgcaggcataagccactgtgcctggccgtataccacattttctttatccattcatctgttgagggacccttaggttgattctccatctttgctattctgtatagtgctgcaataaacttggggatgtaggtatctctttgatacaccaatttcttttcctttggataaatacccagtagtgagattgccggacatagtggttagttctatttttagttttttgagaaatctccatgctggttttcatagtggctgtactaatttacattcccactggtgatatgtaagagttcccttttctctgcatcctagccagcatctgttattttttttttattttttattattttttgcatttttaataatagccctctaactggggtaagatgatatctcattgtggtatcaatttgcatttccttgattattagtgatgttgagcattttttcatattggacatttgtatgtcttcttttgagaaatgcctatttatgtcctttgtccacttttaatgggattgtgtgcttttttactattgagacgtttgagttcctaatatattctgaatattattcccttgtcagatgagtagtttgcaaatattttctcccatttaatagattgtctcttcactctcttgattgtttgctttgctgtgctatacagaaatttttagttcaatacagccccatttatctatttttggtcgtgtggcctgtgcttttgaggttttagccataaaatctttgcctagaccaatgtcctgaagtgtttcttctgtgttttcttctagcagttttatgtttaagtctttaatccatcttgagttgatttttgtatggtgagagataggggtctactttcattcttctgcttatgggtgtccagtttttccagcatcatttattgaagagatctcctttccctaatgtatattcttggtgcctttatagaaaatcaaatgtatctatcattatgctctctgtctactctaaatctatcagtccactctgtaaaaatgtggatttgtttccaggctctctgtattattccattggtctatgtgtctgtttttataccatgttgcttttgttactatagcgttgtaacatatcttgaagtcaggtagtgtgatatattcagctttgttctttttgctcaggattgctttggttagttgtgctttttttttggttccatagaaattttaagtttttttttatttctgtgaaaaatgacattggttttgatagggattgcattgaatctgtagattgctttgagcagtacaataatttttttttttaaagagaaagggagaaagaattgggcactaagtacatcagagtagatgtttatcaatttttttaaaaatggtcttggctaccataaactgtgatgttcttgagagcttacattgtgtcttgttgattttggaattgttgatactcaaagtgcctgacacatagacttgattcatatgtatttaatcaatgaatgaatggataactctgacctcctcttagtgaagtgcacgtcatggggctaccacttgactatatgctgtgggatagatcaaagaaaggtaggacacaaccttgaacaaaattaaagtaaccttcagcttgtttataaaaagtgttctggtggagaaataatgaatcttttcagattttagagtgttgctgatttgatttcaatttgcatttttaaccatcagtctctgtggaactttagtttataggtaggacttttgattgagcttggtggctcacacctgtaatcctggtgcttcgggaggccgatgtaggaggatcacttaaggccaggagtttgagaccagcctggggaacagactctactaagaataaaaaaattagccaagcagagtagtgcatgtctgcagtcccaactacttgggaggctgagcctggaggatcccttgagcccaggagtttgaggttacaatgagccatgatcccaccactgcacactggcctatgcagcagaacaagaccccatctcaaaaagcaatgacacacagaaaaagcagaattttaatttgttctgctcttgtctctagcacttcatatccatttctctgaatatgaacagtgggaaaggtagtggaattgaaatggatcatagaatgtttcctctactgataatttttactccatttggagtatgattgaagagctaatgtcaagatgcacagcaggactcaatgattgaaaaatagtgttactgatgtaaaagtcaccatattttaagctttctttatgatagtcttccattatttcctttgtcatattagcaccactggaaaaacacaagttatacgtagggtagaaaatgtaatgacaatttggtgttttataaacaataataaatcagctttcatgaaattaggctatgtcctctgctctggtgttagaacttacttttgcctgagctcactaaataattatttcaatttcccagataaatgtacttctgtggacagaggccatatgctggtagcccctatacaatatatagagagcataaatttcctcttctctcttggtatttaaaattaggatttttataaaatgcattttattcttattttgcttctccatcattagaaagattcctggatctgtaaaccaaaaataatagtaataataatgataataagattttggcaatttaaagagaaattcactttcgtgaatatggtcacgccagctatcttttgaaccttaaaggaggcaggaagaacatttgaattaagaattttggagtattacaacctcatttggttctcagaagctttttttaatttcatcttctccacgccagtttatacaattctctcatgcctcactttacttttatatcttttcttaaaaacagtttaaattgtatcctccccaccccactttatacaattctctcatgccttactttacttttatattttttcctccattcttccttgtttcattcattcactctcccaagtcctctggcctaagttttatttgtgtggtattaagcagagaccaacagaacaactgtgaagacttcttggggataaaccaggtttcacttgaattgtggtgcgtctgccattggtgtggaagcagggcagaaagaggacagaggcataccagcaagtacagacatctaaacacaaagagaggagaacaacctcagggatactccctcagtgcctgggaagaaagcaaaacttaaagtgctcatagaattgtaaataaactctctcctctttgaaatttatgttcgatggttgctgtgtagttgcaacagtgtcataaagtccatgaggcctattttttttgagtaatcaatattgtggaaaagtgctagagcagacctaccttatataaattaatttgtttgaattgctctattcactatgaataaatatttattggagtaccttctatatgctggggacctcagccatgagatacgcaggtggaaaaaataacacttaagcagcttattgtatagcagagaggtggttgaattgatagacaattaaaatacaacgtgttgaaaggcctgttaaagccacagggtcactcagtggcaggagggattcagtcagcctgggccagccatggcaagtaagtggcctttggaaagttaccaaggtaagacatacctgatacgttcaagaaacaattccaaggttcaataaggccagaagttaaagggcaatgtaagccctggaaactgaggctagaaaggtagaaggatctctttttaccacacactgtgccgggcaccatgaagaatacaaaatagctagctattatggagcctacactttaatgtgtgtacatagatacatgtccatgttggaatttaactccttgagaggtcatgaattacttagtcccggaagcatttgaatttatactggaaagctatagtagagagttgacaaaatattttaaatgtagtaagaagaatttgacaatctattgtgtggtatgctagcaagccagttctccttcctccttttctcaccatcccaccacccctcacaaaaaaaaaaaaaaagttaaaaacctgatctgcagtgtttgtctatggccatggtgcaaatactcctcccatggctggttccaagctaccactggttcaacagttcttttgcagaattcttgaatctttaacacttaacaagatccagttccagcatattcctgcaacagcgattctgcagttctcaatgtcaaataatagaaccaaaaagtcatataagtactacaaagaagaagagagagttgagagccagcttagccaggaaatgctccagggggaagtaaggcttgagttgggacttatagataagaaatgtaaataaaaaggaacaaacactcccaccgtgatgcacaaatattggatcatgtatgtgtgtgacaagtgtggccgtctgtagtggagggtccaggtaaaatttaggccatgaaagccttggtctgtcaaactaatacattttgttacattaaagttagtagacagccattaatggtttttaaaaacagatggtcatagcaatgttttgacaaaagcaatttttaaggaagattttgtttttataaaaagttgaattattgatagcagtgagaccccagaatagaataagagacctgcctcatgtaagtgagagtaattcaattcagcagtaatcttggaaatttgtaacttctgtggtgagaaattgtatcctgggatgttgggtaaagccactgtgaagccaaagaaattagtggctaaacgtagagaaattaagatgaaggaactggcacatggagccactgtgtactataaagtatttttattggtatttagtcttgctgttattgttgctaatgattgtattgaataattaccagctgttgttagttatttgaaattaggtgcctaaagcaacctctcatcttgcagaaagtcatctttcttgaaactttttaaaaacttgcttgaaacatggagacttggaatgggacgtctatcatagtagcacatctgaaatccttctcattcctgctgtcatttctgtcctttcgcagtccactttgtcaccacccccaccattccttgttctgcctgcaatccagctttccagtcactttctctacttcttgcctggctgcagcgtcatcatttaaacagctctgggttggtatctcctttcaccagaattcctgcagccgtggagtacgtgcagagcatcttccttttgaccctcttaaaatgctgaggggtgtttccgacacacattgctttgtaattcaataatagggcagttgtgggttctttttattgcagttatgctgatttttaaaagcactctgagtaagaaaggaaaggtagtaaaatatacgtgtacctcgatgctcattgatcacgtttgcacatgttcttgccaaatgttgtttttaaaacctgtctctgcaggtctgagctgtgaaagtttgggaaatcagggtcagaaggcaaaaaaaattcgtttgtatcatcgtcatacaatataaattacatgtagcatatacatagaaaacaatccaagggatgagcttcctggaaatcattccttcttgtttactctgattatataatggggaattgtatgctttatacaattttaatttcttgaatatatgtgctcaaaaaacattataatgtggttcagtactatatatgctgaaaacaggttgctaatgaatttggacaaagattcccattttatttcctgtacgtttacacattttttggctgtatattatatttactatatatatttattaggactacagcaaacgctaattcatcgactgagataagaaatgtgttttccattaataattataaatctgccagaagattgtgagatttacattgttggggatctaaacaaccaaaatcattgcaaagttattttaaaactattattaattatttatgtaatcatagattatggcttgcagaagactgaagaaattgttcaacaaaccatgtaggttttgtggaagagcagtagactttgataagtaagctcagagtggtccattaaccttttctctatatgtacattatgtgttgataagcatgatatctattatacctcaattattaataacaatatacatcctaactattaagaacttagcctgcaaccctaatagtgtcccctttcttctagaacatagatcagcataaggaaggaagcaaaggaggtctctaagcactcaaaatagatgttcacaatgttcactcactgaagataatgtaggtcattagccagagaaatgtatgttcatattttagtgatgattcatacaagcttggtcatgtggttctaaaccttctataattggatgaagcaaattaagaaaggctgggtaggagatttcagggaaagtcacaactgatattagccaaatgtcagctgatggcctgaaaacaacaacagaaaaagaaaatctacaaaatcatttgaaaaccacagacatagctatttggggcctttttgaaaggggcaataagctcaacccatctttggaaacactgagcgcatcctgtctggacaactgagtataatttttggtgttcaaactgatgaccccaaatcatcaaaaaatacaaaattatattttgctcaatctgtattgctcttctatattatggtaagatttctgtttagtgcacttaaaagtaagactacccccaaatttaatccccatccccttcaatgtctcctcctggacattgctccatctatcgccccttctccctctttctttgacctactctttgatggctgcatctccttcaaaactggttgaagttcctaaggaaaaaattcccttcctctttgatcctgtatcttccatcagttattaccacatatctctattgattttcgcacccaaacttctagaaagtttacacttatcattttctttttcttttccccccacttattcctctacccccttgaagttagcttgcagccccaccactctgttgcaactactgctgtagttcctctgctctcccaattgccaaaccaagtagatatttttcagttcatttctcatcaagtttctctaagtcaattgccagtgtatccctctcaaaaacctttccatctttgcatgaggtcgtacactctttcttttcctttccccccacccttcctttgacctggggttcccaggatcccattctccattcctgctttcctcactctgtgtgtcttccaagactgacttgtgcattcttattttaattaccacctgtttgctgaaagcccctaaatttatatagaaatccatcttaacctcttctgcaaagcttggaaccccaatatttattggaaattcccaactgagtatcccatgggtttataaaattcttcatatccaaaaccaaatttagcttttcctctaaatttgtgcctccttatatatctcagttggtgacactacccagctatcatgttcagaaaataaaataaaaatacgtcataaaagcatcaaaactctataaatttatccatgtaaggattgccaccattaatatatactttaaatccttccaaatgtttgtatacttgtatatatttaaagggatcatatttggtgacttactgctataacacatttttcccatttaacaaaaaaaaaatttttctgcatcaaagtatacttcaaaattatttttgtagttgctcatgttctagcagttatttaactaataatgttaaacatttacatcatctttgcaactttatttctcttgttgcttttttcttaagaaatgactattgaaaatgacccccaaaagggtatataatatcagtgataaaaattagctcttggaaagggaggagagaattttctagtgtatggtagtagcagtaacagtggcctagttacactcaatatctcaatatgtaatgccatttatggacagcttactatgtgccacactctttaaggactttgcataatcctcaccacaaatctgtgagattggatacattattgttcttatttcatagttgtggaaactgaggcccggaggagtgaaatactaggccagggtcacacaagtagtaagaaacagagccaggagtccacctttggcagtctgtttccaagattggtcacctaacacaatgcttatctgccttttgttgtaccctagggcatcctttctaccagagtgtaccacttcgctttatgtttcttagaataaaaccaataaatagtgcagttagttagctaagttttcagaaattttgatagatagtgtctagagaaacaaaaaagacacaatttctaagatgtagtaatgaatgtttcattcatgtcggtgattattttgatttgttgatgtgtttttgataacagagtaggcaaaaaacataccatcaatttaataatggaatcctaagtttaggtttaacatgatttttgaagaagaatcaatgtgcaaatgttgatgtattttcagagttatggttcagaaatgtgaattattcaaatctcatatcagaatctaaatttttaagaaaggaataatagaatatagtaggtcccctaccatcaattctacttctgtacccctattttatcattcatatttggcttgctagtgaagatgccttgtatctgttgtatcactgggtataatgtctggcatttgcaggtgtgcatgcaaggaaggaaagaaggaagtgagggaaggtggaaggaagagaacaaggagggaagaagggaagggtagacactttgggaggccaaggcggttggatcacctgaggttgggagtttgagaccagcctgaccaacatggagaaaccccatcgctactaaaaatacaaaaattagccatgcgtggtggtgcatgcctgtaatcccagctactcaggaggctgaggcaggagaatcgcttaaatctgggaggcagaggttgtggtgagctgagatcgcgccactgcactccagcctgggcaacaagagcgaaactctgtctcaaaaaaaaaaaaaagaaagaaaaaggaagagaaaaagaaaaaaggaagggaagggtagaaagaagagaggaaggaagggagggagggttgaattatagatttccccaactgcctcccacacaatgtgctctaaccataaattcttcatctcagttgctcaggccaaagcttgagaatatccctgtgtctactctttttagaacatctcgtatctaatacattagaactcctgaagcctctgctctcaaaatatacccagagcccagcatccttgtcaccatctccatggttaccatcctattgcaagccaccatcttctctggcttggatgattgcagtggctgtctaataggagaccctgcatctcctcttgctgcataacagtctattcaaaagacagcagtcagtgcaaatcatgtcattcctctgctcataaccttgcaatggctcccatttccctcagagttaaaagtgattattgtggcccacaacgtgtagcccaatttgacccctgtttcatctctggtcttctttttaactcttctttctctcattcactcagctccagcccattagcctccttgctgatcttcaagcacatcagtcacacttccattttaagaccttggtgctgcatgaagtgctctttcccccggtatcttagggccaattccattgctttaagtctttgcttgtgtttcatctccattaggccatccatgaccatcccattttttaaatgcatcgcacattaataccattcccaatgtctgctctattgtatgtatgagtgcttgtttcatagcatgtctatccttctaacacataatttactatatctattgtttattatctctctcctgtactagactggaaactaccatgtggaacaatcttcgcctattttgttcactgatacagatatatatacacaacagtgcctcagccatgctaggttgctcagtacattcttgaataaatgaattatcgatgtactcagttctgttacacagatgatttggcttctttggtttcccattaagagccttgttttctttgccaaataattgaaagtttcactcagaagataaggaacatcaaagacctcaagctttgtggtcttggaaagctgtggctttggtctctgtctcattccccttgggatttagaatagaaaaatgcaggtggagaacacattcaaacatcccacactttatcagtattttaaaagaaagaaagtatggctttttttttctcaaaacaatgtcttagttataaactgaatttgtataaatggccagttgtacattagggcagttgcacaatagaaagcatccagggaacaatcataacctcaagagcctattggaaagtgggatcctaaatagctttctatgatctccctagaaaactgtagaatttccccagagaataagccagcattttgttgaccattctgcaattccaggatcatgcttgcatagtcatagcttggaaggaggcaaattgaaacaagttgaaaatctgcaggaactatccccagtgagaccacagaaaagccagaagaagaaaaggtgggatttggggtagagaacgagccacttctcactagtttgcatgaagcattgaatatcccaagggagaaaacattgaagttctatgagacaccaagaaaagtgtatagattatcacagcatatggatagaggtcatttgttccctccctccctttaaagaaaagtagctttgcaagccacagtttaggaacaaatggactttttgacatagttcaaatcctcctgggtgtggaggcattgacaggagcaatgtcataaattggttaaaggttgcagtctggaatcaggctgccctgaatcccagccctgccatttactagctgtgagaccttgtgcttcctaacctcagttttcttttcttttcttttttgagactgggtctagctctgatgcccagtctggggtgtagtggcaccatctcagctcactgcagcctctgcctcctggactcaagcgatcttcccacctctgcctctcaagtagctgggactacaggcatgcaccaccatgcctggctaatttttgtatcttttgtaaagatcgggtctcgccatgacacttaggctagtctcaaactcctaggctcaagtgatccacctgcttcagcctcccaaaatgctgggattacaggcatgagccacggtgctcaactaacctcagttttcataatggtaaaataggaataccgatagcacctcccttggtataaggattaaataagataatctacatagtgcttgaaacaatgcctaggcagtgttcatcaacagttagctgtgtgctgtgtacatgctggagctgctaccttgtagaaattttaaatttaaaatggtgtgtagttggaggttaggagttactaggggtatcgcctagggaaagacagttggttacccagacaggtccttacagagtagtgttttccctggagaattaactatattccagaatctgtcctcaaccaagcagtctcagaaaggtgatcttgtcacagcctctgagtaagctgattcaaactctcaaaagctcacaagagccttaaagccagagtatcagctgattccttaaaagctacaaagtgttttggccttgccaacatacgcattctccctcttatgggtaggtttagaatgctaaatagtacataacatggatttagaatagacagatttacatatgatcagaaggctcagtggtcatagttttgagggcctaggacatgcatgtgagcagtagggagatcatcacaggaggatgggcacactctcgaggctcatacaggcgctccctctctccatgggcagcacaaggcaagtctcctttgtctttgatttacttgccaaccaccctcattctaatgggaactttctttttccaaatatgttaacaccttcaagtaattactgtcagcgtccagcctgggagtctcttggacacagtttttcataactctagatggatctcataatttgcccctgaaagatggtaaataattttacttctcttacttctggactctaagggggatacttcactcttgctccttgacctctcctctctagatcccacaagccaaaaattgttggaaaggattaatatgagctgggcccaataggctacagcatgcaccagcccctaaagccagctttaggattgggcggagtgtcagcccagcttccaccccacttggcttattcagcgacctcctgcaattgtcctctgctagcccttggcagatcagaaatgttctaaagattgacctctattactttgggctttccttaacttggcatccatgaaaagatccacttaaatgctccagattcagtgaagtctccttatcagagcttcttatagcacccatacttttctttctcagcatttattatgaatgtaatcaaatcatactttgtgcatgttttgttgtggttgctgtttaatgactattttgtccatgaaagaaggaactgtgtttgttttatcactggtttatccaagggactagaacaatgtatggcacatacaggatttaacgaattttttttaatgattaatgcccctttagatagtgtttttcatctgagtgcctcaacttctatgtgcattatgaaactgatatagtgggtcacaactatcagtaagaaaaaaagaactggaatagagtagaaaaagatgagaatgtatcacgcatagggaataacttttataaatctgtttcagtatggataggcaggcctacaccacacacacacacacacacacacacacacacacacacacacacacacattgagttcctatgaatttgttttttttaatttctttcttttttttttttgagaaggaatctcactctgtcacccaggctggagtgcagtggtgcgatctccactcactactgcaacctctgcctccctggttcaagtgattctcctgcctcagactcccgagtagctgagattacaggcacctgccaccatgcctggctaattttttgtcgttgttgtatttttagtagagatggggttttgccatgttggccaggctggtctagaactcctgacctcaagtgatcggcccgccttggcctctcaaaatgctgggactacgggcgtgagccaccgcacctggccaatattttttaaggtaagaattttgagaaacactgtcctaggttccctctaaaaccgaagatatcaccctatgttcagccttttagccctaatccttttcttaatcttccctatgaccaaatattaccatgcacacatgcacacacatacacacatgtgtgcacatacacatgtacactaatccatctaaagtgctactgttaaggaggagcaatagaagaggtgattcagggaatggtttttgatggttatttacttttataatagtttttatttgtaaaaagaagaaacctagagttttgtatcctaaacaaaatttaggattaggatacaaaataataaaattcaaaataagtcttgactagtgagtgtagaaggacagtgctacatctgaatctccagttgggtttacgcattttgtatttatcaaaaggcagtagtgatttaaaatgttgataaacactcagtttcagttttctattgctgcaaacaaactattccagaaagtgatgtcttgaaacacaaccattctattttgcagtctgtgctgggctcagccgggcagtcctgctggtcttacccatggtccccaatatggctgcagtcactccagtagactggaggctgggcttagctgagatgacctgctttctttctttcttcatgtagtctcatggcttttctctctctccatgtggattcctcatgtgaactctccagcaaggtagtcagaatttcttccctggcaactcagggctgccaagaacacaaaagccaggctttcttaatgtttaagcccagaactggcatgtggccaattttttgtgttctgttggttaaagcaaaccgagtcaagaagagcctacacaagtagtaatattacaagtatgatgaaatatcattctcttcttagaccaaacagcatattcctccctccactcttaccctctataatgttttgcttttgggagttcctttatatgaaatgcctcccctctacttctccttctactgaaatcctactcatcctgaatccagctcagagctaactcagtgatttccttcatacatctctattatctcatcctggaaataatcactcctgccaggtgcagtggctcatgcctgtaatcccagcactttgggaggctgagacaggcagatcactgaaggttgggagttcgagaccagcctggccaacatgatgaaaccccgtctctactaaaaatgcaaaaattagccagacatggtggtgaatgcctgtaatcttagttacttggcaggctgaggcaggagaatcacttgcacctgggaggcggatgttgcgagccaagatcgtgccactgcactccagcctggatgacagagcaagactccagctcaaacaaaaaaaagaaaaaagaaaaagaaaaatgccctcagcactctcatagcattatgtctatatttcatattatgtcttgacatataactttacacacacacacaagcacacacacacacagatgtagcttgcttttagattttaagttgcttatctaagattgggtgatcaataactgtttttttcaaaaaacattaactggttttctatgacttttaaatgacagctctaaataattataatttctcactagtttaaaaaggcaggtggtgggatattcaaaactattggagaaaaaaagctgatgtatgctaccagcataaaacaacaattgccctttacatcttcagaaacccctgtactgtgcagtcattttcaaacctggatttttgtcttgtgttttttccaaagtagtatatatttaactttgtaaaatggtgtggtgttttttggttgttgttgtttttgagatggagtttcattcttgtaccccaggctggagtgcaatggcgcgatctcagctcaccgcaaactccgcctcccgggttcaagcgattctccttcctcagcctcctgagtagctgggattacagtcatgcgccaccacgcccggctgattttgcatttttagcagaggcagggtttcaccatgttggtcaggctggtcttgaactcctgacctcatgatccaactgcctcggcctcccaaagtgctgggattacaagcatgagtcaccacgcccggcctaacatggtggtttttttcctacctaatatgaagatacttaatgtcttaccttggaaaaatatacatttcaaccagtttatattttacagaagtgactgagaaatcataagcctttgtgcaataacatcatcagtcaaacacataagcagattctaatctgccctctctatcaattagtcttaaaactacaagttgttcctctataccagctacacatgtgcattggtagtcttaaattgtgatatgagcccttaggtagttcacacctttccaaaggaagctcagtgaacttcctgaaactgtgtaaagaattgtgtgtgcagtatgtgcatgtacattatctgtatttttctgggtggatgatccagtatcctcatcagagtcttaagtttgagaaacccaattatatattagttgtaaatctgtttactttcttagaattcttctcacattaaaactaagattatatttctatttcataggtaaccaatttcttctggagcaactggacacttacacgaacacttccatctgtctttcatctttacattttatttctaggtattactagtgttaggtcacactccctcctatggggagattctctatcacatctctagaacttcaccaatgcaagccttcttaaattgacccactcgctactgagtctgacccctgggccagtcacatcggtgcttgttagaaatcagaatcttggaactaaatcagaatctgcaatttaacaagatttctaggagtttccacagcatatttaaagcttaagaagcacaaagctggtgcatctaataccccactttctgctttttaatcttgcaggatttatgttttaaattctttataatactattaacaattatcatttgatttctattttcatatcatctgacagttttgattaaatcctttaacctcaggatttgtaaggggtaaggggagtgggttaactaactgatctgattatcaaataatgctaccattcaggacttatgcatagtttctgtgattctcaatagaatttgatggtacctacaacctctactccttgttttagtgtctatgtttttccactgtgcttaaaaacatttaaagggagaggctggaaaattattttaagatgaatactataaatgaaataactaagattagaaaaggcaatgataatactgaattacattggaaaaattcagtttacaaaactctgaaaagttcctaaggcagaattttgctgccccggtttctcataatagacccagcagttctaagttaagcacacatctttttggctatatggtgtatataccagactatcctttttctccaaaatttgactttcatctcaaagagtttaaggaatttgtgacttggtgcgtttgatgtggcacagttccacatgtgagggatggtgatttggatagcacgacagaagtacgtgccaagaataattggcttctgtcttgcggaacagctcaaatactatgtgtatcacagtatgtaatttgggtgtacaaaatgcctgtagttcaaagtgctttactcctctgcagtggcaagctgagcttcctgttggctgattccttatgtttgcagtaaacaggctgggtgcagttagaaagaaagcatccatctagtaagtgcattcacatcatccttcaaatgccataggccttagctccaggacattttctgcctgtctccttccctccctcctttctttcttttcctctctccttccctctttcctttgttccttctttcctccctccccttccctccttttcttcctagttccccctttctttcctttcttctattgaataaaacgcaaagtaattctttttctacttactttgattcttatcagctttcttaagcagtttccttgccgctgttgtgaattacatggggctgtggtaaaatgtggcacatttcaaggctatgtatccctttagattctggttcagtaagcttggaaataaataggagagcttacgcttttaactactagcctgcgattcgtataatcatgttagtttgagaaacactacagtaatcacacatgtaagggctttggagtaagatggaccttggttatccaacgcttactgtgtgactttggtaaattacctaaacttttctagccttggattttaatgtgtaaaagatagataatactaactcagtaattctttatgggttccatgagacaatgtatttaaagcacccagcatactatctggttcatagtttacagtcaataaatgttaattccattatttgatcacaatgtaagactattgaggtttaattttgattgttttttcaaaagtttgtaatctgttaggaacaatttctaaagtaaaattcagaaaacaaaaccatcaaaatttaattcagctaacatttttgaggttctatatagtctcgaacatatattatctaattcgattatcactataaaccctgtgtatagtagatattatcattcccattagtggatatgcaaaccacggctgtgggatagttttacatttagtaagtggcagatccaagtctagacagcccaggctggttctctttatactctgcctggcaacatttgccttcatcactgtctgttttcaaaagtaactaacctctacatccctgctcacacatacaaatagctctaaaggtacaaaataaagctaattttctgagcaattcattttattcaaatcagtctaatgatctgttccatgaaaaatgattatgtagctcaaaggtcttcaaactcgtctcaaaccaggggtcaggcagatcatattcacataaagggagaagcttgccagccagaagtcaataaagattcctgggactggggtgacctggaagctacaacctgtttaaaggagacagcttctgcctagctccaggctagtgctcaagtgccaggatgtgggctccctattgtcaaatcttttttttttttgcttttttaagactggaagaaatccaatatttaatgcgaaacttcccatttttgaacaacgtgtgtgggccaaacaagtcacatctgtggaccagatctggcctgaggattgccagtttgcaatcttgacctaattgcccttaattcttcacttctcttgacctggtaaatactccatttaaatgagtattaggtatgttctgggcccttttggactgggtctttgtaatatatacaaatttcaaagactgacctttagtttttcaggttcagaattgattttctcagaacccaattagatcaggtgctgtcactgacactcagaactcatgaactttatgcaagagcaagaacatgaattagggaattcacagtgagaaatatattgacaagtagacaggataccatattggccagatcagttcattctgtccttgtagttcagccccttgagaaacaaacttctaattagaagctgctttgacatatatggagtcagaaactaggaactgtagactttaaagggctttcctgcattgggttttgagattcttcctccttttatggtagtcttaacattcggctgttaagtgttatgctccccctccccaggcatgccaagtatatactgaccaagtgtcttctttatttagctaccatatgagtggttctcaaacccatgcccttgttaaaacacagattacagagccctatgccccacaaattctgattcagtacttctggggtgggtcctgagaattttccttcttataagttcccaagtgatgctgatgctgatgaactgctggatggggaaccccctttgagaagcactgggttcctctatcatcttcagctgacaggctttttcccctttgaagggttaccgctattgtctgtgtctctgctttaatatgctaatatagcattatggtcatatccagatcctgaggttggaacctgggtcttagaacaatttttaaattgtttatatttttaaaggtatttgatttattaaaactatttgattactttatttcatcaagtccaaggtgccattgattataaaaacatgtctggattttagaggcattaaaaatgtaggggccaggcgcgatggctcatgcctgtaaccccagcactttgggaggccgaggcgtgcagatcacctgaggtcgggagtttgagaccagcctgaccaacatggagaaaccccatctctactaaaaataaaaaattagccaggagtagtggcacatgcctgtaatcccagctacttgggaggctgaggcaggagaatcgcttgaacccaagaggcggaggttgtggtaagccgagatcataccattgcactccagcctgggcaacaagagcaaaagtctgtctcaaaaaaaaaaaaaaaaaaaaaagtagggaaaaaattaacagtttcagaggtactgcaaattagtaaataaagcctcagtttggggcagtctcccctggattatgttgtatgtgtgtagctcaactcgatgggcacagttgaaggaaggattccctggtatgtttgttaaacaaacataaggtgaattttaagcctcccttccccaattcttagtggaaaagacactactggtactgtgtcctatggctgactttgtcgtctaattgaaatatcttattattgtatgcatcctctcctacttaaatgtgaccctgaaatgccagatctttcctttggaatgaatcttttttgtcttattggactggtagggctatgcacttaaaaaaaaaaaaaagttgattattagactcactgtttccttggccagtcaggaaaagatatttaggacaagagtttctcaattgtcctcatccagttttgcctttatagtgaatttcaataaatattaccatgcctatgtaagagggtgactggagaggcagaaattctatctgactgtccacttctaactctactattggaaaacctgctaggggtttttgtatttattatttttggaaaaatcattaagtggattcccttagctatataaacataaggcctgtcatctttttctttggagaaagagtgtgacaaaatttcccccttcttattaaaagctacccctcctcttggtacagtttgaggatagcgtggaccaaactacctaagaattcaggagtctaccaggagaaaagagactttctcactttgtcccacaattagaagtactgaggaaacccatgagaatggatgaaaaagggcagtcccatggtgtattgtcgggagagaatgctgatacggcgggccctagagggattaatgtatctgtgtagaggaaggggaaacctaagctgcctgctcaagaagagcatcttagattgttgagtgagggctgatctttactaaatgagttaaatcaaagagccaaactcttggagtccaaggctgggcatggagacccaaaccagcaaggacacaggtctggacaggaccattgttcactgtgataccacatggcagtggcagaagccttcataccaattgccgtcctctctacacctgaagtttagaagcacgactctgctttagactgaataatccctgaggttcttgggttatttgaaagaggggtagttttcaaaaagagagatattagatttcctattgaaagggcagccctggtctccagtgattaactggaaaaacaaaagagatataacaatttttacatctaagtactgtgctagcttctgtggatctagaatcaaatgagacaagatgtagtatgacaagcagttagactctcaagaaaatcattcaagtctgtttaggaaaactgacattcattcattcagcaaactattgagtagctcctgtgcatcagaacctgtattcacagtcaactgaaataaacacaatttctacacgagtggagttttccaaatagactaagatgtcataatggactgtgtgtagagtaatgttcaagttttttttgtttaagcttccccatcccccagaaaatactggatatatatagcaaaacctttcatggataataattgacatataccttggagaccatttggaatctccataaacgaaagaagaaagggcatttcagacaaagggaactacatgtacaaagtcacaggcatgtagaaaaagatgaatgtttcggagtaacttacagtatgtagggcgcaaacagaggaaatggcaaggaataagactatgtgagaaagcaagttagggcgaccttattaaaaagtttatagacagtggcgcaccgccaaagatgtagaaatgtggcttgctgtgttctgtattttggagcaatcactcgggtaccctgtgttgtgagtaggggtgaaagaagagaatcagtggaaccatgggaagcagtttgggagataggttggaaaaatattggaatgttctaagcatgacattgtgaaagaatgctagaatctttttcatatgaggggtgttatggaaaataaagaaagtattggccctgccctcaagaagcttggaacataaaagaagtaaaacatgagagcagggcctaataatgtatctcaaagtgctgaaggaagcatatgcattatagaagttctcatcctggactgtggtttgttgagaatgcagctgggtggagtctgaggaagtaagtgatggccataatcgaagaagagataagaggtaagagcaatggcttaaaagcaaaaaagcctcaaaacattcaaacttcctttgtataatagtggatgttattttgagaatgtcagtttcaggagataccataatcatgtgtttgtctgtatttaaaaagccaccaccataaaagatctagagtcactcatgaagttcaagtaccaatttttacccatgagtgtggaacattctgctcttttacaaacagtaactcgtactgtcacattttgcggcgcatctctcattttgttggttatttagtggccatgtaaacatgtacatgacttgtggtgaatatggtgattctcactttataaccaaagagggtggatgttacagcatatgagcagttatgactgtaaagcctgaagtgtgagtcacagggtctgacccaggtagtaagatgtgttatttgttcatgttggttagctgaatttcctgggctgacctcactgaagtttgctccagtaaagaaccggatctttactgatagatcaaggatctgaattctgcacctagttctttggctaaccagttgtgtcctttgggggaaatttcttaatctttctgctctccatttccctttctgtaagtaagggattagaccaaattccatccaggattgagaaattctatggtgtgacaaagactgctggtgctgactgaatatccttacagatttgttcatttagtaaccaatataataaagatgactgactgaatcttaattatattgggtgacatctgcctagtcaaaagattgcatttctcaggctttctaagagattgatgcagccaactacatgttagcagagggagctcctgcctagaagcactcacttttactcctcctcccgtttgtgtagtagtgatttggtgctggtgctggctggagcatcagtagccatcttgtaacctaaatggcagaattgagaatggaagccatgtgttacggatggtggatcagaaagataataggaacctaggtccctgataaacatggtgtcaccattccaaccttgacctgtttctagattattttctttacttttctttttcctttcctcttttttttttttttttttttgagtctttctctgtcacccaggctggagtgtagtggtgtgatcagggcttactgcagccttagcctcctgcactcaagcaattctcccacttcagcctcacgagtagctggaaccacaggtgcatgccaccatacccagcaatttttttttttttaattttttgtagagatgaggtctcactatgttacccaggctggtctcaaactcatgtactcaagtgatcctcttgccttggcttcccaaagtgctgggattaaaggcatgagccaacatgcccaggctacattttcttaatatgagataaaaataaacctctttcttattgaagccattactagatgcctaattcactttctaactaacatattagcatcagattatctttatgtaatttccattgctaggttttctctttgcagtattggagacaatagcttaccaactagcttgggaacttcttagtgctattagagtttcaacacaatttaccaaatttctaaaattatttagttattggatatatgaaaacataatcaccatatgtgaagaaaaaaccaccaatgtttagtacaaaaattgggagggggaatattatattagagaaagtttattaatccagaaaaccacagaatttaaaaaatattggaagttgggaatttgggagttaaaggtacatttgatctttggttaatggcaagttcacattttataataggatgtaaaaccctatttctcactgcacctgtactttgatcttcttgtctgtcattgcaatgtgattatgaggattactgggtcactctcagcctaagatgtttttgtgacttaattttctaggagaggaaggggatcattaaaggatatcattaaaaggagagacacaaggcttgtaattgaccttccttgaaagtagtcccatctggaagattttatcagtaaacatttatcagtgtatttggcttttaagcagactcttctcctcttgtctttgaaacaaacaggcaaaggctaaaaaggaacacgttagtgctcaaagtttgcttcttgtgcatgctgaatgggaagaaaaataatatttaagaaaaaagctttcttctaagttaattacatgattcttttttcagttttgcttcaatgtttctgtttgccaaattttaattggcaagttatggtgttcttcaatgattatgccttggtgtgatttgcttggatgtgtgtttagagagtggagggtagaagggatgagatttttgtgaaatacagtgagcaggggcttagaaaacctactgcagttctctgtgtgactaagcccagcactagtctgaaacttcgtattgtacttctctggaatgcaataactatcgtcaggaagacaaacgttgctgtggcttaaataaaataaactgacatgatgtattaccagtcaaaataaattacccaaacagtcttgtaaagttgtgttttttggtcatcagaactgcctcattattcatgtgtctgtttgtctctttggttagttttgcttgttgacttgcatgtatcaatgatcacaatccttgtcatttgccaattccatataaactttcagaaagtgaaaattgcttttaagaaatttattttgaagtttctacttatatttacccacataatgcccctcactgatagccagctttgtttcttccattcctttgagaatactccctagtgaatttaaagagtaaaatctgatgttgtggattataatattatacaccaataagtggttgttacacacttgtgtccacacttggtaagatgtccttgtggatgtatctcttctatgtatagtatattaatggctttatccgccatttaatgtggttcccatgaggtttaggtagaccatagatactgtttcaattagaacacttcatgaggatttagtttctctgtctatgggtcctgtatctgaactctccatttttattcttttgtttgttttttgttttgttttctccctgatgcctgatatcagaagaactctccatttttggcttcattctctgctctatccacatgagacagaccaatgtctgcaatctagtgccatacctttccaggttttttatgtccaacaaaaaaagagagcatctctttctagtagctcccacataattaagggtatagcccctctcctgaaccaatcagtcaatcacagtggtcccatctgaccatggggatgttccccaaaggaaatcagggtgttatttttcaaaaggaagaagaaataaatgctggaccttcataacaaccaattgcccactaaaagtgcagtcatatttcttgatgaaatagaacctctccttgtatactgggctccatgacacattgatcatggttagctagaagattctgaagtcttattatccactttgccagttacatttatttgtagctcaaggggactgttaagggaaaggggagcagtgctaaaaacaaatcccattccaatattattaaaaaaaccattgctctgcccttcctttattcacaacttagttcctcatcctcatcttccccagctcctccttttcagctatttcctctgtaggtgcccctaccactaactcccacagattcccccatctcctttgaagaaaaaagctagatgctcccactccctttatttcttccacagtaaccagcttaactagcacacggctttgtacatggtacacagttaagtaatatttgtgaaataaatacggaacacttaagggaaataaaaagcaatctatcctcatcaagaatgagctgagaatccctgagatagcctatttagcagcttagcctgaattctgttttagtttctgtttctggaaactcttcttattttaagaaagaatgattcttataattatttcatatttgttgatattatccagtcttagccagttatcaaaatggtcttgagaattaggaggggaaagcataatgttataaacatttcagcatattgtgcaagtaaagtcctggtagtctgggtaattctagaactcgagtagacttgaagtgatatcagaggaaagctattacccaagtttactgcttgctaatcaggcagccagcaataatgagatggtacaatagaaatgttcaaagtaaggtttcttggcatacatagctatttaattattttatttctgaaagaactatagctccactgttacctaagtttaacctttaggcatttaatataatagtatctctagtgtaacagagggaatcaattactatgataaaccatatcctttgtaaaagaatactataataccaagaaaggcttttgtcttcatctttttagtttttggttattttttgttccattccctttaggtaagaataagcatctagaatgcctcattatgagattgttaatgaatattttccattgtaatttaataagcctaaaaataagaagatactcctctactttgtcatacaagatcgttgaatggtgggtcattagttgatagcaaaaagtcactcattcttagttatgtttctgatgacttgaaaaattgagtggcagtatacaaagtctgagcaaaactgacttcagaatgagtatttggctttgatttctcatggcatcttgcccattgagccatcttttcagaggtctcagctgtatgaaaaaatagtacttttttttttccagaaacatgaagtctggcaatctttataactttgtgcagcttgttgattcccggattcaatggtgttagtgaaaaagaagtctcaggagctccagagtctcagaagaatgacaagaagacccctaattcttgcctgtctctatatttagtatccaagttggggataaaagctagtttttaagattttctgttcagaaatcttttctatatactattcagaggcagccctttgtttaaacctttttttgtctcaggcatggattaactgcaattggattctatgttaaaaatgtatttttttgaacattttgtaggcatcactccagtattttctattggtgaaatcctgatctttttctgtgtagaaatttttgtgaccttcttttctttactgaagttcccacatttcatgatcaattgtcttggtctgcatttttatccattgccctgggcacgcaatagaccttttcactccagagatatgagtccttcagttctgaaatgtttgctcttattcattgataattttatgccctctattttctctgttctttcttccttgaattctcattatcttagttggatctcctagatcatatcctttaatttcttaattgttttcttccttttttgtctttttgttttttggtcttctagaagatttgttcacacacatttttattttccaaccttactattaaaatgtttattttggtcatgatttaaaaataatttagcactctcattctctcctttttttttttttttttttttttttttttgagacggagtcttgctctgtcaccaggctggagtgcagtggcataatcttggctcactgcaacctctgcctcccaggttcaagcaattctcctgcctcagcctcccgagtaactgggactacaggagcatgccaccacacccagctaatttttgtatttttagtagagatggggtttcaccatgttggccagggtgatctcgatctcttgacctcatgatccgcccacctcagcctcccaaagtgctgggattacaggcatgagccaacatgcccagcctcatcctctcctttttaatggtatatgttcttatgtcagaagtgtgttttatctaaggtcacagattattatcctcttgaggttttcctctgtctctctctttcctgtagatttctttcttcagttgatgtttgcttcttctagtttctcttcttcattatggagagtttccttaagaggctgttcattcttagttaaaagcaagacatatacaggtgcatatgcacacacacacaaaacaaagcaacaatgacaatgatggcaagaaacaatgtcagaagttctgtgatcatggatagggctcgtcaactgtagggttgcactgttgcatcataggttgttcaatcaaagccggtgtgttctttgaaatgtttccccaaggtcatgattagggggtaccccactttctgcctgcgagatttgcgcctggggcatataactgactgctaatgtctggggagcatgacaaataaaaaagttgggtttcttattgcaaactctataggctttcaaataagcacctatttcgcaacctgcagcctctcctagtttgctacagtgcctagtatcatcagtttcaaatctctctagccgatttcctccaaaaaagaaagactccgcttccagtaggtaagggaagtagttagtttggatccaaaggctccatataattttaatacactttcagcccctcgctaaactcctgccttccttaattctgctgcctccaagcagtaagtctttctggattcgggagaacacattagtccactttctcttggaatttactctccgtaaccatttcctcgattatgctaaggcacttcagctattttctgatttcaaaaaatcagtagaaatctctcctttgctgatcttgtttcctttattatttgtgcctttgtgggtgggtgtgttgtgtttttattcctttactttcacttcagtgaagtatcagtaaaagagaaagaagataagcaggcatgatttcaccctctcttactggaaatccaggggaacgatagctgaggaggaaagtagcttggaagagcaccttagagtagaaaaagacgggagaaggtgagtttacaaaagtacagcaagatgatgatgatgataaataaaactcaatgcgtgctcactatgtatttgcactgtgcaaagttctttacatggattatttatttgtgtttttgtaagaacacctcaggaagtagctattgagacacagagaagtaatatgacttgtttaggttagtaaatggtagaggtggtattcaaattcagatctgatttcagagaccatcctctcaactgccacactatcttgcctcctacaaattgcttaagcagggatttaaaatgaaaccgtacttttacaaaatcatttttcatgtccattatttaggagtctctctactctatcaaaagtattaattgacctatttattaatatcttagtaatgtaaaatgcttttaggtttgcaaattagtaagagaaacttcttcagattaatagatgctgtctttatgaggactgcatgagacttatgtactcatcattatatacacccacagacgatctatttgaattctgtactcttactcttttgttaaataaatgtactctttctaactatgttttaaatcatctgcaaagagatggaagctgtgtgtatacaacagcaaacatctggaagaaaagaatattcagccaaagcttgttaaagagattcataagcaaagtatgcctttgaattatgaaaatgaattcatgtccaacatcataaagaactctgacatgtctgtttatgtttcaaacatggcttagagatcactgagattaaaattcaattaagtgtgctctgttgtctttgctgtcaatttcagttaaaccagacttgtttggcagttttggggagaaaaatcttcagtgttttaccttgctaacattttaccatttggactttgtgttttttcccaataaatgcatgtcatttaaggagatgcttcatgttatacacacctggtgattttcatcagcagttgtacagatgaaagagaagtaaaagcccccaaataattcatcttttaggctttgtaaaattatcattttataaatttttaaattgtgaaatataacaaaatttaagaaagtatgtaaaatttaaattttaagtttaacaaattgttctaaagtaaatacctactatgatcacccctcagaaagaccctataatttcctgtttcatcctctccagataggtcaccactatcttgactttacttttacttttcctacttttctttatgatttaccacgtatgtatgcatgccaaaacaacagttcaatttagtttgttttgcattttatgtaaatggactcatcttgtagatactcctgtgttttgctccttttgtgcaatattatagttgtaaaattcatcaatgttgtatgtagctgaggattgcacatcataatatatatcatgatatatagcattctgttgtataaaggaaccacaatttactgtccaatcttctttctttatgcagttgaacatatccagtttggaaatattatgaataaagatatttcgaacacttatgtgcgtgtatcttgatgcacataagcgtacatttttgtgggggaatatacctaggagtggattcatgggtcatgcatatctttaacttcagcagataagcagaaagcatttgacaaagtggttgagaaggtaatgagaattcctgttgctccacgttctaataaaaaacacttggattttctttcttttttttcaaatgacagggctctataatgggatcattgcatttctctgattactaatgagagtgagtactccttcatatgtttagtagatatttgaattgtatttgtttttgttgttgttgtagctcttcatgaaaagtactttctaaacagcatttctgagcaccctttagggagccaaaggccaaataagttagagtatttgtcacaacatggcaataagagaggcgaattcatccattaattgcttgccatatgcttatcactggaatatattttgcagcatctcctgacatcactatttatcccttttaccaaaaaaaaaaaaaaaaaaaagaaaaagaaaaaaaaaacatggctactgataatacttgggagcactcaacgaaggtcccgtctgagactctgtagaatatattatagaatgcaaatattctttggattccgtcttgttgttgttgttgctgtttcctaccctacaacttttggcatctctacccaacatttttataatacaggactgtctctgaggtttgttttccttatggttgttctcatgtataaaagagatgatgatagcgtttctcatgccagtatgtctgtgtatgatttatgttgtaaacagtgcaaagagctttacagccattgtctcactaatcttcagagcatcttttcgaaatagagaggagacaagtgaatcaacatcctctatatcacgggaggaaacatatctccctgtggagagatgtccactgctttatcgacaaggcacaaagctgcgaacagaattcaggttgtattctgactcctacactaatgcctatggactagacatggtgtaaaattttatatgcgtgaaacatgaggtgtattcatcaactgatcactattagcaactggctagaacatgaagtgtttgtttgtttttcaaaagaaagatatgatgaaactttatatgcttttacacagttctgatattttaacaatttgactaatttttatagttttattccttccagaaattcctttaactgtgcttatcccgtaagtaattgctaatgttcttaaactaatcgagaaaatcatttctattagtccctaaatacccagacttcataccttcttgcttcccactctcctcatatctaatctctcccttaggtttagcaacaaaatgtgcagcttgacgtggtcagtgggtgtctgaacatttagtgctagtgtttcctctcatctctctgcttttatttggacttctcaactcttaaaagtaattttaacatattataagaaatctttgaatttataacactttacagtttatgaaagactatataaaggttccttctcacaggctgtaaggggtacaaggacaatgaaactcagatgacatccttaaatgcactctactattatatggctaatttaagattaaaaatctggtttcataattattagtctagtggtccttttataggcagcataatacagttgtaaggagtacagactgcctgtttttgaatcactggtccatgctaactagctggcttaccttgggcaagttacttgaggttctctgtgcctcagtttccccagctatcaaatagatctaagagttgtgaaaattcaatgagttgatacatataaaaatacttaaagcagtgcctgtccaacataaatgcttaataaatgttagccctattatctttcctcattatttagtgttaaagagcaagaacatctataaaaataaaaatcaaataatccttcaaaaattcctgaatattataaaactaacatataatgtcaactaaaattgataccaattagtttccttatcttgaatgaaatcagtattgtagtcagagccaagctactgacctggattcacatataacattcagtttctcttctgaaactccagctcacttagcacatttatgccaaaaacaacaacaacaacaacaacaaaaatgtataaattgcctcatttgtttgaagtgtaacactcaggttttccatacagcaggaaactctgatagaagtatagattaataggcaaggcattgctccattccctaaaggcgtaataaggctattccacaaatatgtattgaacttctacacaggtttaagaattatgaggaggagagaagatattgtaatgaatccctactattctgtttattttttatttctttttaacttttaagttcaggggtacatgtacagatttgttacataggtaaacttgtgtcatggggtttgtagtacagattatttcatcacccacatattacacctaatacccattagttgattttcctgatcctctcactcctcccaccctccaccctctgataggtcacagtgtctgttgtttccctctatgtgtccatgagttgtcatcatttagctcccacttacaagtgagaacatgcagttcctgtgttagtttgctaaggatattggcctccagctccatcagtgttcctggaaaggacactatctcattcttttttatggcttcatagtattccatggtgtttatgtaccacatttgctttatcctgtctactactgttgggcatttaggttgattctatgtctttgctattgttaatgctgctgtaatgaacatacacatgcatgtgtctttataatagaatgatttatattcctttgggcatatacccagaaatgagattgctgggttgaatgctagttctgtttttaggtctttgaggaattgccacactgtcttccacaatggttgaactaatttacactcccatcaacagtgtataagtgttcctctgagtacctgttattcctttgaagaaaatacctacacaactagataattagagaaggagagaaagagaaagagagagaaggatggcacaataataaagtgttttttggaggcaaggatgatgttttatgaatttttgtattcccagaaaataacagataagtggttattagtgaatgaagaaatgaatgagttaactaattgtagcagaaaagggaaagataaatataaataaaggtcatccatctatttaacaaacatgtattgcatgcctaggaattgtacttggcttgaagactttaaagtagattaagacagtcccagacttcaaggaccagcaactgagggtgttaaacagaaaggacaatgacattacaacaagctgtgggttcacacataccatttcaagactagagaagagaagaaaatcagagattcttccagaaatgaaaattcttgagctggggctttgaggatgaggagaagttagttagttagaaaggaaagatgagtaaggttgggggtcaatagttcgagcaaatattgcagtatgaaaggtgtgagagagcctcaaacaggttacagattgtggcactataggtgatggggaaggagtgagagaggtaactacagagaagtaacctattaggaactgctaagaaatgttagatattatgctaaaaagcttggaatattttttaaagcatgggggcatcacttgatgatctttctcaaggacaggactattaatcttagggtttattatattcttcaattttgacacaatttatacttcaataattctctgtaagaatttttttcctttgtggtcttatttatttattgagatagggtcttgctctgtcacccaggctggagagcagtggcaatcatggctcattgcagccttgacctcccaggctcaaacgatcctcctgcctcagcctcccaagtagctgggactataagcacgcaccactgtgcctggctaatttttaaaaatttttgtagagacaaggtctccctatgttttcttggctggtctcgaactcctggtctcaagcaatcatcccacctcagcctcccaaagtgctgggatgacaggtgggagtcaccacatctggccttatttttttaacgtattttttaaaaacccaagaacaggcattttctgcgtaatgtgcctgcattttggctttgtatttactaatgcttgaattattgccttagctatacataatcaactgaagaaaagtatttaacttttagctacagtgatttctcatatggaaactgtatacttctcagggattgtggaaatgtccttggaagtctatgacccctcaaatttgagaaatgttgatgtggaggtagaattggagtaggcaggggaaagacaggtaccaggaaaaccagttcagagcctactacaataatcatatgagaaacaaagagggcttgaactaagggagttcagatgaaagaagaatctaatagttatttatagagtaaaatagacagaacttggtgacttccaggattttaggcttgagagagggaggactcaagaattgtacatgggtttctggtttcagtgattagatttctggcatctgctgtccataagatagtaaaaactgcagatagggtaaatgccagtattggaaatatgaagtttgaggtgtctgtgcacatccagatagaaatttatggaatgtggaagagcaatgtaagctggggttttcagcacaatggtaggtaggtattgtagttttgggggtgaaggtactcacacaggcaatgagtagactaaaaaaacaaaaatatagagaaagaagaatccaacaaagagattgagaagtagtggctgagaagtaggcagaaatttaggagagtggtgttctcaactccaaggtaggagagaattccaagattggaattgttagaaaaatttgatggagaaggtattctttgaactgtgtgtgaatagacaaagagctctgacagagcagaaaggaggaggtatggattctgggtgaggaaatgttataagcagtcccacaaagagtgacatcagatttatacaagaagccagagcttgactgtagtgggcagtacagcatagggtggaaagcatagactctgaaaccaactccttaggttcaaatctcagctctccacttttagctatgtgacccttggcaggttatgtaaccttctaaagcctcgattttctcctgtgtaaagtggaggcagtgatagtacattgttaatagattgtttactttttactcttctgtatagacggaccccttgcaaaagtcagggtgattttatatatacaacatcgttatcagctacctctgaatacttgattcttttccttctacaaccccaacctccatttgaaaagttctcattattctttttcttacctattctaaaagtatcactcagtccccacttcctccagggagcttttctgacgagtattcagctcttacttcttagacctccagtaacatctaatgtttgtcaagtacaattaagcacttgcttttacaaaactaattgtgggagattatttctaatggtttcatgttttttaatcttctatccccaagaaagattgtaaacttcttaaagtcaagatacatctccagggtatccgcacattttgccgtgcctgggacactcagtttatgcccattgtcctgatatagtttatatgaattcataatttatagtgtccacttttgactctctcaagagggtagttgtttgcatgataaattccatgaacaacctggatataataatacatactttttgaaattagtaacaaatatttattgagtggctatagcatatctattacaaaataataataagcaagggggagaaaacgaactgtcaataattatgccattgagagataatttttctgtctctgtgtgtgagagtgtgtatgtagagagagaaggagttttactaacaacaatgagattatactgaaggtaatattttataatctgcttttaaaatttcacagtatattgcatcatgaacacttttcttaccattaaatacaattctctatataacattttaatggcatttccttacatgaatatactacacttaagcaattttctattattaaatatttgaagctctccccagatttcacattataagcactattgtgatgaatatctttgtgtagagtctttatagcaaggctgggttgttttcttactatatatttctagaattagaattgtcaaactaaagaattgcccaatattttaaagatttatttttgctattattgtcatattgccctgcagaaagtttatatatacttcatcagcagtctctatttctacattatttccgttgctatattttatcattttaattgttctctttatttgatgaatcacatagtattttgttttaataagaattaatttagcttcaagaatattaaaatctgttttgtgtgtctaatggcaattatacatatttgctttttattattttattatttattcgtgggctgatttgttttttcttgttgattttatttttatttattttttaggagacaggtgtctcactttgttgcccaggctggtctcaaactcctggactcaagtgatctgactgcctctgcctctcgaagtgctgggattacaggtgtgagccaccacccctggcctcttattgattttagagtgttctttagagattaagaatattaacttttcatttatgtttgttttttacacttttttgccatttattcatttctatttttacttttacagatactctattttaataaatagaagtttaaatagtccctatgtagcctgtatgtttatattgtttatatagtctctatataaatatattttataaatccttagcaattcttttccaacaccaatattttcttctagtatttaatcattttacatcatatatttatatctctaataattatggaatttattttactttatttcagggctctgatgttcttttcctagattttctaaattgtcagaatcctaggtattacataatctattatttccttattggcttgaaatgccacttctactgtttatggttagttccttttttaatctttacatcctatttctagacaaaaagccccatgttataattattatggattttaagaaatacattttaatatctgggagaacatattccctcttaatcttattttttagaatttcctgggttattctcacatcgttgtgctaaattatacaaacaatctacttgtcaagtcccccccaaaaaaacccattaagattttgattgaaattgcattaagttgcttataagcagtttataagtactacagagctccttatgatatccctgccaactacttaagaaactcctagttcttaaattacaaatattcccagtcaagaaaggatcaccagacatttgaaaaaagacaaaaaaccaaaccaaacaaaaaaaccagtagcctaaacaaaaaggaactaataaataaacaggacaaatttattttcctgagacaatttatcttctgctttccagaagaaacagagacaatgaaaagtgtgggaaaaatttgtcaatattaaattttcagagatattcagggggagaatataaccattaagtatgatctgatttccataaatagcagaatactgaatatatatgtatatataaagattggataaaatgcaattcaagtaatattcattcttgaatattgaattaagcaaatatcttagaatatagagcaaaaagccaaggatataaaatatgatggaaaagtaaaaaagatatgaagaatgtggtagaagtggaggaatgggaaaggatgtgggaaaataacagaaaaaaaatccttgacctgaagagtaattcaagtcctcagattgaaaagtttcatccaacaccgaacaaggaaaaaaggatacatatctagatgtgtatacacatgctgatgaaaattttggaattctaagtataagaaattaatccttccagagaacaaaaaaaaaggatctttcaaaggtatcaaacttctcatcagcaagattagaagtgaatgcagactaggcaaggtttcaaagttctcaggaagaagaactagaacccaaaattgatagtcaaactatcaagtgttaagacaaactaaagatgtatttaaacatggaaggactcaagtttacaactttacctcctacagattcttcctaattaaaaggaagtattactcgaagatatattcaagcaaaacaaagcaacgggaatcctatacagaaaacctaggatacaaagagcattggaaccaacccagatgtttatgaaaataaatcccagtatgacaactgtgtagtagtaggcctagaaagcaggcagcctaagttagagtcatcagaaggttccaggaaaaatgctttcaagaagaaagtagacatcacatttcgaattgcataattaagagccttttaacattttagggcaaaagtaactgcatttaactcatagattaatctaagacttgatatctttataatattgactcttcccatgtaggaaactagatatattcttcaagtttttaaaaatgtccttcagtgatgttttgcaataatatttatacaagagttttacatttttcgttgtttatttatacatatttgatatgttttattactattatgaataggatcatttatctattttctaactggtatatagaaaaaaacctgttgtggatacatgctttataatgtttgacctttcttataaatcataatggtctaccttttttatacctttcagttgattctcctgaattttgagttacagaatttttatcttaaaatagaatgatttccttctctcttaaaaatatttgtacagcatatttggttttcttgtttggttgcttacgttagaattttctgagcaacattcagtaatagtggagacagcttctttttgtttctgatttcattgttaattatagatgtcgaagaaaagctattcattaccatgaaaaggaactattctattcttattgtactgagagtgctattttactatcaactctttaataagtgtgatatactactgtattaggccattctcatgctgctgtgaagaaataccctagactgggtaatttataaagaaaagaggtttaattgactcacagttctgcatggctggggagacctcaggaaacttataatcatggcagaatgcacctctttacagggcagcaggagagagtaagcaccagcagggaaaattccagaagcttatataaccatcagatcttgtgaaactcattcattatcatgagaacagcatgggggaaactgccctatgattcaattatcttcacccagtccctcccgcaacacatggggattatggggattacaattcaagatgagattttggttagggcatggccaaaccatataatctacattaaggacattgttaagtggcaggataaatggtgtgggctcaactttatactatagaggaccattatagcaatatcataaaagtaatactttgagagactaagccaataataggacaaatataaatttgaggaaaagatatacaaaaccatttagtaattcaagcatctagtgataattgtataaccatatggacaaaggtagagaaaaatacctatagaaagtttgaacttaagagataggtcaggtaacaaacccactttttttcttttttttttttacctgattacttcctggtcatgaggttcaaaatatttgatagcaaaatgatttaaagtccaaattaatattgaattgaatatacacattacagccaaaaccagacctatttttctgttgcttatcatatataattatagaaagcataactgaacaacaggaagttattacttcttaaatatcagaaaacatttgactttctcttctgaaataaggaacggcagtaaccgaattctagttactgctcttaatagttttgtagttctcataaaatattgcttatatattatttggctcccacactatccattttgatggttttaaatttttcaaataaaaataaatgagttttcatactatggatgacttgacatcagttaaaagtgtaaattcatacttgaagatagcaggactctatgctctttcctcattgttctggtcaaatacatttccaatcatgataatcaataatgtgactattaatttttacttgaagttaatctattcatgtttgattagaagtgtctaaaacataaacttgggatgtcaatgaagaactttttaaaattctcctccacaatggctgataatcaggccatgattatattttgaagattttacctagttagtcatatttggggtaagaatatatgctatctccttcatattaatagttcagatctttaattataacatgtttcatggtctataagattaaattgaacattaggaaagcttagcatttctcatttgtgagtcttacattcacacctgtcaggattggtacagattcaagcttgtttttaataaacttcaaagaagatcaaaactagggatcatctgtttcatgtctttgacgtgatagaagtttggggcccccgttttgccctgtagcttttgcctaaggagaaagccacccttttcagctgatacttgctcccacaggtttttcacagtttttgagtagcgagtggcaagaagcaatatgacgatgttggtaggtagagagatacttcttcaccatctggtgagcattctggagaacagagacaagtcccacactgttaaaggagtgaagtcattttgcagccagttttaaggattgatttaagaactctaggagcaggccattatgtagtcatccattcagcacgattcttcgtgggactgtttacactagaaggaactgtagtgatcaatttagcgttgaggaaactgagggctacagagtgccagggtcacgttcatcacacttatttgtgtttcaaagcagaatccacactccaaaatgtgcaactactgtcttactatggaatttacactgacacattctgaggtcatgcaggaaatagaccagagtaaagcattagcaattaggtcagtagcttgagataatgcaggctctgaggcaatcttcactttcactgaccacagactgggattgggaacatgggaaacgtgtgtgtgtacagacacagcaacccttttctatgtgtcatgtcttcagctgagttttaagttgtactagtggaagccatagcctatgttggctcataggtcctagtgccctttccccttcccttgcctctgcccctgcccctttccttgccttgcccctgcccctgcccattccccttctcctctcctctcctctcctctcctctcctctcccctcctctcccctcctttcctttcctttccttgacactgggtagagtgtaatgcaatcatagcttactgcagccttgaacttccagggctcaaccagtcctcctgcctcagcctctgggtagcaaggacaataggcacacaccattatgcccagcttattattattattattattattattaattttgtagagatgggtcctgctatgttgcccaggctggtctcaaactcctggcctcaagcaattctctggcctcagtcatgcaaagtgtagggattacaggcatgagccatctcttccagctctagtgctatctctttataggaatcaaaaatttgttttggctatttcaaattttgtagagtaagaggtcaattagaaaagactcagttatgttttcaaaaatgcactgtgtgcatatgtgtgtagaaatgtattagaatgaaataacatttttttacagtggctaccattggtttgtgaaattatgcatgctttttcttaattttctctaatttttctctatttcctaagatttctaccatgagatttttctcttaatgtctagttttattacataggtaatagataaatatattcatgtcataaaatatttttaaaattcagaatatgagaaagtcctttttcatgctccttagtcttgctgtctttcttgaaagtatccacttagtgatggatacaatatggtgtatatctgccttaatccattttgtgctgctctaacagaatacttgagactaggtaatttatcatgagctgaaatttattggctcacagttctggaggctgggaaatctaaaatcaaggtgctggcatctgttaagggtccttttgttgcatcaccacatggcagaaagcaaaagggagagagatagacagattgggagagagagaggaaaggggaccaaacgtctcactcttttataacaaacctgctccagtgataacaggattaacccttacatcagggcaaagctcacatgacctaacacctcttagaagtcccaactcttgctggatgtggtggctcacacctgtaatctcagcactttgggaggctgaggtgggtggatcacttgaggtaaggagttcgagaccaacctgcctgagcaacatgaagaaaccctatcaatacaaaaaaatacaacaaaatagctgggcatggtggcatgtgcctgtagttccagctactctggaagctgaggtgggagaatcacctgagcttgggaagctgaggccacagtgagctatgatcatgccactgcactctaacctgggtgttgaagtgagaccctgtcaccaaaaaaaaaaaaaaaagagtcctacctcttaatactgttacaatggcaattaaacttcagcctgagttttggatggaacaaacattcaaaccatagcagtatcttttcagaatttttaactgaatatttatatatatgaacatttagaattaggggtaatttttaaaaatcaaaagtgatatactacagatgttattctgtgattgatctttgcacttactatgttttggagattattttattttagtacgtataaatctataccagttttcttaaattgcagcatagtatgtatatcaagtttatcctttaactattttcttactgatggccttttttaatattgcaaaccatactacactaaacattgtcgtgcatacttccttgtgtattacattggtttttaaatcaatgaactagttgtaaacatggagagaaacaacaaggagggagatggatataagagaagaagagattaaaggggatggaatcagttgtttctggagcacagaatattcaccaaatttgaccagatgcgcggttgctcatttaggaaagagcaactgcactgggatgaagaggttttttaggaaatcagaggtcttcagagaagttttggttaaaatctgcagtatacactaccaaaatggtttttgtctttgttgttcttatgcaagaaagactagctctttttatctagagctggaaggttgctgtcttggagtgggggagaaaggagacaagtatctgatgggtgggaatggaaggtgtgtatccttgcagcagacctccagagtagctgactgactgatatgcatggtagtcctaagatgtgtttgagaaaagaaaatattaggagctcttgacaaatcttgaaaatcaatacaaaaattagccaggcgtggtggcgtgtgcctgcagtcccagctactcagggggctgatgcagagaatccctagaacctgagaggcagaggttgcagcgagatcgcaccactgcactccagtctgggcaacagagtgagactctgtctcaaaaaaaaaaaaaaaagaagaaaaaaaaaatcagttgcccatcctgcagatatacagtatagtgtaactgcttcagccgcttgcaaatctcttttacaattcaaaacaaattatggagaaataagagtgaaatattttcctggaaaaataatgtgaaaaattgaagttttaaatatcatagttaaattgaatgtaccttagggacaactcctttatttaaaactccaattctccaataacacacctaatatttgttattttgttgttaaatatttactctatgtagacattatgctaagagtataatgcctttttaatattcagaagagcactctaaaagctattacagctttacagacaagaaacttgagaccagagagaggttaagtaacttgaccaattgtcatatagcatttaagtggcagagttaggatttgaacccaagtttttatgtatttaaaattctggctattaacaccacactgcaaagaaacttatttagtagataacaagttatatccatatatttttagatatcaatatatatgttgtggatcggtagcttggggcacattactgctttgaattgtggtatcttttattagatattgaaatactggattattgataagaccatgtagcagtgagaaaaatagtttttgctttgatttgtgtcagttatactatgttgttggagcttttgaagtagggagtgatcaggtagagacaggcagaagagattagtttgtatgtgttatcctgaaatctgagttatttgacatttttaaggcaaggcattgattgagttttatgaagataaattggcaaagaaaagtaatcccatctgctcaataacaattctttgcttttagccaagaaaattgatttcaacttgagagtaataatcatatttatcacacttgttaattgcatgaactgtatacaaattgtcaggcttattaaggtagatatttacggtcactgggcgttcctcacattccacattttcattgttatggcattaactattttttctgtttctctctttgtcactgaagacttcacgtagtataatagccagtattttctgtgattatatagcaatattctcaaacctaattgttcatacaaagtacaaatcagggactttttctactaggttctgaagtacttgttctctagatttaaactccagtgttgtactaatgggagtaagtttttcttttatctgccaaggagctcctcttacatgtaaaaaactgttgtttttcctctttgtaaatatcagtgtaaagtacacactgtataaaatgtaaattactgatgtgagagtggccattttattcacattgttcaatgccaaagtgggccaaaggattctggctcattaactttaaggaaactatagtattcttttgtctctttagccttccttctggtttattcaaagaattctcatcaggttgatcaagagttgaaaagtaaagcactgttcttaaaaactgctctctagaaagatctgcaatggttttgaggactgccaagcaacaggaggtagaaaaatggataactaaataacctcatttacagaaaatatgttaggttaaattgcataggaaaagatagtatgggtctttaaaaaaaatggatatttataacaaagaaaggataaaattaataagtaagttataaggaatatttagaaaaataaaaacagtattctaaaagacaatacttatatctttctaatgtaaatcttagaaaatggtgagaatttcttgtatgctttatatttataagaagtaataatagcttttgaaataattccatattataagaagtcttttcttcatatgtacccaattccaaataagtggatgctggaagaaaatctgtaatttattttatttaaaagaaatgcagtatattaataaatacctattttttggataataaaataagcaacattttccagaatgaggtttttttttgcaacaaatgtgcataccaatgatttgaagtatttaaaagaaacttttctacttgaaaggaaccaagatgactaagtactaattttgcggaatctccaattgggaggatatctactgctcagaaaagcaaactaaaacaagacaagaaattaaaattgacaaaggagaagttccatataatctaattcaaaatcaaatgagtttttcaaagaaataagtttcatcatgtaatctaagccaaaatgagctgaaaatttacacacaatttcttttctttttctttttctctatttcccattaggtggtttccatccatggaaactagttacatggcattcctaccatcccatgcccatggtagacataattaagaaattgtgtgtgtgtgtgtgtgtgtgtgtgtgtgtgtgtgtgtgtgtgtgtgttttgtaagctttttactccttctcaacaaagcatttcaaggagccaacagcaaattagaattgaaactccattatgtctctcaggtcttctgatcagctcttattatacttactcttagtaaaataatctctattaatagtgagaagtaaggaactatatgatataataaaaagtgctctaaaggaagtcagaacattgtgtggaagtcctggttccaccattaatggtaaactctttgaggacttccaatttctccaggactggttttcaatctgtataattaaggggtttaggctagactctctttttattttttgaaacagtgtctcactctgtcacccaggctggaatgaagtggtacgatcttggctcactacaacctctgcctccctaggttgaagcaatccttccacctcagccacctaagtagctgggattacaggcatgcaccaccacgcctagttatgttttcgtattttagtagagatgaggtttcaccatgttggccaggctggtctggaactcctggcctcaagcaatctgcctgcctcggcctcccaaagtgctaggattacaggtgtgagccaccacacctggcctagacgctttctaaaattcttttcagtttcaaccttctatggcttttggattcttttatttcttatactttcatattactgaatctcataactcactttttcctccattttatattttcaacttttctagtctagggctctgcacaagttattactctgcccttttattactactccaaggtaattcatgttatatgtagatgtatattagccatgacaataaatctacatactgtattatcatctttccagaatttttcaaaacagaaagtctttcttgactaatcatttattccccatataatagtatgaagttattaacaaacgttccttgaattatgtgtgacagaatttgctgggagcttgaatcagtatatttgtttaggctgcatataacagaaggcttcatttaaaatagcttaaataataagagatttattgaattatataataagaaggtagtgatagaatgattctagtagtacaaacatgcatcaagaatccagattctttccttctttctagtcacccatcctcagcacagtagtttttgatctcagttttatcctcttatggtctcaagatgactacagcagctctaagtatatttatacaacttccttttcttctgtcactttttaagaaagataaaaactttaccagaagttccttaacagatttctttctcagatctgtattagaaacaaattcatcatatgcttatatctaagccattcattggcaagagaaatgctatgaaattggctgggaagtaatcatggttcatcctggtcctgggaggggcctgatctcccttgaagcaccaaccgcctgacacctgaacaaattctagtggctgctgggtagggaacaacagtgtctttacaagttggtgcattataaatacatttccataatttgaatcaagcctaccatctcctcctcatctccaaccacccgccccccccgccccccactttattttctgtatcttcagcaacttccagaaacttctcattcttccttaaatacacatttttgtacctgccatattttgcatgccctcttttatcagcctggaatgcactttgtcacctttgcagcctggtaaaaccatcattgtgctcatatttcaagaaccacctcaaatgtctgctctttagatctgaacccttcctgaattccccagcttagcaggtcaagtgagttgttctcagctttgtacttctgctatagatcagccctcatcattttataactatgtattgacccatttactcctgagaatcctgtaaggatgggactcagttccttggtattttgttctcagagagatgatgcttcatacttaccaactgttcaataaagtttgttgaattaatatagttaaaagcagatacctttctgttataagttcaaagcctagtgattgaagatttttctttacattatttaaatgtatttattttggtaaaatatttagagcaagtttcattccatctgttccatctaagcgattcatgacctgcatacattctaaatgacaggaaccacaagcaactcagtcagcaggcttcagaatcggtcatcctaaaagatattgcaggtcaatggctaatacactaacaaagaaagagcttatgcaaataagtaaggaaaatactgtttcaatgttaaatcattaaagacaaattcagactactcacaaagaagatctataaatgccaagttagaatagtaaaacagaaaacaaaaaaacaacatgaagacctctgattacatctatagtaattaacatatccatttaactcctctgccttcagaaaaccatcaatggatgtttataggcataaatgacaaggacaaagaaagtgggaagggagataacagcaacaaaattttggaagctgaaaaacaagtatacaaggggtatacttcctgatgaatgtaaaaccgtccctagacaaggggggcctaggcaggttgaagactgagtgccattctgaaaacagagggattaaataaacacttatatatttgtgttcatgataacacaaggctttttaaattctgtttaccactgtgtctccggtggctagaatagaggctgccaaatatagatgctcaaatatttgttgaatgaattccgaaggttgaaagtcccaaccttcttcccctagtcagcttccaactatgcttaagccttctggacaggagattgatataacctttggagaattcaccaacccaagagaaaaaacccaaagataatggtgcaaggtatttctgaatgaaactgttcagttggatcatcaaaaagtggatgtagttgacaaatcttacctatgcaaacagagcttccaatctgatttttagtactctagccttaaatatgagtagacagataagatttatcaaatacttagaaaaagtaagtgaaagaaaccaaaacaaatggaaaaagaccaacttcaaagtacagatgttggccgggcgcggtggctcacgcctgtaatcccaacacttcgggaggccaaggcggggggattaccttaggtcaggagttcgagaccagcctggccaatatggtgaaaccccgtctctactaaaaatataaaaaaattagctgggcgtggtagtaggcaactgtaatcccagctactcaggaggctgaggcaggagaattgcttgaacccaggagatggaggttgcagtgagccaacatggtcccactgcactccagcctgggtgacagagtgagactccatctcaaaaaaaaaaaaaaaaaaaaagaagagaaataaaaaagtacagatgttgcaggaagaaggtatcatcagagagaggagaagaaatacacttgatattgtattcataaatattaacattgcttccacgaaacaaaagcagatgctatggaaaaaaaaaaaacaactcagagaataggaaaagagctcttggaaagtaaaaacatgatagaataagttaaaaactcaatagaagggttgaaaggtaaattgaggacatctctatggaaatggagcaaaaatacaaaaaggtagaaaatacagaagaaaaagtgggaaatcagaggaccagttcaggaaatctaacatctaaaatcagaaattctagaaaaaagagaaaactgcaggaggacaaaattgaagaaaaatttccagaactcattaattggagcatttagcacaatataaagtattaaaaaagagacttgtgacttgttctaaggatcattatcgtatcgtatagaaggatcaaaaatcaaaagggcatcagacttctgaagattcgttttgaaacctagaaaagaatgaagtgatgccttttaaattccgaaggaaagtgattctcaaccaagaattctatactcaaccaaactattgatcaagagtgagcatggaataaagattatttctgaggtgcgagcctttaaaaaatgtatctctgatgcatactgactcaggaagctactggaaaacgtgctcaccaaaacaagggaataaactctaaaaacattacccttgggataataaggaaagaacatcccaaagtgacagctgagcaagagacatggagaataaccaatccaggtcaaagaggcctctggatgagatttcttcaagaagatgaatttaataaaattcttgatgtgtttgagccatacttagatttttgtaatatgggaaaagtttgggattgaattagtgataagtatatatggacatctaagggaacaaagaaactaacaaaagacaagaattttcaagaaggaaaacaaagaaaaaaaggtaatcagggtatgttacatagtttagctgcttatagtttttctttggttctgctcatggaaacacaatgactatcaatctaagtaagactataatatattagaaggatgggtgatgagaagtgtgaagtgttgcaaaggtaaatccttatcttccgctatgaagtatcaataagcaatgcccaaaaaaatgaactattaagaagtaactgtaaagttatatcatttagagatagagtggagtatagcaaatgaatcagctaaaatatttgaaaatgggtaccctctggggagtggaagatacatgtatgtattgtgggtgggggatgcactgcaggagatctctttttttaatccttgtggtactacttagttctctaaactatttgcatctataactttgctaaaaataacatttaaatttaaaaattgatcactcttgtaataagttcaaattgaaacaaggagataacatagttgctaagttttatttttggacatatttataacattgtatatgtgttagtgagaataccatgtaacatcactctcaagcagtacttctaaaagtagaaattgctgtaatatttctcaaaaactatctggcaatacacattaagaggtataaaaatgtttattccttctgacttagtacttctgcttcagaaatctcttacagtgatctaccttctagaaagactggagataaatacatcaaaatgttcacagtagttgtctctgagtggtagaattatgggtaaaaaaaagatggcttgtttccatttttcttttgcacccctctgcattttttccaaataatctataatgaagacaggctccttttatatttggaaataatttccaaatataaacattttaattttataacattttaaatttttcaaaacactggtcctcataacaagaaaagttatttgttgcaaccacagtagaccaggttaatggtgccaagagtggaatgcggataaaggctgacaaggccatctggaactgtgagtcattcagagcatcacagaagagagattttctgcaagtactagctgtgttgactgtgactgctgttttcctggttgctcaggaatcacccagggaaggagagggcttccccacgggattagggaaaaaaaaaaaaaagcttcttgttccataagagagtctacagataggatgagtaataagggatagattttactaaggtagaacaaaatgttaggacgctggtacgagcaccactgaaatatccctatatcaagttttagtcttttcattgcatcttctgaacctgctggagatgctttcacatggaacgtatttgctataaacttttctttatcttttgttcaatgctgtgaagtttgctaatcttaatgaaccaagtctcttcatgctgacaactcattgtaaaagaggtaaaactgtgtttccatggtatggggaatggagaggtataaggaggaagatggatttaaattgatttttggaatgcttgctttattttatcagttaaagaaaaggtctaacggattatttagataactttaggctccaactgcactgatctgtttgtcattcctttaagaaaccattttgattctgactacttgaatttgcacattttgttccttctctctggaataccctaacaaattctttctgcctgataaactacttactcttccaggtcaagttgaaatgttcccttcagtgtgaaaactttcatgactcaaaaaataacaattataataattacaatttgatgagctacctggctgtttacctaattctcacaccattagatgagcgaggtagttttaggctaactttaaaaaggaggaaactgagacttacaagacttgggtatgtggcccaagagtacatagctagatttgaaacccaagtccaaacccaggacttcctgcttaaagccccttctttttcaaaaactacattacctattgattattttgctttacatgtgcttacatgttgatcttcctcagtggactgccttcattccttaataggaaataaattgtcttttttggaggtgttacatttttgcatataacattaataagattaaaattttcatttgttgttgacattctttgcttgactctacactccacgggataggatccttgggcatagaaaccacgaatgctttgctcatcactgaatccagcatctgtcagtgtctgccatataggaattgctcaatatacatttttgagtaaataactgaactaacaaatgagtgaacaaaagaacaaatgaataaaaaacctcagatctagcccctaacaaaaaatacttaaaaaaaagttttagtgtctcaattgtctgtatagacaatgatttcacaagttcacgtgaaatacactaccaatatcaacaatcatgttaaatcaaatgaaatctatatcctctgggaatgcttgtggtatggcttagggacaagctttacttatgaacaatgatactgagacttcacaatagtcagctgtgcagatgtcagactttgcatttcacacatgcttttaacctagagctcaaataggcagttttaagccctggacctcaagtcaatgtggttcatgttttgtcacttcaagatctacaattgaacttcattacgatagtcttagatggtttttcataaattttgagtcatgaaaaactgacaacatatgagtctccaagtaccttttaatatatgcaatattttacctacttaattaatacatgtgtttatttgataactaaaaagtttataaagtctagaaataaagaaaagtccatgtcctttttcttttttgttttcttttaaatgaaaactcatgagaaataagagggcagaatgcattaaattatttcttctgtaacagcacaattctatatcagattttaaatacaaaagaacatgcaaagggataacagcattgacttcagttctaatataaataaggcaggaaattgggtgaaatcagtttttcctctaatcttacatggaaaaaaatttgtcatttggcaaacccatatgaatccgatctgtttggtttattcatccatgcagtgacattcagactccaaaaactgtatcagaaacctagtcaatatttaaatgccatcatatagattagaaatggaataaggtataggtaacttactgcatttcaaaaaaagtactaattgaaacatattgtcaaacatatatctttttctctctttagaaacctatggctattttctgtctttcagctcacgctacagaaaggcctatttttccttctgtcttagtccattcaagctgctgtaacaaaatatcatagccaggcacagtggctcatgcctgtaatcccagcactttgggaggccgaggtgggcagatcacttgaagtcaggagtttcagaccagcctgggcaacatgatgaaacctaatctctactaaaaatacaaaaaaatcagccaaatgtggtcacaagcacctgtaatcccagcaactcaggaggctaaggcactagaatcacttgcacctgggaaggagagggtgcagtgatctgagatcatggcactgaaatccagcccgagtgacagagcaaaactctctctctaaataaataaataaataaataaataaataaataaataaataaatcacgagctgggtggcttataaacaacataaatttatttctcacagttctggagactagaatgtccaaggtcaaggcacggtagacttggtattttgtgagggctcatttcctgggtcatagatagtgcctctggctttgtcctcacatggtggaaggggcaaggcagctctcttgggcctcctttataagccactaatccccttataagggctgtgctctcatgacctaattatctcccaaaggccccacctcctaataccatcacattggtgatgaggtttcatcgcatatgaatgtggggagggacacaaacattcagactatagtatctgctttttgccacagaatgaagaataaaccacgtcttataaataaaaatctttccatggtcccccaccacataaggacatgaccaacttcctttgctagtcatccatctctcataatcctctccagcccatctctgcagcctcatctccacccacacatgcattctgctgtaacaaatggtgggcaggcttccaaatgtactgtgttcccatgaagttgcacctttgctgatgttattctctttgcctgggtcccctccccatctattcactcctttctgcacttcacccttgctcttcttgtgccctaatagctcctccttttgtgacacatcaaaaattgcccactgtaggaagcccctccaagactaagagtgcctctctctgtgttcctgcatgtgcttttggagcccttatcacacagttgctctagaattgttagcttgaccacactgtgagttttcttaagggcagggacttattcctctttgcatatctggaatcttacccagtgtttagtacatactacatgttcaataaatatttgttcaatgaatcaatgaattgataggttttcttttagtagaaggaataaggtacattttttttagaacagcatccgaaaagcaagcaggaaaaattgggacatctttgcttaaggtaaaaatgcttttatggggaccacctttgaaactccatctacttggatccttttagtcttctttatgagataggaatattaattcttagatccaattaaagaaggtctagttaccaaggaacaaaacaaattggtatagaatggactttcttataagagagtcccaaatcatagatcataaggacaatcttatgttgaaatgtctcaataacttccaaatgccgatgtgaatgatatcatcaaacagtgtgagtcaaaggaagaaatgggattcctaagttttcattgtactccttgactattttattggtgtacagtctcttgacaattattttctcatcttctttcccaaggaaactttagatttaatatgtttattctgcaagatgtttggagacaggtatacaccctaaaaccaccattacaatcaatgccataaacttattcattgcctccaaaagtttcctcccatctttttgggtttttttgttttgttttcctttcatggtaaggacacttaatataacagctacccttttaccaaatttctaagtatacaatatagtattgttgattgtatacttatgttatacagcagctttccagaacttattttgcaagactaaaactttgtaacccttgaccacatctaccaattcccatcttcccccagcctctggcaactaccattctactttctgcttccatcagtttgactattttggattatacatgtaagtgagatcatgcagtatttgtccttctgtgtctggtttattccacttagcatgatgtcctccagttccatccaacttgttgtaaatgacaggatttccttccttttttagggctgaataatatttcattgtatatgtgtgtgtgtgtgtgtgtgtgtgtgtgtgtgtgtgtgtgtgtgtgtgtgtgtgtgtatatatatatcacatttcctttgtccattcatctgttgatggacatttaggttgcctctgtatcttagctattacaaatatgctgcagtgaaaatatctctttaagatccagatttcagttcttttggatatataccaagaagtgggactgctggatcaagttacttcctgtttcgaaagtagggcaccctctggacatttctacaactgaagtgattgattcttacttttggaagtcaggctatttgttggaatggtggggaaaaaagctagagcttaaaaataaatctaaagttggagaggggattattactgatggatgcattaattcaagggttactgatactctaaatacatttttaaaagttgtttgattaacaagtcaaaacagatggtttaatgacattttagagaggtttaatagagatccaactgaattaacaaatcaccatggtgtgcagaatattgaaaattcaccactagtagatttatggcatatttctgggtatttcattcccatttggtttattatgataaatcactgggaaacgggtagcctgtaggacatgacagcaaaccacactttggcaggaccagcatcagggctgcgtgcttttttaggaggctatgtagtctagctagcacagagtgacccagtgagagcttggttggctaggactttctggtggtagcccacagagctcacctgaaagagtaccaaggatgaaaatatcatcttggctaattggtctgctagttgatttaaaaaataaacaataaaaaaaatttccagtgtattttagcaaagtttaatattttgaagggggcagaaatgtagcatattttgggatcttaaatctgaatttgtgtctttttccagactttgtcagtgtctttgtctctctctccctctgccccctccatgtctccctccttccctccctccttctctctttcctttcctggtaagtatactagaaaaaagtatatttttttctcattttttttaacttaataacaacagcaacaatgacaacagtcaaactcttgaattctggtcacaatccagatcaataattttttccttgtagttaccttggaattaggttcttagcccctcactgctctctgtatatttctgtacaatattcatcagtttaaataagtacttcaatttcataccaaagtgccaagactatcctattttcactcatctttaactttcttctttttcatttcccacacccctgccattgccaaacaaaactgattatctctgtttttatctttcttttagactttttaaggcaataaaaaattggcttgctcagaaggctgatacactgagtgttagaataacccaaaggttagaatgctttggtcaacttatgggtatttttgatcacgtatatccatttttaaacctgccattcatgatggatcactgaccctggccctggccctgacccatctcaaaaagttactagcatgattactgattaacacttagactgttggcttgaagtttagtagcctgaaggaaaatttccagaggcattataataaggaagtttaattaagagttaatgttgactcaggaatattatgtatagcattgatccacagtgttgctaatgaattcattatgctgcaaatgcaagtgatttgttagtacattggccaataaaagtgaaatctgtctcaacaagaatgttgaaagaaagaaggcagtgaaactttcatctccactgggagtgaactaacttgccaaatctgggtcatcaatcatagtaaaatgttcaaaacaaataatgcatctttcatggttcactgtattcatcagcacttttgaagtcaccagtctagagtagtcgcctttggccaagttttcagtagcctgtggtttaggcaataagcctcaactgtctttctcgaggatatgttcccaggtggttgtactccatgggccattttcaatcaaatctgaaaggacaaaagggcagttctgtttatatgaaatgacatcatattataacctcaaaattgttgtcttaaaagtcaaatcattatctaaaaggtctcttagaattacttagagcttgaatgcaaaagactgaatttcccactcacgtacttcgccaacactcattacataggcaaaaaagtatagtaagtgtcacttatgtgagcctatgtatgtatgtagtgttatagggggtgggggtggcaggaaagacagctcaaatatgaaataattgaattattcattgccactgttctgattgcctttaaaaaaagttttatctggaagttatttcagacacactggaaagcttcatgggtagtgcaaaaaaaaaaaaaaaaccacatgcattcactcattgtaaacattccacctcatttgcagtatcactctatgtgcacatacacacaaatatacatacacacacattgtctttttttctctgaaccacctgagagaaaactgcacacatcatagccctctatccctaaactcctcgatgtattcctcccaagaacaaggacacttttctgtataactatagtctcaaacatctgattgcctttgaattttatagcatgacttatttatacctttttacttcgagttctaactcagatactgagctatagaggaacagctcaactattagttgagggatagctcagatgtctgatggaaaaaagtcacatcagtaacattttgaattctgcaaatatacacaatatgccaatgtatgggagataactaaatactggttttagagaaaatagatgagttaatacaaatagagattccccttaattaatagatcttatatgtttggttatatgtcttatccatgctattatagctagctagcattcattaggacagccagagaatcttgtctttctgtatttttatactgtttttcttcttctgatcagccgattccaggttttgaaagaatgaagtagttcctacttagataatgctattgccttgctccttaacagtaagcagtggagaagcagagtggacgctggtgatgctgcctttagtcctggagggagtgtcaaccagtgggtaatcattctgaccctgcaacacaaccatcccttcactatttcagtgaaggtctctacttcggtggtaggtctctactcaacatggtacttatagccgttttatacttgctatcttaaaaaaatatgcaggctttcactgctgtgaacagataattgatatttatgtttcataatctgtgaagatagctaacacatttctgacagttgcaattttttttcccaaaacgagtttgagcatgcctatccctctctacccaagtatatttaacagcatttctatctattggggaatctgagtgaggatgacaacgtgtcagggattagaatggacaggaagagtctctgtaagaggagggtgtgatgctggagcaatttatgaaaattgggtcccctggtaactgtagtggatgttatacagacagtcctgcagagtcatccacgaggctgactcactgacaatgtacacatagaggtgggcctcgagtgtgtgcaaataacaagtttactactgcaggcaaactcttcgtttattcatttgacagatttatattgaggggcactgttctaggagctggggatttggtaataaataagatagtcatggtccgtaacctcatagagcttacacataaactgttttgctttaaaatattgtacattcagaggtgtttgtgctccgaccatatgactgcaatatgtcatttgataaacctttcaggcatgacttggacccacccagaacttagctttaaagctatcagattgacaggaggagagaacactggctttagatgacaaatcatggaaataattatgaaaagaccatccagtttttaatgactttacaagaatagtgttcttgtgagactattgaataagaagaaatatatgaacatttgtatcattcaactgtctaactgataccaacaccaataaatatatgaacatccttattattcaagtgtctaatgagtgagggacagtgcctgtaggaaggagagcctcccaacaatggaagcagtgttattcttcatggtagggagaccattttttggttcctcacaatgacttccaggctggaatgatttccaagtagggcagggaagacaaatatctgaagcctaagggaagctccagggtgattcttgtagttttgtttggcagactttctaaaaagcattgtcagatagttttggagcaagcagtttagccatctactaccacacaatatattcaaatcagagtaagctggaagaaagtcatccaacatccaagtctcagcctggcctatgtgaacatacttcttcttaagactaagctgtaggggtactatgcttattacctcggtgtgaaataatctgtacaccagcaccccatgacatgcaatttacctatatgactaacctgcacatatacccctgaacgtaaaatttaaaaaatttttatagatatgttaaatttgagatgtttattgaacatcaaagcaaaaatggtgaatgaacagatatatgacacaaaaaagactaaggtataatcctatatcatgagtgaataggaattttttgttattggtgtttgcgttagttgagattttattcagcagtaaatagagagatttaaaatagaagtggcttaaggaagacagatatttctccttcatgtaaaatctgaaagttggcagtccgaggttaatatggcacctctatccagtacagtcttcaaggacacgtgctctttccatcttattgcactgtgaggtgtagcctctgttgctaaattcaactcaccatccaatatggctgctccgactccagccatcaacttcacattctagccagtaggaaagagaaaacaataaatacaggcagataaaaagatagatgacaaatttctcttaagggaagtttctagcacatcatataatatctacataacgcttctactaccaactcattcaccaaaacttagttatatggcaacacctggcaaccaaggaggctgtgaattttctctattttgggcagtcacatgcttacatgaaaacaggtatttgaaaacaagtgatgaagaaaagcatcaatattaggggacatttagcagtctctgccacaatgttgcctattaataatcctgcatacattttaaatatttaatatcagtctgcaacactctatttgcaaggtaatgtatagtataatctttaccatatgaacttagtagccatggtgttcaggaaagttgtgttattttgtgctagaatattttacctgccctaggtaagggcctaaagataaaatgtgctagactaattaattttaatggcatatagcaagagatttccagcgttaaagattgcatctccacctgcaatttgggaaaggaaaaactgatagcacaaaataaaagtagtgggtgtcctgaaaactgtctgatgctcttcatgttcttaccaactcatatcctcatctaaatttgaatcacaggtacattctgaccttgtcgtagagagagtcctaaagtctcacgagagaattaccgtgcttgttctaacaagactgtgttccagcaggcatgccaaaatttgatagctacaaatagggagatttgaaaggaaagaggtgggagaggtaatttcttttaactcaactgcatctggtggattaaggtagacaatattaccattttgctgacagaaggcagacatggcactaaagagggagaatgagcaaccacagagctgatttaatttccagtggggtttatggaagcaccaaaacatgatgtagccaaatgttcctaaaagtatgaagtaatttaatttgttccatcattacaagaaattaaagccaagcacaattacatcccagtagtaaaaggaacccgctgaattgccattgttattgactaaatgaagtgagatttctgattaccttgtccagcacattttaatttctgtctgtccatttattccaaatcacattacagggccttaactgatcttgacaaaataagctacattattaaggtgcagtttaacctgagaagctttaattactagattagagttttcaaatgggcatgtcttctagacttcagtacatttagggatgtaattattagagattctttgtttctgatgtgcaaaagagacccaagtttaaaaggaagacttaaacttacggaagtgatttttttttttcttccaccaagagtctctttgtagacaggtgtctgttctgttgggagtggacttacacctcctgaatgctgtgattgagagagctgcctccatagtggaaagcccccggtagagggtagtacccagatttccaaggggaggggagttgggggactaaacgatgtacagtgaaccctctcataagtagggtgtctagatgatttagcattcaaaccagaacactttttagaatgaaaggcaatgctattcataattacactggtataacaggcatagaccttggaagttccaggccaattaggatgtatggactctgtacctataaggaagacaaggcaatagatatgtaaacaaatcaatgtgatagtcattataggcatctggagaatgaaaggctctataggacactgtgggtgggtgggcatggagaacagtcactctcttagggatttctctcccctggaacaaaagttacactaatcatgtgacatctcagagcatgaagtttgtagctccctcaaccatattcatattcctctaacagtccagttaatgattctcagatgcattagaaactatggaaatattatagaaaagaagccttaacaggggaagtgtttcatgctttttcagttccattcaacaaacatttattggatacctagtatatgacagccagtgtttagcaccagagatcaaaaaatgaattcattatggttccagccccagagaaattcagtctagtaataaacacataattgtgatagactgtttagtgatttaataacttaaagagttaacttctgatttggttctcatgcatcaaacataatatttgccagtctctatctctacaaggagccctggatttttcccagtcccctactaatgctagataatatggcaaaatacacaggctgatcaggctgttttagagactcttttaagcagagatcttttgttttccagactgctaatttatttttttctacccagaaagcccttcctaccatctgagctattctgaccaaatcagcgaagacaagctacagagatttaggatgtctgggctaaaaaggtttgcttgtttaattagataaataatttgagaatgctttccaggattactgttcctaaccacattgataaatgctgggaagactatctcagttatccagcattggataacagactgttggagaagagtgaagcttcagtgtgagctgggaaagatcccaaaaatcctaacatgctctaggtgcctgcatataaaattcatcatcatagtgactttaggaccacttgctatttttcaggcactgctttacatacatagtcctatttaaataattttcagaatcatactgtgatataggtactgctttctccattttataaattagaaaacaagctaggttaattcacttttataaggtgccaagctagtcaatcagtggcaaagctcagatttggaaacaaggactgccttactccaaaaactgttctcttaaatttcagtgtttgtaaggtccctcactgccccagcataacccagcatttggtccattcaaggattaagaggaacagggatctgccagccttgtttctgcagaaaaaaatgggggaggcagagctggatctaaccaaacaggttaaatttaagtgccaggtttccgtgaaggagaattatgccagcaatggtttctcaccttaatgaattcatttctaaccattctttgccctgcaaagacagcaggatcctgggtccacagggcccagttcatggagaggagaaagaggcacataatgggagcaaaaagtgaagaattcaagctgcaaaatgtaacggaattctcaaagtgctgggttctcttcactcccttatctggcagctcctgttttttctcctttgcctcccacagttgccactttaaaaagtcatttttaatgtggcacatatacaccatggagtactatgcagccataaaaaagaatgagtttatgtcctttgcagggacgtgaatgaagctggaagccatcattctcagcaaactaacacaggaacagaaaacgaaacactgcatgttctcactcataagtgggagttgaacaatgagaacacatggacacagggaggggaacatcacacactggggcctggtgggggttgggggagcaaggggaggaagaacattagtacaaataccgaatgcatgcgggtcttaaaacctagtttgggctgatgggtgcagtaaaccaccatagcacatgtatacctatgtaataaacctgcacgttctgcacatgtatcccagaacttaaagtaaaaaaaaacacaagaaaacaaacaaacaaaaaaactcctttttaaacattgtctcagcgtccagtcggttgagtttctgcacttttagacactcaagccccttctttcgtcctttgctccagtggttgtagcttcctacctccttcttaccctcacccctaggcttccactttagagaatttggagaactggggaaagaaaagactgttttgtgcatggtgtgcctgcagcctagtgccatgagctggttcttgccgtgtctgagccaccagatccactccttctgtggttcacacgctattccctctatcccagccaagcttgcaaactctgatcatgaactaccaggtggaggcggggcatggatatcctccccaggaagcctgtctggaacctctgaacttttctgacctgtgcatgcctctaccacagcacaccttaatttcttttgaaatcactgcatttgttcatttgttagttgtttgcttctagatggtagacgccttgaggccagaattcttctgaactaagctttggaagttgagcacctcatagaataccaagcttctcgtattactggtggggttcaacaagtatttgttgagaagtgatgaatcaagctaaagtttaagtaggcaaagatgaatcacgtcataacctctggtttcccaactttgtctatagaaaaggctccttgctaggtaaaacaaaaacagaagaagtatgtggattctcttcaactttgggactcatcaccctgaatctctcagttatctcaagactgattccctccaccctggagggcctccctgcccctcctttgtacagcagtgaaaggcagaaattgaatagaaggagggaaagagggaaaaaggtctagatgatcaagtggcaaaaacaaataacccagcatgaacaagtatgcagagagggaactctgaggaaacttgctgacaaaagatagagatggaggtgaggtcaaccacaggggaataatgggggcagacaagtctaaggaggtagattttatagggacttcgaatagatgaactgaagtttggggaagacctaaaggcattaaaaatccagtataagttcttgattaaggacagatatcataataattattattataatacaaggggtgctttgggaacataggctatgtaggagggattgacagaggaagggaggaaagatctaggaaaatgagggccaaacggaaaggtgtccttctcctgttcatttgccaatgaaatgcctaggatatatggtggtctgctcctaccctccacagttctagccactgcaaccaggatgcccagcaaccatgtcattcattcattcatatggtctatctgtctcctataggcatttcagtgagtggccgctgctttatgtgttctgttggtaaacttgtagtaccctgagaaaactcacacattatggagaaattacttcaaaaaatatgcacagtagttaactgaaatctttttatgtgttctactctcacgtgaagtagagaagtagagggagagttttttaattataaaaagggaggaagagggaagagggaaacaaaactaacatttattaagcaaggtaatttcttacctcagtgttttcaaaccaattggtagatttcaaaatcaatttaaggggtcacaattaatactttaaaattaaataaaatagaaaacatcagagtgaatcatacatagtaaggataaatgttatttcatgttaaattatgtttcaattctctgtattggctcgaatatatatttactcttatgtgtatggtatatactgttcctatatatacatttcctttttattttatatatataattctttttattggtttaatttatactgaaatgcatggtttgttaaagactgtaaacaaattttgccatgactattatttataaaacacaagagtttctttaaataggagtccactgctctcctctaccttttaaaaataaatataggtataaaacctttttgtacattttttttatattactgaaagccagcatccacatgccttcaaaagtgagcacctcttactttaaacaaatctaccaggttatagtataaaatataaattttactgtagtttactgtcaataaactttgtaagccactgcttcatttcatttaaacttccccaaaaccttgtatgagtggagtctggggattcagaagaagacggtggtcatcacagaagttgaaattctctactgtttacttcttttcaaaggtcttgttagcggtggccttgaaggtgatgaagaaagacactttcaaggtggacaggtataattattgggtcaccaagaacaaatttgaaaaacaaaatatgccaattgaaattagcatgtagcacctaaatacccagaagcttcttcattgaataatttattcattgaataaattatgtaaactgaattagtaattcctagtgaaatagtggatgaattgagaatagtggtattggtaaaaatggaaaaaaatttttttcttttgagacagaatctcactctgtccctgaggctggagtgcagtggcacgatctgagctcactgcaacctctgcctcccaggttcaagtgagtcttgtgcctcgcttgaggcacaagattagatttagtagagatggggttttgctttgatggccaggctggtctcaaattcctggcctcaagtcatctgcccacctcgacttcccaaagtgctgggattacaggcatgagcgaccgtgcctggccaaaaaaaaaaaacaacaacaaaaaaaaacaaaaaacaaaacaacttaattcataaaacttaattcaacaatttaagagttatacttcaagaatgaagatatataatgaaaatatgaagtcttcagaaggacacacatataataattttagtaaatctcaaatttgtctcaaatcaaaaacttgctacacatatttttgtcttaattatcataattaaaaatgtctacacattacataatactatctagtaaatatgccctagagattgtgtgtgtgtgtgtgtgtgtgtgtgtgtgtgtgtgtgtgtgtgtatgtacacccattatgttttcagacaattggaagaaaattgttaggcaattgtttttcttttatcaaggagctgtcatttaagtgcaaagctggagtattcaaaataaaatttgggcttacaagatcagggcatggcaagacctatccagattgctgtggaataatatatgcttccaaacgctaatcttaaggatgaaaaacacataaatgacatgccttcttccccttgcttaccttagtgactacagtttaaataatctaaaatagcagataccatcaatactgttgctaattatgctacttttcagagaggtacaagagtccttgtacctctagtagtagtgataccactactagtatcaaaaatacaagattgttttgttaattttgaccatgttttaaaaaaagatagggaggagatgaattactattaaaagcagctcttatattttacatgtaatagatgataattacaagtttttaacaaataacacatttaagttgaactgaaccgccaaaaaagatagagatatgaatatatgatttttagattaaagttagttttaacattcaaataaagtgtgggaaaatggcctggaggccaccttctagggaatgtatttttagccctattttacaaaaaagaaaactgaggtacagagaagttaatttgcccaaatttgccccatggttgctaagttgcagagccagcatttgaaccactgttcccaagtcatactctttctattgcttgtaactgtcatcgtagaccactaaagtggatacctccacaactctttgctttccactgcatctggactaccacaatagctccttagtctccatccttctctcttctccattctatcctcttaggctaccagtgcacttatccaattcccacaatatccactagctcaaggccacacatttaagtgttcaactctatatcccttctcctccctggaatgtgtctactccacccagcccatttactgtccacacatacaacctttattcaggctgcagacatttcctacacctgaaaacaatgccagcggactccctcctcccacagccattaaaaccacagtcttccttgaagacctacatccaagttcaccttcttcctgaaacccagcacactgagctatagtccatacctccctctccctgctcgaactacagtagcactcccaggctgaatgatttatatgctaccttacactgtctctaggcagcagccgatcatgtgtctgattttctcagcaggttattatggttccttcctgggcccaggctgctgaatctttcatgttcttgtatttcacagcaactatcacatcagagaggctcaataaatatgtatggattttttgactattctctttcagggggaaaaagagagaaagaaaagaagaaagggagggaggaagattactctctgaccatttctcgatagcatacaaagtcaggaggaagagaaataaaatgtcgttagtggagatttcaaccatatgggaacctactaaacacatgtatttgttaatgttttggagttacctgacatataggtataggtataggaaaacctattccaggtattcttcaagaggtgatagttgttgtgtgaaaaatgcattctaaaatcaaacaggtttagataatgcttgttaataaaattaaatatctcattttgctgtggaccttctagcttttggtaggttcgtgtccattagaaatcactgtaaaaagcctacatatacaatatttcccaagcttgtttgaccacaaaacgtcattagtaaggagaatcttataaggacaatattgattggaacattctttgggaaatgtttgaaatgatcttcccagtaacctcagtgtaagtgatgctctgtcattaaccaatgacaaatacatattcttcctacatagttgacttttcatgatttggtgtggtcttgtaaaagctattctattttgttgtttgtttgtttttgagacagagtctcactctgttgcccaggctggagtgcagtggcaccatctcctccacctccagggttcaattgattctcctgcctcagcctcccaagaagctggaactacagacatgtgccacacacacctggctactttttgtatttttagtagagatgcggttttgccatgttgtctaggctggtcttgaactcctggcctcaagtgatctgctcgcatcagcctcccagagtgctgggattacaggcgtaagccactgtgcctggtctaaaagctattctaaatcataggttgttcactcacatttggctcagaactggttaatatttgagggttgatggtgatgatggaaaaatagtaactgttttaggattgagaatctgtggaaaaggaaggaaactctcaaatattaactaccttatttaaaattaacttatttaaacaactctgcaaagtggttcagtatacctactattgattgaataccttctatatgtcagatacagcccttggtactttacatttcttatgcatttctcataataaccctgtaattctcaatgtatacaatgtgctcaggtcttttaaatggcttatttcagataatacaactagaacaatggcaaggctggaattcaagttctgagtgactcaaaagtccatgctctttctgatctatcacactatttcccatgaagagctcttataggttgtggattcttctgtgtgtataataactttcttagccaaatctaaatctccatagatattcttgtaaaattataaaactaatttatcttattcgtgtatggagccagttcatatacaactggataagccaaatataaccgatatactcttgagttctgaaatttgttctctataatgcacacacagttaacaaatgtaggtttaccagtaggccaaaatagtttatcactcatatgtgttgcttgtaatgcaagtaatgagattaaaaattgtacataagaaattacctttctgagactctgttcatagcctgtttaaaagggcctagtcttttcgggaaatcttttgtgtgttttttcttttctttttctctttttttgggacagagtttcgctcttattgcccaggctggagtgcagtggcacaatctcggctcactgtaacctccgcctcccgggttcaagtgattctcctgcctcagcctcccaagtagctgggattacaggcacccgccaccatgcgtggctaatgttttgtattttctttagtagagatggggttcatcatgttggccaggctggtctcaaactcttgacctcaggtgatccacctgccttgggttcccaaaaggctgggattacagacatgagccaccatgcccggctgtgtgttttttcttaatcccagtcttcaactggacaaatgtctctttggcattacttcttaacccttaggtatctcatagtgagagagatataaatgctaaacagagatttatgagaaagttaaaaaaaagaagaagaagaaagcagagatagcgattccgaataaaagattctggggcagtgttgattaaaataattgctttcttttcttcactcaggaaagtattcttaacttggagtccttggtgacttcagggaagtcagtgaacacttttagagtgaaaaatattgataatatgaacttatgctcatttttctgggggtgtttgcatcagatgcacctttgtgcattcatctgtttctcccaaacatcatactggtgtattggtgaattcttttaaaattttactctattttgtaaggatcattacatatgaatgatataccataatacttgtcatttttattttaatgttaatatttcacttcagtaagacaccatgatctgcttgaccattaccaaattttggcaatgttagttcctaatactcttttaaaaaaagagaaagagtttgaaagcaaaagactgagaacaagagatagacgagggtgattacatgtaggaagccacacccaggccagtattactgtttgaatctcgtttggaaataaatattcttatctgatagaaaacaagcatacttactgattattcactcacaaatatttgctgagtgcctgtaaatgtcaggaattttctagacagttatagaaaggcctagacacaaatataaaaatgacattagaaaagtcatacaggcagaagccagcaaattatttccaggtggaaagattggctaagatgggcagtcttggatgggatagtcttagatgtaaataaaagggaaaggtattgaaaagcagccgaaaaaggcctatgtgaacagaagtgtgacattaatacaataagtaggagagagttgtgcagcaggttcttaaaagaatgaaacaataaaaccagggtttaaggaagattattctgactttataaataggactgtgttgagaaaaagtgaatccaaggagatccagtagtagaccattatatgaatctagaaatacacagatgagaatttgactgaaggtgacagttacagaaattaagaagaaattggtaagtcaactggcaaagtattggatgggaatatggtaggggtaggagtggagataagcagagtgagtgtaaatatactccagaactttctatttattaatagctttatttctgagaatacctcaatttcaaatagaaaacatgtacccctgaagaacagttgagctaaactcacagaattccaggatcatggtattggatgggatccttgacaagtaactggtcagtttaggaattccctctacaaacatagctgaccccatccaggctaactataatgaacaaccttaaaaccaacacctaacccagatagtacaatttcagaaatcagataataaatgaatgttagagctgggtaggtgctaaagataatctgttcaaactccttgttttctctaaggaatactgtatgcagtaattgacaaaggtgaagaacaaaagactgttatatcctaagattgatagtatatgatggaaacacagatgctctcctacagtccccccagggaaataaaattgattcctaaaattacaacaagaatacgtaaatagcatacataattgtaactttttttaaacctgtttgcaaaaattgtcctgtaactttgttcaaacaacttcccagacaaaagcttcctcagtagcattctttaacaccctctttagtcttgtgttgctgaaatatgtgtttggaatgaaaattatcttagcgcaaacctgtgggtatatacggtctgtactgaatatcaatggcaaagccttgatatttgtcttagctcaagctgctataacaaaataccataaactgatggcttaaacaacaaacttttatttctcacagttctgggagctggaagtctgagatcagggtgtcagcatagtcaggttctggtgagggcatcttcagggttgcagactgcccacatagcatgtatccacatggtagaaagagagcaacctctggcctcttcttataatggcacgaatctaattcatgagggctccattctcatgacctaattacttccgaagggctttccctccaaataccgtgacaccggggattagatttcagcatatgaatattggagagacacaaacattcagtccataacaatattttcctttgacatttcctttttctttgctcctgagagtttttcctcctaactttctgcagcttctccttccccttcagggactgcttaggattttctccttatctggtcaccaacctcttaactggtctttacttttctgatctgcctttatactattcccagagtaatctttttgaaaagcaaatctgaccatgtgacttcctcacttagaagatttttaatggcctctttagaagaaaatattgtcttagaatagtatacaagtcctccaagactagttctccatctttatctttgtccactgtctgatctaaactttatatccctacctgtttgtagcttcctgaatggcctgtgttctctaagtgaacttcttcagaatgaatccctgttcattccttgaaattcttttttctttctaactaccctaaaaactgttccaggtaactattaagtttctggaccccgaggttatacctaggtattagttgataggctcactaaaattaatagaatgtttgcatttaagttagagacttgagtccaggagaaagtgaagatacaatggaggaggaagggaaaagaatctattaggcaatcaatgcaagattatttaactcacaacctctcacttgaactaaaataacttacaaggctcttgttattatctccaatctataggtgaaataaggccctagaaagattagtagctgaattgcctggaattgcttgtatgaagtggaatagagattggaatctttctccactcttccagtttctttcaaagaataatatcactcacagttgcacacatgtcacatgaagcccccaacctagatgcctaattaaacttagctcaaactccaattttttggacaaaaggcctccttattcttataaaagctttctcctctttctttgactcttctcttatgtcagctcagagagacatttctgcttgggccaatctggccttcaagctcagtcccttcaatgaataaaacaaaacaaaacaagtcgggattttgtaccttcagtaaccttattgacgattgggagaaagggaaaatgcacgggttggagttaccctttagaccaagctgactcctttctcttatatgcacacacacacacacacacacacacatcttcaataaccttattgatgattgggagaaaggaaaaatgtacaaattggagttaccctttagaccaagctgactcctttctcttacacacacatacacacacacacacacacacacattctctctctctctctcactctttcatgcccttacatacatgcacacacagagaccaagctgactcctttctcttacacacacacacatgcatgtgcacaaacacacattctctcgctctctcatgcgcttacacacatgcacacacatacatattccctctctagcaactggcatattcctcccctttcctgtgtagatgaggcacagattagttccacccaaaccaaagctcttcaaagtctcaccttctgtcataaatagctttatcgaacattttaatgcaggcagactctcgtgaaagaaattctggtgaattccattgtttttttctccatcttattacagtatgattaataagttagtgactacaaggttgtagtttttaagagcaagaagtccactccctttcaagtcacattgggcagtccttctgttcatacctgacatattgtgggaacatatgtctgcgtaggattttaatacagagattgtcttagataagaataatcgtcagagaagcaaatggtctataagttatttaattttattcttaatatggtcaaagataatggttgcactgacttcaactttactttcttaaattccattaattgcatagcactagaattttccatataaaataaaatcagatcccatgtcacacagtactctgagtcactctgtgactcctactcttgaagatatagtcctacctgcagatgcctgacatggccagtctttgagatggccagtggctgaggatttctcagatttctccagaatctgttcccctaagcaaggccctactcatggttatttcttttttgacacacacatcttttttttttttttttttttttttgagacagagtttttatgctcttgttgcccaggctggagtgcaatggcgcaacctctgctcactgcaacctctatctcccaggttcaagcgattctcctgcctcagcctcccaagtagctgggaatataggcatgtgccaccaagcccgactaattttgtatttttagtagagacagggtttctccatgtggatcaggctggtcttgaactcccgacctcaggtgatccacccacctcggcctcccaaagtgctgggattacaggcgtgagccaccacgcctggccgacacagacatcttgttcatcataggtctgtgtgcttgctcatcttttctcttaaaaatccttcccactctcttttatttcattcttgaggactcagccttttcccactccacctctgtccctgtctgatttaaatagtcctcttttactgtcccatagcccacatgcttccttctgtgagagtgcactctacagttgtttgctgaaattacctcctctgctggactctgggtaagggacacactcttttcatcatcttgtttctgcagcctctaataaagtgcatggcacatagtcagtgctaaataaatgttgagttactggtgggactaaaagtcaatgaaagccaacctcatgtttatttcatataaaaattctactagaggcataggcaacattcggaaaaacaattgtagttagtgagaagataaaagaaaaagaaaaccgtcacaaaattgcacacatctttcctttggaagctttatgaagtactaaataaagttttatatattttatacaattttaaaatacttcaaaacaataatttgatgccagaaatacacttggagatgagagcagcttgccactagcaaactctgcttaaacctattacatgtacacattgaaagagaatccaaagccttcatgtatttcccatcagataaaatgtatagaggaaaaaaaattaagtcagcaaaagttagacctaacctacacaaatcttttactgtagcaaactaaaggaatgactagctcaaagcaatacacggtgaaacagaaatcattttttccagttctatctactgtagacagtatcaattccttccgtagaacaaaggggaaattttgtaagaattaagagaagagaagctggaactggttagggagatttaagtatttgctcttaggagctttttgttgtagttcttttatttttaaaaaatctggatcagtgctcatcatgactggccatcagagaaatgcaaatcaaaaccacaatgagataccatctcacaccagttagaatggcaatcattaaaaagtcaggaaacaacaggtgctggagaggatgtgaagaaataggaacacttttacactgttggtgggactgtaaactagttcaaccattgtggaagacagtgtggcgattcctcaagggtctagaactagaaataccatttgacccagccatcccattactgggtatatacccaaaggattataaatcatgctgctataaagacacatgcacacgtatgtttattgtggcactattcacaatagcaaagacttggaaccaacccaaatgtccatcaatgatagactggattaagaaaatgtggcacatatacaccatggaatactatgcagccatgaaaaaggatgagttcatgtcctttgtaggaacatggatgaaattggaaaccatcattctcagcaaactatcacaaggacaaaaaaccaaataccgcatgttctcactcataggtgggaattgaacaatgcgaacacatggacataggaaggggaacatcacacaccggggcctgctgtggggtggggggaagggggagggatagcattaggagatatacctaatgtaaatgaggagttaatgggtgcagcacaccaacatggcacatgtatacatatgaaactaacctgcacattgtgcacatgtaccctagaacttaaagtgtaataataaaaaaaatctggatcagttgttataattttttttgtttttttgagtcggagtcttctgctgttgtccaggttggagtgcagtggcccaatctcagcttactgcaacctctgcctgccgggttcacgccattctcctgcctcagcctcccgagtagctgggactacaggcgcccgccaccatgcacggctagtattttgtatttttagtagagccaaggtttcactgtgttagccaggatggtcttgatctcttgacttcatgatctgcccgccttggcctcccaaagtgctgggattacaggcgtgagccactgtgcccgacctcagctgttataatttgtattttttttttaaattaagggcatacaaatagtgtccaaaataagtggtattttttggacttgttctcttcatgtataccaataggtctatctaggaattatgacaagccgatacagtcctttagcagaccttcaagtgttggcaaagaaactaatgtccacatagttacacatcccgtacagtggatccttttacctcaatggtcaacatcactgtgagttgtgggtaagagtaatggactgaacatttcacaaaaaatgacctcaacctctagctaactgctgtggctctgaggtgattacttttttcctttttcaaaaggaagctgcttcttcagcatcttctcctggagcccctggcacagtttcaggccatgtgtcaggggaacctctaagcatatcactgtgacagaagccaagtgctggcccgcaagaattgaggactgtttgttcacagaagagcctcagcagaatgcgggtgttacatagttcaaaggtgccttgaagaaaactgatgctgttgtagcaggggccttcaaggctcaatttatttctcagttgctgttccatagccctctcccagcctttagggagtttagccaatagtttttgcttgggtgtttttctctgtttagttccttgacttagcaagatttggtgcagttaaagagttttcatgtatttttaaggagagccacagtgtatactactctggcaggggttgaggggaagtattttattaatgaatgcagtatgtgttcttggtaaaagccaaaattaaactggctcactgtttttgtcctgctagctgtcgacatttaggtgtgttgcttggtgtggtgactcaatttcctgtgggatagttggcaactccactttgaggtttgttcggcgggatgaaaaggtcagttacttgatgtcttagaacacttggggttaaaattcctaaaagtgaagctttacaaatgatcctgaaaaatcgtggctagctatattgcctactcacctaggaatttggaaaaaagcaatattctcagctctatgctaatatcaagaataattctttatttgagcaacagtttcacagagcaaactttactctgttagtaattattttctcactagcatgtagatgtgttccagtgatttttcatttttcttatttatacagatgttagaacttaaaatatatgcttaccccattttatcatcatactcaaatcctgtctgtcaaaagtggctggtgcatggcttggacataaaatggatattctgaagtaaattgttcctcctgtcactatactaccttcttaagaacaaatcctgtgtataaagtgcatgatgtcttgaagcattagccaaaactttcctgaattattttccacattaaaaaataacaactgaaatataatgtgtggagccacatcctgttagatttgaagcctgagtctgaacagctttgggaacttggtgaagatggaggaagggggcagtttacttagctactgggaaatcacttgaggctcaggctttgagaaagttggagtgcaggggagaggagccacagaaagccgaacctcagaggggactcccagcttcattgtaaccaatgattgaaaagatggcactgaacaaatcccagacacaatggttatgcatctttaatccactggataggctaactatggacagctcaaatgatcataaaacaagtcaatgtcctcttaaaatttcctacattcctatattatgggaatgagagagagaggaaaatatcaaaaccaaaccatatagtagatgcactaccatggcaactaggtgatgctatacttgcatatggaagttattcagtaaaatgaaaatgattgtgttagagccataggcgaaagtattgtttgtgatctttagggtgtggggttacaatggacttcctatatttgtgtgtaatgcttcaatttttataacaagcatgtaatattttttacattcttagaattggggaagctatacagagcaggtattttatatttaccatttaaaattattaatatctttaagcttgttaagggggaaaaaaaagcttcaatctgaaactttaattcacctggcaaggtttaggcagttgtttgtccatctaaagtatatatttacatagactgcggggtggaggaagtagaacaaaaaagaggcaaattttaacctagagtactcaaagtgaacagtaaatagttcaagtattcttgataacaataagccacgtggcacatgtaacaactactttaaaagttactctaacttttacaaagttcacataaaaagctatctcaaaaatcccaggagcctaaattcagtccatgaactttatttgttgtgccatgttaatttatggagtctaaatttcaagggcagaatttcttctccaatacctgtagattcaaagacaaagacaagggatcccaccacttagtgtaagtttctcagtatcttctttccactcgacaatgacaaagttttatcaaatggacccttgggagtttgacttctcctcactatgaatggtttgcttattgcatgctaatgtagaaaagttctcccacaactgatctgcttagggacagtgtccctggtgccctgggtcagcctttgtaaacagaacaggcttttctgtatgcctttgaatatggtctttccgttttctcaaaattgtagtgtactctgcacatggtgggtagaaacacccttccagattttcttccttggcccaagatcatctaggtcttatgcaattcacaggggaaaggagtagtatgcaggacatgcgtaaattctccttaccatgtggttctttcacattgctgttcctttaagagaactcttaggcaattcggcatatgaaaatgcagcctattgtcaaatttgtgaattataaagcgttccgaccccacaacattgtatattttgtttgcttgtttctgtccgccccaacatttagaagtctggtacttagtagggactgggctgggtagaaaaagaatgcggtcttaattcccacaaccctgcctccttgaagtaggtgaatcctaagcctttagaaacgaacccccagaaaccctaaaacttaaaccctcagaaaccttgagggtcctaaataaccttgtttgtgaaacttcgcaggaagcagccggtcgtggagtcgcagaggctccagcggtctgggcaacctggagggcagtggctcggcggggcgcgcggggttctagcgagacaggtgcgcggccgtgcgcgcctgcgtgccggtccctcctgagccccgcggcgggcgcgaccccggacggcggactgcaggcgctccacgccgggttttccgccgctctcctagcacagacagtcccacagcagccccacagacacacacgctcgcgcccgcgcctcctcgtctgcacttcaaagcgagtggcgcccggctgcgccggggggatggcactgcgaggtggcggggcccccggggcagagctcgaggggaaggacgcggcgggtggcacggacagggacaggcttttgcaattcggaatcttttcgtaagggggttgaggaggagccaggcagcgccgagggccgagaggggcgtgagggggagtgttcccggaaagctgcggcgttggagccgcgctgcgcctgccgcccgaggagttgagaaagaaaacaggaaacgtggtggccgcgcacccggccgcggctgattcattcacttcaagtgccgtgcagaaggctcggcaggcggggcgggcgtggggccgcggctccgggttggggaccgaggagatccggctgtggaccagacgctcctctgcggggcgggcacccaagcgcgctcgccaccccctcgccatccgctagagccgggctcctggactgggactcgggcccgccgcacagttgaaaagtcgcatagtggtttttccgctcgcgtcgctgtgtgaaagttggctcgccgctctttgcacgccctccctggaggccgacccgagacgccaagctggagagaccgtgcctccccgaggccggccgccccgcgagcacagcctccgcccccgttgcactgccgggctgggcaatatgaaggagcagccctcatgtgccggcaccgggcatccgagcatggcggggtatggcaggatggccccctttgaactcgctagcggacccgtgaagcgcttgagaactgagtccccctttccctgtctcttcgcagaggaggcctaccagaaactggccagcgagaccctggaggagctggactggtgtctggaccagctagagaccctacagaccaggcactccgtcagtgagatggcctccaacaaggtaagccccggttctgctgtcactggtgcccccaggctgctgattcccatgccggcgagccactggtacccatagccccgggaaataaattgagaggttttttaggcttactgcatgttggctattctgctccttagagggaggttcctgtttccttgctttgcctcccctagtcacgccagataaacattttccaaaagcaatttgacgtgctaaatttaagtatctcccaagacacagggttcctaagtaacactgagcccttgcagcagaaacccagtagggtccatgggcattgcatgtttaaaggtgttcttgggattcccggttgaaaataagaattggtggatgtctgtgaaatcacttgaatgtcaccacctagggcactcaaactcagaagagttcatcgaacttggaaccttcaccctaattcatctagttgtcagggtaccccgcaagaactgagcctttatatattcagttggccatacatatccgcaggaaacattaacagagttagaaggttccttatgatcattacttttgtttccattaatcttggaaagaaagcccagttttttgaggtcatttagtacaaggaggcttcaactaggcatctgtgccatatgtgctaaggtgctggtcttggcagttaatggagttttgagggctgagaagtaaccttcagcctgggacagccttaaaatagcacggaaggcaaggtatagtgttttcagttttgctgtattttttggatttcctgttctttttgtctttagttatgcaaggagataattggaattgtgtatgtttttagtggctatttgcctgtgcatgtcgtatgcagatggctgaaggattcagccagtaaggactggtaatgttgtgagacaattagtaatagttgcctcgtcaagatatttaagtatttttggccacctatttacaaggtcaagaaggttatattatcttacagttcatctatgtgcacatatctttaaatgagtgatgcttttttttttctacctttctatggtttttatcccacctgttctcatgcagtttttacaaaaaggccacggcataacagccacttgattgtcttatctattaacagtgcttttgtaggtagcattgtcaagtgaaaagttggcttcaaataaataaaaggggctctgtagacacggccagcagatactaacctacccatatgcacactgacctacccatgtccacactgatgatcaatttttttgtcatttgtgcctcatttctaaatttggcacagctcctcatcagaatgaccaattattgctctcttactgggacttttaccccctgctgtagcattaggcacctttattctcatctgagtaacaaattcttagttttataaaatatagtttgttttcataatttgattctcaatagcagtagacatatgctgaatatgtccagtgtcctaactgctaaatgggagcactttgccatgggcctgagttcttaattctattgtgtggttgattctgtgtaagaaaatgaagagcagaatcaaaagccacttagcaatgtgcaagcattagtgtatattttcaaggtgattcgacagtagtttttcagctaaatgaatttgagcagctagttactttccctaaaatccatattcttaatgttgagatctatgtttggatttaaaactgaatgtgaaatttaataatgtattgtaaatgacttcagctgtcaaggaattaatctatacgttaagatttaaaaattttttaggtcataataattgcctaaaatgattcctttcttttaaaggcaccagataagacagggatttaaaaaaaaaatctttattatgaaggccccagattagactttgagttaatttacaggtttaataggagaggttggtctgtttggttaaaatgaaatctaggtaaagtgagaagataattttttcaaaatgtagtcattctagcaatgtttatgtcttgtggctgaaaaattaggatattttttcctagcccacgacagagctgaattgaaaaattattgctgtcacactaatttttaacattaaacttagctcagcttaagctgttgcttaaacttttaatgtccaagccattcgtgtcttctttaacttatttatttctaaatcagtgctaagcttacatgactgttatagacaaaaaagggttagcacagaaagaaaaaaaagctcttgctaaaggttgtaaagttacccttcttcttcataacaagggcatgaataagccacatccacaaaagctgtaaactgagttggagcagctgatcggaaggcccctgtgagtgttgccacaccttcagtctgaactggaaatgtgtacagcttgcatcatctccactcagttatttgatatttcttgagtatgaatgaatgagtcagaaacattgcttttcagttgttagttttattaccatccattctttttacatacacgtgttcaaactgatattttcagtttattctcctttagcctttgaaaaattatgacagttttctgtgttctctcttgaggttttaaaaaatttactctaatagattgaaaagcacaataaaaacactagtaagagatcaggatttttaaatggtgatagagaatacttattatggagatggatttaggtattaggaaggaggaaactgattcctcaaacccatttaacaaactgggttaacacattatttctgtttcttagacttctcaataaaaggcatcttagccaattagcagcttttaaatgatgctctaggagcaactagctgtatttcctgtattggtattatatatgtttcttgcttgttgatggcattgaagcaggaaaattattgaattcttggccaaggctagggttggctgtaacacatgtaggatgcttgtaccaagtagggtaagagattccagatggcatttaatttgagtgattaaatctatggcatttacccttataagcacattaatctgcctgagatttgtacagatttcctttggaacctcattgctacaattgagggtaattttagtgaggtctcaaagctttggaggcaggcaaacctggaagttgaattatggttttgtttcttgctaatggagttacattagagaaatgacttcaattttttttagcttcagtttccttagcatacaatgggcaccataataactatcttgaaaagtcagtgtaagagttccaaagaatatatacaaaagagctagctaatatagtatctgacaatagtaggcactgtatctgttgttattgctattatttgggttttaggtcaaacttcattggttgcctacgtggctaaaatgtctttttaccattcggttgtaatttataccagacacttcaagtttgatggatttttataattcttagataactgtctatagcgcacatttctgtatcataaaaatgcttaaattatatttacagtttttgtggtataatacagacatgaacattctgaagttctaattagaagtttaggcttttcttaaattccagttacagaatgccagacagaagagctaactaagtacttttcctgttttactctaaaactgaaaatgcagaccttactaatttttagaacatgtgaaatgtaataagggttagtggtcaatgtgccttttcagtaaaacaccttttaagcagaatagtttcaccatgtttttggttacctttctctcatggaaagtatattgaggatgggagtcagtagagaggagagcaggacagcggcctgggcctcagggctttcaaggattatgctatggaaccctgtaacgttatcctcttgtgacctaataatgcacatttcaccaggccttccctgtaagttcagtgaggttcaaaggagaaaacgaaatcattttgagttattcccaagacatatcactataaaaatgtattttgtttctgctctaattttgggggcagtttgaggtttggcatggctggaaatgactgtgtttcaagctgaaagtctgtcttgaagttagaatccagaccctttctaagagacttcagatttttctatacttcattccaaatatacttaggccagctttacaaatgtggtcatgacttctttatggaatttattttgtgtatttggcttttggcaaacctctctagcatgtttctgttgcctataaattaaattgctttgctgggtgctttgtctcagagctttctctggctgctccccctactgctttgtaatagtcaatgcagaacatatagtaggactttttgttgatgtattttcttctgggcaagaggggtgttataacaaatataggatcttcatagaagtggctaaatcttaagatatttccacattatgcaactacagtgtaactcaacagatataaatgttaaacttttgctaagaaggaaactaagttaattggaaaaggcatgttagttttatagagagaaaacagcctcagttgttttctacattaacatattaaatcttagattaaaaaagtgttaatatgcctaaatacaaactttaaatttcaaaagaaaatatcttctataattatagaaaatcaacatttagatgttttgagttcgatatctgctttttcatctactcaataaaggtagatttgggaaagatttatgtagcttacatgtagtaccttaaagttaatatgaaagattgagaatcctataatcactgttagaaaaaatactttctttgcttttaagtaataatggaagagggaaacaattttaaaggaaatttttctttcactgaaaagtagagcccttgatgttaccttagcataaaacttaggattaaaacaaatcttaacttgtctctgttgtcatccgttcagttcctgtgccagtatttagtgaaagtttaattattcccaacatttaattatcaaaaactcctaatttttaattattcaataaattaatcattactagataaatttctttttttcagttacattttgacttaatatttggggtagtagtggtaacttctgtctgagagcattatgaactgtctacgttttcgaaaaaaattccgaaacataaggattgcccatgataaaagaagtattttttctaatgttatgggtagattaaacaaactggtatttttctagagagaaaggatgatagataatgcttttgttcagtttaagaagatttctgcgatagttacatagactgtagctatcacttaagatataaatacatgatggatgtgcagtgctgtttatgtcattattttcagtggattcacaaaatatgtagggtttggttttctctttttcagcaggagggaccaactctttttctagaactgtagattgctggggttaattttgtgatagcgtagctctagtaggggagcagtttttacatggctatttgttgtaatagtttaattgacactgttagtctgagatctttctagaatgtagagagatcagtagcactttattttaatattcacattagttttgaaaggcatttgaagaagactttttttattccctgtaacagggattggggggtatgccttgatatttgcttaaacaacaaacaattctgctgcgtccattaggaaattagttaagttcagtgaccaactacaatgacaataggtttattatcttttactcttagagaatagtttatcttttataaagtatttattattattatttagtattcagagcttcttgtttttgttttgttatactttgtatgtgataaggatgaatgatatttactccctggcctggagtaggcaccagtgatacttacagcagctttgtacagtgaaaagaacataaatgtttttcattaggcaaacttggtttcaaattccagctctgttgtttcctatctaatattttgggcaataggccttaccgctctggagctcagttttttcatttataagtggcgataatgaaaggggaaaataaaatgaaaaagttattgagaccattagctataatgtatgtaaagctccgtttggtgcattagcacacactgggtgctcaataaattgcatgtgcttgcctgtctagaatatactaaaaaagagagattaagaaaaactctgtgtcacatatttcttgcaatgtaaaaacataatatttcttagaagaaaaacatgacttttctattctttaagaatttacagtccaaattaatgttgctcaaactttgtcatttttgagacagagtctcgctctgtcgccaggctggagtacagtgatacgatctcagctcactgcaacctccgcctcccaagttcaagcaattctcctgcctcagcctcccgagtagctggactacaggcgcatgccaccatgcccagctaatttttgtattttgagtagagatggggtttcaccatgttggccaggatggtctcgatctcttgacctcgtgatcctccctcctcggcctcccacagtgctgggattttgtcatttctgtgtacattcatatctgctattatatgttgaatgttttaacttaatgtattttttattaatctttaaaatttatttgtcaattattcttaattgacaaatattaattgtatctatttcttgggtataatgtgatttttaaaatgtgtacatcatagaaagatttagtaaagctaattaacatatctatattacctcaccaatttatctttttgtgatgagaatgtcaaaaatctattttagaaattgtaaaacatataatacgttattaattactggggtctccatgcagtgcaatagatcactaaaacttattcctccaatctaactgaaattttgtactgtttgatcgacatcttccatttctctctccctcctcctctacagcctctggtaacccacctttctactctctgtttctgagatcgacttttctagattccccataaagtgagatcatttattaaagacaatatttgtctttctgtgcctgacttatctcacttagcataatgtcctgtagttccattccatgatgttgtgaatgacagaatttctttcttttataaggctgtgtaatcttttttttttttttttttttttttttttgaggtggagtctcgctttgtagcccaggctggagtgcagtggtgtgatctcggctcactgcaagctccgcctcccaggttcatgccattctcctgcctcagcctcctgagtagctgggactacaggcgcccgctaccacgccccactaattttttgtatttttaagtagagatggggttttactatgttagccaggatggtctcgatctcctgaccttgtgatcggcccgcctcggcctcccaaagtgctgggattacagatctgagccactgcgcccggcctgtataatctatatatatatatatatatatataatatatatatatatatatatatatatatatcacattttctttatgcacacttgatgaacacttagattgcttccatatcttggctgttgtaaataaagctgaaatgaatatgggagtgcaaatatctttttgatgtaccaatttcagttcctttgggtgtatacctagaagtaggattgttggattttatggtagttctatttttagatttttgaggaaccttcatactattttcaataatggtggttctaatttacattcccaccaacagtgtagaagggctcccttttctccacatccttgccaacacttgttatcattcatctgtttgaacatagccattgtacatggtggagagcaacacatactggggtctgttggcgggtgggatgggtgcagggagagcatcaggaagaatggctagtggatgctgggcttagtgcctaggtgatgggatgatacgtgaagcaaacatggcacatgtttacctatgtaacaaacctgcacatcctgcacatcctgcacatgtacccctgaacttaaaagttgaagagaaaaaaaaggaaaatagtcattctaacaggcatgaggtgatagctcattgtggttttaattgcatttccctgagaattagagatattgttgagttttcgtttgtttttgagacagggtcttgctcttttgttcaggctggagtgcagtggcgtgatcatgtctcactgtaacctcaaattctcgggctcaatgatcctgcctcagcctcccaagtagccaggactacaggtgtgtgccaccatacctggctttttattttttcgtatagagagggtcttgctattttgcccaggcttgtctagaattcctggcctcaagtgatctcctgcctcagcctcccaaagcactgggattacaggcatgagccactgtgcagggctggggaacattgttttttttttttttttttttttttgtatctctgttggccattcatatttcttttttgaggaaagtgtgtctattcagatcctttgtctaattttaatcgatttgttttcttactatttggttgtttgaattttttatatattttgaatattagcctcttatcagatgtatggtttgcagatattttctcctgatccatgggttgtcttttcactctattatttggttgcttgtgcaggtactttttagtttaatgtagtcctatttgtctatttttgttttagttgcctgtgcttttggagtcctatccaagaaatcattgcccagaccattgttgtggagattttcccttatattttcttctagtagctttacagtttcaggtcttatgtttaagcctttatatctcttttgagttgatttttatatggagtgtgagataagagtacagtttctttcttctgcaggtggacatccagttttcccaacactatttgaagagactgtcctctctccattgtgtgttcttggaccctttgtcaaaaatcaattgactgtaaatacttggatttacttctgggctttctatcctgttccattggttgatgtttgtttttatgtcaataacatgctgttttgattacagtagctttataatatattttgaaatgagggaatatgatgcctgcagctttgttctttttgttcaagattgctttggctattaggtctttttttggttcatataaattttaagatttttttctctatttctgtgaaaaaaaaagacattggaattttgaaaggaattgcattgaatcaatagaggaactgcattgaatctatagatggctttggatagtgtggacattttaacattactaattctttcagtgcatgaacatgggatatcttttcatttatttctgtcttcttcagttgtttaaatcaatgtcttgtagtttccagtgtatagatctttcaccttgttggttagatttgctcctaagtttttttttttttttttttttgtgatggagtctcgctctgttgcccaggctagagtgcagtggcgcgatctcggcttactgcaagctccacctcccaggttcacgccgttctcctgcctcagcctcccaattagctgggactacaggcgcctgccaccacacctgcctttttttttttttgtatttttaagtagagatggggtttcactgtgttagccaggatggtctcgatctcctgacctcatgatctgcccgcctcggcctcccaaagtgctgggattacaggagtgagccaccacgcctggctgctcctaagtatttttttgatgctattgcaaatgggattattttcttaatttcttttttggataatttattgtcaaagtatagaaatgctaagagcaacttattgttaaatctaaatactcacccaagtgcctcatcttaagtaatggtatacatgaaatcataggtttgatgttcaagttatattttttctgtattttttctaaaattaatgaataacaaaatgagaaaacattcatcttgcaccaccttaaagcattttgcctaccatttactaacactgggcatacttttggacacactagtctaaatcagctgcaagaacaatttagagactaatttattgttttaaacaatcaacatttttccttctttaccctcagttggatttctccactagaggagaaaatggcaaattcgttcagcagaaatattccaattcataaaatattcattccttaggcagaatggtccgtggatttagagcaccctactatagacagcctgcctgaattggattcattctctgccttttaccaaacgtaaattgggccacgttgccttctgtgcttcagttttctcatctgttaaatagttgctgtggtgatttaatgaattaaaagatgggaattgtctcgactgagtcaggaatcatactagatactcagtagaactcattcatttccatatgtgaaggaataacattagtttttattttattattttggggggtgagggttagagaagggtgtctgccatcctgatttctatccttttgataaagtgacctaataatattgatactaaccaaagaggactattataatgttttatttactcttctcccccattaatcactttttttggtggtgttttatatgttttattcctttattttcatccttcaaggagtttgccctttgtttccttctgtaattttacagtatagctcatcaagcaagcctgagatttttgtcagaatatctgaaaatctctgagctttttctagcagaaatgcataatgcagtgcagaagaatagtctagccagtgtttttcataaatgaatgtacatacgttcttcctctgcataagactgaaagtaacccaggcacacaatatcttattaatatttaatattaagaaaagtatattaagaaggtaactctccattctacctctcaacatcttaccatctagtatacacacaaatatttccttgctctatcagccgagagggtctagaagctaccataccccagtagcaatgagcacacttagcaccctcattttggtttctaataccattctctggtaaaaggaaccaagactctttgaaaaaaaatagctgatttctagggactcaggaaggaaatatgtaagatgagcctggagcatcttgtagtgccaaaaagtaaggacctgctcaaacaaatggaaccctacacccgtgggaatatactgaagagttgcaagagcaaactgaaagagctcccaatggccaaagctagaacaatttgagcaagaaaataatatagtattggattatatcccaaagggtaaaataaatatccataaacccatattgatacaatttattaaataaatacctaagtgggggaaaatagacaaatctcctcctgtgcggaattcccaataacttctatagatactctactctcaaggagggagaacataaccccctacaccgtaagtgtgagctgtgcatattgacttccttctaaacagtacagtgtagaaagggaaaaaaaagaaactgtagtggagaaacctatcactacttcagccaggttatcaaggtcaacattgacagtgataagtgataacatgtaccctcgatatgatctgatgaaaatggcacttttaatctgtggtttccctactgaaaacatataaccccagtgtaatcatgaggcaaataccagacagatctcagttgagggatattctaccctcgaaacttgaccagtatttgaccagtactcctcaaaactgtcaaggttatcaaaaacaaggaaaacctgagatacctacagccaagaagagcctcaggagacatgaggactaaatattatgtggtatcctggatgggatccagaacagaaaaaaggaaattacgtgaaaactaaggaaatctgaatgaagtgtggactttgtttaataataatgtatcagtattggttcaataattgtgacaaatgtgccatactaaagtcagacattaaaaatgggaaacagtgtagagtatataggaattatctgtaatgtctacacaagttttctgtaaatctagatctgttctaaaacaaaaagttttatttaaaagatcgaagccatcttttaaggcctatctggaatgttacatcctttataaagcctttttttttaatcccatcttcttcccatcctatatctggggtgtcctatgtctcccacctcaggctttcctaattggatacctttgactttccacagaacttttatttgtaattctcttaactcttagtacaatattttgtgtctctgttttattgttctgatgaggtcttctacggtgtttttagcccaacccagtgagtgtctggtgccttagaccacttggccatcctgacaccctacacagtgagtgtcaatataacattttgtagttagtcacataaattagtacaagaatgcatgatgttggttaatgcaaatgctgttttttaccttgtattggtagatggagagtctgagcattctactttgtgcctttcaagaaaggtttttttctttttctttcagtgacaggaatcctgagcatttctcacttaatctcagttctgcttttagatactcatgtctcagaaattttatcatagtatatgctagatcaatctcatctcgtttaaattaaaagtttgtagtgcacaggcaaaaaccatagaggccatattcatggtcataaactgctctttctcatctctacctattttagcaataacattcttcttattagtttgttccaagtgaaaatgacataactgaatactttccctgctagtctgggaagaaaggatgtgtttgttggcttttgcctgtcagagagtattctgcaatgtttgcctagggcatgcttgcattcccatcagcatctctggtctgctgcactgtaatccctatagggacagcctctggcttttattactgacaagcagtgcactgtgcagccataggcaccataataggaaacaccttggcctgtcataaacaggtctggagagtagaaagtacaggcctgctggggatgtgtccatagcaaagaggcaaagatgcggctgccatattggagtaagtgcaggctaatgtctgccatctccatttcagaaaataactggctgattttgaagctgctttttgtataaacagtagtgttttggttgctttttgtttttggcttaaatatgaataaagccatcttaaagagattatacccttcaaagtattttgagaagatctataaagtattttccttttgttattttacatttaattctacctgatcattccaatccaaacccaatagagaaggaaaaacagatatttcactatagtgggaaattaggaaaaaaagaaccatgcaaaaatacaagtgattgtgtgtcttttaaaagaattacaaatcacactgaattacccaaaattacaaagaaaagtgcatttattattaaggtaacttgtgttgtctgtgcctttacatcaactccaagttttataaaaggagtacattctttgaccataaagactttatatttgttagtgtttttttcaatctttagggaaaaaatgaactgcaatattaatgataggctttgtagcaagaatttaggaagacaataaatttcaaaattggaagggttatcacagtttttaataaagagataaaattatttcatgagtgctttaaatatatataggtgtcattttattatttacaaggaaacccatttcacaaaagaggctaaagactgtaaagattgaacaaagctataatcctgttaaaaattaagataggtttaggaaaactaaagtcctaattttttttttttgaccactttggccagagctgttcataaattaggtaatcaatatttgttgactagtcccctcccttgttaaaaactaaacacttgtcctcttgtatcttttttaaaaaaatatttcaagtaagtttcaacagtatgctgtgataaggatgaaacctattaacattatccttggtatatattttgattttctgttgttttcttaatcttatattgtcagtatggtttctaagatctaagatctccataagggtaagtgataattgggttttgataaatcataaggaatcttctactagaaatatgtctgtttatttattgtacatcaggaaacgattagtttactttatgccagaagataatgtttgggcctaaatcttaatttttctatctagtgttaatacagtagaatgcctaaaggatatatagaagaaaagacaaaaaaagaagatgaagagaatgcatcattacagactgaatcatcagtccctacagaaggggaatttgttctttcaaaagtagaatttcagcagccgggcgtggtgcctcaagcctgtaatcccagcactttgggaggcagaggagagcagatcacgcggtcaggagttagagactagctggccaacatggtgaaatcccgtctctcctaaaaatacaaaaattagccaggtgtgatggtgcatgtctgtaatctcagctactcgggaggctgagcaggagaatcacttgaacccaggaggcagaggttgcagtgagccaagatcgtgccactgcactccagcctgggtgacagagcaagactctgtctcaaaaaaaaaaaaaaaaaagtagaattcagctgggcatggtggctcacacctgtaatcccagcactttgggaggtcgatcacatgaggccagaagtttgagaccagcctggccaacatggcaaaacctggcctgtactaaaaatacaaaaattagccaggtgtggtggtgcatgtctgttatctcagctactcgggaggctgagcaggagaatcacttgaacccaggaggtagaggttgcagtgaatggagatggcgccactgcactccagtctgggcgactgagtgagactccatctcaaaaaaaaaaaaaaaaaaagtagaattcatgggaaaaattatttgttgctatttagccttatttttaaatatttcagtatattgtctgtttgatacatatgaacaatctgactacaactcattgggaaacaccagtatttaccttaccttctaatgtaaggcatgattccaggtattttctcatacctcaaaccttaaatctctaatttagtcccagaaacagtattctacatgtcaaaacgttttttgttttgttttgtttttggagacaagttctcaccttgtcaaccaggctggagtgcagtggcgccatcatggcttactgcagccttgatctccctggctcaagccatcctcccacctcagcctcctgagtggatggagccacaggcatgtgccaccagaccggcttttctgttttttaatttaatttaactttttttttttttttttgtagagacagggtctcactatgttacccaggctggtctcaaactcctgggctcaagtgatcctcctgccttggcctcccaaagtgcatgagccagtgcacccagcctcagaatatttttaaagatgaaaacctaatgctcagttaaacttttataagatctatgtgcttctaaataagtgtaaagatgactattttctggatgttgtattggtggggaagatggagagatagaagaacaagtgtttattctctggttgtattttctctctctctctcttttttttttttccttgagttagagtcttgcactgttgcctggactggagtgcaatggcgtgatctaggctcactgcaaccttctcctcccaggttcaagcaattctcctgcctcagcttcccaagcagctgggattacaggcgcctgccaccacgcctggctaattttttgtatttttagtagagacagggtttcactatgttggccaggctggtctcgaactcctgacctcgtaatctgcccaccttggcccgccaaagtgttgggattacaggcgtaagccactgtgcccgacctctggttgtattttcaaaatatatccaaataatattttaaaaatgtatttagtgagcactagattccaaaatagcaagagcaatttcagcaaagtataattcctagagaggaatcctacagtacctcgttttgccttttttgttctctaggtcatgtcaggatgggagcataactgacctggccctagttcctaggaggagcatgtgccctctaacatgtgcacagaaggataatagggtcagtgggatgaggagaccaagtgactaaagcagatctgagaatctgagctgtaaaggatttggaggtgggatggagggataaaaccttagtgggaagcagacagcagatagagaagatataggataaactcacggaaggtgtaagcaggttcatgattttaaaattagcctgttaagaggttgtgttggaggtctgttttcttagtgggggcaaagtggcaagggaagtttcacttctgaatagggtggaaaatgaagatataaggaaagaaagagagaaagaggaaagacgtattaggcagtgtgaggcagagaaagagaagagtgggagaaggaggggagtcagactttccttggctggaggcaaactgaccaatgcccgttgctgcccctttccaccgcagggttcatttggtgaaacctggttggactgaacctttaggagaaccttgaagtaaaaaagaaatcccagacaggtcagtggcggatgtaaatgtttaaggaagaacagacagtcagctgtagaaatggagggaggggtagagctgactggagagcgatttatggatggtatatttcatgaggcttgagtcttttttagcactaatagttggcgtcagcttcacctgttgcctccatgagtcatgccctggtagcagaggatggtgggccaactgccaagccatcccctgaaggaccggctgcctgggagtgaggaaaggtggttgatgggctctgagacagcaaggtacaaactgaaatggggtgaaaagagactgtcaaaataagtatgggctgatttgttctaatatatcataggttattattagatgctggaagagtaaaatggaatagaagatgaaaaatgtgaacctttatcttgattccattttaaatctcctaaattctgaggagctttgcaattcctcttctggatataaatctgccctacagtagagttgcaaccttggataaataaataaatttggcctccctgagcctctgttttccctgtaaatcaggactaacataatctacctcaaaggattgtgttgaaaattaagtgaaaacttacataaattatgtagtgtggtggggacatatgataggtactgtggcctatccttaggagggatgaggaatggaactatttttaaacataaaaggtcaactttatatgctgccatataagtaacccagtgcaattggagcttgaatcaacagggctgggagaaagcttacagagtgtgcctttgaaatcccaatacccagtcatggtgatttatgagaccttaccagcttgcatatgtgatggcccactgagtttgtttactttagttttagctcagttacccagcactctatgatagcctattttttatttacactctcactaactcctttattatgatttctttgaaagaatatgaagacagccataaaaaagactcttattgaagttgagagggtctcctgtaggtcttcacttcactgtgtctaaacattggtctgttgcttgtgctttgcttttctctcaccctggatgaccttcaaggctcttccaaatgatttctctgattccctgaaatactgaaattgtgattaacagaagtttcaagtgttaatcaatatcaagatagtagttgtctcttcctggggaaactagaaatgaaaaccaaacataggcctctgtaatcattgcacagattaaaaatgaaaatgcagctgagaaacagaggaatgaatgagaaaaccctaaacctagttctagccccaggatgaggtctttgtcatgagtctgacgctagccacagccggtaagagaaggaattccctagtagtgtagttgttacaagggaatgagtcattttgcaggtaattgttcttcttccattttccacttgctgtcagccactttacagaggagtcggactttgttctgcttaagagaagtctctttccttttattgtttaaaaaaaaaaaaaaattccagaagcccttagaaagagatttgtgagatcaactggtttaccttcttcattcagatgaagtaacaaagcacagaaaagttattttgtcaaggtttctgtcttgtagcaaatacaaactttctggtgttaaacatatgaccctgatttgggtctttactgacatcatcacttttttttttttaattttctgagacggagtcttgctctgttgcccaagctggagtgcagtagcacaatctcggctcactgccacctccacctcctggattcaagtgattctcctgcctcagcctcctgagtagtgggtataacaggtgcatgaccacgcccagctgttttttgtgtttttagtagagatggggtttcaccatgttggccaggctggtctcaaactcctggcctcaagtgatctgcccacctcagctttccaaagtgctgggattacaggtgtgagtcaccacacccggccaacatcatcacttttgaatgaaatttttagtttggtgatgactttattatttgtatttgatccttgtccatttttctctagatctggtactaatttcatgtggaaaataaatcgttaggaggttttcattttgtacgttttggctgcaaacaaccacaacccagtctttaggttttcactgagggatttttgttttagcccaattattgtatgacatgtatctgctccagaggttcttataggtgaaatgagatttttatgtatctgtattcaaacacatagatagatagatagatagatagatagatagatagatagatagcgaaacatatagacatacctctgaaaatacaaccagccatataatgtaagcctgttgtgtgttaatgaatgatagggtaataatacattatgttcctgtcctgtagaggagttcgagtattcaatacagaggaccagaatgattggtcccagaaaaagtgctccttaagctggatcttgaatactgaggatttatataggcatctaatagggaagaggtggtattccaggggctggataaggcagggtaggatggggtattcatgtggattcgctttattgtatgtttgctggagaggagggtagtgggcattctggaggagtgagcctctctggaacagaggatgtgattataggaccagtggcaggtgtgagaaatgtagattgaggccatactgcagactgtcttaaatgccaggtcaagccatttgcacattgtcctataattcatgaagaacccttacatttgactataaggaaaatattatgaagaaactaaaataaggtgactttagaaggttatatctggtggtagtgtgcaggatagattatatcaaggggaaattgtactgaaagcaagaagaaaccgttagggaattaggtgtaagagtgataagggcctgaaataggatagtgatgaaaagagaggaatgagtaggagaaagattgcacagagaagggtgacagcatacataagacttggcaggaccacagccagaagaaagcatgaaattctaaacctgaataatggacagaattatagttggaaaatcatgaagagaagccagttgggtattgggggagggctggacaatatgacagttaagtttttagacatataatttaggtaaggctatgtatctaagcggaaatgccctataagctttcagttgtcaggactggatttctggttaaaaaaaaaaaaaaaaagagggggcaggattttacttgggtgttgtctgcaaagttgatagctaagaccttaaggctcatctgtgaaacgggagtgacagtgctcattaaaggttattattagaaataaatgaagtaattccaggagagtacataggactctccttgacacatagtagaccctcaataaacattaggttttattattgtttattatgggttttagggaacaacacttttgtgaattattagaaccttatttgggaagctataaaagccatctgcgtgatgtgttttcttagtacaccaaatggaagttcatatgttccattcatatacatgcttccctagctgttaggggaaggtgatagcgcatgtttaactgttgatcactgtttgtaaggcttttcgtgttttttacatatttggttaaggatcttaatccttgagctgtattttgttctcatttgtttgtgtccagagtcaaattaagtttaaggaatttataaagagcttctttgcaagaatgatattaactcaatgtactaaagctacattcacccaaagtgtaatagacttacacaacatggaagaaatccaggagaggcagacagttattcatgaagagtggtagtattcctgtctgcctgtctgtacatttgtcagatcagtgcattctgagaaaattatgccaatttgaaatctccaaaagcattctcagccagtatccgtgattctgatagtttacaaactgttgatagcataagctgttaggaagatattgtagaaattttaatgcagctgttttaattagattgctttccttataacaagtttcagtgtttctggtcacaatacaatttattagctcctgacacatgacactgctggatcaccaaccttaactctgattctctccatacaacccagtatccttaagtaaaatgctgcatatttcattgctggtaagagaggcagggccaagattcgaactcacatgaagccaactagagaagcctatgctctacactattttacatctcataattctcatacactactaacctgttgcaaatgaaaaagaagtcttattattgtaccacttttaattgcacttattattgccttcagtaaagtcttcatttctaaaatgtcttagtaaaacagtaatttcataaaaatattgccaactaggagtactaaattctaattttggttatattatgcggccttggataaggaagtttcttaggctttcatattccaaattattggactattctaaaaacatttttaagtattttgatggatgtagtctattctaatataatgtctttcaagtgtttgaaagttactacttattcaaaactcaactgtctggcagcttttcttatcctgaactctgtgaagaacttcggggacaggaggtaaaatgtctttgaagagtaagaaatccaaaacttcatgtatttacatgttctggtcttgtctcataggattcttctttctccttacataccctcctttaaatccgtacctcccccggtcttctccatcttgcaaatggcaccaatgtccatcctagacattgatcatcccagaagtctaggagttgattcttctcatttcttcagttctgttgtgcaagtcttcaagtcttgtcagttttgcctcaagcacttttacaaactatcctctacagagacagctttacaaaatgtaaatcacatcctatcattccctgctcagaaccttctaatggtatcctcacaccctctggaaggctcataccctcaggacccacgtgatgttgccttgacttgcctcggctctcattccgtagacctgtcctccctcagactggctgtgttactcagcctttgttgagagtgctgtgccccaaatctggttggcttattctaggcattcgagtctcttcccaaataccaccttctcaagtgcagcttttccttactacttaattttatagtcccccatcaatgtacgatgttaccctcttttccttcattgagagtgtttgtaatttttttttgtctgcttgtttattgtctttttgccccataagtccaaggtttacatgaacagggaacttgtctgttttgtttattactgtatcccctatgctggcacatactatgtaataagtgtttgttgagtgcatgagtgaataaccattctaaaaaactctgatgtttaaagccctttgctttatataagaattttacttggaaccctggtattttcgtttgtatttgtttgttaataaatgtcaagagttcagtagtaagataggtttcagaaatgctaagttaaacagaataaagaaagaatatgtattacaggtcctggcagagccttgaatatgctaacatttgacagtgggagtctttgagaattatcacatgaagctgctgtacattacaacacattctaggaaatgctgtcttagacaaaaacctgtcatattagaattggggtaaggggcacgatactgaccgtgaggcagcagattcctatggactacattaaaaaaaaaaaaaaaaaaaaagaacagactgataatctagggctcagaaaaaaaaaaaaactgtgatatgaaacagtggcaaaaggattcaaaaagaatacagcggttgggactatctacttttttaatttttttattacactttaagttctagggtacatgtgcacaatgtgcaggtttgttacatatgtatacatgtgccatgttggtgtgctgcacccattaactcgtcatttacattaggtatatctcctaatgctatccctcccactcccctcaccccacaacaggccccagtgtgtgatgttcccccatcctgtgtccaagtgttctcattgttcaattcccacctatgagtgagaacatgcggtgtttggttttctgtccttgcaacagtttgctcagaatgatggcttccagtttcatccatgtccctacaaaggacatgatgaactcatccttttttatggctgcatagtattccatggtgtgtatgtgccacattttcttaatccagtctatcattggtggacatttgggttggttccaagtctttgctatcctgaatagtgctgcagtaaacatacatgtgaatgtgtctttatagcagcatgatttataatcctttggatatatatccagtaatgggatggctgggtcaaatggtatttctagttctagacctttgaggaattgccacactgtcttccacaatggttgaactactttacagtcccaccaacagtgtaaaagtgttcctatttcttcacatcctctccagcacctgttgtttcctgactttttaatgattgccattctaactggtgtgagatggtatctcattgtggttttgatttgcatttctctgatggccagtcatgatgagcattttttcacgtgtctgttggctgcataaatgtcttcttttgagaagtgtctgttcatatacttcacccactttttgatggggttgtttgattttttcttgtaaatttgtttaagttctttgtagattctggatattagccctttgtcagatggatagatagcaaaaattttctcccattctgtaggttgcctgttcactctgatggtagtttcttttgctgtgcagaagctctttagtttaattagatcccatttgtcaattttggctcttgttgccattgcttttggtgtttcagacatgaagtccttgcccatgcctatgtcctgaatggtattgcttaggttttcttctagggtttttatggttttaggactaacatgtaagtctttaatccgtcttgaattaatttttgtataaagtgtaaggaagggatccagtttcagctttctacatatggctagccagttttcccagcaccatttattaaatagggaatcctttccccatttcttgtttttgtcaggtttgtcaaagatcagatggttgtagacatgtggtattatttctgagggctctattctgttccattggcctatatctctgttcttgtaccagtaccatgctattttggttactgtagccttgtagtatagtttgaagtcaggtagcatgatgcctccagctttgttctttttgcttaggattgtcttggcaatgcgggctcttttttggttccatatgaactttaaagtagtttttccaattctgtgaagaaagtcattggtagattgatggggatggcattgaatctataaattaccttgggcagtatggccattttcatgatattgattcttcctatctataagctttgtgtcctcttttattttgttgagcagtggtttgtaattctccctgaaaaggtccttcacatcccttgtaagttggattccttggtattttattctctttgaagtaattgtgaatgggtgttcactcatgatttggctgtttgtctgttattggtgtataggaatgcttgtgatttttgcacattggttttgtatcttgagactttgctgaagttgtttatcagcttaaggagattttgggctgagatgatggggttttctaaatatataatcatgtcatctgcaaacagggacaatttgacttcctcttttcctaattgaataccctttgtttctttctcctgcctgattgccctggccagaactttcaacactatgttgaataggagcggtgagagaaggcatccctgtcttgtgccagtgttcaaagggaatgcttccagtttttgcccattcagtatgatattggctgtgggtttgtcataaatagctcttactattttgagatacatcccatcaataccgaatttattgagagtttttagcatgaagtcctgttgaattttgtcaaaggccttttctgcatctattgagataatcatgtggtttttgtctttggttctgtttatatgatggattacgtttattgatttgcatatgttgaagcagccttgcatcccagggatgaagcccacttgattagggtggacaagctttttgatgtgctgctggatttggtttgccagtattttattaaggatttttgcatcgatgttcatcatggatgttggtctaaaattctcttttttttgttgtgtctccgccaggcattggtatcaggatgatgctggcctcatcaaatgagttagggaggattccctctttttctattgattggaatagtttcagaaggaatgttaccaactcctctttgtacctctggtagaattcagctgtgaatctgtctggtcctggactttttttggttggtaggctcttaattattgccttaatttcagaacctgttattggtctattcagggattcaacttcttcctgatttagtcttgggagggtgcatgtgtccaggaatttatccatttcttctagattttctagtttatttgtgtagaggtgttattctctgatggtagtttgtatctctgggggattggtggtggtatcccctttatcattttttattgcatctatttgattcttctctcatttcttctttattagtcttgctagtggtctatcaattttgttgatcttttcaaaaaaccagctcctggactcattgatttttttgaaggtttttttgtgtctctatctccttcagttctgctctgatcttagttatttcttgccttctgctagcttttgaatgtatttgctcttgcttttctagttcgtttaattgtgatgttagggtgtcaattttagatctttcctgctttctcttgtgggcacttagtgctataaatttccctctacacactgctttaaatgtgtcacagagattctagtatgttgtgtctttgttctcattggtttcaaagaacatctttatttctgccttcatcgcattatgtacccagtagtcattcaggagcaggttgttcagtttccatgtagttgagtggttttgaatgagtttcttaatcccaacttctactttgcactgtggtctgagagaaaatttgttataatttctgttctattacatttgctgaggagtgctttacttccaactatgtggtcagttttggaataactgtgatgtggtgctgagaagaatgtatgttctgttgatttggggtggagagttctgtagatgtctattaggtccgcttgttgcagagctgagttcaattcctggatatccttgttaattttctgtctcgttgatctgtctaatgttgacagtggggtgttaaagtctcccattattattgtgtagaagtctaagtctcttagtaggtctctaaggacttgctttatgaatctgggtgctcctgtattgggtgcatatatatttaggatagttagctcttcttgttgaattgatccctttaccattttgtaatggccttctttgtctcttctgatctttgttggtttaaagtctgttttatcagagactaggattgcaacccctgcttttttttgttttctatttgcttggtagatcttcctccatccctttattttgagcctatgtgtctctctgcatgtgagatgggtctcctgaatacagcgcactgatgggtcttgactctttatccaatttgctagtctgtgttttttaattggaacatttagcccatttacatataaggttaatattgttatgtgggaatttgatcctgtctttatgatgttagctggttattttgcccattagttgatgcagtttcttcctagccttgatggtctttacaatttggcatgtttttgcagtagctggtactggttgttcctttccatgtttagtgcttccttcaggagctcttgtaaggcaggcctggtggtgacaaaatctcagcatttgcttgtctgtaaaggattttatttctccttcacctgtgaagcttagtttggctgggtatgaaattctgagttgaaaattctttcctttaagaatgttgaatattggcccccactctcttctggcttatagagtttctgctgagagatcagctgtaagtctgatgggcttccctttgtgggtaacccgacctttctctctggctgcccttaacattttttccttcatttcaactttggtgaatctgacaattatgtgtcttggagttgctcttcttgaggagtatcttcgtggcattctctgtatttctggaatttgaatgttggcctgccttgctaggttggggaatttctcctggataatatcctgcagagtgttttccaacttggttccattctcccatcactttcaggtacaccaatcagatgtagatttggtcttttcacatagtcccatatttcttggaggctttgttcatttatttttactcttttttctctaaacttctcttcttgcttcatttcattcatttcattcatttcatcttcaatcactgataccctttcttccagttgatggaattggctactgaaacttgtgaatgcatcatgtagttctcatgccatggttttcagctccatcaggtcatttaaggtcttctctatgctggttattctagttagccatttgtctaatcttttttcaaggtttttagcttctttgcgatgggtttgaacatcctcctttagctcggaaaagtttattacccatcgtctgaagccttcttctctcagcttgtcaaagtcattctctgtccagctttgttccgttgctggtgaggagctgcattcctttggaggagaagaggagctctgatttttagaactttcagcttttctgctctggtttctccccatctttgtggttttatctacctttggtctttgatgatggtgacgtacatatggggttttggtgtggatgccctttctgtttgttagttttccttctaacagtcaggaccctcagctgtgggtctgttcgagtttgctggaggtccactccagaccctgtttgcctgggtatcaccagcagaggctgccgaaccgcaaatattgcagaacggcaaatgtagctacctgatccttcctctggaagcttcatctcagaggggcatctggctgtatgaggtgtcagttggcccctactgggaggtgcctcccagttaggctactcgggggtcagggacccgcttgaggaagcagtgtgtccattctcagatctcaaacttcatgctgggagatccactactcttttcaaagctcagttggaaatgcagaaatcacccgtcttctgcatcactcatgctgggagcagtagactggagctgttcctatttggccatcttggaacctcccccagctatacctactttattggatttttgtgtctccatcagctgacatggtacttacagcctagaatgagcatacaaaggatactcattcgctattcgatgatgactgacaaacagtctcccaggatcaccatgaaataactaaactgagtttgatttatttaaaaatcaggtccaggtaacaaactgcacctgtccccttgaattgatacaaataaaaataaaacaaaaaaggacaatattttactttatggaactttttattacaaagaattaaaaaaaaataaaataataatacttaaaagaatactttgactattattttatcacctaaaggcttctcttattattttatttttggagacagaatctctgtcaccccggctggagtgcagtggcgcgatctcagctcactgcaacttctgcctcccgggctcaagcaattctcctgcctcagcctcccgagtagctgggattacatgagtgcaccaccacaccctgctaattttttgtatttttagtagagacagggtttcaccatattgccgaggctgatctcaaactcctgagctcaggcaatctgcctgcctcggcctcctaaagtgctaggattacaggcatgagccacagcgccctgccaacctaaaggcttttcacaactgggaattcactgaatgttgtatcattaaagctaatgtggaccttggataactgtatgcctgttttctgggaaataatggtggagctctttgaaagggtaaaaatggtgttttatcatacataactatgcctgaggtttttgttttgcatttatctttgggcaaagttgtaaagttaagcaaatctggaattgaaataatttgataacatcagctaatatttttcaaagttagatttttgaggtataatttacataagagttactctttctagaggtatagttgaatgcattttcacaaatgtgtacaattggataaccaccaccataatctagatatataggtaatgtgtaattataatatatatgtactatataatataggatatttataccacccaaaaagttttctcttgctttttatagtcattccccaaaccccacgtccagtgctgattgtccctatggttttgccttgccagaatgaataatacattaaagatatagccttttgtgaatggcttctttcacttacaatacttttgagttttgagttgaattataagtttcacttataatacattttgtgttattgcatctattggtaatttgtttcattttattgctttttagtatttcatttttttccagtatgtcattttatggacacaatttgtttacccattcaccagttgactgatatctgaactgtttctgggtttctgctatagagagttgctataaacattttcatataggtctttatatagacatatgttttcatttctcatgggtagatacttagaagtaggattgctgggtcatatggtcactctactttttaactttataagaaactgtcaaacctttttccaaagtttctataccattttgcattctcactagcaatgtatgagaatttaatttgctctgcatccaggccagcattttgtattgtttgtattttgtattttatacattctagtaagtatgtagtgtggcatctcactgtggttttactttttgtttccctaatgtctaatgatggtcatggatcttttcacatgcttattgatctttttgattcttatgaagtgtttgtttgttcaaatcttttgaccatcttttcactggattgtcctcttattgtgttgtaaagattttttaaaaaataatttctggatacaagtcctttatttgatatgcattttgtacatattcccttctcaagtctgtggcttgttgttctgttttcttaacagtttttttcaaagagaaatttggtaaagtccagtataccattttttattttatgcttcatgcttttgtggtttaagaaatctttgcctaacgcaagatcacaactactttctactgtgttttcttctagaagttctttagttttagattttacatttagttctatgattcatttcaagtagatgttagtgtggtgcaggataaaggttgaagtttcttgttttatgagtggatgctcaattgttcaagcattctttgttgaaaagaatatcatttctcttttatagctcaaattttattacttaaaattattttaagatgcacatattaaagtgatatgtgtaaaagattatatatttctggaagcatgcctatttacactagttattattactttaggagacagatattctctttgtttaaattgtttccacaaagcataccacgaagtacagaggggacattagtaactattttatgatgattatggtattcatttaggccaatttaagtgaattggagatcctaattttctctataaggagacaatactttttcatacaagattatttttgtggaggcttcatttatgtgaagtttttgcacccatttattgtcatgattattcttcagtgaaacaaaagtctgtagtagatatgctgctgctgctggttttaggtaaattgactaaatagttatacaaaactctgtctctaccatatatgaattcaaactgtatcaacaattacagaatactatgctaacatctaataagagagttagcccatgtagaagagaaatataaatacagctatcagatcagtctcatgttatttcagcttcaaggagcctcttagcaaaaatggtttcctttctccatacatgttgcaggtgtttactattttaaatgagacttttttgttaaaaaaaaattaaaataagatcatttagagaacgattctcagcttgttcagatgattatttggttttaaaaaagcagcctggagttcctcttaatctcaaatctccataaaacttacaagagatgttttcatttactgaaaggaatagttttttcttaatcaaatgtagagccattatcactagagggcagtaaatacaaacagatttagtggatttactggcactaacgatgttttcagaatactagcattaatcaaagaaagtatagtttttataatatgaaaatacatgtaacattctgttatgtaaaatattggttatgaatcaattctagattattgtctgcctctaaaatatttttaaggcatttgaaagcaaagggaggctgagaaacactagttttctgtggctattctgtttaatacttgaagtttaactttgcctcagaattcttcaagggacatttaaaaattagatttgcatttgttcaagctgaacagtactggatatatgagagaccacgttatatagatttgcttcttgattaataactaccacgacttttaattttaaggtgaaaggtgtaaaataaatgtagattgattataggataaaatattttccaataatgtaagtcctactgcaaacagtgctactgcctggaaaactccttatgttggagaggtccaagagctaatacacttattttaaacaatatttcttaaatatttcaaacacagtaatataatatacagcttagaattgattatattaacggatctattatgtaggctctaggctaaatataaaataatgcctgaaatagttttctttttttggcaatttagagtactctgaaaccagacagtctgggttcaaatcctggccctgttacttactactggctttgtgaccttgagcaagacaacttgacctctctgagccttagtttccccataatttagttttgtttttccctattcaaaaatgcatcttttctctcttgacctctgttacaaagtcaataatgacagcatgtgttaatgtatcagcagttcagctccatcagcagaatttcaaatatcctgaaatgtactgaaatagttcaaaaagattgttaattgcttgggtatctggtaaggactgagaaaacaaggaatagcagggaagtggcctctagaaattctgaggggtatttctaggaaaagtctgaaaaagagaactaactgaacattatgggaattttttttttcttttttgagacaaggtcttgctctgtcatccaggctggagtacagtggtgcaatcatagctcactgcagccttaaactcctggcctcaagccatcctcccacctcagcacctcccacctcccacctcagtagtatctggaactacaagcacatgccaccacacctggctaatttttaaattttttgtagagacggtggtttctctatgttgcccaggctggtctcgacctcctggcctcaagcaatcctcccgcattggcctcccaaaatgttgggattacaggcatgaggcacttcaccaggccaagaaactattttttctatttcaacaaacacacttgcatatatgtatataaaatcatttgggcatttgagagcagtggattacagataagaaacctgagctctagctgtaacgctgtccctcaagttgtgttgtcagaacttttctggacctcagttccttgtctgaatgtgtcgtcatcattacatctgcatatgagggcagctgtgtgttgttcacatagcgctcccaaacataagcgtgtctcactatatggcagggctgtctgcctgtgggcacctgcttcctcaccctgtccagagatctgaccatggtgatagtaaccatgattctttaattcaaggcactgtaaagttagcaaaaagattgaggataaacaaatccactcctagattcatactgtttatcatagagtttgcatcagcctaattatatgatgagctgtcatacaccattaagagcaaggactgggtttgcatttcaatcctgtcacctatggagcaagttattgaatatgtaagaaggtccatcttttcatgttaaaatagggataatatttatcttatcagaatgttgccaagattagaaatgaggtatgtaaagttctttgtgcatagtaggtgcctagtaaatgttgtaacttattaaagtttcttcattaaatttggtgaagccaagtctgactataagaattgtatctctctggctctattcaaatttctcttctaaattatctagattctctctgcagatagcagctaccgtggcaataggaaggagattctagtctcctagaaatggagattagggaaaatgaaatgaattttaatttggctcagagatttttgaaaagatttcttattccctagaaatatggaaactttccttggtactttttactcaatatgattaaataatctcccttattgcagcaaattagggacttatttgaataagttaaatcctttcacatccagcacctattagaatgcctggcacataatagttgccaaatagaagtctgttgaatgaagggaccatcactcacattcagcagggagaagaggctgcagattttagagggaagggaaactgtatgtgtgtttctgcataatgttttaagacaaggagtattatctactatatgtaatctgttttaaatgtttttgatgattttgctgagggtgaaaacccttgtcctttcctgtcacctataatcagtataaaaatattgatgttttgcatctgcatcagccaacaatctttttgtggcaatagtacactaccttgagaaatacagggacataataagatacttttctggcctcaaagatcctccaccctggatgaggagtcaaagttgaagacagttgaaaaaaatagaacagtgattcttaacactggggaacattcaggaaatttcaggggacagtgactggggagtactcctggtgcttggtgggcagaggccagggaggctagatgtcctgggatacatgggacagcctttcaccagggaggtttgctgtgtgtcccacacaacttccaaaaagtcccagcagctattcacataggtgaaaaaacaaaatgcatttataattctctgagcctagaacccaactactttttacgtataagtattaaatatttttacatggttttaatccacaccaaattttctagtaatgcagcaatagtgtatattgtgaagatggcactttgttacatttgaaacctttcaaagaatcattcatcatatcaggaaaaaggaaaatttttctaacataacacccctgtattcattttcatgctactgttacttttgtggtaattctccccataagagaaatcatagcaaacccttagatagcacttactgttctaagagccttatgtatatgcactaatttaatcctcacaacaaccctgtaaggtagaaactattattctcattttccatgtgagtaaactgaagtatgggaaatttaaatagcttccccaaggtcacacagctaatcagttatagtagtttttgactactttttaaaatgtagttgtgtacaagtatttatattttgtagtatttgatagaaattactcatttctcctttatttcactgataagccattatactgattttttttttaaatctatgtagggagtatttagcctatatgtattcagtacagtattatgaaggaagtgtatttaggaatttcatttcaggatgaatacttgttataaaaagtaaaaagtaactgagtcttaagtttgtcaaagaataaaattgatggatggatggatttttttttttttaaaggagggggaaggcagtgagcctgactgcagagtgtaatttgcatttaaatgacaagtggtatgacacttccacctgttcttcagggagcctcaccaagtatgttttgcctcgaggcctttgcttttgccattcctcacttggttttcccttctctaccctacctctcaccccgcaatccacatggcttgtttcctttcttcagatctcctggtatacgtcatctcatcagaggggctttccatgatcaccttatagcaacctctatccgtaatccttatcccttctttctctccattgtgcttatcaccccatgacgtattatgtatttattaacttagttttggaatataagctgcaggtgagaaagctttgtttctctttctcaggcagtgcctgacatagagtaggagcttaataaatattgaatgaaggggcagatgtagaatcgttagaatttggaaaaaggctggaatatttggtcctaagatgtactttgaatgatttaaatctgactgagaaaaccagtttgaggttggcagagtagaagaaggagggtattttaggccgagaatttggtaagacagagatgggattgtcagctgtatggtgaaggtggaggagtactagtctttcaggaacagagcaaatgtaatagagcagctgaaaataggcttggcgttggggattaaggtcagatatggcagtctggaatttacagagggatgtgatgaagcaggcattactagctttgaagtaacaggctgcggctggatttgaggaaaattgatctggcagtagaggtcaatatgagactagaaggggaaaagccaggggcaagaagatgagctaagaagcaattacagcattttggccctgagacatggagtgctgtgatgcaattgaaaggaaatataacatatatattttaaaaacaaatgacaaaccagagaatttttttaaatattagtataatagaatgattatcataatgatcattgtcactgtcatctttactgtctgatacctacttatcttcaactttgtaccatttgttgttttaagtgctttgcatatatggtctcatttaatcctcatatgtatctgttctggttatttattgctatgtaagaaatcacttcaaacctaatactttgaaatatgaatgtatttttattagttttcatggctttgtgggttaactggtcttggctagacattcttgcttggcattcctcatatggttgcagcccagtgggtagctatctgaaagctgaactggctggatggctaggatggcttcttgcccctcaggtctggctctgggctggggtggctggcattgctgaagactggccaggcatgtgtgctctttcttgtgcaagtgctctcttgcgctttctctcttcactgtctgtgaagttaacatggacttcttgtagcatagcctctcagagtagtcagacctttttttttttcaacctaatggcttaggggtcccaatagcacattcaaagaaagcaggatgagagctgcaagatttcttatgacttagcctcagcagtcatgcaccatcacttgttggttacacaagccaactcagattcagtgtaggacagtgtggctcattaagagtatctttggagactagctgccacagtaatccactttacagatgaggaagctgacacactaaaaagattatttgtcagtgattgtgcacaaaagatttaaacttgcaattcttgttctcagtaccagagtgaacctgggaaaatcattttttctctctaggtctcaactttatgtggaaatgagggagttagagggggtgatattaaagttactttctatttctctcagtcttttaaatatttggattcagattacgggaggggtaatggtaaggaataaactgaaagaaacagctctggataaaagatagggcttgctaacaaagttgaatgaaggagggaaggtgatgccgtataggggaacatgccgggttactcaaggattcagctagatggtttatattaaacacctgacagtgtctgacgcacatgaaacacctgttgaatggtaggaaagagtcatagattccatctgagatactggaagaaatataggctcactgactgaaatggaagtaattatactaagaactactttaaatagaaaaatgtctcacagttttgaaaaagtttgtcgtgactagcagggcattcgagaggagaatcttgtattcagaaatatggcactgaagttcaagttagaagtggtcattgaagattgtgggcctagggaaaattaaagaagttcaggatcctgggagttgagggagagtagtaggaatgatcaaacatgtggaacacttcagagaagtagggagaccagagaaaaggaggaccttagtattcctctgggggtagctttagtggaatgttggagctttaatttcttccttttgtagaggagtaagagtgatggaaatgaatacaacagatgttaacaaaagcagaggactgtagcagctaaaggccaatagaaactcagagagacacagtgttacaggagtgcttatcagagagcatgctctctaagacagacatgccacatgtggaaatagttaaatgtcaggaagactgcagagtagccataccagcaagttaaagcacagagtagtaagcacaggctttgagatggagaggaggtaaaatgcacagaattatatgctaaaatcaactaaaacctagtttttccttgtttctcacccacaagacctctttagtattaaagttacagggtaatactacaccaaaccaaatagaaaatgctgtttttctagaaagaactttgatttctcatttaaccctcctcgtaaaatgtctgattactcttgagctcaattctggattcctaagagccactcattcctttcttaactttgtgtacagttattaaaatgttctgttctggctgggcacgttggctcacacctgtaatcccagcactttgggaggctgaggtgggcagatcccctgaggtcaggagtttgagaccagcctggccaacatggtgaaatcccgtctctgctaaaaatacaaaaattagccaggcgtggtggtgggcgcctgtaatcccagcttctcgggaggctgaggcaggagaatcgcttgaacccgggaggcagaggtgacagtgagccaagatcgcactactgcactctagcctgggcgacagcgagactctgtctctaaataaataaataaaatattctcttctgatcaaaatacagatcctgagttctatatacaaaacactgcattccttatgcatacacagtgccctagctttcacatttccctccccccagaattgcaagtggtcccacccctagattttgaaggttttagaactctgtcatacataacaatagaaacaaaaggagctgagagcagccatggcacacaggtgagggaatgtgtcattgccatctgtgccatctgtgaattctggacattagtcgtattgtttaatccctatgcttttatgttggatgaggggagaactacagtcatttctacatcaccagggagccacttgttttggatttgagagagggaagcaattaaaatgctcgattgccatttttggagcagtttttatttggaaggaagggaagccagaggacattaaaattcatagaaaatgccctccaaaaggatgggcaattcttaagaatgaactacgaattttgaggagttttatggtcattattcatcactgcaagagggaagccccgttcatcttttctcagggtggcctcagagctgcagggataccattattcaatggcgtttgtcgggtgaggagaaagcctccccagaggctggcccttgccaaccaatcccaaagcagcctgcaccgaggccacaccccctcgccttataggctaagagctggaatgcaattggtgcagagttggggttttatgggaggggcttcttgtcactcttcccggcttccctgcagttccttatttggtagcttttgacaggactagcctttcttgcaactaagcatcttgacatacattattcattaagccctggagctcgggagagaaagatgcagacccttagatctttagatattcctttatcacgtggattttctttattcagaatagttgctgaattttgtgccattctggagtcttacaaatggcatgtattcgatgggaagacggctggatgggatttaatgcgaggctttcttatgtatacttaattaccaaaaatctttaaaaactcatactctgcgtggcttgtggaggttgttaaagtgtcgagattttgaagctaaatacattttagagcttactatatatatacatatatatatatatacatataatcaatcaaaaatgcctgaagcaaactatttactgtcagtgtcttggggctacataaaggtaagacttacttagcttttgaaaactccttactctgattacaaaattatttagaaagcttagactctactgtaatttgttcaaactatcagttatgtattctttccttacacatgaactaggaagaaatacgtgttaatagtggtcaagataagattgtataactttcatcagttgtagtttgagtgttaaaatagcttttttagatacgcagtagttcttctgtttgtcatgtggtatatgtttgaattgtgcttgaaaaatatatggtaattaaatacattcattgcaaataaattattgggccaaattacttatactgatttatggattccagttagtatgttgcacataaagtttataaaattaatttgtggctgtttctaaaaatctatactactttaacctgacgaggaatacgtttttttcacctttagctataaagccctaggtgacattaaaaattgacattacttaactatgtaagtgatactaaagtgaaaacttgattgtctattatacttgcaaaactgaacaaagtttttattacactgttttgtgaatctcaagaaatgaattaataaacaattcaataagattgtgtccatgcttggcaggctttttccatgccctgtggtaacattagcattgtgatcctgtctccacaatagaaggaggtagaaaaaccttattcagtcctaaatgaaacatcacttcacagatttttggtatttgagccactcgcttgaacctgggagccaatcacaacacattttaaaagattcattttctgttactctgaggatttttcagattggagtgtttgtcgtttgctttgtttctttctttttgaaggacaagttcccctttgttttagagatttacttgaattctaaaaaaattagaaaacttatttcagtcttggttgtccaagtagtcatgattccttacctccctttaaatctgtggatgattcagatttttaaaaatgtttttaaaatatatagacttccattatttgaattttgttagccatttcttggctaaaaatcttcagaaatgcagaaaagtatagagagtaaatataagaagccctcattatccgccagaattcagctcctagcttttagccagctcacaactgatgttatttttgaagggcttcacatttgtactgtgattatgaaccatttgtactatgattatgaacaatattgccaagaatctacatatagaattttagtacgtttctttttgaggaaaatttttcctggacagctttatgtttaatactgtacctttaaaaacatgtaaaaatagcaaatatagatatatttggtcttatgcattttgaaggttttatttttataccatcaatggagtatttgtttaaataactttgaatactgatatctaccaaacttgtaatgcatcacagtgcagcatattcaaatgatttttagcagaatattgtcaggaaaaaataagaaaattttcttactattggacccataccacctccttaaatatatattgggaggatatataatatacccagtagcacactggcgtgatgtagaagtaaaggagattacatttaaggacattttgttttattattttagtttgcttcctgaacaatcttaaatgcctaatgtaaattgaagaattgcagttctgaaaagcaaaatacagtattgagattcaactgcatttttactttcctttatgccttaactgctgtacacagacattctgatgtataatgagaacaaaggattcaaaagcattcacttagaaatcctcccgtttttttagttgcaaccctaaatctgtgtattgttttcagactacttaggccaaaaacaattagaaattcatcaatggaaaatatttagaggtcacttaaaaaaataaactaaatgcttaaatggttctgcattttacaatcggttcgtttcaaacagcagtttaatgttttgtcccttctaaatatattaattgagaaatatgatgggatttcccagaagaatacattgtattagctttaaatcagtccttccccctttggtaattttatgtagttatcttagtaaatattatataattatttttagatgagagaagtatcacatttttaaatgtttgttgaatgatctagtgcatttttttagtacatctagctatgcactccaaaaccaatttgtgagatcaactaccagttgagaaagcacttatggtaatttttgtggttattcatttagctttgctggactgaaacttttatatggatagcaaaaaaggaaaacaatgttaattccttttagaaaatacccttgtgttataacttaatgtacgcttcagaattatctttaggaaattccttagaccgtcttcctagagtagagaagtaattgcttcaaatattgtcttttataattatgttaaaatgaaatgttgacttccttggagtcccttataagccttggtagggaggtgggcatgtgatggaggatttctccaatccatgtttttgtgttttaaacaaaggctggaaagtactctgggaataatgtatatgaccagaaagatgaacatgcaggatgtcacttatctagtctgtacaatatttagattcctttcactggcttttttcttcagttatctgtactaactggctattttggtgaattgtttaagcaaactgccaggaaaattatacttcgttctttatattcttttagaaaaatccaataatatatgtagcatatctgcaggtagcatccacatgttctctttgggcaacataatccttatactagtttgtgtacaagttagaagataaacctgtgataactgggtctctatctatctttatcaatcactcccagaaggcttcccttgttttgctttattgagagaagtgcaaggagggcagcagttcctgtatagactgctgagattctagcaatggtgaaagctttgcctcatctcctatcttttatgaaaaaaaagactttgtcatgaccaggtagttcttaatagcaacttttagctcataacatgaacaattttaggtcaaagagatatttcattgaatgtgtgtttaaaatgtttagcagactcttttctttggaatatgctttgcctaatgagtatatttttccaagtgtgaatttatctgtaaagcaaattttttttaattattatactttaagttctggtatacatgtgcagaacgtgcaggtttgttacataggtatatacatgccatggtcgtttgctgcacccatcaacctgtcatctacattaggtattttgcctaatgctgtccttcccctccctacccgctcataggccctggtgtgtgatgttcccctccctgtgtccatgtgttctcattgttcaactcccacttatgagtgagaacatgtggtgtttggttttctgttgctgtgttagtttgctgagaatgatggtttccagcttcatccatgtccctgcaaaggacgtgaactcatccctttttatggctacgtagtattccatggtatatatgtgccacattttcttaatccagtctatcactgatggacatttgggttggctccaagtcttaagcaaagagttttttaaacctgtgtatgcatgacattttagctgtgcttttgagacatagctatggtttcccatactaatgctattccaaattctttatgggatttgagaaagaggagctagctatttaagtaactatttttatggttataactacagtcaaatccttcatctgtctgacctgcaatgataaaaatcagctattactttaaaaggcccaaaagttatggaccaagtgccagaaagtgagctgggagaaagaactcaaataatattgagcatctactatgtgccaggctaaatagaagacacttctatattagctcattaaattatatgatagcccataatttactcaagaaaatataactttgtaaagagggacagaaaaaattttgaactctattataaatgtctacaaatattcttagaaggcccaaagtttatttttttcagtaggttataagatataatgctgagtgaacacaagcagtaacctatgttctgtataccacctgatgccagttttaaaaatatgtattcacatacaagggtagaaaaaaggcataaaaggaaatttaacaaattatctgtggttatcttccagcagtggggatttacattattttcttttttttggtatagctttctacattttctatagcacatgtacattttataattagaaaggagttataaaaacatatgaacaaagaagtgaatttagtgttcctgagtttgagactaagctttctagaccagtaatttaacaaccagaatttgtactggtcatgccagttctttgtttttttgtttgtttgtttgttttttccccagcatttattttatttttattatactttaagttctagggtacatgtgggaattgaacaatgagaacacttgggcacaggaaggggaacatcacacattggggcttgttgtggggtggggggaggggggagggaaagcattaggagatacacccaatgtaaatgacgagttctttgtttttgactacgctggcatgcgaatacacatttctctcatccaacagtccattgaaatggttgagggttttttgtttgttttgataacagttaaatgcggagttaaaacttaatctagatggtctataagattgactttggaagttatttagcaaacggtatagagttaggccatcttggtatgaattatgcagagaagcaaaataattctaaataattaaatactaagaattatatttcaaacatcactaaaatatacattcaacacttaccttcatacttaaatgagaatttatggtgaaatttcaaattttaaaggctaatctgatgattagagtaaatgcatctgacttttttttgtcaagtatctaatagcagttactctatgtgtagaaaaaatacattgtttctgtatattaaggcaaatattaaaggcttattaaaaggcctcgtcgggttgttttcagagtcaaaggactctgaaatgcttaatgcttaagaaacagctgatgggggtgggagaagtgtaaaatctttgggagatttggatactggtaatgccatgtggtgttggtaggttaattccagtgtttctttcaatgaaataggcactatggcatcagtaataaaaactgtgaagtagattgttgaaaattgacctgtttcctatttagtgacttgggaaaatggtaaattttgtggatgttgagaaacaataagtgttatactcttacttgaaaaacaacttttaaaaggaaacattatacagtatttatttaaatattttacttctccatagtcctggaagagtactcaagtctattaagttttgctttggagtaaaagactaaattttgagcccttgatcagtatatatattcatttctgctaatgataaattaattgaagaaagcattccatgttttattgtatggcaacacttttatgtgctataaattagtttctctcttctctaaataactaataatacatcttaatttttaattcccttttctttgcttatttctcctgattttcccttcagcccttgggagtctaaatttgtgctggtcagtctggtggccatgagccacatgtgattatttaaattaaaagtagttaaaattaaataaaattcaaaatttggtttctcatttgcactagccacatttcaaatgcttagtaaccacctgtggctagtgactgctataattggcagcaccgattatggtgttttcccctcattgaagaaagttctgctggaaggcactgttctaaattgtcaggacaacttaaaaattctttgggcatatcttcctgtatctcagagtatgcatatatatttcacttaaattttcctcttctattatttcattttacttttctgtttttcagtttaaaaggatgcttaatcgggagctcacccatctctctgaaatgagtcggtctggaaatcaagtgtcagagtttatatcaaacacattcttaggtgagaataacaacatgcaattaaatttttttcttcagttgtttgcttgtttgtttttgtaggaggattggggtgccaactcattttggaaaccaaacaagtgttagaagttctatttgttttcattcgtcatattaataattcgacactatccgcctctgagttttagagttgcaggtgacaaggtacattttcttagttttatttaggactttaggaattcttgaattaagattatatattgccattttttcatagtaccaaactgtaaaatatattttatagagagatctattcatatcttcaacaaattcttattaaatgccagccattgttgggcaataggtgtttaatgataaattagaaatgattcctgccctcgatgaatttaccgtcttgtgtacatcaagcctagtaaactggtgggcagataaaatacaattgctaaataaaagtttgctaataatagctgagtttggtgtcctgggacaactcttgtacctcatccacagaaagaaaatgcagtaaataaaggtcagtaatttgaatgtatcctggacttactttcaaaacaaaattgctgttatatatagttaacatttattaaacacttagaatatgttctatatataaggatgagttagagttgctcatcactgccttgaaatcgtggatgaaagtaagaagatatcttaggtcttttactatagaacacaattagcttatgtacgtattcacttatcaggtaatatttatgattctctatgctcccataaaacctggggatttaacccttatctcactatcatacagaaataaaaagtagcagaattaatctaagtcatccaaaacctgctgtttcagctcccacagtgttacccatttcagttagctgttagttttatatactgctgttttcatgacatttgcgtataaagtttctaccatttcaaagtatgtattgaaactgtagtccttagttggcaagaacaatattcagttcattaagtcagtttcacaaaggaatggaattgaacagtggaaataaccacctgttgtgtattctgagtctgctgtcatgctaagtcttgcagcattttttattaggacattgtatcaaagaggtaaccatggaatacatttgatattattattttgtaatggaacttatttgcttaattttgtgtttgaagacatcaaattaagtccaattcaaatgtaaatactgaactctctaaaaggaaactttttagttggaaacatttcctggaatatataatgatcaattataatccttccaattatgcatatgatataaaacagatagaattaataataaatatagaacattttctaaatttctcaagataagcaacatgaagtggaaattccttctccaactcagaaggaaaaggagaaaaagaaaagaccaatgtctcagatcagtggagtcaagaaattgatgcacagctctagtctgactaattcaagtatcccaaggtttggagttaaaactgaacaagaagatgtccttgccaaggtatgatgatttcaaagatcaggatcataaatattaaatgatgccctttcatgaattttcacttctagtcttttaaatggatagaaaagtttattaattggggttttttttttttctttttttgaagatgggaaggcattttataaagctccttttaaagtgccttagacaggtggtttggtatgttttaggggtttggggggtgattatttgcatcttcatttcattgtttggccttaaagagttagaaatctgtcatgtcttctgggttttaggaaaacagttaaggttttgtgaatagattttatccattaaagaagtgctttgtgattgatacttaaaaagtacataaatgtgttgtaatgtcaaagtcacaaggttaagccatactgttcaattttcagtacatttaagtaaatgtgcctaaagtttgcctatgcttacatggtgtgtctgttaacatttaaaatgaatcattgtttaaaacaatctaacaatctttacactgaagtctgttttgttttgttttgttttgtttgttttgagacatagtctcgccctgtcacccaggttggattgcagaatgcagtggcgcgatcttggctcactacaacctctgcctcctgggttcaagcaattctcctgcctcagcctcccaagtagctgggattacaggcacacaccaccacacctgactaattttttttatttttagtggagatggggtttcaccatgttgggcaggctggtttcaaactcctgacctcaagtgatctgcccgcctcagcctcccaaagttctgggattacaggcttgagcctctatgcccggccacctaaggtctgtaatttttaaatgattgtgttcattgagtcatattttactccactttctaatattttagtatctttttttttttttcactccaggaactagaagatgtgaacaaatggggtcttcatgttttcagaatagcagagttgtctggtaaccggcccttgactgttatcatgcacaccatttttcaggtaaggtggttgagttctattacatttattttatttaggaacttaatgtccagtctgtagcttatgcatacattttgtcttttttaatattccccaccttttgcttatttttatacttttatccttatttgctcctttgccaagggacaagtaaagatacagaaaggtggagtgtggataaaccacaaataacatcaattttgttattttttttgcatttaagaaaaagatgtgatatagccaaattgaagcaatttattaaaataataatttagacatcatcttagtcatctgaacctgactgcatagagaatggagtactaacttaaaaaaaatgaataaagcccctgctggctactaaccttagaatatagttttttcagtcactttcttgtgtcctgcttctttcttcatatccatttctctctcttattgaccctttgctccagcttagggtgggatttaaatgagaagttgaggctgctgtagatatctcgggaccgaaatgggaaacttcagccctagagaggacgttgatttttagttggtgtgatgcaggggttgagttaatagtgcttgactggagctgcctccatgataatgggacatagaaacttttagagttggcacctcattcctgacaccatacagctagggcgtagtattcttgggttccagcaggacaacccaactctggttttgtcccagagtccctggatcttctcagaggttcccattttcctcactagacatgtgagagtgcagttgccatttccaggttatccactggcaacactggtgtgtgatttttttttttaaacatactctatggagaaatttttcacataaagacaaaaatgttaagatgattttttttcctacaggaacgggatttattaaaaacatttaaaattccagtagatactttaattacatatcttatgactctcgaagaccattaccatgctgatgtggcctatcacaacaatatccatgctgcagatgttgtccagtctactcatgtgctattatctacacctgctttggaggtaaatctgtttctgaaatttcaagaacactaacttgccactcataaaggtctattaaacttttatctgaagggttttcaatggagaagataattggattcattggaagtataacttattgacttatgggggaaaatgctatagttaatagacaatcaagtctttgatggattttgcttatgaaagttggtcacagatttagtgattgatctgtttatgatattgcttctttgaaatgatccactgaacatttcataaagcacatctggcttactcactttttgttcatttgttttcttgaaatctagtctgacggcttttatttataggccaaagaacgttttataaaacataagcaatatattgatattttttcatagaatatattagaaggacatactttaatttttctaaatcctaagaagttatttcattagttgtttactaaagcaatttgattttcttaagaaatatattttataattcagtttgttttcattataaaattatgttaatacctcatcatatgggtgagtgattctcaactggagatggtttctcttcccctttctttccctcctgccaccaccagggacatttggcaatgtctggaggcatttttggttgtcacaactatcacatttttagttgtacatgatactggcatcttgttggtagaggccaggaattctgctaaaaatcctacaatgcacaggacagcctcccacgcaaagagttattgggcccaaaatgtcaatagtgctgaagttgagaaaccctggtttcgatgaaagaaaataattgctaatgtcttactaattttatgtacattttcagaatattcttagacatcttaaatatttagaaaataaactattattttcttttaaaataatttcagagttttaaaataatattttaaaaaatacagtgaatggaaaacatttgatcatgagatgtaataaaattagataaaatattttcttccaagattatactttaaaagttcacaagtatctaagactctcccttgacacattgtaacacattttgaagcttcattttgttttccatttaaattctagagatttcttatttgtttatacttttaattcatatcattgtagaatagtaatattatctatattgtctgattttccaggctgtgtttacagatttggagattcttgcagcaatttttgccagtgcaatacatgatgtagatcatcctggtgtgtccaatcaatttctgatcaatacaagtaagtaaactttattttttcagaacacatttttcccttgtacattttagaatgactaagggtctttataaactcagagtcttccagagccataatgttcttttgagatgtgtatatatgtgttttagtgatagttcatgttaatgtaatttaactgaaaattatcattatatcccttgaggcatgtgatatttgaaaaatgtgttccagttctctttaaaagtaatatattgctgtgttactagacaagggtaattaaaaatgaaagtgtgcagaaagatttagaaagttgtattggccctaaagttttaaattaaaaaaaaagttatgagaattaatggtaagtgttcctcactttatgtaggtcatcatttaatcctcttcagaggccatagcttcccttcctcctccatgcccaacccctgttctttcctttttaaaatcttctaataagggtaacaggaacttcttaatattttttcaaccatttggttttttctcactgttaacatctcaccttataagaagtcatcactgaatttggaaatataaggaatagtagagactgtttaatatggagcatctctgacattgccgcacagaaagcctgtgtagggaatgtttaggtaatgcttgagctatcccttggtaaagagatttaggtttatagaaattctatttggtacttgaagttaattggtaagtgatttaagtgaactatgacttaattccctcccatatggtagattataaattatggtagattataaaatcataaattcacttttatatataaaaaatatgcaaagttgttgaaaatgttgtatgcttaagaatccacctttctttcatttttgcttgaggctatgaataatagtcttctcgtgcctatagcaatctagctatagaattatttatgaattcaccattcatttcctgtactttgctgtagccagatttaaagaaggaatgtagaggtaaccttgctttgagagatttaattcagagctttaggattatttacctatttttatatcttataatggcctctggactatcctatagcaaaatatactctaatgactcatccatgtagaggactggaaaagtcagggatttcctgagatgtgtggttagtcaagtatttttttacaagtttagtttaggaacttatttatccagattagacaggataacatttcatgttctacctacctatgagcacctataatgaggtacttttagaactcatcaaagcatacatacaaatattaatatacattggatgcagctccctgcatttacatggtatcagtggggaggtatcagtggggagggttcattatgtcctttctaagaagagcagggaggtcatgcaatacagtgcatgctggcactttacatgagcctggcctgatttattttgatgcttatgaatgtcttgagatattctgaattttatcaatttttagtaaatacataaaatgtatttttacataaaatttttgtgttaaaggtatatatatatatctatcttaaacaccaaacattcaaactggtatgttttctttgcattctgttatatagcatattatatgttcccttagaattaagagtagatttagaagacaaattaaaacaactgatagaaaggtcactgtcttccaagtactctgatacattttttaagggtaatgaggacctgctctattcttcattcttttgagcccttaaagcagcagtctccaatgtttttggcaccaggcaccaggttttatggaagacaatttttccataaactgggggcgcagggagagaatggttttgggatgaaactgttccatctcagatcatcaggcattagttagattctcataaggaacgcacaacctagatcccttgcatgagcagttcacagtagggttcacgctcctaggagaatctaatgtccctgctgatctgacaggaggcggagctcaggcagtactgatgcgggcttgcctgctgctcacctcctgctgtgcagcccagttcctgacaggccacggaccgatattggtccacagccgatggatggatcggggacccctgctttaaagggcacttgggctttgactggcacctggaggaccctggcatcagggtccctgtgcagtctgccatttaagctaacaaggcctcagtctacagatgaatctgatactctaaagtttgagaaccaatgaaatagtggaggaaactgaagaagataattttatctccttaggatgtctgtttaaagtcattttgctggtgacctgcctgggatggaaggataactaatcctgccgctgcaaattctttctttgttatttagtaatattgcaatgatctcctttctgtgtgaccacagcgacatagggaagttcacagttgccagagtagctttggattgctaaagtttttttgacgatgaggtgtgatgaggctgtgttattcctgagggaatgaatcagcattgtcactttgtacaggaaagtatcccagggttgttccgggccccagggcattatcaaaattacagccttagttagtttggtttggctagggatcatgtaagagaattatcttcccagcatgcagtaaaggaatccttctaataacttgtaaacttgtgatatgtagcttcgtgaaatattttatcaaaatttgtgcttatttttagtttgcagtaaaccttttttaaaatttgactttttatattttatggatggcttgagcatccatgtgtcaagccagcacattctcagctcttgcctcagagctggagctgccatcctgtccaaagcctgcagctgaatccatatttctcataataaagaattctaaagacctctgattatcaaatttataaacccatagttggttacttgtcttactttaaggaagctacggaagcactgagagcttaaggcacatggggggcgctggggattcccttggctggttcccagggcagttaatcctcctgcttcttacatgtgctcttcgtttttcttaattatttcagttgttttagctttaggtgccaaatgattttatactaattgtatttacactcgttgaaagcatgctggaggttctgcaagcagagagaacaattctacctggtagagttggttaagctataataaatgatttgagtgtgggtactgtgaacaggatttagagaaattgaaatttcaggcaggaagctgcgtaaatatttttaaaggatgatgcatataaataaatccataggccaggtgcagtggctcactcctataatcccagcactttgggaggtcaagatgggtgaatcactgacgtcaggagttcggagaccagcctggccaacaaggtgaaaccctgtctttacaaaaaaaaatacaaaaaaattagccaggtgtggtggcgcatgcctgtattcccagccactcaggtggctgaggcaggagaattgcttgaacctgggaggtagaggttgcagtgagccgagatcataccatcacactccagcctggacaagagtgaaactccatctcaaataaataaataaataaataaatccataaaatgtaaatagcagcatgaacttttgaatataaaatgctggagggtatatttaacttagctttattttctgaaaaaaagtatcaaaagtacagaatatagcattaaattttacttggcaaatgaattatttttgttaatagcaaagatgcctaagtttggggcagaaagatttattcacattagtgatgcattcaaagcatgcggtttttggtttccaagagcagaggcatttcattatattaaggttaagatgtatctagctgtcagtatacacttttttatttctctacttttattttgaaattaaaattttcatagctacactagtagattgtatgtagaattttatttttctgtataaacccacaccttcaaaataaggataaattcatgtttatcaaatgtgattatatagatatagctacagagattattttattcaacaaaaatgtactgcaagcctactaaatgttataataaatattatttcaggcacttaggacacatgggtggacaagacaagacaaatccctggctcttaagagctggcattctgctagaaaaggtggagcataataagtgaatttatggcatgtgatggtactaagtgctatggaggaaaataatgcagggtgagggcatagagagtggagtgatgaatgaggcagttttcttgacaactgaatattaagttaaaaccaccacttccctctgtcatttcatggagaaatgtttgtttctgaagtccttttgaagatttatgtttatttcagttgtaacttagagacatggtgtagcatgctgtcattttctaactaactcaaggctaagcctagtaaagctgtaagaacagtgagtgtaagtcttacttacaggatacatatctatagtgtctgccccagtcttaactgtttcagctccaggtcttaatattggctctgatctgccatgtggactccatcataagacacaaaaaggcacaatacctagtggacttagttggatttgggaggcaatgtattccttctttgtgtgtgttactctggcccatttactaagtgatctgaaaagctgctagtttagatggggcacagaacaagagagtgtcacaaaaactgctagttttgagtggggctctacaacaggtccagcctgctgtgcaagctgctctgcacatgggccacatgatccagcagatttaatggtgcttgaaatgtcagtggcagataggaatgttgtttggagcctttgacagagccctctgtgtgaatcacagcacagactctggagcaagaccctgccatcatccaaagaaagataactaactactctccttttgaaagaaagatataggcctgctgctgggccttaggagatactgactgactatgggccaccaagtttccatgtggtttaagctgtctgcccatcattaatagggtattatctaacgcgccaagccatatgttgggcatgtacgacatttcatcatcaaataaaagtagtgtaatacacgatctatcaggtccgagcagacactaaaggcacaaattacataaagaagtggccctaatgccactcctattaattacactgccttctttctcccagcctacacatgtggtcgcatggaaagttccctgcaagtagttgacagagggcctggtttacggatggttctgcgtgatacgcaggtaccaccggaagtatacagctgcagcactactgcccctctctgggacatctctgaaggatggtggtgaaggggagtctttccagtgggaagaactttaggcaaggtgactcgttgttcactttgcttggaagagggaatggccatatgtgcaattatataccagttcatgggccgtagccaatgatttgtctggatagtgagggacttagaaggaatatgattggaaaactggtgagaaagaaatttggggaagagatatgtgaatgatctctctgaatggacaaaaaaggaatgctcaccaaagtgtgaccttggcagaggaggattttaataaccaagtgaataggatgacccattctgtagatactagtcaacttggttccctagccacccctgtcatcacccaacatgctaagaacaaagtggccatggtggcagggatggaggtggcaggatgtgcttagaaacatggacttccactcaccaaggctgacctggctatgactattgctaagtgcgcaatccaccagcagcataaaccaacactgaacccccatataacaccattttggggggatcagccagctacctgatggctggttgattacattggaccacttccatggtggaaagggtagcattttgtccttagtggaaaaggcactttctctggaaacagatgtgccttccctgcagtttttctgccaaaactatggtattccatacagcattgcctctaaccaggaactcaccttactggcaaagaagagctgcactgggctcatgcccatggaagtccctagtcttaccatattccctaacatcctgaatcagctggcttgataaattggtagaatggccttttgaagactcagttactcagctaggaggcaagaccttgcagggctggggcaaggttctccagaaggccataaaggccatatatgctctgaatcagcatccaatatgtggtgctatttctcgcataaccagaattcatgggtccaggaatcattggatagaaatgggactgttacgactcataattacccccagtgacccactagcaaagtttgcttcctgttcctgcaaatttatgtgctgctagctagaggtcttagtttcagaaggaggaatgcttctatcaggagacacaacagtgattccgttgaactggaagttaagacctagccactttgagctccttatgcatctgattcaatcatccaagaagggcattacagtgttgactggggtgactgatcctgactaccaaggggaaattgggttactactccacaatgaaggtaaggaagagtatgtgtggaataaggagatcccttagggcatcccttagtattaaccatgccctgtaattaaggtcagcacaaaataacccaatccaggcaggaccactaataacccatacccttcacgaatgaaggtttcggtcaccccaccaggtaaagaatcatgaccagctgaggtgcttgctgagggaaaagggaatacagaatgagtagtaaaagaaggtaattacaaataccagctatgaccatatgaccagttatagaaataaggactataattgtcatgagtattttcttatgaatgcatttatatgtatatatacatatattaagcatatatcttcattttctttttcttattcccttatataacataagaggtattaacttatcttcattttctttttcttattcccttatataacataagaggtattaactttatattagtatttaagtatttattttatatcatagtatttaagttataggctatcaggataagagtaaacattactcaaaaactttactttcacttctggggaatgtgttagtgtgcttttagttgtatgcaggatagttgtagcctgtttggtagaattatggccttatggagattaaatatggttaaaggagatgcttatgggtaccagggtgacaaggggcagaatttgtaatggttaattttatgtgtcagcttgactaggctaagggatgcccagatagctggtaaaacactattttggggtgcgtctgtgagagtgttcctggaagagattagattagcatttgaattggtagactgattaaagaagattgcccttaccattgttggcagggatcagtcaatccattgaggacctcaaagagaagaacaaaacattgggggaagggcaatttgctttctcggagcctggacatacatattctcctgcctctaacatcagggttcctggttgattctctggcctttggacttgctttcctggttcacctttgcagacatgggacttcttggactccataattgcctgagccaattcctataataaataaatgtgtctttttctcacatacacacacacactcatacatatgtctattctatttctctggagaaccatgattaatacagagagagaaaagattagcacagatgaagtacatgttctcagttatgtggtagtacctgcccacccttccccccatttcattagcactcagaagagagggacacaaaagtggtcttcctgccttcagtagtagcatatgttgggcataatttaatttattcttgatgatccagggtagttgtaacaaatgagcacaattgatctatatataataaaatgatggctttgagtttgtaaaggtatgcatggcctctcaataaaaaataaatacttacaaagttgtctttataaatgtgtgccaggcactgagtggactgtgttgatttcctggttcatgtttagtgttcactgctcaggttttcacctctataaggtacttgtaatcatagtcagtataaggtgagggctctagaaactgcctggttttaagtgctggccccagcacttactggctaggtgatgttggcaaagttacctaccttctctgaggtacattttcttcatttgtacaggattatatgagtatgtctatgtaaatatttatgtgtataaaagatgtccccaagggacattttctatcccccagcctatcccaaggacacaaagacttacttcccacctatatggctccatgccatccatgaatggaacatagccttaaaatgtcgataacaacagtatcttcctaaaagagttatgaggattaaatgagatgattcacataaaccatttaacacaatggcacctaaatcctctaaatgttgtgccttgctgtattcctgtttgtactttgtaagtttgaaataattgaagtgcctaggggaagccagataaccaaacatattaaattaataacctttaatattttgtaggggcttaagtctctaagtaggttgggagggtttggggaggaacgattaaaagatttgtagagataaagacaaaaaaggtagaatgcgatacatgctaaatgggtggtacaaagtagtatagaagtttacaggagaaagtgggcagtttcatctggtaattaagaaagacttgatggaagaggtaacttatattgggcttgaagatgaaagggtttcaacaaaaatgttatataagctaacctctttgcccctctgtgctgtgcactgtaccatcctgacagcaactttctgatcattcctgaaccttcaaggactctacttacaagtaatggattagtgtctttgatgaaaatctgctgaggagctgcagactcctacctcccaatttaaatgtgaccatatgccttcagtcctaaagaagagtagaaagttaaataacttccttgagattcagtttcttaaatgctaacatttgttcatttaaaaatcaacagtcaccaccactttcctgtaacagcatctgagatggaagaggctatggaggcctgccagtccactaaggcatcctttcctggcttttctagccaatctggactctttaagtgtcaggagataaccactctccaagacaggccttgccagtattcttggacatctgccctacatgaaaggccctacttatatccagtagaactcagactctttgttgcaccttccatacaacagatcacccttttccttgaaggaagagctcatcatcttattcttttgcagggtcaacagccttaatttccttcaccttcagcttcatataagccaattagggtttttgtaaggctaagtcaattctgttaacactgcttgtctacatgcatatttccttccttaaacgaactctaataattatccagtatctaataattatgccttcctttcaatatatgtttgtttatttgattccactgtagaaatacaataatatgtgctaagaacctatatagttttaaatttttcatttctatatgcttacctatctgtagataaaggttcataaaggcatttatagacactataaaagttcaccagaaactgccttttaaaagataaacactattgttttatctaaagaaaacaaaaaataacaaaaaaatactgtacaaacctactccctactagtctaaacagctctgctcctgtagtttgggagcagaaatttaagtgtgcaaatttgtatttctatagttccgataaaataatagaatttctcagttgaaaatgtcttaagcctctcctctccttcctagctccattaaaatagccattgaatagtattgggtatttctttcttaaaaaaagatatatatttccaaatatattttctatgcattcgttatatattttctatgcattcgttagaaaaaagatcaaatacctgtgcttttaacctttttcttttcttttcttttctttttgaaacagagtcttgctctgttgcctagtttggagtgcagtggcacgatataatggctcactgcagccttgaactcctgggctcaagcaatcctcctacctcagcatcccaagtagctgggactacaggcacgccctaccatccccagataattttttattatttgtcgagatgaggtctccctatgttgaccaggctggtcttgaactcctgggcttaagcaatcctcctgcctcggatttgcttttagtctttacagtgattaagtggaaagagaataaagcatcaaaagttttttaatgattatcttgtagctctgggtctgctatttacaagaagtaggagagaggcagaatctctccctgcctaaaattcacaggtctagggcagtagggagagagtggcagaatcttcaccagagggtatacagacagccaaacacaacatcactgtgaagctgtgagcaagcaggcaggaagagcaatatccctgtacagtatacaatgactgccacgatacttggaaaagaaaatggaaaacaatgaataaagcttggactttcagagctatacatgagcaaatgagcaaatctaaacttgttcatatgattccttattgttcttgtaccctctttgagtacaaacaatcctgtaacacaggatcctcactttatatagtgcagggtaggtaattcacagttatcaggaatacaaaaccttatgctctggatgtgttatagatactaagaataatgtcatattctgctgagctcatggcaactctagaggagaggttaaagatccaattctttcactttagagaaagctgagacctacagagtgaaatgacctgccacatgttagtagcattagaattcactccccaagattcattccagtgttgttcctgctcttatgttatctgatttattctctcctggatattgtcaggtaatgataagggcagcagagaagtttaggggaaattacatcctaaatccagaattttaagaatcagataaacttctcacaaacagttttgctgatctttggccttttgtcttttttacagactctgaacttgccttgatgtacaatgattcctcagtcttagagaaccatcatttggctgtgggctttaaattgcttcaggaagaaaactgtgacattttccagaatttgaccaaaaaacaaagacaatctttaaggaaaatggtcattgacatcgtaagtagctgataaaagccaaagaagagaactgtgatgcaagttgtttataatttagacataagaacaagatgagtattaggtaaaaggaactgcatttcaaaacatattatggccctttatgttatagaagctgcccgtgatgctggctgtgatgttctgtaataggtttttcacttctagcagtttggacttgagaataatgtcagctcaccctcatcatttattttctgggcccctccagtctggtggcgggcagagaaaaatgactaacaaaagcagattgtgtgggccacagctcaaatggattttttccccaccttttctcatcagtagacagtgccatttagacatccatgactttactcttttttctatgcatcttattcagtgattatgagacacaggaaaatctctagctttcaaaaacttataaacttgtgatgatgtcttatccatggagatgtcacccatttttcaccatgaaagtggttgtcagtgcctagcatttctgtatattacacacatttatctgggctttgggaaaacttgatagcaaaggggaaaagactctgcccccaaggagtagtaaggattttccactgtcattaaaaggcatagtgttgttttattcctttttcattcttatattctgcgtaatattttcatgtgtaaattctgttttctctgaacttaataatatactctatattttaaggtacttgcaacagatatgtcaaaacacatgaatctactggctgatttgaagactatggttgaaactaagaaagtgacaagctctggagttcttcttcttgataattattccgataggattcaggtaaagccttgtttgagtttgctctgtgtgtgtgtgtctgtgcacatgtgcacatgtctgcgtgttcagctttgataagatgtatttcttccttctcccaccttatactttcagcaattgtaggcaggatttttatccaaatttttattcctgagaattaaccaggtaaaattctactggtctttctgtttgcatctacattaattaaaaaaactaacaaacaaacaccccacagaaccagccacttaagcagctctgaatctagtcagccatgcacataaacagtttctcttaagctatttagatgcagtagaagtggcataatttggaactattaatacaagtgtgaactatacacagacacatcatggttgagctgtttggaataaatcttacactacgtgtatttttaagtgttgcagtcatccaatgtgaatttctagttttttttgtttttttttttaaaaaaaaggaacaggagtgaatagagaatgcatccatctattttaggttcttcagaatatggtgcactgtgcagatctgagcaacccaacaaagcctctccagctgtaccgccagtggacggaccggataatggaggagttcttccgccaaggagaccgagagagggaacgtggcatggagataagccccatgtgtgacaagcacaatgcttccgtggaaaaatcacaggtaatgcatgaagtgtatagctttcagagagaacagagctaccgctttagcatttggttactttgtattacatatgatagtattttactggatttttaaaattactttgtttttgacaagctcaatttcaccttagtatttatgatccaaagaactttcattcttatgacttacattcatatagtcatatatatattctaaagacatattcatttattatgactatattcatttaatatattcatatacatagagcacatggcattatttcagttatctggattcacctacaaattggtgattgtaaaataagccctaccatgtcaacaactggaaaattttttatgctatagaacatgctctttaaccaaaggttctagaagctaattttgaccagctagtagcaatactttactttaaatggtctgttgttgttgaaaatagtgacaattttaccaaactaagtttagtagtcttctgttcagtgttttatttgtgggccatgatctaattaagcttttccattgtttcttagtcccaagtcctctactcatactggatttttttcttaactaggtgggcttcatagactatattgttcatcccctctgggagacatgggcagacctcgtccaccctgacgcccaggatattttggacactttggaggacaatcgtgaatggtaccagagcacaatccctcagagcccctctcctgcacctgatgacccagaggagggccggcagggtcaaactgagaaattccagtttgaactaactttagaggaagatggtgagtcagacacggaaaaggacagtggcagtcaagtggaagaagacactagctgcagtgactccaagactctttgtactcaagactcagagtctactgaaattccccttgatgaacaggttgaagaggaggcagtaggggaagaagaggaaagccagcctgaagcctgtgtcatagatgatcgttctcctgacacgtaacagtgcaaaaactttcatgccttttttttttttaagtagaaaaattgtttccaaagtgcatgtcacatgccacaaccacggtcacacctcactgtcatctgccaggacgtttgttgaacaaaactgaccttgactactcagtccagcgctcaggaatatcgtaaccagttttttcacctccatgtcatccgagcaaggtggacatcttcacgaacagcgtttttaacaagatttcagcttggtagagctgacaaagcagataaaatctactccaaattattttcaagagagtgtgactcatcaggcagcccaaaagtttattggacttggggtttctattcctttttatttgtttgcaatattttcagaagaaaggcattgcacagagtgaacttaatggacgaagcaacaaatatgtcaagaacaggacatagcacgaatctgttaccagtaggaggaggatgagccacagaaattgcataattttctaatttcaagtcttcctgatacatgactgaatagtgtggttcagtgagctgcactgacctctacattttgtatgatatgtaaaacagattttttgtagagcttacttttattattaaatgtattgaggtattatatttaaaaaaaactatgttcagaacttcatctgccactggttatttttttctaaggagtaacttgcaagttttcagtacaaatctgtgctacactggataaaaatctaatttatgaattttacttgcaccttatagttcatagcaattaactgatttgtagtgattcattgtttgttttatataccaatgacttccatattttaaaagagaaaaacaactttatgttgcaggaaaccctttttgtaagtctttattatttactttgcattttgtttcactctttccagataagcagagttgctcttcaccagtgtttttcttcatgtgcaaagtgactatttgttctataatacttttatgtgtgttatatcaaatgtgtcttaagcttcatgcaaactcagtcatcagttcgtgttgtctgaagcaagtgggagatatataaatacccagtagctaaaatggtcagtcttttttagatgttttcctacttagtatctcctaataacgttttgctgtgtcactagatgttcatttcacaagtgcatgtctttctaataatccacacatttcatgctctaataatccacacatttcatgctcatttttattgtttttacagccagttatagtaagaaaaaggtttttccccttgtgctgctttataatttagcgtgtgtctgaaccttatccatgtttgctagatgaggtcttgtcaaatatatcactaccattgtcaccggtgaaaagaaacaggtagttaagttagggttaacattcatttcaaccacgaggttgtatatcatgactagcttttactcttggtttacagagaaaagttaaacagccaactaggcagtttttaagaatattaacaatatattaacaaacaccaatacaactaatcctatttggttttaatgatttcaccatgggattaagaactatatcaggaacatccctgagaaacggttttaagtgtagcaactactcttccttaatggacagccacataacgtgtaggaagtcctttatcacttatcctcgatccataagcatatcttgcagaggggaactacttctttaaacacatggagggaaagaagatgatgccactggcaccagagggttagtactgtgatgcatcctaaaatatttattatattggtaaaaattctggttaaataaaaaattagagatcactcttggctgatttcagcaccaggaactgtattacagttttagagattaattcctagtgtttacctgattatagcagttggcatcatggggcatttaattctgactttatccccacgtcagccttaataaagtcttctttaccttctctatgaagactttaaagcccaaataatcatttttcacattgatattcaagaattgagatagatagaagccaaagtgggtatctgacaagtggaaaatcaaacgtttaagaagaattacaactctgaaaagcatttatatgtggaacttctcaaggagcctcctggggactggaaagtaagtcatcagccaggcaaatgactcatgctgaagagagtccccatttcagtcccctgagatctagctgatgcttagatcctttgaaataaaaattatgtctttataactctgatcttttacataaagcagaagaggaatcaactagttaattgcaaggtttctactctgtttcctctgtaaagatcagatggtaatctttcaaataagaaaaaaataaagacgtatgtttgaccaagtagtttcacaagaatatttgggaacttgtttcttttaattttatttgtccctgagtgaagtctagaaagaaaggtaaagagtctagagtttattcctctttccaaaacattctcattcctctcctccctacacttagtatttcccccacagagtgcctagaatcttaataatgaataaaataaaaagcagcaatatgtcattaacaaatccagacctgaaagggtaaagggtttataactgcactaataaagagaggctctttttttttcttccagtttgttggtttttaatggtaccgtgttgtaaagatacccactaatggacaatcaaattgcagaaaaggctcaatatccaagagacagggactaatgcactgtacaatctgcttatccttgcccttctctcttgccaaagtgtgcttcagaaatatatactgctttaaaaaagaataaaagaatatccttttacaagtggctttacatttcctaaaatgccataagaaaatgcaatatctgggtactgtatggggaaaaaaatgtccaagtttgtgtaaaaccagtgcatttcagcttgcaagttactgaacacaataatgctgttttaattttgttttatatcagttaaaattcacaataatgtagatagaacaaattacagacaaggaaagaaaaaacttgaatgaaatggattttacagaaagctttatgataatttttgaatgcattatttattttttgtgccatgcattttttttctcaccaaatgaccttacctgtaatacagtcttgtttgtctgtttacaaccatgtatttattgcaatgtacatactgtaatgttaattgtaaattatctgttcttattaaaacatcatcccatgatgggatggtgttgatatatttggaaactcttggtgagagaatgaatggtgtgtatacatactctgtacatttttcttttctcctgtaatatagtcttgtcaccttagagcttgtttatggaagattcaagaaaactataaaatacttaaagatatataaatttaaaaaaacatagctgcaggtctttggtcccagggctgtgccttaactttaaccaatattttcttctgttttgctgcatttgaaaggtaacagtggagctagggctgggcattttacatccaggcttttaattgattagaattctgccaataggtggattttacaaaaccacagacaacctctgaaagattctgagacccttttgagacagaagctcttaagtacttcttgccagggagcagcactgcatgtgtgatggttgtttgccatctgttgatcaggaactacttcagctacttgcatttgattatttcctttttttttttttttaactcggaaacacaactggggaaat
